United States Patent 8,067,671 (METHODS FOR GENETIC CONTROL OF PLANT PEST INFESTATION AND COMPOSITIONS THEREOF) - sequence listing, part 18

SEQ ID NO: 19406 - DNA, 1154 bp, Heterodera glycines
  misc_feature (1030)..(1030): n is a, c, g, or t
ctaataattaaaaagtaagaaagggttgtgcatttggatgttgactctcggataataaatttatatttgttattaaaagttttgctagattcattaaatttttaaaatttaataatcattagtcatggaatatttttacaaatattttttctttgcaataatttttcttttagtggtttatgctgaattttttctaaattttaataaaattgttaatttatttctgcaatatttaatgttgttaaatctatatatataatattttcctttccattaccttgccatcaaaaaaacatttttatgtgtttttttaatgttgaatttttttaaaatattcaatctatattaattaattttatttatatgatcataaattgaatttcatggaattttttttttattttttgtatacgacaagttatttaaacatgaaaatttttagcacaatcttatcaaattttgccattattcattattatattattaagttaaaattttgaggttttcaaaaatacaaagcaaattcttatttattttatatcagaatcatgttgcaaacaaaacctttccaaacttcttccaatttttggatttaatttcatcattaattattttctaaaaaatgaaataataaaaaattctaaaatgaggtatgtacaaaaactcctaaatatttaaaatagtaaataattgaaaaaaatttatctaatggtgaaataggacgaaatgccataaaaatgaactaaataagcttccaatcacattttatatgttttaaaaattatttttgatatctctttttaaaaaaggatttttaggtgtacattttcaaaaaaaaaaaattaaattttccataagaaaataattctcaaaataattaaaaagatgaaaatgtgtaggaaaaattgaggaaattttgatttataacgaatatataagaatatttaaataaaactcctacttttggtagtaaaattacgaaataaatttgattttactcgaaaattttttcggaaataataattttggncttatgtgactcggaaaatgaatatgtgttatatgccattggatagagcatcgttgacaactattgtaaatttttaatatttacggctgattgcgagaaataaaaaagttgtgcggcctcaaaa

SEQ ID NO: 19407 - DNA, 1688 bp, Heterodera glycines
aaaagtgaagaatactgacgtagttgcatttctatacaaatgatatgtcattcgacttctttcggtctataatgaatgaatctgaaggaatttttcgggggtcatcatttcctgatgagttacatacacgggactcaagtgtccaaatccagcggtactaaactatatctatccgtggctaaaacaaaatacctaattcattagttaaccgttgattttgtttttaggcgaagcctaagctttaaagtagggtagcacgagaccgagaccggtaccgataccgatccggtaattaccggttttttcaggtaccggtaccggtctcggtcccggtttttgaaaaaagtcaagtctcggtcccggtttttgagtatcggcggtaccggtactaaccggtactaaatatgcactggtaagaatggagttctgagagcaaaagaaagagagaaggttgggaaatgggaaaatatttgtattttgaataacatttcgccaaattttacagtcagtgggttgtgtgtcaagcaattgtccacctcatttatttctttcattttttgatttccatctactttttttcatttagaattaattgattaaaatgtctgatatttggaaacattacaacaaaaatttgactggtgcaatttgcaaaatctgcgcaaaaaaagtcacccgaagtgacggctctactacaggaatgtggaaacatttggaagcaaagcatcaaaaggaattttctgtgttaaaaaacacagaaaatttagggcaaatgggggaggataaggtttattgtgatttttattgtaatagagactaatttttagaaacaaaagcaaatacaatcttttttggtgacaaaaaagaatgagacggaaattgctgaagaacgcatcgtgcgaataatggtccggcaaaacaattcattctattttttcgatgacccagacttaaaggatttgtttcaaaaagcacatccgaacattgtacatcataatatatcttatacattgtgaatttatttttgaaggatcttggtgcacgagaacattttcgccgaaaagtgattcccaggatgtccgatcaaatccgttgtttaattcaatcgggagttggatctgatcattatgcaattacgagtgacggttggtctaagccgacactgtcaccacaattacaaaggttgataattattttttaataatgtttaatcattttaattgtaatttcagtgtcactgttcattggattgataaaagtttctctcgccacgatgccgtacttttgttagtaaaattacgaaataaatttgattttactcgaaaattttttcggaaataataattttggcttatgtgactcggaaaatgaatatgtgttatatgccattggatagagcatcgttgacaactattgtaaatttttaatattacgggctgattgcgagaaataaaaaagttgtgcggcctcaaaaacgaaattttatgcctaaagggcgatttccgagctttgttcactttctattaattgcaaactttacatttattatttttttaatgattttactaaaaaagactatcataccatttttaatctaaaaaaggattttgcggtatttatacatgcgattttgaagggttttttgttcaaaaactattttgagtgtgttttatagttttacttcactg

SEQ ID NO: 19408 - DNA, 1661 bp, Heterodera glycines
  misc_feature (35)..(35): n is a, c, g, or t
  misc_feature (1553)..(1553): n is a, c, g, or t
  misc_feature (1605)..(1605): n is a, c, g, or t
atttcgtgaattgagaccctgaaaagctttaactnttggtttaaaataatgataataatgtcatttgttttgcataattcgcctgtaatcacttcatttttccaatttgtcccctcaaattctctccgcgccgtgccattttttatattccaaaagcatccatcgcattttggtcggccgattggaatgattggagttgcgcccgaatgctttcgatcgcttcttccaaatcctccaatgtccgctggtcgtcctcccttatggtcgggtcggtgtcctgctgaatttgctggcgaagttggtctgcacgttgctgaagctcttggagttgctgttcgatttgctaaattaacaaaatgataactcatacaaaggaccaaaaaatagtaaattaataattttaataaaaaaaacatatatggcttaaaaaaaccaaaattatttctgaattatgacctaaaactgtgaaaatatgacctaaaagtcccaaatttagagggtgaaattgatttggaaaaattccctttccaccgaaagggttctagaaaaaatgcggataaatcacaaaaatattctccctaatatggatctgatctaccggaactggtcgaagttttcggatggttaaaaatcagtaacggtaaaagtcggaaaatcggggagcggtcagtcatcagatgcatttttaggttcaaccagtaattttgcatttttctttttttctttgttggtttcttcaaatcccatcccaatttgacctgaatgttgacagtgatttgttgcgaaattttgaatggaaattggagaataaaaaattgaataaaaattaataatgaaaatgttctcattttatttatttattggtaatcccaattttctcctctttttcgtttgaatgggaaaaccaaagcttattttctgctgctaatggtgagaaattaatttccaaattcagcaaatgaaataaatattttttaattattcagctgcaatttgtgataactattaattgttttagtaaattaattcatttttactaatttttcttaattgatgcaaaattaaaaatttaatcaaaaataattaaatgtgaaaaataataaataaaaacaattatggaaaatggtcacaaatggccaaaagaatgctttgttggcattagattttaggcacagaattacgacatgaaaaaggggtgccagggcattttcaaaatcctaccattgaaataagatagctctacgtatttagaacttatcccctacatttaagccccggacaaatgaaattggacatttgcgcccggaatttatgtgcccgacatttgctcagcattccttaagggctattttgggacatttgccgcttgatcattctaaatttatatatgttttgaagagaaattaattatagttagcatgcatcaagcattcaatatttcctacactattattttaactattttttgttagcagaaatgagttaaaatttttaaaaattcataaaaaattaataaatcattggattattcaaatttatcccaagtcagtaanaggatggatcatttttctatttttattaaaagaattaattatttattcattnttattttaagtttaaaagaatctttttgttttttttgtttctttaatttaattttt

SEQ ID NO: 19409 - DNA, 1574 bp, Heterodera glycines
ttaggtgttctctatcagaatattaatttgaaatttttcgaaattacaaaaaaaattatggtcataaaatttaaacaaattttcagtcagaattttttgtccataacatttttgaaagcaatgaagttttttatattaatgtttagtcattatagaaaggatctcaaaatgctaaaaggaaaattttaatttaattgcttatgaaaaaagttctaaagcattcattataaatgctttgtttttaaaaattgtgtcagtttttttccaaattgtgaaacagagattacctatataattttattcaataaaaaatgaaaaataaaaaaataaaacttataagaattttttcaataccattatttaaaatttcaaaagaggaaaatctttacccaaaggaatggccaaatgccaaaatgtatcatcattcgaatagttcaataaaaaactgaaaaaacaatgagaaaagaaagtaaaagcgcagtagggagaacagaacaaaagtaacgcagcgaaccaattaaaacataataaatgaggtgagggaaaacaattagtggaactgatagccaccgattcgattgcgattgtttagccaaatcaaagctttatagacacgcccgtggtagaagtcggttttcatgagtttataacaacagatccctgcaatggtaagtgcaaaaatggaaggccatgactcaaaaaagcctaaagtaattgtgaaaatgttgagcaaaacgaaagcgactgccaaactgaggatggcgagcagtacatctgccgtcttttcaatttcggcttgctggctccgttttctgcgtcggtgccctcgtggcgacgttttgccatcatttgctgccgacgtatcggctggcccaccttcggcacccaaaagcagcacatttggccacaattgcatgagcaattggagcaaatcgcttggcattggcacggcattcgttgccagtgtttttttgattattttttgcacatttgccgcttcattttcacccttttccatgccgttgtcgtccacttttttggttttcgtcttctctttccccagtttggctttgttttgttttttgtcgccgactcttacacttcgttctttgtttatttctctggtttgcacttcatccttcacctttctcacttttcttcgtcttaaaacgccatccttgtctccatcattggcataggcttttctctccctattattggcattggcattttcctctttgatctgacccttcccattgtccccatgctttttgtcacaccctttgccctcggttcgttcttctgcttcttctccatatcttatgccatcttttccttcttccgcttttccctcggcatccaattgatgggacatcactcgaaataaatttttaacggaaagaaacaatttctgcgcttcagtttctgatcccgacttttgtgccaagaattcggccaatgtcccattaaatccgctaatggtgctaattttctgctctttttcattcttcctcaaatgttcaataatttgtttgccattctctttaatgaaattcgtaactttctccactaaa

SEQ ID NO: 19410 - DNA, 2608 bp, Heterodera glycines
aactgttgccaaactgcacgcggacgggcacaaagtgctcattttctcacaggtcctccgccgatggcatttcgctggccctttcattactacaatatttttaacaactatgagagtaggagggttcgaaaaaattaggaaatccacatattttttcttggactgtgggagacctggaatgcatgaaaaatttgtttttttttggtttaaagtttctaggatgtagttctatttccatttttgtccatattttgacatttttccagaaaacctgtaattttctctgtaaattttttgaatttaattattattttttgttgattttagttaaaaattggaaatttttgcttttacagaaaattaatattttagctgtttgtttttttttcttataaaataatggggttttggttttcatttagcgaatttgatgaaattccaggaaatttattatatccatatttttgcaattttatattcattaaatttgtaaaaatttaagatggtccgtgtgcttgatctgctcgaggaatacctgtccatcaaagggtatctccgtaattagaaaattgataaaaaaaaattaaaaataaataaattctcgattaaagctacccattcgaacgcattgacggcaatatacgcggcaatgatcgccaagcagcaattgatcgcttttcgaggccacaaagctatgatcgttttgtgtttttgttgtgcacccgagcgggcggtttgggcataaatttggtgaataattataatttattattatttttttttaatatattttaatcatcttttgatttgaatttttttttttgaaaatcttgtttttttgagatctctgatcatgaatctggcactattttaaccaagtccaacttcctaatctaaatttgaacaaaaaacaacataaaacgagaaatttgaattttcgatcttggttcaaattcggcttacaaattagagattataaattggtccaaatggatgtaatatttgtgctcattgtcagtgactaaaaaaaaacccctagaacaaattttcatgaattattattatcacaaaaaaaaattatataacctaataaaattcaaaatatacgactttttaactagcgccaaaaaatctcaagaaattaataaaattaaaaatatttttgtttaaatttttttatgtggctttaattaatcccattcatttgcctgccgatcattatacaatatttatcctccactcttccactgtgatcagacatctgcggacaccgttgtgctgtttgacagtgattggaacccgcaaaatgatttgcaagcgcaggcgcgatgtcaccgcattgggcagacaaaacccgtgaaaatttatcggctgatcaccgccaacagttacgagcgcgagatgttcgacaaggccagcctgaagttgggcctggacaaggccgtcctccaatccatgttgcacaacaacaagggcgaaagcacacagcaaatgtcacgccaaggtgtgaaaaaagaggcaaaagcagatgaagccacccccagtgcatgacaaatatcgtcgagacataatgtcgcagggacaaaacgtcgtcgagacataatgtcgctggacaaaacgtcatcgcaaaaaaatattttcttttaaccctagcctaaatcaaaatttttctataaatcagaaatttttgtaaacagaaacatcgaggttttcaaaaaacttctttttttctgcgatcttttgtcccggagacattttgtccattggcgttttgatcatggtggcgattgtgttatcctgatcaggggctgacttttgctaataatttctttgaaaatgatccgggttttattttctttttttaatcccccccccctcttttccaacacagaggtggaagatttactgcgcaagggcgcctacggtgccatcatggacgacaacgagggcaccaagttcagcgaagaggacattgacaccattttgttgcgccgtacacaaaccattcggctggagccgggcgtgaagggctcaacatttgccaaggcgtctttcacatcgtcacacaatcgggaggacataaacattcaggtgggaaaaaaagaaggcagttcattgggtatggtatggaatacggtagttgatgagtgcgtgggttaccgtactcttttcctttcaactattggggtggaaactaagttctgtcatagctgggaatcgctttctttttgaatttttaaaaaatgtctccgttgctccgctggccagctctcatttgcattttgtaaagcaatgtctgcggtttcgaaaaaatggccattttaattttccatctcattttggattttttaaaatttttgaatagaaccctcaaaaatcaaaatccgatcacttttattgtacgggtcaaaactttgctttgatcggttggaaatttattaaaagcagtttttctggccaaatcaagtccggagaatccaaatctggcctcagatttgatctctgaattttctctggcattgtactgctccatgtcgttgacaagaagttgaagcagtacagggtcatagaacagcaactgactaaatctgaggcgatattcggattc

SEQ ID NO: 19411 - DNA, 1015 bp, Heterodera glycines
  misc_feature (985)..(985): n is a, c, g, or t
agtttttgagaattaattgcgtaattagaatttacaccctctagctgcttggaatgtcctccgtttttgttgtcccatcacttttttttgcttctgtttcctgctgctgcttctgctgttgttgtttctgctccagttgagaatggacatctgtcatttcgtcgtcttcagcaccgccgggaatggtaaatggacttttttctgatagaaacaacgaactttaatttattttaccaataaattactttaatttattttaccaataaatttggccaatttttatcaaattgtaagggtgaaaactaattttctaatgccccacaaaattgtcaattaaatttattttacataaaaattatattctgccgaaaaaatgtaaattgaatcattaagccattttctgtctttacctttttgttgcttttgttcactgtcgtcgtcgccgtcgttggccgagtccgcttccgccaattgttgttgtattttgacccgtttgcgcaactgtggcgaaatgaacacaatcggacgctttttccgctcatgtttgttggtgctgatgtcgtcagtgctgtcagaatgatcctgaaaattaaaaaaagttcgaattctaccgaaatgtaatagaaattggtatgcgtggacgaaaaaagaagttttttcggcatccatccaatcatttaacatctaaattgggtgtcacctgttgtagttggtcgctgatttggtcggcgacacgttcaaggaactgattacggcatttggtgtaccgtttgatgatttgctctaagctgatgttggcctcttgtgacaaagcgtacgcttcctcttcaaatggaaggcaatttgtaaaaagaataaaatgactttttccaatttttatttattttttgacaaatctcacagcaatattatgagaatgtgatggatatgtcagtagaatatatgaaacaaaagatataaaaaaacacaattttagatactaaanatatttttttttttgtgaaaaatttctttt

SEQ ID NO: 19412 - DNA, 1139 bp, Heterodera glycines
cccatcataaactaaacaaaaaggttaatgaattccgaaaatgcgaatatttacctgcaaaaaaagagcactcatctccaaaactgaggatacaattatgcgcatcctaaattcatttttaagatttattttatccgttttaccaaacaaaaaacacagacctcctgatgggttcgccatccttaaatagttgccaatttaaatgcgaatggaccaatttcaacgaactcttccctttttataaaatattaaaaatgcccaatttgaatttcacaggtggataatgtcgaactcaccttgcatggatgtcgcagcaaaactaaaaagatgttagcttaattgcaaaaaaaaggtttaaatgtaccgaataaaatcattctccccctcctcgtggcttttttccttttccggccttgaaagatacgcgcccattgctcaacgaataaaaaataaataaataaaatatgcaaaaaaagtacaaagaaatggaacatgtaaattcattggcaattacttctaataagttttttttattcttttacattaaaatacatttcaaatacctaaacagttttaatatgtacaaggcggagaaggcaaagaacttaaaaaaaaaaagaaaaagtaaatggaaaatctctgatgaattgtgcaaattcacgggaaaatcgcaacgattttaaatcgcattttgttaatcccaaaagagaaaataaatatatttcaaaattttccaaaaactaaaaaaatttccatcggtaaatcagaaagataatattcaagaaaagttaatgaataatgatgaaaagatcatttgaaaacaatgaaaatgagtgtaaatgttaattgagtattatgtggcacgaagaagacgaaggagtacattatgaatttataaaaaaacaaaacacagaattggcaatattggaagagacagggaaaacagcaaactgaacagaaatagcacaggagcacaacaacaaaatggaaaaatggcggggaaaagaaatgttagtggccaatactggcggtgctgctgctgttgacgacacttttgttggcaatcaaaaaatggaggagtaaatgctgggggaaaaaggatggcaaaattaattggacaattgaaatggtttaaggaa

SEQ ID NO: 19413 - DNA, 1466 bp, Heterodera glycines
cgtcccatcacattttacgcgtgccaacaacactttacgcgtcccatcacattttacgcgtcccaacaacactttacgcgtcccatcacattttacgcgtgccaacaacactttacgcgtcccatcacattttacgcgtgccaacaacactttacgcgtcccatcacattttacgcgtcccaacaacactttacgcgtcccatcacattttacgcgtcccaacaacactttacgcgtcccaacaacactttacgcatcccaacaacactttacgcgtcccatcacattttacgcgtcccaacaacactttacgcgtcccatcacattttacgcgtcccatcacattttacgcgtcccatcacattttacgcgtcccaacaacactttacgcgtcccatcacattttacgcgtcccaacaacactttacgcgtcccatcacattttacgcgtcccaacaacactttacgcgtcccaacaacactttacgcatcccaacaacactttacgcgtcccatcatattttacgcgtcaaaaaatgtttttcgaaccgtcaatcggaaactttataccttccgaatagtctaattgttcttgtttgtatactttgatcatcgaaatgtgcaaaagcaactctaagcacacttaatgatgtcaacagaaattcaactaatataagaaaaaaatttacaaaagcctaagcttaggcctagtctaacaataagccattgttcgagttgcctgtgtataagttgtcatgataaccttaggtttaacaacgaaatttatagttaaaaactttactgaatacctgacaaaaaaaaaagtttttctcttagttattaggacaactataataccatgagaccagggatggcacggaattccgaaaatttttggggcctcggaatgccatccctgccatggacacaaaatgtcatgggacgcgtaaaatgtgatgggacgcgtaaaatgttatgggacgcgtaaaatgtcatgggacgcgtaaaatgccatgggacgcgtaaaaccgattagaaccattgcttttaccaaatacgaaacgaaactgaaaaaatgtcattttttgcgttgattttttccaaaaaaatttcacggggattccaatgttgtgcaattgtatagaattgtggtcccgacgaaaaataaatttaaaaattttattttaatttttcctggggtggtgaaaataagctgattacgaacatgaactcaggttttctctatgattttttcatcaagtgatttttaaaattaaggaaattgttggacgtaaaaacatacaatgtgttgtagaactgaaaaagagctttcgaacgagctattgaatgtatggggaagttagatttttagtttttcgaaatttaattattggtctctttggtttttatgaagctgtctgaagttccgggccggtttgacccaatttatttatttttatgatcct

SEQ ID NO: 19414 - DNA, 1024 bp, Heterodera glycines
  misc_feature (34)..(34): n is a, c, g, or t
cttctcaaaccacaaaatgaagtgaaatgaaatntggactgtagttcaaatgaataaattaatttataaataaataaacgaacaaaaataaataatcatttaagagaaattgtattaaatgaatgaaaagatattttgaatgaataaaaaattgaaaagtaaaagaggaactccgttcacctcctgggccaatgctggtggaacttttgttaaaatttcgaatttcaaaattaataaatttcaacgaaattttcccaaattgtcaacattaactttcttgcttaataaacaaattgaaaatttaatttggtttttttcaattattttaaataatcaaagggcgttgatttgcaatattcccaattcatttattttttcggggctcataaacagctgaaatgccaaataattgaaaaacaacaaaagtgcatcattgcaaaagccaaaaaggctcaggacatactctgagaaggcaagaaaagcctcaaataaatgttaaaatcggtaaaaaaatgaaatgaaaatttatgaatatttgaattatggccatgacggcaaatgtccgactcattcgtcagtgttttattttttgtaaattgaatgaaaatgaagaaagtattttttgaatgaattaaaaaatagtcatttttctattaatcagaaaacatacataaaatggtggtcaaatagcgcaatatcaccaaaataagagcaaaaatgccaccaattagtggcaaaaacgattattgacaatttctgaaagaaataaacaattttaattctaatttaatgacagtttaatttataatcagttgataatctgccgaaatttcgcaattgaaactctcgaatctggcaaagtctcgaaactcgaaaagactaaagagtgagtcaaaagacttgggtcttcgcttttgctgattgttagaccgacgaaacaaacaaaatacgaccatcatcatctgagttgaaaaaccaagagcgaaaggtcatagaccgcaccaaaatgccgggacatttcgcc

SEQ ID NO: 19415 - DNA, 1542 bp, Heterodera glycines
gcttttttgcacattttatcggggggggggggggacttttacggggacgtgacaaggcacaaccaccaccccatctcgccatcgggctgcgggtgggatggcggtacccgcctatcgccgggttgcttctgccggcagagaccgcccattttggcactgtcggccaccgcatttaagcgccttggggccaacaaaaaggcattcaatcccaactccccataatcctcctcttcccttcctaggtcaataatgaccgcgttgattagactcgtgtaagtcaattgggcgggttattcaattaagatttattttttctactcaaatttttagtttttttgccagcattgtctgcgctatggaaactgctgccctgggacggcgctctgtcaactcgagcgcagcggagccgacgaacgaacaaccgggtaaataagaattaaattaatttatttaaaattaaattaatatggagacgggggattatttttcgctgatttattcgtgaaaaatttttgaaatttttttgaacgtcgccaaaaaatgtaatcgtgtcaaaaaaatcaatttatattttttagtgaacaaatcctctgcgaatgagaagaacatggacgtcggagcgaatttgtttgtgggcaatttggacccggaggtggacgagaagttgctgttcgacacgttcagcgcgttcggtgtcattttgcaggtgtggggacagccaccaagaaaacaattattttttaaaaataatttccaataattttagcctcccaaaatcgtgcgcgacgtggagacgggcagcagcaagggccacgcgttcatcaattttgcatcgtttgaagcgtccgatgcaggtcgtctcatttatttttcaattaaaatttgacatttgttccccggacatttgcctatgtccaacgggtttaaatttgagtgatgtttaggcaatcagggatttaaaaaacttatttgaaccctattttggacatagccacaaatgtatggggcgaaaatatctgcagacggaaaacagagagttgcaacgaactccgtcaaattagaatacaaaattttgggaaagttttccgaaatttttctttcagcgctcgaggcgatgaacggccaattcctgtgcaaccggcccatcacgtgttcgtacgcgttcaaaagggacaccaaaggggagcggcacggcacaaccgcggaacggctgctggctgcgcaaaatccgctgttaccgcaagaccggccgcatcagtgcgtttgtttttgcatattacggcacaaatttttttgtgagaggggggggggggggatttcactaaattgtttaatctctaaattaaagacaatttagaatttgtgccctaattgcacaaatattgaaagcgttcgtcccacttccctcccctcccacattaaatttaattttaaattctccactcaagtcttcggactatctctagcaaaattaccttttgcaattaataaattaggaaaaaacggatttgccgacgttcataaaaatgtgccattttcaca

SEQ ID NO: 19416 - DNA, 3040 bp, Heterodera glycines
tgccaatgccatttatcgtagccgaatttttttcagttcacgacaacgacaatgatgatatgcattttttgtaaaaaatatatttttaattatgtttggtaatgaatttaattaaggaaatcttaggtagctcttaaaactttaatttttttctactagctttttgtaatttattgtaataaaaatctcttaaaattagttttaaatactaaacaaaattttctaacttacaagtctaaagaatcatttaattaatattttaatgaaaaaaaactctactcatcgccggagacattttgaaggcaaatggaggggaggaggggagaaagatggatgacaagaaagcctcgcctgaggggcgggggggggggggaatccgtcggcggaggggacgcattaattcttttcgtcggagcggccaaaaataaataaataaaatttgctgcactactgagctctattagtttacgaataattattaagaaagtaaaaatgcaaaaaattttgacttaaaaactaaaattttttgatacaacagaagcataaaacaatttttaacatccgtacaatagcgaatagcgcagccggaagaaaatttgaaagtttatttgaattattatagttaatgacgcgccgaattatcttctacctttatatgcttcaaatactttttatggagaatttcagcaaggcaaattttgtaaattcatcatgatattttttaacaaacatttttaataatttttcgagaattgggaattcattttaaacattccttggctatctgtttttttatatagtgaccggcaattttattggtatttccgtacaaataatttccgcttttcaattatatttttttaactttatgcataaaatagatagatccattaataatgaaggtagcatatgcaaacagaacgaatgtacaaaatatacatcgcattttcggaacctcagaaccgttcattttttaccgtatccatagcctccaaaaccgccaaatgcaccgtaaccaccgtatccgtatgcttaacacagaagaaattaaagaggcgaaagagtggttaaaattccttcaactaacaaaacttagatcatttggacgcaaaaatcagatacaaataatggatttacaggaaaaattcattgctcaaaaattttaaccccttttcttaggaaaatttaaatttttatcctgttttttagaaaaaactatccaaaaattaacattttttggattcggtttaaatattgaaaggattattgaccgagagttcgatttacgccagatcgtaaaaacgtcgaccctttcaaaaaacaaaaatcctgatacttacgcgaatattttttgacgaacaccacgtgcggaggtgacggcgggggaggcggagggggcggtggcggtggtgggggtggcggaggaggcggcggagggggcggtggcaccggcaccggcattggcacaacggggtcaaatggtgcgccgaagaaatcgaacggactgccatacgaggacaccgtgacgatgaacaacgaaagcatgcacaggctggcaagcggttttggcacaaatatcaccattttctgcctttggactaaaacatacaaaaattcttacgtctcgtaacaataattaattacaaattttgagataattttagttaatttaatttttaaatgagcgaaaaagcgattaaatcccgactttttgtttccactaccttaacaggggggacgaagccgagaaatcgtctgggaattaaggataatggctaataaattcaagtttttttgggtgatcggaaatgttaatgcatattcaatagagaagaatcacttctttttatactgccgcctttctgtgggcaaaaaaaaaatgggtgaaaagtcctccaacctcaaaattggcgcaccattacaacaatgccaaatgttctcgggagctaattggatcgagaacgaaggagagaagaagcagcatgggaagggtgcgcctccttttccaatttccattgtttgtgctgcacgaatagacaattttctcaatttatttttttttgtaaagaattgggcacctgcaattttactccgaatttttgcacttttctcaccgtaaaaaattgcttcccgaatttttcacggtggcgcaaaaggcaaaaaaaaaaagagagacggccgacgaaaacgacgaaaatgacgacgaacacaaaattggctctgttcttaagcagcgacggaggcaaacaaagaacgaatgaatgcatttgacttaataaactcgttcccccctcctgtggaagcgctaattactcgattactcggaaagtacagacaaatttccattttttgcccatctcctcacaaattgatggattacaaatttttctgtggccttaagataattaacaataaataagttgattttcttttaataaatttttaaaatcattttttatacatttacaaaaattttttatttatttcaaacgtcgaaagcagccaaatcgaattcactttaatcgtcatgggatttcgaagttccttgctggaacatattcaattgacagcttttaaatttacaaaacaattttatcagaaaaagaccattttacccacgaacacatccaaaggtatttgatttattattgtgcgagcaaaaaagaataggaaaatgagcaaaacaaaaaatcaataaatttggctatttaataagatttgtctctccgctgtacatcttttttttgatccatttaatttcaaattatcccacaatttttgagttaaaaaaaattaagccatatttgctttaataatggcgattcaaatttattgctgtgtgcatttatgcaaaccaataaaaacttccaatactccaaacatttcgtcatttatccccgcttaattagtcaatatttttggttctaaaactactgtaattgacattaattacgcaatttttaaatgtagattgcttttttttgaaaaacttgtcagaaagggtgcttattattgccattctgatggtttttatgctgat

SEQ ID NO: 19417 - DNA, 3017 bp, Heterodera glycines
cattttgcgattccgttggaaacgatatgcagattactattcgggggtggagagatagtacacaacttggagaggaagtgcggagaagggaagagagaaaggtagagacaacgaaaacactctgtccctttcttctcttcccttggccacccatcggctcgagtgcaaagggaaaaggatgagaagaaaagcaatgaagaataaaaaatttatttaaataaaaataaaaatttacagtataccaaaaaatgcacgaaaaataaacagccaatacacttgggtttttgcgcgaaaaaaaagtgtgaaaaccagggacagtcgaccacctgccccagaaaatgcgcgaaaaaacagccaatacccttgggtttttgcggtaaaaaaggtgaaaaccggggaccgtcgaggtgtgaaaacccggccaccgtcgaggtgtgaaatttcacaccttgacggcgacggataccgtggactcactactaattatattataataatttctttcttttttttatatttgaatccaattaatttcttttctgttatttatgcttgtctttttatctcatgtcttcatactctccttcctcttcttctccaggcaccggtggtgcttacatttaatattgcatgtctataaaatataaatttaacttagttttttcttcaatattattactttggttaattattatctttttattaaaactttttttttcaattgccaacagtaaaaaatgttgatcaatttttattattttaatttttttaatgatatttcagaagttagcattgatttattcaagtgactgaaataattggctcttatttctgccgaaagtattattattattattattattgctaaattaaatgagtatttaagtgaatattttttacaaattttaaagtggacccgattatattttcaattattgattcaagaattgaattattttagcaaaattatttaatattttattaattaagcgcttaaattatttttcaaaaattcttgttcatgcctgtgtagtatttcttcttgaaacattccactctattgaaatctggatttgtttttattttttctattcataattttagaaatatacataattattgtatcaatgagttatttgtttaagaatttttaaaaatttattaagtttatttgtaaatgacttattaatcatttttttttaattttagctcattacccatttcaacaagcattgactgtgaaaagaaaattgttttcaaaataaatatcctttattttattttatattttgacatatatttgttaggttaacgtaactattatagatagacataattctttccttccaccgattctttacttgttttaaaactgaatataatttttaatattcgatacgaatttatttttaataacatcttatagtaattgtattttttattacttttttttgttttgattgatgttttatgtcaaatatattttaaaattgaaactacataataaaaattatattatttgctgaattataatataatcagtttatccctgccctcatttgttattatttttaatactatgatttgttttaatatatcttataataattttaatttttatcgattttgagcgtttaaaaaattaactttcacaagaaattcctatatattatcaaaatagattaaaaaatgaatattacatttgacctttgtgtttagtttgtcacgattaatttgaaaatacttttaaattagttatattggttaaatttatatattgatttaatttttgtgactttcattaaattgttttatcgttggattaaactaaaaaacaaaacaaaacaaataaggaatgttttttttcttataaattatatgacatttccctgtttgtttaaataattaaaatttgctgtttaatttaattaaaataaattttaggctttattaatcaaaaactatctacattatttcaactatttttattttattctttttttattactttatataaaagataaataataaatttaataaaaaaaacattttacaattgactttttgatcaataatttgttttgtttttatgcctattagtcaacttcttattgcctatatttatttttttattatttattatttattttctttttttcataaatttcttcaataataaatattttattttaaattgtcaaaaattgactcaaaataattaattttatgtgaaaatctataaacaaatgaccaacaaattttcaagatttgcgcttccgttccccagtttgtgtactgtttgccggttacctttttacagtatgatatgtataatttttagaatttttaaattatttatgaaataattttagtcttaaaaaatttcttttaattatttaatgaccaagaaaaagatgacagaaattttacgtgtaaaccaaacttgtgaacaatttttgactgtttgacataaggcaaaactccccgaccgatttggtccaccccatctccgagccaacctctgctgatcccgaaaaagtggaccttgatttttctcacccccaggggtcacagtacctaccctaccatactttgtagtaataaatttttccaatttccaaaaatgaatttattattatttagctcttttttctttaatctcattttcttcatttgtttgttcgtatgcgtctttcttaaatgtataaatattttttttttgttgaaatggtttattattttaagtttgtaaaaaatgattttaattttaaattattatttgttatctctttttttctcttcaaatattttcttttttatttcatgaggtcacattttcttttaatatgctcattttgccgctagttactaagcgtagtattttgaaaattttttcacttttttttggtctattttttttttgttttttttacacataataatgaatattaaacattaacaagacaattatggcgaataaaaagtattttcacgcatttttatctcaaaaaaatttt

SEQ ID NO: 19418 - DNA, 780 bp, Heterodera glycines
atacaatgcttcgaaacggcaaattgtcgtttgggagaacacttggccacaaagttcggccaattgctgtcccacgtccgcctgagtgtagccgagcttaacacgccgttgtttgaacatcttggcaaagttctccaagtcctcaaaaaagtccgtcggtcggtcccttcgcttccgccggcccttacctctgaacacagctgttcctcctcctccgtcatccccaccgtgccaatgccctccaaaatgcttccgccgtgcggcccttcgtttgcgttttcctcctcgtcttcgtcatgttggagctgttgttggtgtatcatcgaaggactgtttcgcctcttaacgttcgcttcgtttgtcgccttttccaattcagaggaagaagaagaagaagaggacgaagcagaagaggacgacgccgagtggtgctgcttgtcgtcgggggaagggaaaagcattcgcgagggaccttctgaaagggaaaaggacgcaaaatgccaacaattgtcgttgggtggcacccccccccccaatgcgagccatccccggcaaagaacccaatttaacaacgtacccatcacaaaagaggtttgtgtggttggagtcattgccattgtccactgcaaatggggagcgattagcggaagagccgtgggatcggatggatgcacgagggacggaggtgggggagcgaggggctgaggctggccaaatttggtcggtttgacaatgacggattggcactgctgcgattggttggggggagggaggggtgcg

SEQ ID NO: 19419 - DNA, 1460 bp, Heterodera glycines
aatgattgtgtgccaagagtagcccattgttgaagggcgaaatctgcagcggaagaggaggaggaagtgagaagtgttgggtacgtgggaagaggcggaggcagcgaaagaggcggctgacccattggggaaacgacgattgggtgcggttgtgacgaatggcacgggccgtaggcactgccaatggcacaaagaggcgactgaacagaaagggcgtgaagctaaaggggcagtcactagcacaccaattaccgactgatcaacaccaaaaggctgaagcagcgccatttggtccattggcataatcataggataagacgcagtcattggccaatcagacggagagagaaaaggggacgaaccgatgagacaattggcagaggaggcggaggagacggagcaggtcgggacggaagcggacgaggcgacggaggaggacagaagaacgggcccgaaatgggcatgggaagggagcgactgaacaaagtttgccattccaaagtcaattggcaaaatgccaaccacccaccggttgctgctgataatcaacgatcatcggccaaaaatgtgtctccgaattcgccgtcgacgcgtcgttcttcgctggatggccctcctcttctccgccgccattctccgcaattatttcgccaatgtttcgtggccatgtgccgttattccaacaatgccattgctgaatataatccgcgcagtttccaaaagtgctgtccgcgcatgtgcgaaatgtcgcagaagagattgttgcactgtccgccggaggaatggaagcggtcctttggtggcgcgcgtcgactgccaccgcggctgccattacggaggcggcgaacgcggcggagggcgccggaggcacggggaggtcggaatggtcgctgaaagcaaaggggccgaggaatgcgacaattttgggagcggctgaccattcggatgacgagagcagctcccgcttgacaggcaccgaaggcgcattgcgcaaacgcatgacggaagaaacggaggaaacaatcggaggagagcgaggagacgggccagaagaagatgaggcatttttgggatgggaatggtggacgaagcgacgggagagcaacggctgggccaagtggtcgccgaaatgcgaaggaatggatgacgagggggaggcggacggcgagcaagaggccctcattggcattcagtggcggcaggggggagagattgcgccttggggagggaatttgcatcaaaaggtgcgggtgaatcgggcattggtgcaatgaatgaatattcaaatttgaacaacaaattcaaattgggcaggaggggggggggggtgttgggaaagacaatttgggggagagagagttggggaacgatgagagggtggggtgggaagagggagagggattgggtggaatagacggggcaaataatgggacgacaccaaacctcccggcgggcaaagg

SEQ ID NO: 19420 - DNA, 1081 bp, Heterodera glycines
  misc_feature (25)..(25): n is a, c, g, or t
aggctctccggaacggattagcatncggggttacgagatagaaaattgtcctaaaaagagatagccatttttctgagaattaattcacaatttccgcagctcttagggtaatggaaaaaattttgaagaggctctccggaacggattagcatcggggttacgagatagaaaattgtcctaaaaagagatagccatttttctgagaattaattcacaatttccgcagctcttagggtaatggaaaaaattttgaagaggctctccggaacggattagcatcggggttacgagatagaaaattgtcctaaaaagagatagccatttttctgagaattaattcacaatttccgcagctcttacggtaatggaaaaaattttgaagaggctctccggaacggattagcatcggggttacgagatagaaaattgtcctaaaaagagatagccatttttctgagaattaattcacaatttccgcagctcttagggtaatggaaaaaattttgaagaggctctccggaacggattagcatcggggttacgagatagaaaattgtcctaaaaagagatagccatttttctgagaattaattcacaatttccgcagctcttagggtaatggaaaaaattttgaagaggctctccggaacggattagcatcggggttacgagatagaaaattgtcctaaaaagagatagccatttttctgagaattaattcacaatttccgcagctcttacggtaatggaaaaaattttgaagaggctctccggaacggattagcatcggggttacgagatagaaaatgtcctaaaaagagatagccatttttctgagaattattcacatttccgcagctcttagggtaatggaaaaaattttgaagaggctctccggaacggattagcatcggggttacgagatagaaaattgtcctaaaagagatagccatttttctgagaattaatcacaatttcgcagctcttacggtatggaaaaaattttgaagagctctccggaaacgatagcatcgggggtacgagatagaaaattgtcctaaaagagatagccatttttctg

SEQ ID NO: 19421 - DNA, 1051 bp, Heterodera glycines
  misc_feature (60)..(60): n is a, c, g, or t
aaaaaatttgaagaggctctccgaacggattagcatcggggtacgagatagaaattgtcntaaaaagagatagccatttttctgagaattaattcacaatttcggcagctcttagggtaatggaaaaaattttgaagaggctctccggaacggattagcatcggggttacgagatagaaaattgtcctaaaaagagatagccatttttctgagaattaattcacaatttccgcagctcttagggtaaggaaaaaattttgaagaggctctccggaacggattagcatcggggttacgagatagaaaattgtcctaaaaagagatagccatttttctgagaattaattcacaatttccgcagctcttagggtaatggaaaaaattttgaagaggctctccggaacggattagcatcggggttacgagatagaaaattgtcctaaaaagagatagccatttttctgagaattaattcacaatttccgcagctcttacggtaatggaaaaaattttgaagaggctctccggaacggattagcatcggggttacgagatagaaattgtcctaaaaagagatagccatttttctgagaattaattcacaatttccgcagctcttagggtaatggaaaaaattttgaagaggctctccggaacggattagcatcggggttacgagatagaaaattgtcctaaaaagagatagccatttttctgagaattaattcacaatttccgcagctcttacggtaatggaaaaaattttgaagaggctctccggaacggattagcatcggggttacgagatagaaaattgtcctaaaaagagatagccatttttctgagaattaattcacaatttccgcagctcttacggtaatggaaaaaattttgaagaggctctccggaacggattagcatcggggttacgagatagaaaattgtcctaaaaagagatagccatttttctgagaattattcacaatttcctcagctcttacggtaatggaaaaaattttgaagaggctctccggaacggattagcatcggg

SEQ ID NO: 19422 - DNA, 1988 bp, Heterodera glycines
  misc_feature (1837)..(1837): n is a, c, g, or t
  misc_feature (1865)..(1865): n is a, c, g, or t
aaaaataccgatcccaattttaaataatttaatgaaggttgtcataatacaaatttcaatgagaaaccaaaattattccaataaacttagattcaacatgctagacacaaatacttattgataaaatctataggaaaaacataagtgatttttattcaaagaaaagcatttaaacgaagtaataatcgttaaaaatctacctagctaagagacattttttggccatgaatatgtaaaaaaacaatacaataaaagataattttgttaataacttaaagataacaaataaattttaatttacattctgtaaaaataatacacgcaaattattaaattttatttttattattggttatgataataaatgaattactatattgtgatgaactttgcataaatgaatttgttcgcctcatttaaacctatgactttttaatcaaacaataaaattatgattttactagtattcttaaaataatccatacctagataattaagagtaaaatgaaaaaaaaacaaaaagacctaaaatatacaaaattaaatgaatggtaacaaaataataaataattgtaattgtacataaatgcttctgccctctagatttatcaaaatcatttggagtgttggatcgctttttgagtgatttttctcgacaaaattcagtgaataaaacttaaaataactaaaagataagagattggctaattataccaaaaaaaaatcaaacataaaaacgtctttttattcatatcttaaggaactatataaagaataaatgaaataagccaataatccaactatttattattataaatttaacttaaccaatatataaaaaaatcgatcaattacaataataaattttaaattgaaagagcacaaacaagaataattaagaattgctgccgtgttggaaggcaagtgtcaagaactatgcaaaaaagaaactataaattacatatacgatctattagaaataattattaaaatttgatttaaataaaaaatactaaaaatattaaatttaataaatccaaattacaataaaaattatggcaatataaatcaatgcatcgaatagttcaatacaatgaaaatattcccaaaagaatcaactaaaataaaataaagaaaataatttaaaagatttattttttaacaataaaaaaattaaatttgcctattaaaagagcgtcttttattgaaaaaagaaaaaatgtaccattatagaaaacgtgtaaagctaataaaatgcttttcaactaaaggtattcaaaattaatgtaagaacagataaagtaaaaaaagattcaagatatatgtttttcatttatagtaaaaaaaataatatctattaaaattaattaattgaaaatcaaaaatcaagcaaccgaggcatccaaatctcagtaaagaacgtacgcaaacaatagatggtgaaaactttttaaatcttgtgataatagttcaacataaaaaggtgctaggacaaagtccgaataggtaagttattaaatttgataaaaaataataatattattttataaaatgttaatttttaatttttatatttaaaagattttgatacatttttgagctttttattctacatataaatttatttttaaatgaccttatttgttaatacgtaaacaaattttaatgtacaataattgtcatatgtttacgacatccccatttatttcgtaactttgtcaaatgacggtcaatctgcacaatattggtatcaaaaaaatacatgcatcgaaacctcagttgagttatttcggcattttttggaagaattcagttaaaccgagttttaaccggtttnaaagtatgccattttgcttacctaagtnaaatgttggcgaatttttgtttgatgccgttattatgtgtttccgcatctttttattgggagatctggggtcctttttggttttcccttgtctcttctccggcattgcaaacatttattgcag

SEQ ID NO: 19423 - DNA, 1221 bp, Heterodera glycines
caaatttgaaattgtttaacaattgccttgtccatgttgagaaatgcggaaagtcttcattttcccactttccagctgttagacattcgaatctgtcgatgaaaagttgattgtggttttgcaaagagcttttccaaaattttcactgcttcatcatagttgaaatcagtaactttttcggtagatagaatttgttgtactccgaaaaagcgttttccaaaagtttgttcatcaaagctttcactttggtttcgtcctgtgcgtttggtgacgcacaatcaattgcaaacgaaaacctgtcaaaccattcggaaattctgctcttttcttcatttggttcgaagattccgatgtccggcaaatgcggaattgtcgcatttgcttgctggttttgtcgtggttgtccctgtcctccgacgaattgagcaaactgcgtttgggcctagtgcgcgcttgaacaccttttttgtacgaagtacttcctcggagggcaagtacttcgtccactacacaacacctttcaaccctctgttcggacgaagtgcttcctcagagggtaaacagtaagtccgctacgtccctcgtgaagttatgcctcggaggacaataactacacgaaactacgaacactagacaagcctcagagggtccttgtctaggctctctaatttgctttcccttcccctgtgtcaccgggattcgttgagttaatccgtggttcacagatccacccaggagcgccaatttgtcccgattgcgttcgggccaaaggccggtcactggggtcggggcaagtagggacgagacacagaataaataaaaaatttattccggaaggacctcaaacttgggtaattaaacaaaatatttgaaatggaaaaaaatatcacaaattgatcacagaaagtgccatcaccggggaattaatcacaaatgaaattgggcaccgggatgggacaggaaaatttaaggaaatgggggcattcgggcaaatggaaaatcacagaattcgatgcctgggaccgggaggaacagaaatggaaaacaccgggccacagatcaaagatcaacaaccgggggtcaaagaatgatcacaattgggggccatcacagttaaaggcaaatggagggcgggagagaaacggcaaaattgccaaatgaatttgggttgtgaattttgggggcatttggccgtttaaataacaataaaattagataaaa

SEQ ID NO: 19424 - DNA, 811 bp, Heterodera glycines
actgccacacaacgtcgcaatttctatgaaaaagacctaagactagaatagcggagaattttggtaactaatcatttttctaaaatttaaatacacatgttctaaatagagaagccgtttaatttggtgtttaagccggtaatttcggttattccgacaatgcctaaaaagttatggattaatttacattgtaattctagcatatattagttcgcctctcggaatgacatgcattgacaatagagtcgtatgggaccgggagcgggtcggtaattcccggttttgccagtcccggtgccggcgggactaaataagcattggtacgaatgcgtggtgagcccaagcgacaaaaatatgggtgtggcgaagcgacaaaaatatgggtgtttgtaataattaaatttaattattattttaattttattttccaagtaattaatcatcacttagcttaagcttagtaaattaataaaattaagtatttagcgacagctcgaagcatcctctactaattatgaaattttcaaaaaattagtaaaaatttacaaaaagttgtgaccaaaaaagtacgaaaaattttgactcaacaattttgaccctagctttcttgaaattcaataaaattttttgaaatttaacagaacaatagagtaatctttaagctatctaattatataaacaaaattaaaattgattgccccccacccccccatataaagaattaatagggtcatatttttatgatcatccgaaaaatgtaaagatatttaaatgccctaaaaactgttccaacttaaatgaaatcgctccg

SEQ ID NO: 19425 - DNA, 2289 bp, Heterodera glycines
  misc_feature (616)..(616): n is a, c, g, or t
  misc_feature (737)..(737): n is a, c, g, or t
ttaatgggtacatttttggatttagtcaatttttgtaacaaagtgcacttaaatggtataattagtttgaaaacaatttctcttggaaaattgcgtggttggtagcggtctcggtcgtgaatagaggtaccggtacctgccttttgtggtcgcggtaagtaccgctcgcaatcttgtcacagttttcggtcctgtccaactcaaatggacagcgagtaaacatataaaaaatcatattaatagacgcatagatagtcagattctagatcagcgctcaagctacacgagaaaaaatgcttttactttgccgaaaattatgatatttttgcaggcgcataaataatataacaactgctttaactgagaaaatactatgaatggacagttcccctcccccccccccccccacgttctttcatgaccctcaatagtgacacacttagtataaacaaattaaacttattttaacttatctttcaatctttcaataattattattaggttgtcattggatgatttaacacgtctgttttcaaaagtgcacatttgtttcctggacgcgcatgcacttgccgaaattagagaaatgacggacaaatgcattaatagagaattngataatgttatgtttgatggtgtttggaatgatacaactgccggagggtcaattcgatttggagcaggtagaaaaaattcaagcaaaaataagaatttacaaataagggaaattagcaatntaaagaatcttcagtcttgcactaagttaaaaaccagaaatacatttgcccttcgttccaactaaagttttgtatgggttggtttttgtactacaaagtcttataagcagtttagaattaagtgtaatttcaattgttaatctttttaaaaccgggtaaaattgttattcaaattgattataataaagtattaaattgaggttagaaaattgtatatacaccagggctgggcgcaattgcggattacgaaattgcgagttacggatttttgggatttttctgcaattttgatctgtaatttgacttggattatttttcgagacgatttcttgtaagattatttttataaaaataaatttttattttatttaaagggatggctacctgtatttcgattgtctcaaattcaatttcattttttctccagtattccaaattggattatttctgaattttcttcaaaatttttttgtaaattttcagaaggatttatttttttcttcttctgaatttttggtccaaattatctggattttttaaaatttcccatcaattaatattcctggtccagcttgggacccaattttttcaatttttaaaatttggctattcagttctttaactgatttggttgcccaaaattgtatcgtcgggcttatccattaccaaagccaataacaatatgcataaatccaattataaagctcagaacttcaaaaatttttacaaaagtgacccaattcaaaaaattgaattttttagacccaaaattataatttctttgtataattgaaataaaaaataaagaaaatgtttcccgaaaatccatttttttatttttattaattcaatttaaaaatttgtttttcaaaaattatgacaaaaattgattttgaaaattacggattgcggattacgggaaattgcggggttttggacccccataattgctgattacggatttccgtaattgaaaatccagttgcgcctagccctgagccacactatagcctcataagttaatgtgatagtaaatcgtgacggaataaaattttaaaataataatttatcatcataacaaatttcggcattacagttttaattttagaaaatttcacaagaaaccctcaatattggataaaagttgctggtgacaacccaaacaaaagcgtgattctgatcatttcgttgatgcaaaagtatcaacgagaagaacgccggccaaactacgcagctggtttcaacattttcaaaatggtagttaacataaaaatgggtttagacaactaattctatatatggaagcattcttttaaataataataatattatttaaaattaaaaaaaatgaataaaatttttatttattttaaggttattcttgaaccatgaaagttatagcattgaataaattatgtttatacggattgctttcgaataattaaattcattaacaccaattaatataattaatattatttatttatcaatcactgagttttttgagacgccggcgaagattatttcgaaatataaaatctgttatggagtt

SEQ ID NO: 19426 - DNA, 979 bp, Heterodera glycines
ccatgcgagcgacaaatttgccaattttgggccggctagcaaatgagtgaaaaagccaaaagtatctgttcaatgtcagagcaacatttgcagatttgcatgagccgctgcttcgcgacccggacagtttgctgagcgcattgctgtggccgctgatcgacgcggacgaccgattggacgaagaggaaaccgcgcttctgccggtgcaattgcaatattgggagggccgcagggacaacactgccgagagcggtgacaaagtgttgcggacactttaccaggtgggcaatgcgtacacaaccattcattctttctttctttctctaattatgtgaattgcccgtgggctgattagtgagttcgcttttggcaatggccgacaagcgaatgcccccggggcaaaatgaactcgcgtgttcattattcactcaccgctcaattagtcaccaattacgcccttccattcttttatctttgtttaaatcacaaaggaatgtgccgctcactgcgctttctttgctgcgttttgcttccttctgctgtttcttcttttccttcatttcccgcccctttttcagttttgtgccactcgccacggccgacaatgccttcgtcggaagggcatttacgcgttgttacgcgaattggacagagcaacgaagccgcggaacacgcacaaatcgacgaccatcgaagaggggcgaatttgcacaataattgatgatgatgaaggaggggcggaagaatccgctggactgaacggacatggccaagtgctgcgggcgctcatcggcatgctcatccgttcggaggaggacatcggcgtgacggatgagtccatccggcatttggctcggatgatcggcaaatgggaacagaagcggcggaaacggaaaggtcggccgatcggtgaacgccttttgctgatcagagcgatgtgtccctttcttcccttgtcccctttgcatcaaacaaaaaa

SEQ ID NO: 19427 - DNA, 1325 bp, Heterodera glycines
agatgaattggatagagccgctaaaagggagggaaaattaatatgtccattgggggggggggggcaaagggcgggacattttgtgggaataatccgtccgttcatcaaagaaacggagggggagggaatgctgggttctttccacgacagctgccactttacatttattttttattgttatgtgctttttgaataaatttttaaacttaattatccatcataattagctgaattaattaatgaatggtcagtgttggctcttgacttggttacttttgttctttgctcgacgggagaaacggaggaaggagttaatgactctttccgccgactgtttgcccatcggataagagagcactcacattctcttcgatgtctctaaatgtgccgtcgtagccaccgaataaggcgattgttcggtcggctgaggagtccccctccttctttaatctgctttgcgctgggcttccgatcagtcggtctcctcttcccctgccaaatgcttctcccccccccccctttcgcccattctccttcccatggcgagggatgcgcgaagggaatggacaaaaacaaagaaaagccaagggaggggcggtgtcgaatttgcacaaatgccacaatcactagacagtccaaaacatgtccatccgtcggtcccttccctttggcttcatttcgtcgttcgttcgtcccttccccgccttccatggaaaattggccatcagtccaattctttcttccaccaatttcttctcgtcgattgtctgtcgtccttttacgatcgcatgaaaataacggaagcgatgaaaatgggcgccgggcgaggagagaattggaatgggaagggaagggatgaaggggagcccgacaatggaattattattttctcccgtgatgccaacaatcgcaccacccccgagggattctccggttgcgccccttcataaatctctcagccgacggtcggcttgatgaaagaaagacacggaggtggggaaaggacgagtggaaggggaggggagggagggtgggtacgatcctgcccctccccaccgcaccccctcgctctgccgtctcccgtcacccttttccctgtgtcttttcgtcaccctccggccccaacggcgtcgacgagtggcgacgggtgggggagggggcgggcccgcatctgctgctcgctcccgcaggcgtcaaactccgccccgaaatttgctgtcggcccgcgagaaattggagctggaggcgaggattcgtttgcgctctctcgtctgtctcgctgtccgctatgacgcgtctcgccacactctctcaccccgcttagg

SEQ ID NO: 19428 - DNA, 3073 bp, Heterodera glycines
ataattaataataaatttaataaaaaaaaagtcaccaaagaagaacaaaaatagaaaaaataaaataaaaattcctatttcaccttccgcttcagcataaagaattaatttattccaaacactgaagaaaatgcactaaagaataaattatttcaaattttttcaaatttatttcattattatattgaaataaatgcatcaaattaaatattttaatattttattgataaatttattaaaatattaatcaaaatttaatgtctcctaagaatgaataatttcttctctcatttggctttccatctcaaatgttcatgcacaagtattaatcattttttcaattttctgatcattcattttggaattcctattttgttgaaaataaattttcaattttttaatttttcctttcttcgtgattatttttaggctaattgcaacttttttttcaattttctaatcataaattaggctaattaaattttctcataagtttcgcttaatttgctgccacttgaagaactttctggtttttttttaaatttatttttttgaaaaattgtaatttcagttcataatattatatcaacgactctcgcataaactaattgacattaatattgtactgttgtcaatacaaaaaagaattaaggcaaaactcacggaaaatttgataggatttaattaattaatttgttttttagatatttatgccaattaaaaattaataaaataaaattttatgcaaatttaaataaaatatctcaacaatcaattcttgctttttaattaaaaaaaattcgtacacttttaagaatgaaaatttattatcacaattgtttcttacatttgtcaattgttctacggctaactccgattttcttgcaaatttcggcatatttttggcgccattcttttcttgaatattttctttgttgcttatattcatttgtcggaaaaagataaatttaaaaagaataatataaaaatttgtcatttttgttctaaatttttttgcatgaatatcttttgtcaattatgggcggaaaatgcaaaaaaaaaacaaaaggatcggcatgaaatttcatactataattgaaaatagtttttgcatgtaacggtctaatgtacaaaagcttaacttaataccctttagctgcatttgttcatgaagtttttttaatgtcttaatttctttattttgatagcttttgacaagttctatagccccgtgattttttataaattcttcaaaagcagaattattggtagtcgaatactcaaataaaaaaaaaattttattcattttttaaatttttatttagtttttaatttttatgttaagaatatataaaaactcatcgtatgtacattgattttacctttacgtggcagcgtaaaattatacgtgtttcagagttattgatttcacatataaatttttgaatggcaaaaaaatcgagtaaataaaatatttttaaattttattattatataaattagtgaatcgcataattaaatattaggtttttcttatcccaaaactgagtttttttcgcatcgcccaaattcttgaaaatcaatgccaggataaatacgaaattaaaattgcattttgtgaaaacaatgattttgttgctactaatgttgctgcatctgaatatttgaaaccgcattttgatcaccaattttcatgcgaaacaaacgcttcatgctttttcctaaataatcaacataaattaaaaacaattaaataaatgaaaatcaaacagtcaactaattatcacataccgaaacattttatattcgaaacaaatttgatacggtaagcattgatggtgcaaaatgatacgattggatttaaagcggacggtaaaataattggaaaaggtgagagtttgttgtaatacagaagccaatcccatccttgtatatcaatattgaaaagcagaaacacaagttgaaaatttaatgaaaaataaatgatgatgggcatagaagcctaaataataaatgtaaattaaataacaaaatattgaataatttatatttaaatagtacaataaaagtgctcaattaacctgaaaaatgagatttcgagaaacttgtttattcacatcaatcatctttttggctatttcagaagaagatgaaacgcttcaaacacaaaaattaaaataaaaaataattttaaattaattaccatttggttttcatgtccaagaattttttgatacaatatgctagtccaaacattatgatataagcaaaagtgcttataatgacaaggtaatataaacttaaagccaaatggatatcctaaattaaaaaaacgaatttttaaattttattgatttaccgttacattaattgcatatgcagccaaaataatttggtcgtcgagatttatgcccaaaatttccgcgacagatttgtcgtccaatattgcgtgatcagcaggtggaaaaaagcaaatgaacatattaacgcaatatgcaaacgggaacaaaagtatcagaaaaagcagcaaaaaatatttaagggacgaaatttttttgccacttaattttgaaaaattattttttagtttattatatataaaaataattagggattcttttttaggcacaaaaaatagcgaaataggcatcaaataggcagaacaaaatcgcaaaataggcatcaaataggcacaaaaatccgcaaataggcacaaatataggcaaaaaaaaaaaaatttaaattaacgctttttaggtataaacacgtaaaaatttacatatttcaattgtaaatgaaattattaaataatttaaagttttttctaaatattcttcatttgttaaataatattgcaataattttagtaatttttgtcataaaataaattaattaacaaaattattgccaaatgaaaaatttttagtttaattatatttttgatcactcgaattaaccaaatcggaacagaaaagaaaaaattagaagaaaaatcatttaaagaaatattcgggggaaaatgggaagaaaaggaagaaaaacaacgaaatgaactcaaaaaaagagaaataat

SEQ ID NO: 19429 - DNA, 2223 bp, Heterodera glycines
taattaaaaggctttattttcctcactttttctgtgcgttagtgtttcttcttgcccaacaaattgcacataaattcctccgctcaaattcttcacgcattccttaccagcatcaaactaaaaaaaatttaaataaataaaaaaaaatattttaaatgtctttacttctgcagaatgcaaaaaaagtgccggcagttcgtccgccaattttttgcccttttcaaatcgcaaattcattgcgttttgtctctcttccctacaatcaatttgtttgttactgaatttaaattttgatcatttgttaattacatcgtcctctgcgagtacaattcgtttcgcaaaagtgcggcccgacaatgcgattggaggtggacaatggtcgagcggagatggccaaataatcggacgcattggtgggaacggacgagcgattggaggcggacgaagccgcgaatgatcggaaaaataaattccaaattaaattggaaattgaaaataaaataaaatggaatgaaattaaatttaaaattgaatttaaatattttggcgaatgaatcaccttttggtaattctttttctgtgtgaaagtgcgccaattcttctgaaaaacgaccgcggcccatcggaggcgcgcgaactgttgaagttttgcccatccgcgaagaattttttgggccaaaacggcacaatgacggagccgctctttgcgcaaattttccatcagaaaatgagcttcggactaaaatttggagaataaaatttagaattatcaaaaaatgacagaaacaaaaaattgcattttttaaaataaattatttttaattaaatgttttactttaaggaatatttttgtccttccaaatgccaccggcggtgccacacttttgccatttgcttcaaaaattcgttggcaaatggcgtgcgtctcctgaacacaatggccattttgaagcgtaacaggtgctaaaaaaacttcaatttacggcaattaagaaagtggcaaaaattggcactgcgatttattttattttttaatttaggactacgcaaaatcggcacgagaatgccgtagcgcgaaacaaagtgcgaatattcaaagctggctgtgaatcccgcgcgacactgctcgacaacggccaaaagatccatctgacgcatttggcgaaggacgacggaacggtcgaaatgctaaaatcggattaattattaaaatttaaaatctttccaatgccgattttggtactatttaaatacattttcctctgctggcgactcatttggccgaatgcatcgtacaaaatacgcatccgccgccgcacttcgccccaaccgtcccaccaatgcgtccattttgcgtcgacaacaattggacaacgttttgtgtttcaaatgtgcatcattttcgatgctaatactcaattattaataaaggataataatgataatttgtcaaaatgttttcactttcgttcgctgtcgccgttttgagtcggcaattcaaaaagaagttgcaaaaagggcaatttgcttccaattagcatccgtcgcaattggtgcggggaatggcttctgtttgtggccaacattcccttggcctaaagtcattttttgattttaaaaacatgtatttcttctttttttgacttcgtatgtcacttgacccgtgtaatgattgaccacaaattgggcacacaattgcgatttcgggctcacataaaagcattgcttttgcttttgttgtccattcgtttgctgtgtgttgtgcaattgttccaacaattgatcatcggaaaacttaaccactttccatttataattaaaattaaaattactattttttacattcggtgcgccactcgcatcatcaatttgtcccattatgctcaatgaattgacggccaacatgtccaaaattggccaattgtccgaaaattcgacacacccaaaactccatcctggcaaacactgtgcttcgtattcactctttaaaagccgcaaatttcagaaaaaggtcattgatttttgttttaaaataataaaattaagttcaattggaaatttctttggctttacctgttcaattttgaaaatgagacggacgaaaaattgctgaaggcattcggcggaataattaatgcaaagttgctcttaaaacaattaagaaagcaatttgaaacaacataagcaaagaaaaaacacaccaaaatgttggcacatcaaaat

SEQ ID NO: 19430 - DNA, 2826 bp, Heterodera glycines
  misc_feature (7)..(7): n is a, c, g, or t
agcacanttctgttactactcaacttcttgaagtggtggatgatttcagttttgctttagaaaatagaaaatcaattgatgtaattttttttgatttagctaaagcattcgacacggttccacataaccggctaatatctaagctccaaaacattggtataaataattccttattaaaatggattcagaattacttagaaaaccgaaagtttttcgtcaaaatcgggtctgatttctctgacgaatatccctgtctcagtggtgtgccgcaaggctcaatattgggaccactgttatttcttatttacatttacgatttaccaaaattctgcgaaactgaaaatgttaaaattaaactatttgccgatgatcttaaggcctatcatgttctttcaaatatttccttttctccactccaaaattttattaacaaatttaatcaatactgtaaatttaacggccttaaaatcgcttcaaataaatgtttaactttacatttaggacacaaaaatcaaaaaataaattattttattgatgactttcaaattcctaaaaatcccggaaacgaaccagtcagagaccttggcatttattttactaatgatttgaaatgggcacaacatattgacattatctcgaaaaaagcattacgatctgctttcgctatactaaagtcaatcaaaactcgtgatacgaaaatacttgtaaatttgtttaatatttattgcagaccaattttagaatttggatctccaattttcaatccttatttaaaaaaggatattgaaaaactggagaatgttcaaaaaacttttttgagagtaatatttagacgtaacaattatgctgctgattaacctaattatgctgaattgttaaacatttatgatcaaaagtcgcttgagagtcgtaggttaaaaatagacttaaaactttttcatgaaataattttaggtaaaataaatttacaaaataatgaatccttttctttttccaaaaacattgtaaaaaatgaatacactataagaacagcttattgctcaaccaatgctagatacaattcgttctttattcgaacctctcgtctctatagacttttacctaaagagacgagattactaaatccaaatgagtttgccaaacttcttgaaagatctgatcttaatttgttgatttctttgccaccccaactccaaaagttgaccaattgattgttttgatattattatttcattatttctttatttttcggcgtcacgcttttgcgtataaatgattgattgatatgcctttttttgcgcattagtttcgatatattaagcataaataacacattttctgcatgatttaaagcttctaggttgggttttattatgccttttttttacttttttgtgattttcgtgcttttattaatgccttttttggcattttttcacgaaaaattccataaaaatgcaataaaatcgggaaaatacacccctaagaattgaaaaatttctcaaaaatagatcgtcaaaatttattaaaaaattttaggtttaaaattttctttattcgaaaaaaaattataaaatatttaataatcatttaaatgaccaaaattaagtttttgattgagttttacatgttttttgctccataaaaatccttaattaaaaattttaatgtcttttgtcatgcctatttgaggatttttgtgcctttttcactccttttttgcaattttttggtgcctattatagcgcctttttcgccatttttggtgccgcctttttttacgttttctactaatatattaatttcgcaatatgtgagtttcacaaagtaataaaattttgaattatttattgacacgtttatttttataagaaataatgaaagaaattgaaatgcaacaagtcggaggtcgagagtagaaccctgccgcgggatgggatcccgcgcgggattgcagaatccagtccgcaatcccgcattttggatttgcgggattaatcccgcgggatcccatcccacagaaattttgaattccataatcccgtagcgggcgggatccaaaaatttgaaatttccggactctagttaaggtgggttggaggaggagagtgtagagcagtgctgggcgtaactggattttcaattacggaaatccgtaatccgtaattacggcgattttctcaattacggaattccgtaatccgtcatgacgggggtcaaaaaaccccgtaattttccgtaatccgtaacccgtaatccgtaattttcaaaattttaatttttttaaaataattttcaaatttttatttaaaaaattcaataattttataagcaatttaaaagcatattaaaaagatttggcgtgaccgaaagtgcggatagacgccatagaggaaaattttgaagatttaagtgcaatttgtaaaagattttgcgtcaaaatggtagtgctgtccgagaccaaaaatttcccgggactcgagaccgagaccgagactcgaccccgggactcgagaccaagcccaaaaccccgagaccgagaccaaaaacccgagactattttcaaaaaattttcttattcgcttaaaaatggttaaaaaaatttttttgcgtatttcttaacaaatttttgtttgtttttttaattatgattcaattaggtaccataatcaatccaaaaacgcaatttgttttcgcggtttttgagtcaatttaaaaaataaagggaattttggaactccggcggtgtcgataggcgccgcctggcaaaattttgaaaatttgaaatgcatttgttaacagatttagcccaaaaaatgtccgaat

SEQ ID NO: 19431 - DNA, 2021 bp, Heterodera glycines
gcccagtgcgttggacagacatttgtacaacaactcagggtgggtgtccgtcacacagtccgtttgactataataatcaccaaatttgactaggttgaggtccaaaacacggagctgtacgacagcggaaccctctacccttacaaggcgtactcgaccaacgaactgtcctttccgaacagtgcaaagggacactttatggccagcgcgggctaccatctatcgcggaagcacgacgacgcgacggacgccggttttctggcacgctgtgcgcgcttcgcgggcggccgtaaagcacgcttcctttcccggctggacttcgacctgggcaaccaggagctgtatctgttgaacaacatggacgtcctgttcaccatctatcgggcaaaggatgcgttcctgttacaaagtctagcggcggcggcagcagcagcggcgggccaacattacgcgctgtatctacacgacataaagctgtacgtgaagatggttgaggtgcaaccgtcgctgaacctgtccatctacaagacgctggaaaagcagccggccacctacgcggtacggaagacggaggtgaagtccgtgtttctgaccgccggccgtaccgagatggaccacaacatattttccgccgccatcccgcgtcggctgaccattgcattggtggcgaacggagcattcaacggccagctggcactgtcaccgttcaacttcaagccctacgcaattcgtgagatcagcgtgcacgctgccggtcatgtgtatccggcagtgccacaccgcatggacttctccggctgtgcctacattcgaccatttgttgacatgtacgaggcgctgggcatggccaactcggagcgctctatggacatcacgctggagcagttccacgacggatggaccatcttcgtggtgccaatgacatcgacgctggacgacagttgcggctttgaactgctccgctccggcaccaccagcattcggctcgcgttcaacgaagcgataccggcaggcggcgttgagatggtcgtgctcggggaattcgatcagttgatcatgattgactacaaccgccatattgtatccgactcaaaaattgcataaaaaggagcccatattatgattaactacacattgctcaacgctccaaatttgtacctatcaacaaagtgtcttattcataaacctcacacaaacataaacatatattgtctgcccacgataaacatgccaaacctaagctgggtgattttgtatgagccacgaggggacggactggtggcgccacatcccctgttcaatgccagacctgaagtgccagcacgggtgattgacagtgcgccactcatttcgccattgcacagcggtcagcgtgaaattaccttcaagcattatgtctaccgccacccccagcaaagacatttgtaaatttaagaaattgcactgacgagcaaaagtgtgccatctgccgttgagatgaacgttacgatgagcgcagatggtgtggacccaacagcagcagcagccccagtcatgtctgtgcagatttggtccgcactgctcctgttcaccaactacgccatcatactgccgttgttcatcatttgttggttgtcggttgtacgctggcttcgtcactccggtctcatgccaccgtcgtcgccacactcgtcgacgccaacatcgtctcgacgtcagatcaacaacaacaacaacaacgaacacaacaaaatccggagcatgttcagtgatggtggggagagcgggcgactgcagcaacagcacaccgctgccgtcatacgggaggccaaccgtgtgacgtcccaaatagctgcggcaacagcaattccggagccaatgcgcagcgtgttgaccgcctcggttgcgattccgatgatcgtgtccgctgcacaaactggtggtggtggtggtggtagtgatggaagtgacgtgacaagtggcgacggctttcgtgacgagcacattcacagtgaccgttcaacagacaatgatacgattgt

SEQ ID NO: 19432 - DNA, 2052 bp, Heterodera glycines
  misc_feature (10)..(10): n is a, c, g, or t
  misc_feature (24)..(24): n is a, c, g, or t
  misc_feature (1446)..(1446): n is a, c, g, or t
ttgcattttntgttaacaaatttntgggcaaaacgccaaaatatgtgaaaataagttcttaaaattttttttaggttttaggtgctaaaaataaaaacctagaaaataggtgctaataacttgaaaagtagcttaacaagagccaaaaaaacatgtttttcgtgtgtttcaggccacggggagctcaggaaaaaataggtaaaaacctaaaaatcgtagccctacatattacactcaaaattgcataatggaaaaattcttcgaatttctccccacaaacgagaattaaaaaattttatgggtacatttttgaatataggcaatttttcgtaacaaaatgcactcaaattttcaaattttttttcaaaaaatttcacttgggaaaattcctggttggtcccagtcccggacaaaaatcgaggtcccggtcccgacttttctggtcccggtaagtcccgtttccggtttttgtcaaaattcccggtcacgtgcaactctaataattaccttttttgctaacttgctatttaaataggtaaaaaaaaatctcaaaataggtattaaataggtacaaaaattccaaaataggtaaataaaaatttttattaacgattttttagtggaaaaaagcaaacaaagagggaaaattttggttctacatatctctttgtaaacgaaattttaaatatattaatattttcttagatactattgacattttaaattaaaaattttgtcaatagaaaaaataaataaattttgggataaatttttgagaaatttttccaattcttagggtgcatttttgaaaatttttttggtcgattcttatgggtatattttttgattttattgcatttttgttaagaattttttgaaaatccttaaaataggtaatcaaaatgccgaaataggtataaaaataggtacctaggtaataggtagaaaaatcccgaaataggtaaaaataggtattataaaagtgggtgtagaagctccaaaccaagctaaaaactcgttttttatgcttatctcaacgttacaagtgcgcaaaaattttaggtatttaactaaaaatcgcatccctatttattacaatttccaaaaaattttccggcggcgcttatcggcaccgccggaccttcattttaccttaatttttgaaattttaaccacaaaatgggtagaatttgtcattttttatctgagaaaaagatcgaaccggaaaatgcagattttttttgcatcacaacctcaaaagctattggtaaaattttttttttaaatttcgcttttcgcattttcgcatattttggcttttcgcatttcgcttttttttcatttcgcatttttcagtttcgcaaatttcgcttttcgcatttcgctttttatttttcaatttggcccatccctggtgtatagtaaggcaattaaaaaaaaattaanaaatgttcagcaatttttgctgcgttttcaatctttattgtttaaaaatcaaaattcgtttgtatttggcaattgtcacatttatttctgcgttgcatggatgtattgtcagtttgggtttgcttaatagtggaaacttacatggtgacctaatgatcacttgttgcttcattgactttttcatggtgtaatttaaaaaatatataaaggcgaagcacgaaaaagtgcaagtgatcaaattaaaatcaaaataattattttaaaaatgaaatcaaaaataattatgttaattacgatttaattgtaacatttattatttaaattccgttacataattaaaatatttttttatattaatgattttatggattgctttgttgattttgacttataaggctaggaagcgtggctggacgtaattacggattacggaaattacggcctttttggaccgccgtaatgacggattacggatggccgtaactgaaaaatcgccgtaattacggattacggatttccgtaattgaaaatcggttacatccagccctgctatgaagacttccttaaaaatcaatatgaatcattcataaatttttttctacaaag

SEQ ID NO: 19433 - DNA, 1039 bp, Heterodera glycines
ggttaaaataaaaacaacaaaatgccaaaaaatgccaattctattaaaaaaaaatcaaatttagcacgccaaccttagccgactggcgcgccgcctttccgccgcgagccgttccgcttgtgcaagcaggcgtcgggcgagtacttccgcttccgctgatgtcatgcgttgcagatcgccggcgcgcgccggactgggcgccttgcgtgtcggcaacagcgcaacctttcattttagcaaataatttggttgcgccgatttagcgcaaaaattggacgccctaagatgccctaattagcatttttccttaccggcacacgtcgcgcggagtttgtcggcctcggctgactgccgccgtgtacaatcattggctgacgccgattagccggccttccaatacacccctaagaatctacttaaaaaatttcagaaaaagtaccctcctaaaatcgtcccaaaaattaaaaaaatacactcctaagaaattaaaaatttccccagaaattcattttcatggcatttttggccttaaaaatcccagtcctactcatttgcaactgcaattagtaaataataaattttggctcaatttttgttcgattcttaaaagtgtatttttcgcttttattgcatttgtgttgcgaaattttccaaaaaatgtcgaaatagtaaaaaaatattgacaaaacgccaaaatagtaaattttcactattttaagtagagtgccacgggaccgggattttcggtgtcaaggcagttcgtacaatttcaaatgggaatggccataatttttttgaggaaaaagaaaattgcagctgaacaccagcagaaacattttgaaaaatttgacccaaaagggggacccaaactgtactagtaccgctaatggatgtcggaatcccccgccaaaatcctgaaaataattgtcacatttttgaaaggaaattcattcattcgatagatagcaaaccattttatacacccgattatttagcaattgagaggtttttctcataaatgcatttgatcaggatgaat

SEQ ID NO: 19434 - DNA, 2261 bp, Heterodera glycines
  misc_feature (2233)..(2233): n is a, c, g, or t
tttaataaaaaacttttaagctctgatggggttttgaacaagcccaatttcgagaaagaattactcgattgagtaaatttcggcataaatttgaagagaaaaaaaggattttcgatgagagacctattttgattttggcagcaaatgtccgaaaatggcccttaagaaatgggccgcaaaagacggaccgcaagcaactgaagaagaggaaaaagaaaattgcagctgaacaccatcagaaacaacaacatcagctgaagcaagaacattggaaggaggagagacggaagagaaagagagaaaaaggagcagcaacggaacaagtattgctaatggatgtcggaaatcccccgccaaaatcccgaaaaataattgtcacatttttgaaaggaaaattcattcattcgatagatagcaaaccattttatatatccgatttatttagcaattgagaggtttttcttcataaaatgcatttgatcacggatgaatatgatcggtcgatcgatcattcttaattaattcatttcttcttctgcggctgatcactgtttttgttcttttgtccgtcactcatttgtcagcagacgacgcccctttttcgctgctttgtcctgcttcgtcttcttctttcggtggcggagacaatggactaaattaagcgaaattttaattacttaaacaaaattaaatgccttttttatttgctcacccaatgcaattagtgtcactattaagccaaattaacacattgttacaattgttgtcccaatttccgtcttcccaattgaccgccgctgtctccccaataattttgcatcgtttcattatccaaccgatgccccattcatttttctttgctttggccaatgtcagcttttcctttgtccattcgttcaccaattcgaatggcaccattggcattgacggcgcacgaacagaaaaatgaatttcgtaactgacgtaagaaatggcattggcacgaagaaaatgctaaacaatttgattggaaaacaacaatcagtcatttgtcgaattatggccacaccagggatggcactgaattccgatttccgaaatttttgataaaattcggaatttttcagaaattttcgatttataacttttttggggtcgggtttcagaaaataactcagaatgccatccacagaccgggtacacccctaaaacgtcgccgtctcgtataaaaactaattttctgaatttccagaaaaataaaaaaacgacttttttacatttccttgaattttcttaataatttttttcgaatttatctatttttttttgatttaggctagataactaaattttaaataatttttttaattaaaataaaattttgcggctacgttttgtcccccccccccccccccggaccacacctccttgaaattgtcgatccaatcagtgttcgtttgttcgtagtaattatcgcaacgcaattgcttgggttggccatcttttctcggagagtgcaaccatttggacaatgcttggccagcagtaattgttgcatttggcccatcaaaatcaccaccaaacgcagagggcaacagaccaaatgaatggattgaaaccaattggttaagatcgatgagaattgtcggcgaaatttgacgaagcaaatagtccaaatgatcaccacgggaaaagcacaaatggcgaatatttgccgaaaaaattggccaaatttcacgaccaaaaatgtcccaaatccgctggccttccgtggtgtgtgatgattgaatccgcaagtgtaaattggtgcctcttttgtcgaaaatttggtgatttgaacgaagaaaagcgatgacggagtgatcgatgtaactgaaaatgaaataaatgcttttattgtcatagctctctggtttttaattactcaatctgaaggcatttaaaacggattttgctgggcaacggacggtccggcaacggaaatggcacaaatttgtcatccatccgcacagatagtttcggttctggtcctttgtccttgcgacgaatttcgattgatctccaaattgtcaattcgcttttgccatcgaaatgtttgtccaccaacgcatcgaaacgtggcgaaagaagtgccaatttgaggccgagttgggcatggtcaaaactgggcaaaatgtccatccaaacgtcgttgcaaatccaactgaaataatgaaagtaaattagggcaaataagaaaatggacttttgaaanttcttttaccgtcggttcattttttggt

SEQ ID NO: 19435 - DNA, 873 bp, Heterodera glycines
tcatgaaaatacatttccgggggttttcggggccgctgatcacgaatatgacattcatttcgaccaatttcgaaccccggacccggattcgaacaaaaagtcgaaaatcgtaaattttcactttttataaatgataattttttaaattccttttagcaaatggttaattttggggtccccgatcacgaatctttcaattattttgatcaattccgatttcctaatctaaatttgaacaaaaaatcataattttaaaaattcaaaatttcgatttttattcgagttcgggttagggattagaaattagtaaaaatacatgtcagattcgtgattagcgacctttaaaaccccggataaaaaattatcatggttttttatcttaaaaaaattttgcaaaacaaaagggtccccccttttgtttcaaaatcttttcaaaaaggccaacttttacagtagcgccacactttctcttttttattgccatttgccccgatgtttaggcccgggtgtgctgcagcatcagcaaaagccggagattttcacggcatccagcagctcagcggccagctccagcacaacgttcagcaccgggcggggcagcggctcctccatggctgtgccggtgaccgcggcgggctccacccggtccaacacgccgaccagctcgcaccagacaacggcacggcacaaaaagtgattactgattgactgccgcggggggttttggacgggccgacggacgacgacgacgcaatttctgaccagtcggatcagatcgatggcgaaagcacaatgtgcccatccatgcacatctctcccggttttgtctccagctgctcctgctgtgcaacacaacacatttcggtcacattt

SEQ ID NO: 19436 - DNA, 1539 bp, Heterodera glycines
aaaaaagactcaatgggacgaataaaaaaaagtatcaatgatagtaataattgattaatattattattattttaatttgcaaaataataaaccataacttacaaattagttcaaactattcaaaacattaaacagtctaaaataataataattaaacacaataatcattgatatgtttttaggttcgccccattggcacttttatagttcggcctagcatttcacaaacaatttcatacataattcgtatagattgattattgatcagcaccagttttgttttttgtccgcccatttttcttagaaaataaataattagactcttattttgctcggtcaaactttggatatatttgttttcccacttttgatgctttttcaattttgagtgttgtgcctattctaatgggacctatgcccatcataataattcaccaatgcaaaaatgtttaagcaaattaatttttacgcgacagtttagacactcagctgcagcaaaagagacaaaaaaaaacagcaaaaaataacaaaatttcatgtcaaaaaagacaaagtcaatcaaattttcttaggcgccgatttttctccccgtttctccgcgtctctttttttattgccgggttcagagaatcgagcaaaactttcgtttccgttgcctttgcaccggcggcagtagtgtaacccccccccctccgtgacacgtaattacccccttcttgtcacagcccccatcttgttacagtgcttttacgttttatccccccaacctgtaccaatgcttttacgttttatccccccaacctgtaccaatgcttttgcgctttatcccccgacatgtaccaatgcttttgtgttgttctgtatcaggtttggcaggcatttcccccatgttgtttcactgcttttccaaccattttttttgtttctatttttctattctttttccccattatgtttcagtcccaataactctcatcatcgattcccattgcgtctcatcgattttccgttggtcatttccagtgtttttagtaaacaaaaaaatccacaaacttatttacttttttcttataaaatttcttgtttcttttttctcaatttacattacaatctgaattttataaaaatgtccttctctccaaactcgaattgggacaacgactttttcaccgggcagcaacagcggaacaacaacaacagcaacaatggcgcaacggcgaatagcagcaacagttcctccctcgggtggtgtgttcgtggtaagacatccgaaccaatatacctcatataaaattttttttgttttaattagagcgaatctctcttctcctcctgctcatgcttttggtcaacatggcccattttctgatgatgttcatcgtgctgctgaacagacgttgattcaaggacgatgaaaaaattttattatttttcacaattgtgatcatttttttgagatctctttttttttgatcgcttctctaaaataaaacttagaagagaagaattggttcgtttgtgagcgtagaaggggagggg

SEQ ID NO: 19437 - DNA, 2667 bp, Heterodera glycines
  misc_feature (41)..(41): n is a, c, g, or t
  misc_feature (52)..(52): n is a, c, g, or t
  misc_feature (94)..(94): n is a, c, g, or t
  misc_feature (134)..(134): n is a, c, g, or t
caaaaataaagtataaaaaatttttcgaatgcatttatttntggtattaaantaatcaagtgggtgaaaaaagattgtctaaattagagaattntaaataaataattataaattttttgttacttttttggatntaaaattgaactttcccaaactgttgttccctccccttttagcatctcggcttagccgtgccgttgcctcggttatttccataatatttgcattttagcgccaaacattgggcagaaggggtccaaggaacaaacgttccgaaaatgacatttttaccctgggagtttttggccgggtactgcccccaaggcgctcgctgctcgctcttcattggccacttaagcgggggaaagtgaggggggagaagcggaaaacagcgcccgaggcaattcagttaagccttatggccaaatttgtactggaaaattcttcggaattggaggccatccgtcgagggcgtgccaatgggggaaaataattctgatttaaaaaaaaattatttattcgacgaaaatttgaataatttaaattttttaaaatacaaattctttattttttctatttgaattgaaaggaccaaaaatcggagtgaaatgaacggaaattttgagatatttaaagaatataaaggcaaaaactaatttagtgcctaatttggggactttgcctccccggggaattaatttactgaaaaatgggcaaatttgtgaaaggatgtcaagccaaagaagggaggaacacgcgcgcaatatttcattctcggcacaaattgctttggcatgggaatttatggggggggggagttggtgaaaattgtgggaacagtagaaaaactgaatttgtgaacatattccatgggaatttcaaacgaattctttggccaaaaaaaattttaaaaaataaatgccaaatttgtcaattgagtcgattaactgtccaaaaatgttgttcactttgccactctgttcaattgattgccattccgtccgtccgtccatcagtcagtgccgtgtgccatggggccataaacaggcgaaggcggccataaaacgcaccggtggccaaccataaaattttattcattacaaacaaagtgcccatttaaccatggaaaaagtgccttctttattcggcaaaattatttttttgaaattaaattttggcaaaattttatgcgaaacaatgggacaaaattgaatttaaaaataattttggcaaagcgcgggtggggcgatggattttggggtccaaaaatgttgcaacaaaggcaaagcaatgcaattcattcattgtttgtttatttgtttatggccgcgggggaagtcgttccaatgcgaccactctcaacaattggccgaattcagcagcagcagcagaaggccaggaaaagccatgtcattcaatccaagtgaaagcggcggaagggggcaaacatttttagaaatttgggactttataccggccaaagaaataaatgttggccaagctcacacaacaaacgaacgcatggcaacagttgaagtgatttcgggggagaattaagccacttaaagaggcttacattaaccaaaactctccgccatcccttcgtggccaaagggtggcgcgacttaagacttaatggatttatgcctctgttcaatttaaattcaaatttccgctgaaatttaaattaaatttaagccctttgaatcagagaaaagtgcaaaacaagcgcaaaccgacaaatttctgtaagccttttctgttttttttgtttttttaacttccaccggtgatagaaaaacatcaaaaattttgaagattagcgtgcaactggaaatattttatcccttttgggctaaaatattttatatagaaaatttgagaaaatttttcaaatcctaatacttatttttcattttaagaaaatattttcgtttgtggcaattgccttcttaaacccttaaaattgaatataccataaaccacaatttttttttgttttaaatttatttattaaacattacgccaaaaaatgaaaaaaaatcaggaatcaaaggacaccgaaattaaaagccagcgcactcacaatcagcggtaggctgttgttgaatcacttcttaactttgattttgagcaaaataccatgcgaattcccacaaaatgtacatattcatcatttcctatgactgtgaacgatcgacggaatatttattctttgtaaacaaaaaaaattatatgcgaaggaaagtgtttgctcaggcgaaaatttatatttgcaattgtacaaaagtctattttgcgagaggatgttctttccaagcttttcctggcttttgacctgaattttcgatgaaaattcaccaaattccacttgattttattgctttcaaattttaccatttcaagggttgtaggtaaagcatttgatcaaatttatgtggtaaaagcctcctcagtaatgattcaaaaaatgcgcagttggctgatccgtcatcgtgatcaaaccgcagtttcatacaaccgatttggacggccaggcactccgacaaaataaaattgtttttttaattgaatttttaggggaagaagaggaggacaagcccccgccgacctcaattttagtggcaccatttcatgagaatgctccagagtttatcctgttcaata

SEQ ID NO: 19438 - DNA, 2818 bp, Heterodera glycines
  misc_feature (29)..(29): n is a, c, g, or t
tatgatttttattttttaaatatattttntttgataaaatctaattaaaaagttttgttttcccattttattatgcccattttaattggccttggcagccctttgctcggttattaatatttaaataatttgttaatatatttttttacgtaaagatatttcggcaaatgttgggtcagaattattggacaaatatggcctcaaagaaaacggagctgtgctaattgaccagcaaaacatggacaaatttatgccactgtagcaaaatccaattaaacactttgtctccattaaaaaggcatttaagcgaggacgaaattctcaatttggactctgtcatttttttacccggcggatcagcacttaacacaattcgcgtgttccaatgggttttgaacggaatcaatgggcaaaaaaaagtttaatgatgcgattaatcacttaattagctcatagtttcataaggctgatcgtgcaatatttttcggttcggttggcgatgattccgaagcggaaatgctactcgagaagaccgttgagacgggtgtcgaagcgaaattccaacggattgagggggttcggaccgggaaatgcttctcactgattaatgccacaaatcggtcaattaattaattttattaattttaattgtatttttcccaattttagttcgctttgcgcttgccttggcgctgcttctcttttctctttggattttttgcatttgcccgaaaatgcgaaattaatcgatacagcaaaatttttttattcatctgtgattcaaaaaataaaataaaactaatataattaaaattattaaggcccatttttttacggtttgccccgaggcaattaaacatttggccacaaaagcaaatgaattggagaggccttttttattcaatttgagtgccgattatattcctggaaaattcaaaaaggaattgaacgaaattatgccatttgtggacattctttttggcaagttttcatttatcaaataacaaaattaactgataaacttttttgttttatgtttaaatttaatagtttcccccaatttagctaatgaaatggaagcatttgcttatgcaaaggcaaatgaactcaacccaactgatcatttgcatcaaattgcattgcttttgacagaaattaaaaggaataaataattaataattatttggataagcaattgtttttcttttttgttttaggccaacagaggaaaacggggggcgaattgtgctgattacacgaggggaaaagccgctaattgggcacaaaatgggacaataaagaatttcctgtcatttttgtggataaaattgtggacacaaatggggcgggcgacgcattttgcggaggtttctttttgcgctgaattttgaatgtttaatcattgaatgggcaatttaaaggctttttggcagcattcgcctgtgacttttcgctggaaaagtgcgtgaaattcgcactgtccgcggctgccataattgtacagaattgcgggtgcactttcccggaagaatgggtcggcgaatgccgggagcgaaaatgacgacaaatccaagaaagtgcctaagggacactgaaaatcaatggcttaaaagcaaggatattaccaatgtgaattatgaaatgccaaatttaattcaccgtcttttgcagtattgccaaattgccccccccccctctaaattaattaattaattatatttaagcaaattgtaaattcacttttggccataattgagacagtttactttataataacataaagcagaagcttgaaaaatcatgcccattaaacactgtgtcatttcgctttcgctatttgtgccattgcaaatgcaaaattcggaagtacaaatcggcatgttcgtccgctgctggctccattttttgactgtttttgtttttgcgtctcaagaaatagtgatagaccaccaaagtgatgatggcatgggcgaagagaagccaaaatggaaaatgtaataattactattttaattaattaattcagaaaatcgcaccaaagtgattgtttcgtacgtgcgaatgtacaccaaaatgccaaattgttcacgtttgattcgaatataacccgaaaggatgttgaaaatggagaagaaaatggtgtaggagaagtccaacgggaaaatgatacgcatggtcaaaatgttttcatttgtttgatagtttctgctcagtgaatagtcctgcactttgttggagctttggagggaataaattggtttttaaagacttaaaatattcaaaagttgggaaatgatcaaagcacttggggattggctcagattttcgggatgaactctttttacaactaattaaataatttgtgctttggtgttccccgctaattcctccttttcttttcccccttttttacaatgcccgctttagtcgtcgattcattctgatcaaaaaataatcggcgattgaaatgcaaatgacgagaaggagaaaaaaataatgtgcatataataattcggtggcattgtaacgaccagtgagcgtaaaataaacctaattaataaagcaattaaaatgcaaataaatgatgtattaattaatgagttatattaacaaacaaaccatgggtttctcaaaggtcgggtcgatagattgtgctgaagcaaacgtaaacgcagaaagcaaccaacagagttgccttaacgaattggcatatgacgacaaatatttaccttttttaccactaaagccaaaatgccaacgccgaattatgtgccggccctttcttaattgcgcacacacaacgtgacacggacccttt

SEQ ID NO: 19439 - DNA, 1824 bp, Heterodera glycines
ttcatgtgagctgttagtgttgtggctgttttcatctcgaatttcagtaaaaattcttccaagccaatcaggttctgttggctcttcctcaattttgcataactcaagcgggtagaagcgattctcttgaccctcgggaaagcgttctatcacacaatgcaggaatgggtgtcgaattttaatgcggtggcgaacataaaaatgtgctgacacattgacattgaagggtctccccagtcgtccgtaagccatagtcgttgatgcgccttgcggtgttatgccaccaaacgaaaatgttttggtgtagccgttgcggtcattgtaagttgtttgcacttgtcgtccatacagtgctttgacaacaagttcacaatctgatgggtgattaagacgatcacgaagatcagatacgcgacaattcaaaacttgagcgattttttcagtaagaagcattatttgcgaatataaaaaactaaatttaaaaaaattaacgaaaagaagtaataaagtgagtaaagcagtgaaaaatatgagcgaatattaagctatttataagaattttttgttgtatttctaggttaaacaaacaataaactgtataaaaacggaaatcgtgatcattttattcatcctttattcaaaatacattgaaattaaacaactaaattaataatgtccactccaaagcaggaaaataaatttccaaaaaaacccgaattttgcaaaaccgagcaaggtatgtatacctattttattaattattttaataatattttcaaactattcagacgatgatgaagttgatacggacccttctcctgaagaagttgagaaatggacgccggagcaagtgattgaatgggaccagcgttgctatggaaaaatgcctgccgaagaagagatttggcaagaattcctcgacaacggagaagcgaacgtaaataacttctttttttgtctttcgataattattttattaaaactaggttatacgtgaatttttcggtggaaaaggtgccatggaagttgagaagagccttcgtgaatacgccaagaagaaagaaaagagggatgaaattttgatgagaaagcgaaaagaatacgaacaaaagatgggaaataagaaggacgaaaattaatttcgcaacattgtatcaaaattcggataataaatcagaaaatattcaacattcgactttttgaaatgaagataggttaacaaaccattggcagctataaaacaaaaaaatttttacagttttaattcattcataaatttacaaagcaacaaccaattcacattcataatgcttcaaaacgaggattcctgcatgaacgaaccaaaagaaattccaccaaacgtcccaataactcaatcctggaaactttttcgcccaaaatacatgttgacttaccgcttgtgcgattgtaagttatttatttaaacttcaatatgttaaatttgtggcttaagtctgtctttcggcactttggaacaacaaaaacaaattcaagactaacgaagaacgatcagtgatcagttttgaactctgtgagaagtgtacgatcgacaattgccgagcaaccgacattttggccccattcaaaccaaagaaataaacttgatgagacttataatttcgcatctaactcatatccttcaattaataatatcattatatttgttattaatttttaataaatcgttatttatttaaaaaacctttcaatcgtattaaatatttataaatctcttttcgttgcgccttagtcattattgtttgcgcaaatattgccaaaaaattcgcctctccacgattagca

SEQ ID NO: 19440 - DNA, 2919 bp, Heterodera glycines
  misc_feature (31)..(31): n is a, c, g, or t
aggggaatattgaatttatcaagcacgattntggctaccataaaaagattttttttaaatctccggaagtcatttgaaaattatttgtaaaaatcttttaaagtataatacagaggctattaaaattaagaatagaaaaaataagaacgaatccagctattcaaagattgtcatgtttccaccgaagaaacacatacaacaggcatgaacaagaatttttacaaaaatatatttaattgcttctatctatgaaatttatatatttaaataatttttataattcttatatattataatatttcattgattttatttttaaaaaataatgaaaataatgaaaaaaaattttggtttataaatttaaaaaaataatcatttagaaaaatacctttaaaattttataatttgatgtgcgcacatgacaattaatgccgaaaaaaaatatatttatagattctttaaaatttatatgaatcttagacaattctaaaatataaaagtgcgtttaataatattattgaaaaaaatattcgtaaataaaaacaacataataaatgttttctaaaatgttcgattaaaattacattggaattacatgtcatatcactcattaaaaaaaaaattcataaaaatatttaaaaacttattaataaaattcataaagaatattaaaattaatatttcaataaaacaaataaggaaaaacatatggcacaggataagcaatagaaccatgtgaattcgtcatgataaaaatgaataattaatatttaacataaattccatatcagtaatttaaaatttaataagaaaagtgagggcctatataaattgataaaaatacaaaagtattagaattttacttgttagctacttaaaaaaacaatacaatttaaaaaaaggataattattattctttttgaatatgaatatcaatttaatattaataaaactaatttatttaataagaattataatttttttaaagagaaaaatgaatcaaaaatattcgagaaacataattcaaattataaaaataatttccaaaaaatgaaaataataaattatttagaataaaataaatgaaaaaattaattgcaattgacaaaggagcaagcaaaaaatctggaatgattcaacaatcatatgataataaatattgttaataatactttttgaaaatactattgcaggctcattttataatccataccagaagagaaatttaaaaaaaaattaatttttaaaaattttctaataaagcgatattagctatattcagtttacgcgcttaattattttttgaaacgtcaaaccatttagaaaaattatttattcaaaaataagtagaagtgatttaaaaccaggataatagtcggtttacagaaaaaaaaaattttagttgacaaaacaaaatgatcaattaaaagaactaagaggacagtagaatatttccttcagtatcgggtttatgtgaaaacagcagataaatttatcattgaccgatagattaaaaggtaaatattaaaccaaaagcagaaaaattataaattgatggatagatcaataacaatcaaatacgaaaaataaaaattataaatgataattaaactgtaatatataatttaaagtagggttggtcgggaccgggaattttgggcaaaaccgggaccgggtttgtttgcttttttccattaaaaatcgttaataaaaaattttatttacctatttcatggttttgtacttatttataattattttgaactttttttatacctatttaaatacctatttcgcgatttttcttgcctaaatttcccagccctaatcataaactacaaaaaaattgcaagaattgtactgaaaaaatacaaagaatgacgaaataattattaaatataaaaaaatcccacaaaacacgtgtttgaaaaataatatatatttttttaatatatacaaattaaatatcatttttctttcatttataattacgtacaaaaattaataatattataataatactaaaaagtcaaagcaaaaatgaatgacaaattcttttacgagaacttgaaattgaacaaaaatatttcaaatcgcaatttcataattaataataatttatataaatttaaaaaaaaagaaaatgtactgaaattttatggagaattaatttacatttatataaacttttaaaaacaagaagaaattaaatagatataaaacaaaaatcattaagaaatgtgggtcttttgttccaatgagataatttttgagcgcattgagagttaccaccaaagtttgcataattaaataggattttaaaaaacttttgcatactcagacagataaataagtgattttataaaaaataaaattgaatgatattgaaacaaattttgcccgaaaaaaacaaattctaatggcaactgattcttttaaaagaattacaaatgatagatgaaatttgaaggaaaatttgaactaaataaacaaatctatctttaacatacgaattttaaaatacattttctctagtatcaaaagattaaaacccaaatagaacttttacacgattaactttatattttcatattattatggaagaaagacttgtaaatctgagtgctgagccgaacctaaaaaagtatcaatgataataatatttagatttaattattaaataataaatgacaacttagcttaaacttagtcaaattaatgaaacttggtattgggaaatagctctatgtattgtcttcaattttaggtaattaaaaaatctagcaaaaatttttacaaaaagttgtaacgaaaaaattgcaaaaaatgtagactcaatattttgtccctattttaaaactcatttaaaaattaatttaacagaattatagagaactctgggctatctaaacatattaa

SEQ ID NO: 19441 - DNA, 2465 bp, Heterodera glycines
ctcatcccgtgttcatcacacgttgtggtttcgactttcagtgtgaatggtgcgaccaaagaatggatatggattccattacaagtcaatggccaccagatgaaacttgcagccgattcgtgttcacatttgtcgatcatacagcttccggtttggcaaagtttgggcgaaccgaggttggaaaaagttggtaaattagtgggttccttttcgggccacaaattgaagttgttgggaagtttcaaatgtgacgttctgttcagaggagtcacaatgcggcttgaactttcagtggcagacaccgaagcgccgagcatcatgggattggattggatcatccctttcgagcgtgccacccaacagccaattgccacgactttggagcagcagtcgcccattgtcaacagtgtgcaaccaacaaatgatccggtcaaattggaagggcaaatcaaggcttccttcccgaaggtgtttcaacctggcctcggacattgtgtgaagacgaaggccacgctgcatttgaagcaaaatgtgaagccagtgttctgccgtgcgcgacctgtgccgcatggagtccaagcagcagtcgacgaagaattggaccgacttttggactcgggagtgctgaagcccattgatttttcgcgctgggcagctcccgttttggcagttcgtaagaaaagtggtaatgtgcggatttgcattgacttttctacgggactaaacgatgcgctggagttgaacaggcatccccttccgcggaccgaagacatttttcatgctctgcgtggagccaaagtgttttcgcagcttgatttgcgtgatgcttatctgcaggtcgaactggacgaaagttcaaagcagttagtcggcatcaacacgcaccacggactttttcaatatcagcgtcttccttttggcataaaatcggccccgtctatttttcagaaagcgatggaccaattgacgtccggtattccaggcgtgtttgcctatttggacgacatcatcattgcttcggccgatcactcgcagcatgttgctgctctcattgaactcttttcccgaattcaggactatggatttcgagttcaattggacaagtgccactttttgaaggctgaattgaagtttctcggacacgttgtctcgtccgatggtctgaagcccgatcccgctcgatccgatgccatccgtaatatgccgtcaccgcatgacattggcactttgcgctctttcctgggtgcgctcaactattacggtcggtttgacaaggaaatgcgcaatttgcgtacacctttggatctgcttttgaagaaggacactccttggttttggggtcctgatcagcagaaggcttttgatcaggccaaacaggttcttcaattggatttgttgctgacgcagtatgatccgagtttgccgatcattgtcgctgcggatgccagccaatgtggaatcggagccacgatcagccatgtgtttccaaacggagtggagcgcgtcatcgagcacgccagtcgaacgctcactcccgctgaacgaaattacgcccaaattgaacgtgaagctttgtctctgattttcgcggttcaaaaatttcacaggatgatttacggtcgtaattttactctgttaacggatcataagcctctcttggctatattcggtaataaaaatgggatcccgatctacacggcttcccgattgcagcgttgggccctaattttgtccaattacgattttacaataaaatatgttaaatctgcaaattttggacaggccgacgttttgtctcgattgatttctgagcaccggacagacgaagaagtcattgtcgcccacacatcggacaacgacgtggacagcactgaagaagtcgaatatgctcttcttgtcaacttggagcagctgccagtcgatgcaaaagaagtgagcgaactgacgacttcggacgatttgttgcagcaggtggcacaattcgtacgttccgggtggccaaacaaatgcccagctaatgaattaatgcctttctattcgagacgtgatacgctcaccctcgtgggcggttcaattttgacaggaaaccgagtcattgttcctgcgccgcttcgtcaacgtgtactcaagacgttgcactttgctcatcctggcattgtgcgaatgaaggcgctggctcgcaaccatgtcttttggcccggtcttgacagtgacattgaggcaatggtaaagcattgtgcggaatgtcaattcgccgccaaaatgccgccgaaagcgccacttcgaccatggccaattcctggtgaagtttttggacgtgtccatattgaaattgcaggaatgcgataacatttatctcagctagtgtgataaacttttataatacacattaactaaaatttattaaacttttgaaaaaatatttaattttaagtgtgccttttccactaataatttaacaaagt

SEQ ID NO: 19442 - DNA, 2966 bp, Heterodera glycines
gcgcttctttccttcgttggttttgctcctccggtgataacggcctaaaaacggacggcattttgaacgggttttaaacactcagaaacgccaccgtcgttcgttcgcttctcactcacccaacgcaactcgacacaatacaaccaaaagcggacatcgcacaaatcgggccaaattttcgttcgtctttcgttttgctcgttgaaccgcccccggcaccgtctcgtccccattaattggacatcgcttcaacagccaattagcattataatgcccatcgttttccgtctccaaagtcagcttttccctagttagttcgttcaccacttcaaatggcacaattggcgttgcgacacggagcacaaaacgaatggcgtaactggcacgagtggtggtggtggcacgaagaaattcctaagcaaaatgaaatgaagaaatgaaaaatgcaatttctgatatgatcagtgatcaaatggctctattacagtttaaacgacaataaaaaagaccgacagtaaaataatttgacaattttaaagcactataacttcttcaaaattatcaaaattaaacattcttggcagcatttgatagccttaacagtttcagcaaaatttcaattatttcgttatttaaaaaaaattatagccagaaacatcaaaaaatcggttttcaaaaagctttgatcataaatttttgaatcttgagtgaattttttccaagcttagtagacagagaactcttggggctaccgaatgatgtcaataatgtttaatttggatgcttcttgaaagtgttatggtgctttaaatttttccaaattattttatggtcgtctctttttttatagtcgtataaactgcagtaaatccaaaatatttgctgtatcgacgacgacctccttgaagtcgttgacccatccactgttccgtaatgaattgtaatctttgcaacacaattgcttcggctgtccattttttgtcggagtgtgtaaccattttgacaatgcttggccagcagttgtgtttggcacatcgtcaccgatcaccgcggggaacagatcaccggaattgatcgaaatcagccgcttcagatcgcagagaattgttggcgagatgtgatgacgcaaattggtcagatgagcaccaccaaaaaatgtcaagcggcaaatgtttggcgcaaaaatgggccaaatttcatggaccaaaacattccaaacgatcggcatcacttcgacaatgcgtaagcacaaatcggtgggtttgtcaaacactttctgattggaacgtagaaatgagatgacggtatggtcgatgtacctgaaaagggaatacttttattttaaaaatgtttggattttttttatcattttgaattacgtaatccgaaggtcctcaaaccgaactttgttgggcaacggtcggtcaggaaaggcatattgtatagtagaatctcgataagactaaaatttggttaaattttcaaaaaagttttttaaaaaaattgaaagcccgctgattatagatctgaaatctgtttcgccgatgtcctaatcacggacccgattcagcaatcgaggacccttttttgatcaaaaagagccatacgaatttgggaaatttgagctcgactttgtgggttaaaatttagtcgaaaggaatgtcagattcgttaccaggggccttgaaatggactaaaaagttatcgtataatttttttttttttgaaatttcaacccaaaaaaaccagttccgagtaaactggtgataaacaagtaccgagtcgtcaccaataaccacacacagttttggtttcgcaccaaaatctttgtgaatttcgatagtcctccaaattttcttttctgtgccattgaaatgtttgtccactaaaacatcaaaatgaggcgaaagaagtgccattttgaagccaagtcgaagacggtcaaaaaatggcataatgtccaaccaaacatcagtacaaagccaactgaaattattgaaaattatttacggtaagaaaatgaaattccaaattttttaatgcaaaaattttctcacattttccttaaacgccgctccattttgctacacaaagattagttaatttgtgtatggtatttgtaaatttgtgaattttttagacaaatattttattttataccgtaaaatcgaagaaatttggaagaaatgcgaaaaagcacaaaaatgaaacgaatcatttttgcctataaaatggcctttttcttcttcctcccctttcattcattcgctcataatttccccccgatcattttattgccgtaatgtcttcaagaattccgtacgtttttctttttatatcatatagcatttcattaagaaaaatttggccagggttgccaagattgaaattttcagtgaatttcataattttatttgagtaccgcatcagtcggccccactaaaacttcaaaataaaactaaatttcacatttggctttcctggccttggcactttcctttgctttcccattccattcattattcattttatttcccaaattcgttttcagttggtacgccgtgtctcttctgctgttggttggctgtggcaccattctttggttcttttggaacaacgtcaaaaaacgacgacgccccaacaaaaaagaaatgtaaaaaacaaaaataaatatataaaaatcaaaaaattccctttttcagcttcatctccgccgactgttggctcgaagtgttcgctttacttccgccttctcagcttggccttggaatcgctctgatcagtcgccgatttgaccgccgcgtggacgaacatttcaaaacacgcaaatggatattggacaaagaattgcgaattcaggagaaaaagcgatggtttggcgaggaagcaaatggaaattgtcgatgccaacggagaaaagccgattgccgaatcccacaaattccgttgcccaacgaagtcgtcgg

SEQ ID NO: 19443 - DNA, 3081 bp, Heterodera glycines
ttttagctttgtgcaattcgtcgccataattcggaaattgcatttcacagattgctttttgtggaagaatcgaagagggaggggaagggacggagagaagggaggagggatatgtccgttctttggcatcgggggaagtgccgggcaaaagaatggcatttccatgaaaacagagggcaaagagcagaagggaaattaacaatgttagtcattcaatttattcatttataaatggggtcaatttgttgatcaaatttccataattcgaccaccacggcgtatttcccaaaaatgccatcgtatttctaagaaatttttgggaaaacggtggaaaggtgaagaatatgaaaatgaatgaatggcaattttatcagaatttcagtgataatttccatttattcattgggtggcagcatgcaattacaaacagtgaaatcgaaggcacagtcaaagcccatggcaacgagcaaacaaataaaaaaggcgtgccaatgagaggcttaaggccgagtccgtttggacctcacagagggaaagggagggagggaaaaaggagggggggggggatttacgggggtgcccaatttattaatggacaaagaacggtcttctgagatctaagaaatggcaaaagaaaaactaagaggaatgagtcggatgatgccatgcgaatggagaacaaataaaactacaaaatgacgataacagcgggtcgatgttggggcaattgggtaggaaaatgggcgaagagacggcacaaaatgccggaggcattgtcctttgggccaatctttcgggacaggtaagtgcaagtaaattgtgggcggggtggcaaatggagcggcaaaaatgggacaaatgaaggggagaggggagacattttgctttggagagtttgccgagtgcaattaccaccttcacattccaaggggggggggggaattccgtgccaaaaagagcgggggagggggcggggaagggactgaccacgagtggccggccacaatgccaattgggcaaagaatgaatggcacgattggcatttaatggaaaagtgccatttggaattccttttgcttcattttttttgtatttggccaaaaaagagttcacagggcttaatttaaatgaaaggaagttttcgttaggctttcgccaccctttcacttcaatggatgggacggataaaggcaatgtgagaaggtgccatttggcataagaagacatatcgagaagccctcgggggagagggagcggaggggaggggagggaacggcgataattacagcgaggagaggaggaagggaaagggagaaaaaggaggaggagagacagggaaaaagagggaaagggaaaagagagaaagggaaggaggtaaagaaaggaaaaagagagaaagggatagaaaggaggatgaaagaaaataaaaagaggaaagaagtgagaggaaaagaaaagaaaaaggaaaacaaaaatgaaaggagggaaaaagagaaggacaagaggaaaagaatagaaaggaagacaagagtctcgacatgtcgagaggtgaaggagctccaattctttgttagaaaatattatgaatttctgggcataaatgtaattcacttcaacacgcgaagggccaccaaatgaaaggcagcgaacggacggaagcactcccttaggcaattttaatttgataaaacgggggggggggggatgtcattcctcatttgtgatatggaacggtatttgtaatattattcgtaatttggaaaacccgggaaaagggaccaaaaaagggcattcattgcactcaaatttgtcttctaacttctttttgagtacaaaaacgatgatttaagcacaaacaaatatttttatttgaagaattgaccaaaaataaggagaatccaaagtaaaatgaaatggaggaagtgcaaagacaaatacaaaatgacaaacaaaatgggaaattggcaaccaattccgttttgttgaagtcattttctgttctaaaatatttgagttttcgaaaatattataaaacaaagcgaaatgggagatcgaaaaatgatcggagtacgcactttattggatgaattggcgaaaaccctcatcagaaaatcaaatggtcacttgggcacccaaatcgtcatcaatgtccgcactgtccccctcgtcatactcgaaatcctggagagagaaaacagggttacaattaaaaattttttcacattttcgtttcaaaatcaacccaaatgccacctcttcgtcatcctccagctcgtcgtcgtactcgtcgtcatacggactgttgaggccgtattgcgttgcgtgtggcatttggccagtgccgtcgccgccttcagtcatactgctcacggcccctctaacgcgctgactttgagacggattttggccaattggataaatgtgacggacgacagttccggcgggacgcaaattttccatttgagaggaggcagacgaaaggttcgaaggatgggcaaccgtcgcaacgcctccagcggagtccccagctgcagaaccgatgccttcctgctggtggtggtgctccatcggatgtttctgctctccctcgcctccctttgcatggccattgccctccacattgttcttgacgaggtgcaactgttcgtgtttgaacgaagccatcaatttttgttggatttggtctaagctctgctcgagctgtttaattctataagatgggttattgaaggaagctaatgtaagtaatgcttttgactgcaccgtctgtctttcatttcctgcgcggccgaatgggtcaactgcaaatggccgacgtattcgcgatgagaggcgatgagtttgtcacggtcgtcagcggcacgagataattcattcttaaaaagaatagattaaggagaaaagaaaactggcacaaccagaagttggtcgatgatgtcgttgaattgctgaaccgacgtcccgtgcacaatgctgccccgataattctccaattcgcggttgattttgaaggattcttcgctgtaagttggtggtgcacagagactcagagagcgaaacccggaagaaacattcgacggg

SEQ ID NO: 19444 - DNA, 1444 bp, Heterodera glycines
  misc_feature (1367)..(1367): n is a, c, g, or t
  misc_feature (1401)..(1401): n is a, c, g, or t
  misc_feature (1434)..(1434): n is a, c, g, or t
ttaagcttttttctttggcatccaaatccaacaatcttggtatcattcgaaagctcttaacatgctctattagcctttcaaaaacgaaaagtttttcaagcctgtaaaaattttattaagaaaaaacttcaaaaatttcgacttttcgcaattttcatgcataactgttttgataattgtctaatcgcaaagcaatagcttagaaaaagcttctaaatagattaagctttcgaacgacaccaacaatgttggatttggtttacaaagaaaaaagttaagccaaaaacatgctggcgccgaaacgcagtggacccgggaaaaataccacctaacaaataacaaacatttaaacattttttaaaattatgcgtctctaccgcacatattagaagggtccgtggaaacagagaaagagaaattatgaaaattgctttcagaaaaaattgtcaaatttattttatcgcctcttttttttatggtcgtgtgaactgaaatagagccaattttcctgcattcgggccacctaggaattccttgaaattttcaaaatttttgccaaaaacttaatctgtgcttgtttaaaaaaggattttccaaatcaattacatcaatcaattgaaaaaggccaaagtgtgctaattgcagcaaaaatgaacagacggcaagcaatttaaaaaataaattacaaattttcattttccaaatttttttttgccgtgtttcagttggatttgtaacgacgtgtggatggacattcttccatcttttgaccatgctcaactcggcctcaaaatggcattgctttcttatcgttttgatgcgctggtggacacgcatttcgatggcaaaacggaattgacaatttggagaggaattagtgtttgcaaggacaaaggaccaaagccgagactttctgtacggattgctggcaaatctgtggattttccgttgccggatcgtccgctgcccaacaatgttcgatttcagtgccttcagattgagtaatttttttcaaaattgtttatgttaaagcattttttattttttcagatacattgaccactctgtgctcacatttctccatgccaacaagcacatttgggacaaaagtggcaccaatttggaattgactctgtgttcaagcgataatgatgatgagccgatttgggatgttttggcgcgcgaaatttggccaatttttgcaccaagcattcgccacttgggctttttcgatgacgaacaatttgacgctttgtgccgtcgcattttaccgacaattctcactgatcttgatcaattggtatcaatcaatttcgatcagctgatacttgtgattgctgatgatggacagaatggaacttctcctnggcaagtgttgtccgaatgggtgaacactccganaaaagacgggcaaccgaagcgattgttttgcgnagattttgac

SEQ ID NO: 19445 - DNA, 883 bp, Heterodera glycines
catttgattgatttctctcatcagagatgcttttgttgaatacacaaaacattcaaaaaaaaaaaattttttttatttttttgcggtttttggcacatttcttccaatgttggtgatattttgtcttcagctaaatacgtgcctgatcctgtcatgaaaaacaaggcaaacaaagaatttgcgaatgtttcatgcttgattttcttccttttaaaacatttgcccaggtgatttcgccagtgagtgaattcgccagtgagtgaattcgccagtgagtgaattcgccagtgagtgaattcgccagtgagtgaattcgccagtgagtgaattcgccagtgagtgaattcgccagtgagtgaattcgccagtgagtgatttcgccagtgagtgatttcgccagtgagtgatttcgccagtgagtgatttcgccagtgagtgaattcgccagtgagtgaattcgccagtgagtgaattcgccagtgagtgatttcgccagtgagtgatttcgccagtgagtgatttcgccagtgagtgatttcgccagtgagtgatttcgccagtgagtgatttcgccagtgagtgatttcgccagtgagtgatttcgccagtgagtgatttcgccagtgagtgaattcgccagtgagtgaattcgccagtgagtgaattcgccagtgagtgatttcgccagtgagtgatttcgccagtgagtgatttcgccagtgagtgatttcgccagtgagtgatttcgccagtgagtgatttcgccagtgagtgatttcgccagtgagtgatttcgccagtgagtgatttcgccagtgagtgaattcgccagtgagtgaattcgccagtgagtgaattcgccagtgagtgatttcgccagtga

SEQ ID NO: 19446 - DNA, 900 bp, Heterodera glycines
atttttggcatgtcaaaagattggaggaacggagctcacaaggggaaaaatggtataagcaaattgaatgaattggaaatttacaaaaagaggggtcacaaaaagaaagggacagtcggccagcctcaaaacgacgtttagcgaatgggacaactgagtagaaattccgcctttgttgggcatttgcagaagcggcgtttccgtgctcaacaaaaggtgggaagcatcgcggaaaatgctcgaaagatggacaacactttcctaacaaaggaaaaccgaataaaatgattaaaaaaaagaaaaccgactcgaagaagttgtgtaaataaaagcatcagcgaagaagtgacggtgccgtcattatcattgcccagggaggcaaccaacttattccaggtttgctcaacctgaaattggccatcatttttaaacaaagaaagacaaggacagagataccgagcccgaaatgtgatgactgcactccaaaggagtcacagttacgtcgttgtcatgcgcaacagcaacgacttcttcaacacgttcctggggttgttgtggctgtgcatcggcaacggaatggagtcgttgttggatggggaagagagaagcaaaggcaccccctccggtggtgctggtgatgctcatccgttcgggcgtactgagcgaaactgtgcggaaattcattaccggggaagaggtgcccgtctcctcattgttccgttccgacaaatgataatgctgggacgaagagacggccgacacggcggagtctgcggcagaaacgttgctcatcgtatggggcagggaatgtggtttctgttgctgctgattatggggggaagcggaaggactcgtcgcttttttgtgccgcttctgccattgacgtttgttgtgccgctg

SEQ ID NO: 19447 - DNA, 1545 bp, Heterodera glycines
aggggacatgatgacacactgtctctttcggcttcttcgtcttcgtcctcctcctcctcttcgtcgctgtgccgtgacaattggactggcgttgtgtccgatgagacatcatttgaatcgctcactggaatttcaatttttaaattgattcgtaaataatcagtcacttttgctcggaggtcgtttgatcactgttcctcctgcatttgctgtccctttcttttctcctccacccattgcgacgccattccgacaacttttgccattgttgctgcccatcgaatggcgcgaaccggtcattgtacgcggcgacgagccaaagttgccgatgcacgctctgttcgcagccaatgcactttggtggtccatctcgtcctcctcttcgtcaatgtaaaagtcgtcttcatccggcacatcctcctcctggtcttggttcgttccgttctgtccgtccgtatcctcgcgacagactccacaacgcgctgttctcattgtggacaaccaattgaagcaagactcagtggactccgagacggagtcgtgttcagcctcgaggaagtcgaactctttgaacactcgcgggaacgaatcggtggttcgtaatgatgccaattcgccgccactattcgccccgctgttattgcctcccacaacggcactcatcaaactgtttggactcgacatgcgatcaaagccgatccctcccgacactcccatctcatcggacggttgctgttgggaccaagcggaagggtgagcagtgtcagcggagtcgggtgagggcaacattgaagcaccattctgacagattgccgagctttttgctgccaaaactgttgtctcccgcactctttggtgaatgtcactggaagaatgggagaaaagcatctgaaaggataaatgagaaattgaaagaattaatctgtgagatcagatcgaattgcaaaggaaacgaaaacgaaccgaagaatgtttgggtgatcgggcacgatgtccggacgccgaaagaacagagataagtctatcgcgaaccttcaaaagttcagagtaaagggaaactggcacagttttgaattgttttactctgtttttcgttagcctttcattcttcgctgttcccatttcagcactttccttcgcaaaagtcctttcaaaatgcaactcaaattcgggctttcgcaatgccgtggcattcttcttaaaatcaaatgggccatttaagatcatatacataaaaaagagaaagggagaccacctcattttgaatcaaataattgtatgaaatggaattccactgatccgtcacaattttgagtattttcgatgcttcgcgtccgtttggcccgtgaatgtgtttgagaatcacccgaataaccttcaaagaatggtcaaaaaatcagtctttgtttttgagaattttttacctgagaattgatcatttctggcggggattcgttgtaattggcataagtgaacaacaaatgcatcacatccaacagaacggaatggaaggagacagaacaattctccaaccatctgacaaaa

SEQ ID NO: 19448 - DNA, 2518 bp, Heterodera glycines
  misc_feature (68)..(68): n is a, c, g, or t
  misc_feature (176)..(176): n is a, c, g, or t
  misc_feature (387)..(387): n is a, c, g, or t
  misc_feature (454)..(454): n is a, c, g, or t
ctatcgcagctttcctggatccggaagttcgcatcatctttcccttcgcacaacaggaaagcagaaanagaaaccggagcaatccttgcaacagccaagcaaccccaacaacagagaacggagcgacgcgcgaaccggcacagcacgacgaacgccaaaagacgacgggcacgaanaggacgaaacaacgaacaaccaaacaaacagcaacgaggaacaacagccgaagaacgaccacgcaaggcaacgcgacaaagagacggacgcgacacgcaacccgcacaacaacgaacgcaacaacacggagcagggcaaggacaagccggaacagcacaccacggcaaggacagaagcccagggcgcgaagaagggcggaagagaaggacncaccacgcgcaggcaaaaaggccagagcgacgaagcaaacacacggaggagacgaggcgccagcgcngagacaacaccccgcaagcagcgcgacagagagcgcccaagcacgctggcgtatttgctcaatcctaccgagtgactcttctcagcctcgttggagtacgcccgcacccgacattccgacccaccgtttctaaaccactcgggatcgaagagggaatgccgctgcgtgaaatgccacgaacccccaaaccaccagcgcgcagggcagagcaccgatccatgtcaccaatcaaattggacacgatcaccagaacggctcggtaccaacaaccacgaacacagagccatctcgacctcacagaagactcgccctttgggaggcccagacgaaaagaattctgacgggcccatctttttcacgccggaatgtcggaactctgggattccgactgccgatcaattgatcagcagaattgaagaaaggaagtggcgacccttccccctccctttcacatgccccgcgcaccccgttccactcctctgtccccctttccttcaaattgtcaattgtttttgtgtgttcctcccccactccgcgcacaaattaatgaccaatttgtcaaaccgcaacttttcgccgccgtccccaatttggcgaatcgactccaaagaactatgaacccccaaatttcccgttttccgcccattttgttcatctgttcatttttgtcccccgtttttcatttcgtgcccaattttcggcccattttcgttctgctcacatttgccactttttatttaactttattgttatttaagcggccaaaaatgtcccccaatttcacaaccaaatttcatttggcaattttgccgtttctctccccgcccctccatttgcctttaactgtgatggccccccaattttgatcattctttgaaccccccgattgttgatctttgatctatggcccggtgccctccatttctgtttctcccggtcccattcattgatttctgtgatttcccatttgccccagtaccgaatgcttcctttctgaaaattttcctgtcccatcccggtccccaattcatttgtgattaatcccccggtgatggcattttatctgtgatcaattttgtgatattttgttcaccatttttaaatttttgtttaattacccaagtttgaggcttttttcccggaataaattttgcttaatcaattctcggcgtttgatttggccggtcctcgtccctgcctgccccgaccccgcaccggtagaattcacatttggcccgacccagagcaatcgggacatttatttaatttatttgttttaaatagtattttttttcttttggttattgtaaactacgctttcatttttcttttctgaatttgggtcgtattataattcaaaaataatgtttatgtaatacagataaattaattagtaaatgatgttaattttaataaaatttgaataatattttactaaaaataatctattgatcattttctttgtttttttgtttttaattttaaattaattaaataaatttactttaggtctaaagcaagtttttttaataaattacgaattacattttttattttgcattcgccgattttactttaattattatttagtgtttaaataatataaagtttctaacttatttttatgctatttttaaaccagatgttcattatttgagaatttatttttatataaatttaatgttaattctttactattattacttaaggctatttcatttatataaattattataataattaaattgtattttttttttgttttttaaataaatgattttaagtaaatataattttattagatagcattaaattattcttagttcataacaccaacggtttcagaaaaatttggtcaaaagcaaataaattttatttacatatatatattaaattattatttaagttaataaagtagaaatgaattaaacaaattaattaatagatgtcaataaattaatttataaaatcctcttgaatcatgggttatgctgtggtcatttgcgacacatattattaaaaaataagataattcgttttaaaattgaaaatttttatttttat

SEQ ID NO: 19449 - DNA, 1181 bp, Heterodera glycines
ggggggggaaaacacgaaaaacaatgaatggcacaccgatcagtgatcgacagagggatggaccagagaagcaatttaccaaaagggagagagagagagagggagggacagagagagagagaaagaaagagagagagggagggagagacggagaaggggtgagagcgatgggtggaatgtgagaagaattttaaaaaacggaactcgactctcgacttcttgtgaggcaacgatcccctgggcggcataccgaaaggttttcttcgctaattgaagtggggcctcgtaaaaactgtgggtgataaattgattaccaaacactaattatcacctcattatcgtccttttactattttttatcgcttttatttccctgcccatcggctgaaaaacataaaatgtctaatcgaacaaaagcaaaacacaaaacaaaaacaaattcataatatgataataataggaagaagaagtgaaattcgtacgatggcattgccaaatgattttttttttgcccccgtgggaaggaaagggtcactgactcattcattttcttttccccgcagggccatttttgggcaaaaataaacaaaaaagcgactttttggaggtgcgaagagcgaaactttgcgcaattcaatactaatgacctaaggaggagaagaagaagaagaaacagaaggaataaacttacaattagcataaattaaaaaataataaatttatggaaaatttaaaagaaagacggagagaatacggtggaaaagagagaagagaaaagaagcggcacttaaaagaacaaaaattcaaagtttgaaccatctttttcccctgggggagcaaaaattatgggggaaaagcgtaaaataaaaaaaaggacgcggaaatggcagaaggatttgttgaattttggaggcaataaaaaggcacgagcgcgaatttgggggtgggaaatgtgtgaaatttctcggaggcctccccacccccgggggccaattgggcgttgtccccccgggggacggacggatgtccgcacgatttgaacgacgacggtttgcatcaaattaacaattttatgcggtgggaatcgcggggatttgtgaaattaaaaagggcggacaatgggagaaaaagcgaagaaaaatggggaaaaatgggggggggggaaaattttgaaaaaaaaa

SEQ ID NO: 19450 - DNA, 1761 bp, Heterodera glycines
caatgaatgccaatttccccccccccccccccaaaaatccctttggtcgcttcttctgattttttttctttttcgccataaaattctttgcaaaatcatcacaacttttcgggtgatatcacaaaataacaaatgaataattaggttaatgaactaacttatttgttattacaatttgtcctcaaaatggtcgcatcggaggggcgccacaaattccgtcacaatccctgaaaatgcgacagataaagaaaatcattgatccggcactatttcaaaaataattaattaataattttgaattttgcataattaacaaaataattagtgaattaataaatgacttttggccgccatttgcgtgttaatttggccattgctgcgaatgaacggaagggagaagcaaacactgcgaatgatgagaaggagcagaaacagaagcggagggaagaggaaaagcagagggaaaaggacagccgaactcggccctggggaaatgccaaaggacgaaaattcaaatgattccattgaatccgacgattgccatggcctcccccccccaagcgatccatattttgctgatacatattccatccacttccactcactttaatggctccgctgagatcattttgtccgttttgtccgcgggtgcctccggcaccgccgccgcgtcttcgccgagtccagcagcaaaggtgcggacacgttgaggttgaggactgaggacgggcgtcgccgtactgctcccgacggggctccacccatcggaggaggaaatgccaaaggaatgaccctaagatatcggaaaaggacggttatatcgtaggaacgaagggtacggtagcatcaagacaaacaaatgaaagtccgttagttttttacctgtcgattttcatggaaaatgtcgccgaacatttcgaagaacaaagggtcggttggacgagaagaagcggtgggaaaagtgtgcaccttttggatgaattttcaaaaaaaaattgggacatttggccaaaccattcgaatattttcaattaaatcgcgggagagaagctgaaaaaggaaaagcgaagtcaaaccaaaattaatttgaaggcccaccccccaaaatgaccattagctttggcaaaatatgaagcaattttgcgaagcgcagcgccgcgtcggagggaagggacgcggaacaaaacggaggcaatctctggggagaatgctaaaagggaaaaaaggaagaaattaggggaaaataattgagaaaatggcaactaattaaaaaggcaaattaatggacgataattaaggaaatggtaattaatgaggcaaaagaaaaacaaagagagaataatgaagagaatgtgataattaattaaccaaaaataaataaaaataaatgaggaattaattaaaaaagagtttcattgattctgaatttattgttgtgatttgtttcacattgtaaagtgccgagtgcacattgtccctgaggcgttccacaaaattttgcccggagacggacagcaaattgccccggggggcggcggggctccgctggccctccaaatcgccaattccgttggaatccatggccaaaacgatgatcagctgagataaaaggaagttggaagaaagccaaaggaaactaagggccaaaacggcacactttgaccatgacgaattcctcctggtccaaggcaagttcggtgagaacgcggaccaacgaataacgcaacgggagacaatttgttggctgaggaaactgtgaga

SEQ ID NO: 19451 - DNA, 1038 bp, Heterodera glycines
tttcttataaaaatctttttttctaagattttgcatttttccgagttacagcgcgaggttctcgtattttgcaaaaaaaaattcctaaaataactattcttttttcaaaatcgcaccgatgccacgggaaaacaaatcaaattttacagccaaataactttttccaactttcattagccctcccctcattgcaaagtatttcttacaattaggctgccgtgttggtgctgagtgtgttgaccggcggtgtgtttcggctgttgctccattggtacccggaatggttcgtccgactgaccgcctccaaatgcgcactttcccggtgcgaccacgtgttggtcaggtaatgaatgcacgacaataactcgtcccccatttaaaattttcttagaaaaatatttccaatatttttttctgcaaaatttctaattttattttttttttaaatttttcggtgtgtgtagtgcaccatgaataaaaagcggcgttactttttcaaaattaaatctttttatgccgtttccatttatgtcaactttttggtactaaatttttcaaattgtttggtactaaatttttcaaattgcttgatccaagcagtgccatcagcgaacatttaatatattttttccgaaatttcttttgagaaattaaaaatatgttatttgacagggacgaccaccaaaacgtcgtctttcggcccgttcatcggttggaagccaaacagtgcggccaaaaggaattggcacttcccggcggtgccgggcacacccttttggtggcccaacttcgcttcttcacttatcgcaagctgaaatacctgtggcatccgcacaaccggtgcttctccaccatttcacagttggaatctgatgtaaaaaaattttttgtttggtgtgaaattcctacaaaaatatttgagaaattccaaaaaaattcgttcggcatttcctctcttccgacatgaaaaataattatttggtttttcaggtttacccaaatctgaaaatcgctgggtatctctgtaacatttcatgt

SEQ ID NO: 19452 - DNA, 1809 bp, Heterodera glycines
  misc_feature (1802)..(1803): n is a, c, g, or t
attaaataaatgtatttgtggtagagttcgaaaacgctactggttttgagttaatctgacttgaaacttaacgaactttttgaatttagtaaaataattgtaagccacattgagtttgtcgaaaaaaacactaacaaaacgacaaaaaaatgatcccaaaaaattatccggggatgttttttggggggggggggggtggaggggtacaccgccattttgccaatttccatcacccttttctcagttgcccctttcgtacttccattccgcgtccaccaatgcgcagtttggtctgtcccatggcgaggcggcccagcgtatgcacacgtacgggcccaacctgatcgaggtgaagctgaaaccgctggctgtgctgctgttccgcgaggccatcacacccttctacattttccaagtgttcaggttgggctggggatgggataatcatttgcagagggaatttggggatcaattttaccaaaaatttgttccactatgaaaaattttgactgttttctggttgttcgacattaaaagttgatccaaggaagagaaaaatccattaaaaattataaattgtaaaaaatgtattttttttaccgatgcatattttttagtgtccacattcgtcgtcactcattcccaaaattttttttttgttttttttcaaaatttttgcatttaaaaatgccgtcccactcaaaatgcctttccctgccccgtttttgcagtgtgactgtgtggtacatggacaattacgcctatttcgcttcaatcattgtgttaatgtcggtgatgtctatttcattggatgtctatcaaatgcgaaaacaggagagaaaattgaggtaaagccgccggagggggtgggggttagaaattaaaaattcaatatgtttttttttcaggagcatggtgcacacccacgagccggtgcatgtgttgcgcgatggtggccaagtgttggagttgtccagttccgaggtaacacatatattctttggcaaaatttttaaaaatttcaaattttaggattttgaaaaactgaaaagtttcagtttagtaaaaacaaatttaaagaattttttgatttttaaatggatttaaaaaatctttgaaattagtgcgaaagaaatctattttcaaaaaaaaaagattttttaatatttttggtgggctgctgctcccctttcctcggcctgtttcaaagcataaattattaattaattttttccgaaataaaaaaatccaatattaaaattaaatttttaatttttgaattgaattgtttttatcattttacagctcgtccctggcgacattctgctgatcccgccccgtggctgtgtgctccaatgcgacgcggtgctgctcaacgggacggtgattgtcaacgaggcgatgctcaccggcgagtccatgccgatcaccaaggtcaatcgacggttccacttttttggcatttcgtttcagattttagcttttaatgtatttttacaataaatatgtttaaatttattttcatccctttttcatttatattttgtttctattttgtcataatctttctcttttttgttaccattttggatttttcagttttaatttcacccgtttttggcatttccatttgttctcgcgtattttgcataatttttgttccccattttcacaggtggcattgccggaatcggacgatgaccaccagacggagttttcattcaaggaacactcaaagcatgtctctactaggcactcaagtgcttcaggtgtttgttgtcttacagatttggacctgcagnngcatgc

SEQ ID NO: 19453 - DNA, 1222 bp, Heterodera glycines
aaaaaaagaaaaatgggattttggaaatattttttcaaatttttcccgggcaaaccccgtactggaaaatttccaagaaagtgttgggttccctgatattataatttcaagggccgactcagtccacaagggatagaaaaaagaaaatgggatttttggaaatatttttcaaattttcacggacaaacccgtactggaaaattccaaggaagtattgggttccctgatatataatttcaagggccgactcagtccacaaggatagaaaaaagaaatagggattttggaaatatttttcaaattttcacggacaaacccgtactggaaaattccaagaaagtattgggttcactgctatataatttcaagggccgaatcagtccacaaggatagaaaaaagaaaatgggatttttggaaatatttttcaaattttcacggacaaacccgtactggaaaattccaaggaagtattgggttccctgatatataatttcaagggccgactcagtccacaaggatagaaaaaagaaatagggattttggaaatatttttcaaattttcacggacaaacccgtactggaaaattccaagaaagtgttgggttccctgatatataatttcaagggccgactcagtccacaaggatagaaaaaagaaatagggatttttggaaatatttttcaaattttcacggacaaacccgtactggaaaattccaaggaagtattgggttccctgatatataatttcaagggccgactcagtccacaaggatagaaaaaagaaatagggattttggaaatatttttcaaattttcacggacaaacccgtactggaaaattccaagaaagtattgggttccctgatatataatttcaagggccgactcagtccacaaggatagaaaaaagaaaatgggatttttggaaatatttttcaaattttcacggacaaacccgtactggaaaattccaaggaagtattgggttccctgatatataatttcaagggccgactcagtccacaaggatagaaaaaagaaatagggatttttggaaatatttttcaaattttcacggacaaacccgtactggaaaattccaagaaaaagttgggttccctgatatataatttcaagggccgactcaatcccccagggaaaaaaaaaaaaaaaaggggattttgggaaaatttttttcaatttttcccggaaaaaccc

SEQ ID NO: 19454 - DNA, 2495 bp, Heterodera glycines
cgcaacatgggcggagatcattagttcacaattctaaatttaggaattgtttaattaatatattcgatgagaaatggcgttgaaaaaattagggagcccttttcggttgttgttattgtattttttgattaaagacaatgctttgccgcctttgcctcacccccgccccctttatcccctctctcgtcccctcccttattacccctctcatccctctatcctcctcccctctttccttcccgcccccttcatcccctctctcgtcccctcccttattacccctctcatccctctatcctcctcccctctttccttcccgcccccttcatcccctctctcgtcccctcccttattacccctctcatccctctatcctcctcccctctttccttcccgccccttcatcccctctctcgttccctcccttattaccccctttcatcctcgttcctccctctctcctcctcctcccctctttccttcccgccccttcatcccctctctcgtcccctcccttattaccccctttcatcctcgttcctccctctctcctcctcctcccctctttccttcccgccccttcatcccctctctcgtcccctcccttattaccccctttcatcctcgttcctccctctctcctcctcctcccctctttccttcccgccccttcatcccctctttcgtcccctcccttatttcccctctcttatctcccatttcttctcctctcctctctctctcccctatttcttttcccttccattctcctctctatcccaccctccctatttcttgcgtcaaatctctcttctcttttcccaagttctatctcctcccctccttgcgcctctccctccccccccccccctctcccgctaatttctcaactttccccactcgccgttactttcctattgtcggaactctcccacacaattctcgactattttcgtatttactttcatatattttggcacttccccattagttggcattgcataaacacccataaaatcctaaacaaagaaaagggagaatgaacggatgtgagaaaatttaaggaggggaaagcaattgacgcaacatcagaaagaaagacactttatggtggtttatttcactcaacggacggaaaaagcggaggggaggaagggaaaatgtatagggagggaagggaagggaaagcgatgccaatccgaagagaaatgggcaaaggtcagcagcgaatgatgaatggcattggcacaacataccatcaaaaattgttgaaattttgtcgctgctgaagcacaggtttgaatgctttgggcgaagaggagatagtgttcgagtgaaatggccgaaaaacatttgttggtccaaagttggcattttctttgagcacatttgaatttggcacggttgaagacatattgccaatgttttctgaaaaggaaaattgccattaattaagcgaacaaatcgggaatataaaaatgtttttgcctttttgagagacgcccaaaatagactgaacagaatggcgcacttttggcaatggcgcaacattggcacttttggaagagggcacgggaaacgaagcggacgaagttgcgacaaaatgctgcgaagagagcgaagacggcggaagaggaggggaaagaggagacggaagaggagggggaagaggaggggggagatgattgggagggggtcgaccgataagcgaagagatcaaagccatcggagggggccaaaaagactgaagaagtaaagtgttacacataatatcagggcaagtctaaccaagttcgactgttgtggcctgcagaagaaggcgttcggtggggcgccgtttggcgaaggttcgaaagggccaaagggcaactgaaagtcaatgccatttcggttggtgcttcgcttcgtttaccattggcttcggccttggcaattgtgccgttgggttcatttttgctgttgttggctcttcaacttttgcttttttaatttctgtccgttggcattccgtcggttcgtccgtatcccttttgatcgttttcgcctgcgttaattgcccactgaattctcttaaatttaattgaatgaattttggcttttccttctttccattaccctttcctctttcgactttgctcctttttctgatcacaattcggctttttcttctcctcctccgcccctttcaccgattcggctgctgcttttgtcagtccgctgcgctgcagaaattccatcattcgaaggtgtcccgcggcgggatcagctgttttaaaattgtccaatatttaattagttcatttgtcttttcttttaattagtgccaaattgtgtccctcactctttccatttgctcaccgtccggttcgggcccacagtattcgaagagtgggatttttttggtgccgaaaagggcatgctttttgaggatgagtcgcattgccaccagcacaaaacaatgtcgtaaagacgacggcatttgctacgcggcggcg

SEQ ID NO: 19455 - DNA, 1103 bp, Heterodera glycines
agtgattggaatgtttggtggggtggagtcccagtgattgaaatgttgggtggattgagtcccgttgattggaatgttggtgggttgagtcacagtgattgaaatgttggtggattgagtcccagtaattgaaatgcagaagaattgagtcccagtgattgaatgctggtggattgagtcccgttgattgaaatgctggtgggttgagtcccagtgattgaaatgttggtgggttgagtcccagtgattgaaatgttggtggattgagtcccagtgattgaaatgctggtggattgagtcccgttgattggaatgttggtgggttgagtcccagtgattgaaatgttggtgggttgagtcccagtgattgaaatgttggtggattgagtcccagtgattgaaatgctggtggattgagtcccgttgattggaatgttggtgggttgagtcccagtgattgaaatgttggtgggttgagtcccagtgattgaaatgttggtggattgagtcccagtaattgaaatgcagaagaattgagtcccagtgattgaatgctggtggattgagtcccgttgattgaaatgctggtgggttgagtcccagtgattgaaatgttggtgggttgagtcccagtgattgaaatgttggtggattgagtcccagtgattgaaatgctggtggattgagtcccgttgattggaatgttggtggattgagtcccagtgattgaaatgcaggtgaattgagtcccagtgattgaaatgctggtggattgagtcccgttgattgaaatgctggtgggttgagtcccagtgattgaaatgttggtgggttgagtcccagtgattgaaatgttggtggattgagtcccagtgattgaaatgctggtggattgagtccccgttgattggaatgttggtggattgagtcccagtaattgaaatgtagaaggattgagtcccagtgattgaaatgctggtggattgagtcccagtgattggaatgctggtggattgagtcccaatgattggaatgttggtgggttgagtcccgttgattggaatgttggtggattgagtccccagtgattggaatgttggtgg

SEQ ID NO: 19456 - DNA, 2063 bp, Heterodera glycines
  misc_feature (83)..(84): n is a, c, g, or t
  misc_feature (97)..(97): n is a, c, g, or t
attaatttcacatgatacaaataaatctgggtgattaaaaataaattgctatgggattaatactgacggattgtccgggagcnncggtatggggatnggtaataattcgttcgttttctaattaataacattttccattgtttccacaacatctcccattcagtacaattttgccattaatgtcatttctctgtttgctctcattttgcgtagttccgttcctttcgcttatctcaaattctgtgatcaccgcgtagtgatcggatggccaatcgttttcccactgatcagggattgggcgtagtgagtttttgcctgcataaatctcagaacggatgggccgaaagaatttgttaggcttgaagaaaatgaagtcgattctgtcctgcggttcgggaatcgtccagtcccattcgggaccagccgatttttgcactgtcgaccaagtctctcctgttcttttcattttaaaaccgactcttggattgttaaaaatacctgggtttttcactaagtcagggttaacggaacggtatgagtccacaaatcctttgtccgtcaataatttggtggcaggccattcgaaagtccatccgccatggttttctcttggaatgaattcaatttaagggacgaattaatggaaagtttcactttgtttcttcgatccaatccaaatgggaaggactgttgaagtcacctgcgacgatgaacggttgttcctcggaaaggtcgttgaattttttgaatttgtcgttttcaagcagttgttcgatgttttgcgcacgacctttcagtttattttaacattattttgacttaatttttaccgtttcaatttgcctaccgtaaccctctttattccgttctccactcataatctgcttctcgcttttcacttgtttgttgtttgctgcgtacggtccgtaagacttccaatcaaggtgctttaacaattactaatgcattttgaaagtccggcgccatttttctctgtttctgaccattgaaaagacgtttactcgttgtccatcttcgagttcaatgctaccaccgaccccataagtaacaattgaatgattgaagaaattttcttcatggaaaaggaagtcggaaatgtcgcgctgaaattgcattgcgatgggctccgagatgaactgaaaatcggtcttttttcaacatgagactgtcgatggcactttgtgctttgtgataatcgccgtgtctggataagcagcattcggatgatgtatcattttccacttgcctatccccagtaaaatggttagatttgtgccaattactgctgattgaagttcctttaaaatcttaatggatggtgttgcttttcctgtacaacttgtatagcgacaatgtccgggtcgaccgcctttatttgctctgctattttttccagcccatttttaacgcgtttgccggacagccatatgttgaaagtcattacgcgcagcattctttgagaaggtccaatttgggaacccttttccgaggaattgacacttgcagaaaaagtgatcgaattggcgagaaatagaaaaaggattgggcaaagctgaagcattgcacgcgaaatgacggtaattaccatcgctaaatggtaaaaaggaaaagagaacgcaatgaatgcttcgttggatattttgtttaacgttttgacagttgtaatgtcattccatggtgagcccacattctctactcttccatcgtcattaccattaatcatcaattaatgagtttgtgtaacagatatcaatcacccccatcatattcgattggtttaattaatttatttttcattccacacacactgactaatattattccaagtcccttcctattaatgaaagtgtgaaaatagcagagttttaatttacggacacgcccataaaaagtcattaattatcacagactgttattgcatgcatatcactgtgttttttaatgtccccaatatttaataaaataaaagtgcatttttattattttatacaacattttcttccagcaggggggatggattttcaacaccgaagcacatcccc

SEQ ID NO: 19457 - DNA, 1947 bp, Heterodera glycines
aatcaaaacggatgaaatcgcagcgtatttggtaaaagattatagtgtattacccgctaattgacttaacttttatgcaaaaacgtgttaatcacaaatgaaagtccatttaaagcaaagtgcgttaaattatacttttggatttaattaaagagcattcaaatcaaaagaaaattttatcatgtattttattatataaacggttcagtctgttgcctctcttacaattagcttagttcagtgggttaattgctgttacgcttgcaaattggcgttggttctttccccgctggtgagaatgaccgcgatgaagactttcattgctttatgacttttgtgtatgattatccaaaattcttacctacattatctgagcggtttttctttttttgtttttattatgataattatagatttggtgacagctcatcataaaggcaatgtaatgaaagatttggtgagtggttgtcgggcggaaagccattttggatattagacaaaagtcgaattcgctaaccgaactaaaattaaaagattaggtgaccatcgaagaagacaaagacaattttatgccaaagaaagatcttaaaaagtttgacaatcggaggatgaatttaaatgcgaaaatgctaaaccaattgatccaagaattggagagggatttggctgaacaaatggcgacgaatggcggagaaatgccaagaatccgtgagataatttgcgaagtttgtgccaaaaaacaaaaacaattcattatcggtggcatttgcccttttccctttagcgctgttgtacatttgcggatgggccgagattgctaaaggcgtcgctcactttttggcaattgatttactccaattattttcattttgtccctttgtttggtaagacaataagcaatgctgaaattatttttatttgcttcagcgtaccaatgccaacaaaaagaaaagggcggcgtaagagaaattaccacacattatttccgcgacacgcccggtcagtacttcgtccttccccgaccgatttctcatccccgtccatcattcgttcagacgcggccatccttccctccgaactccaacatctggatgccattaaacgcttttcctttcaaaagtccacttggacacggcacagaaatcaaccgatggatgaggaggacgattttgcccttttgacaactcaaagtcaaccatttgaccacaattttatgggaatcggtcaaattgtgggcataagacactaaaaacacggagcgtttcttattgttgattgattgtttacccataaatgcatattaccataattgcaatgctttctgataccttccaataattaaaatcgcaaattgacccactccctcctttcatgttggccgacgtccctccctttcatctccatggcaacttgttcgaactttcgcttagccgtctgaaatgggagattaattacagggaaagcactaactgttagcagggtcttaaaagggattaagtaccaaatattgtgggttggccggagggagaggggggggggaaggaatgtttcactttcgcaatggatggatggcatcccaattagtcacttttctgcgctttttgcgttgtcaggagttcttcctgcatttatttgtccattttcactttcctttcgcttccctccaattgttttgttttcctttatttatcctcctaattcgattgtgaattatgcgcatcgacgacatatgggaaagagccaaagcaaattgagcagcgagaaaatccgaattctcgccaagcaaagcaattgtaaggagaaaacgaaagggcaaatggaaattcagcaaattaattcctttggaggaattggcaaattattcgtttcggaatcgttccttttttctgccattttcattttcctcgaccttcgcaatgcatttttcttttattcgtttagttaccg

SEQ ID NO: 19458 - DNA, 976 bp, Heterodera glycines
aagttcaaattttttgtgctaaaatttcaaggaaaaaaaattctgataattttctagcgggttttttttgaaatttttttgaaaaacgcactgtgccgtccgacgcctcgctcatgcagtgccacaggtcgtcagtgtccgcattggcgtattggtgcctcttcagataggcgcgcagtgccttttggaagatgggctcgcccaagtagttgaacaacatggcgtcccatggcattttacgcgccccgtggcattttagcgtccaatgacattttacgcttcccattttcgtccctatttatgcgtccgaacaataatttagtgacccatggcattttacgcgtccaatgacattttactcttcccatcacattttttcgtctctatttatgcgtccgaacaacaatttagcggggcggagtcgttatttaaaaaacatcaatatgatttgatgaaaaattatttataactagctcaaaagcaaccaagtttttcattcttgatatcattcgttaagtgttctctaccagactacctacaaaattaaaaaaatttcgttaagtttcaaaagccatttataatagtaaaaaaattcattcactgtcataattccaattgtccgcttctctccaaatgttcggtcactcataggtttctttatgcattaacattaatcattgaaaatttttcaattgggtacctcaaaacttgttaattttagatattttttctttgaatacggtagaatattatttttgagatgtccaattttgacaccctctcttgcttcatggacccacatttaaagggcaactcgatagaaaattttgtgctctttccaattggcctgtataatttttacagaaaacatttccagtcccctaaaaattttttgtgccaacttagttttttgataaacattttgtttctatattattgcatcaccaaaaatgggagttgttgttctttgtatcgt

SEQ ID NO: 19459 - DNA, 1036 bp, Heterodera glycines
agcatctcttcaaagagaacgagaaactgcccgtaatatgactcggtacccgtcaacatattttgacaaagaccagtcatatatcggggtgtttggcaaactacaacctggtccaataactatcttggttggtttgaaataaacattgactaaatatgttattaatgggatatcattcatatcaaatttccaagggggggattcgataacggataacgaagtcaccttcccgactattctcccaaggaaaaaatcaaatatttttccatttaaatttggtacctaagcagcatcaattcattgatgttttagacactcatggaaattaactccgaggcacttgtgctgcaaaaccccagagccgggggcttcattcggcgacacgacgggatgacaattgctggcagacgatgcaccgaaggtccgcaagtgtggactgaacttcgcgagttcatctggcgactcaacgatgagctcgaggcgccgggttctgatgctgttgttgttgctgcgaaataccatattaggatggcaagtttcatttattccaataataaaaaaaggaaaagcctatttctgcgattattttatatcactgtctctcgctatcccaatgttcttcgctttctttctttctttctcaccttcaacgtctctcttataccttttcttcgtctctctctttttctctttcttttctctctctcctctctatctttttctttggtgttctttctcattttctttgaaagcatttgctatttctctatctacatatattttcctccatctatcactaggggtataaataatatgcacaaaaaatgccaaatatgcgcataaaatatgcactaaaaatcactcaaacatgtcctcaaaacccttaaaatgcccaaatttgcactaaaaatcgtcaaaatgttttttaaccatccaaaaggccaaaaattgtgtaaaaatttttaattgtctattattcttccaaacccttgaatttccttggttttagaaataatttaaaaaaaaggaattatgg

SEQ ID NO: 19460 - DNA, 1176 bp, Heterodera glycines
cagggaaccccaacattttcttggaattttccagttcgggtttgtccgggaaaaatttgaaaaatttttccaaaatccccttttttttttttttatccttgtggaatgagtcggcccttgaaattatatagcagtgaacccaatactttcttggaattttccagtacgggtttgtccgtgaaaatttgaaaaatatttccaaaatccctatttcttttttctatccttgtggactgagtcggcccttgaaattatatagcagggaacccaatacttccttggaattttccagtacgggtttgtccgtgaaaatttgaaaaatatttccaaaaatccctatttcttttttctatccttgtggactgagtcggcccttgaaattatatagcagtgaacccaatacttccttggaattttccagtacgggtttgtccgtgaaaatttgaaaaatatttccaaaatccctatttcttttttctatccttgtggactgagtcggcccttgaaattatatatcagggaacccaatacttccttggaattttccagtacgggtttgtccgtgaaaatttgaaaaatatttccaaaatccctatttcttttttctatccttgtggactgagtcggcccttgaaattatatatcagggaacccaatacttccttggaattttccagtacgggtttgtccgtgaaaatttgaaaaatatttccaaaaatcccattttcttttttctatccttgtggactgagtcggcccttgaaattatatatcagggaacccaatacttccttggaattttccagtacgggtttgtccgtgaaaatttgaaaaatatttccaaaaatccctatttcttttttctatccttgtggactgagtcggcccttgaaattatatatcagggaacccaatacttccttggaattttccagtacgggtttgtccgtgaaaatttgaaaaatatttccaaaatccctatttcttttttctatccttgtggactgagtcggcccttgaaattatatatcagggaacccaatacttccttggaattttccagtacgggtttgtccgtgaaaatttgaaaaatatttccaaaaatccctatttcttttttctatccttgtggactgagtcggcccttgaattatatatcagggaaacccacacttt

SEQ ID NO: 19461 - DNA, 952 bp, Heterodera glycines
  misc_feature (933)..(933): n is a, c, g, or t
tcatgctttgaaaaaacaatagtggtttgttctgtgactttcgtgtgagacactaatgtgtgtcatgcttttgaaaaaacattagtggtttgtttgtgactttagtgtgagacactaatgtgtgtcatgcttttgaaaaaacattagtggtttgtttgtgactttagtgtgagacactaatgtgtgtcatgcttttgaaaaaacattagaggtttgttctgtgactttcgtgtgagacactaatgtgtgtcatgcttttgaaaaaaacattagtggtttgtttgtgactttagtgtgagacactaatgtgtgtcatgcttttgaaaaaacattagtggtttgtttgtgactttagtgtgagacactaatgtgtgtcatgcttttgaaaaaacattagtggtttgttctgtgactttcgtgtgagacactaatgtgtgtcatgcttttgaaaaaacattagtggtttgtttgtgactttagtgtgagacactaatgtgtgtcatgcttttgaaaaaacattagtggtttgtttgtgactttagtgtgagacactaatgtgtgtcatgcttttgaaaaaacattagtggtttgttctgtgactttagtgtgagacactaatgtgtgtcatgcttttgaaaaaacattagtggtttgtttgtgactttagtgtgagacactaatgtgtgtcatgcttttgaaaaaacattagtggtttgttctgtgactttcgtgtgagacactaatgtgtgtcatgcttttgaaaaaaacattagtggtttgttctgtgactttagtgtgagacactaatgtgtgtcatgcttttgaaaaaacattagtggtttgtttgtgactttagtgtgagacactaatgtgtgtcatgcttttgaaaaaacattagtggtttgttctatgactttcgtgtgagacactaantgtgtgtcatgctttgaaa

SEQ ID NO: 19462 - DNA, 1024 bp, Heterodera glycines
  misc_feature (47)..(47): n is a, c, g, or t
atgtgtgtcatgctttgaaaaaaacattagtggtttgtttgtgactntagtgtgagacactaatgtgtgtcatgctttgaaaaaacattagtggtttgttctgtgactgtcgtgtgagacactaatgtgtgtcatgcttttgaaaaaacattagtggtttgtttgtgactttagtgtgagacactaatgtgtgtcatgcttttgaaaaaacattagtggtttgtttgtgactttagtgtgagacctaatgtgtgtcatgcttttgaaaaaacattagtggtttgtttgtgactttagtgtgagacactaatgtgtgtcatgcttttgaaaaaacattagtggtttgttctgtgactttcgtgtgagacactaatgtgtgtcatgcttttgaaaaaacattagtggtttgtttgtgactttagtgtgagacactaatgtgtgtcatgcttttgaaaaaacattagtggtttgtttgtgactttagtgtgagacactaatgtgtgtcatgcttttgaaaaaacattagtggtttgttctgtgactttatgagacactaatgtgtgtcatgcttttgaaaaaacattagtggtttgttctgtgactttcgtgtgagacactaatgtgtgtcatgtttttgaaaaaacattagtggtttgtttgtgactttagtgtgagacactaatgtgtgtcatgcttttgaaaaaacattagtggtttgtttgtgactttagtgtgagacactaatgtgtgtcatgcttttgaaaaaacattagtggtttgttctgtgactttcgtgtgagacactaatgtgtgtcatgcttttgaaaaaacattagtggtttgtttgtgactttagtgtgagacactaatgtgtgtcatgcttttgaaaaaacattagtggtttgttctgtgactttcgtgtgagacactaatgtgtgtcatgcttttgaaaaaaacattagtggtttgttctgtgactttagtgtgagacactaatgtgtgccatgtttttgaaaaaacatta

SEQ ID NO: 19463 - DNA, 2336 bp, Heterodera glycines
attgctttatggcacacaaaaagttgcaattgctttctaccgatcactttcttccctgagagatgaacgcattttcaacgctcggcttatgatcgaacgatcaacagcaattgtaagattttatgttgcaaaaaaaattgtaattatgtaaaacgactgtaaaagttaaatttaacagttttaaagttacaagatttaaaaattatcaacttatattcgtttaaaattgtttattttgtaaaaataacaccaaaaaatccaaatttaactaatttttgtattaaaaaatcaaaagcaattttctaatgaaaaaaagataatttaaaatcatatttaattcatttgtagaaaataccaactgtggcaaatgcacttgcaagtcaaaagaagattcagcaggtgattttatgaattttgatataaataacacattaaaatataaattatttataattattaaataagataattatatgcttttgcaaattgcttcatttctccgcagattctcgcaaagcccgggatggtggaacgctttttcccgcacccaaatgaagcggacaaagtggcggcaattcgcaaaacattcaccggattgtatcgcgtccagacatttgcggacggacatttgcggacggacatttgcggacggacttttgcggacggacttttgcggacggacttttgcggacggacatttgcggaaggtttctgaattaaaaaaaattatttttttagaaaaaaaatttggaagagtgggcctcgtcagtatggtctcttccggttaaaaagcaactaattacgtgtgtttcggcccaaccgtagacacaataacttaaaaagcgcacaccaacaaacaaaaaaagcaaagcaaataaattttttgattaattaatattttaaatttattaatggcttgccaaaggcccaactggcaatttaaacataatcagagacactcaagtaggtcaagttttttgtcattttgaatggcatataaaaacaatgttgtcagtccatgcttgtcagattttgctctttttatttgtccatcggtcccttaatagctattctatatttatatttcctatacaattaattaataccgaaaaaacatatttccttaagtgactcacggtccatataagaagcgatttttttgaacaaattttcaacgcgaaattcgtcttggcttacaaaaaattctgtatccattacagagaatttgagtgggaaaacgtggcagttatagatgattcataaggcgaaatgtatttctttttaataaaaaataaaaccttcgtttaaaacgtcaaataaatcgtccactattaaaccgactaatgccccagctccgccaattaagtgctcagatttttttaatagccgaacttcacggaagagtcttcccaaatttaaatttggccgtgggatatgaactctagcaatgatttcaacagaaagaaaaataattaaaattagtatggttattagcttcatcttaaagactacatattgtataggcttaaataaacgaactttaaaatgaaaatgaaaaaagatatgattctaataatagtttaagtaaaaatatgtttttatcaaaaattgtttttgcttttatatactctaaacgcggttccgccgaaagataattcgctgatcagctgtcagataaaggaaatgcggttccgccgaaagataattcgctgatcagctgtcagataaaggaaatgcggttccgccgaaagataattcgctgatcagctgtcagataaaggaaatgcggttccgccgaaagataattcgctgatcagctgtcagataaaggaaatgcggttccgccgaaagataattcgctgatcagctgtcagataaaggaaatgcggttccgccgaaagataattcgctgatcagctgtcagataattaatgataagcacaaaaattactataaaaaccaaagataaaagctaattattcaactccctagttcttcttactctcaatcgtcacatttgcacaatgtattcaatttaacggctaaaatattttatctttttttaagataatgccattttttattttttccatttttcttttgtttaacggagggctagcaattaacacatctaaaaatcgcgctttaatatattttggagggtacgaatatcgtcaaaaggggacgagtgtcgatgggcaaacccaattttggcaatgtacacaaaagaattgtccaggaagagcacatggtcctatcggcactttggatattacacgtattgtgtctgaacataaccatccccaagtttcttctcagaatactgtaagagaaat

SEQ ID NO: 19464 - DNA, 2354 bp, Heterodera glycines
  misc_feature (108)..(108): n is a, c, g, or t
tgatttataaaaaatgatcataaacaaatgttaaatgataatatatgtaattcttctaaattaaaacataaaattttcggtttttattattatttaaaatatcctttntaatgaataaaaaaataaaagcaagaaatcatgaaacacatcaacaaatttaaattaagcactaaactaactctattttatttgtttgtttgcatattttttggtattttacttgaatgtgtgtttgaatttgaatttatatttaataaataaatattttttaataaagaataaattcttatgcataaagaaacgaatataaaagaatgtcttacgcaagaagcgaacaattaatatagaattgttttaaaaaagaaatgcatttaaagcgatttaatatcatatgtagattggtctagaacgattaacgattgaaataagcaataaaactgattaattcatattatttagaacaacaaaaatttgaactttgaaaggagagaaatataaatttaatctcgtgatttatgtattattttgggagaacataatttagaggatatgcattaataatccatcttttaaaataaaatgggaatgaacagttcaaataataaaaatatatttgaattaatcaaagacaaattcaattcttttaatgttaattagtctataattaataccttttaacggaattaaaattgagataaatcgctcgagcatatataattaaattctgtatattaaagaaaaaatgtgagacaccgaggggtctaaatttaaaaagagctaaagaagatatattaattatattgaaaaatattaaaaatgtttcaaaattacaaaaaaccttatttcattcatcaaaaaaataaaaagattaataaccgaacaattcattaagaataaaataattgaagagtaagatatattcttgcaaattacttaaaataataaatttttggaatattataacttgaatgatagcttgtcggcatgctaaaattataaaatgataataaatcaatcagactgaatcttgcatgaataaataaattttattaaaaaattcttaataaataaatacagaggagccacaaatatttattcgttagaatagaaaaaaatcaaaaacgctcaaaagaaaaatgttttactgtagtacgaaaatagttttaatttttctatatcagttaaatttttgaataaacaattaatataacaaataattaaatagtgcattctaatgaaaaaaattttattttactatactatattaattttaatttagggatatcttaatttcaagaattaaatagttaaattagaaaatcggaatggtgaggaaaaaaggatacacgacgaactatatggggaaaatagttaaaattttgaagtttatatttgttggataagggaccacaccgattattgattatattttccctttcactccctctcttattgtctctcgtcccgccccttgaccagccccataaatatgtctccctttccctcactccgggcattctcccattcattccaccatttcattattttatttatttattccctgctgtcctccatatttatttgtttaataaataatttatttatttattggacaacatttgctttggttaaaaaccaaacatttttattgttgtagtaaatacacaataatttggcgcagtcagcaaaggacctgctctacatctttgggtgagaaaaggcatcaaattttgttttcaggacacaaagccgagacggcaaaacaaattcaccgaaaagccgggactggctgtgaattgttttaaagcctatttggcaaattcttcaaaaagcagtcaaagaaactgctagacaccaaaagccgggtcggcgctccgaattcgtctaaagccgggtcggctcatcaaaattcgtcaaaagccgggtcggctcagcaaaaattcgacaaaagccgggttggctcgtcaatttcgtcaaaaaaaaagcaggcaaaagaactacttatccgggtcggctcgacaaaattcaacaaaagccgggtcggctcgacaagttcttcaaaagccgggttggctaatcaccaaatttgatggaccccaatcagcttaaactgattttggaggctgttttgaaagcatcagcggaacaaaacaacagttctgctgcattagcgacatcaatcgatgctcgcctttcaacatttgagtatgaccctgagttagggcatacattcgacgtttggctcaagcgctacggccagatcatcgcccaggacggacacgcactcagcgaccagtccaagtgcatctattgattggcaactgggcgaagcggagtacaagcggtacatcgac

SEQ ID NO: 19465 - DNA, 1655 bp, Heterodera glycines
  misc_feature (835)..(835): n is a, c, g, or t
  misc_feature (871)..(871): n is a, c, g, or t
  misc_feature (883)..(883): n is a, c, g, or t
cgtcattagtcgtaaagaataaaaaaaaactatttaactttttagattcgttgtgttgtgttaaaattcaatatgattgcgtaatcaattttattacaataaagaaattaaattaaaaatgccttttggcatgattatcgccggaccatcagggagtgggaaaagcacatttttaataaaatttattgctgaatcttcggagttaattagccctagacctgcttcactgctttatgcatttggtgaaatgtcaagtattgttccaacactccaaaaatgcggtgtgaatgtgtacccgggagtgccccctgaggatttgattaaccgtctaccaaaaccattattgtttattcttgatgatcttttgctttctatcgatgaatcatatcttagtgctctattcaccaaaaagtctcactcaccatcagaattttgcagttgtttttgtcacccaaaatttgtttgaacgaagaattaaagttgcgagacaaaatgcccaatatttggtgttaatgcgagctccaaattccgcattggcgattcggaacattggagttcaacttttcccagggaaattggattatttcctttcggcctaccgtattgcgaccaataaaccgtatggttatctcctcgttgatatgcacgctgcttctaaccccctgttgcgactaaggagtgggatatttaaggacgatgaagaagaaggaaaaaagatcattttcattcccaaaaatggccttttgtaaaattggagaaatagtacataaaaattttgattttattcgtttacttgccaaaaccaaatcgatgaaaaaaaggagagaaattttanaacgtgcaaatgccgatcaattgttaacattaattngaatagctttanacattctttgttcacattttaaattaacaactcgtcaaagaaaacgtttgttaccttacgctaattttgttcgaagtcttgctcgtcgaaggaccgaaagagggggcacggaaggtcctggttcaaactggaagggggctcggaggagtttttgcagctctgctcactcctattcttattgatttggcacgcactgctataaattcaagctcaaagagcgacaattgatcattttatcatggcttcaaaatttattctcgtacccgaagaaatttagcatggcttaacaagcagtgattcgggaaacataaacttggatttttctaagcatgcgctggaaagaacaaaaagaaagagggagaatgtgagcgcaaaaaatattaattataaccaagaattgtctcgttatctccacctgagagatgaccaccaaaatcaaccagcaaaatagaaattaccaaagggatgaaggcactaatcaaaaaaggggatgaaagtgatgaagacgaacaaatttttgatttgggatcagaaagatcacatcctcccgtttcagaaaatcgcagacagcgtcggcctcatcaccattaccatgacgatgaggaaatgccattagtaccagcaccagcttctccacccccaccaagctgtaaataggggtcaaaaaaggaaagcaaattgagtattattcctcatgggaagagggagctaagcgacaactcatgcaaaaaaacgagccgacttttttcctctaaaatagctaaaaaacaaa

SEQ ID NO: 19466 - DNA, 2856 bp, Heterodera glycines
  misc_feature (45)..(45): n is a, c, g, or t
  misc_feature (115)..(115): n is a, c, g, or t
  misc_feature (194)..(194): n is a, c, g, or t
tcagagcttattgtccctagacctgcttccattctttacgcattnggagagatgtccagcattgtgcccgcgctccagaaaatgtggtattaatgtgtatgcggtagttcccttngaggaactgataaaacgtttaccaaaacctttgcttctcatccttgatgaccttttgctatcgattgatgaggcctatntaagtgcattattcaccaaaaaatcgcaccaccagaactttgccgttatttttgtgacacaaaatttatttgaaaaacggattaaagtagcaagacaaaacgctcaatatttggtactgatgcgagcccccaactcagcacttgccgttcgaaacattggtgttcaactttttcccggaaaattggattattttctttcggctaccgtattgcaacaaacaagccctatggataccttctgatcgatatgcatgctgcctctaacccattgctgagacttcgaagcgggatatttaaggaagacgaagaagagggacaaaagatcattttcattccgaaaaatggggtcttgtgaaattggaaatattgttcataaaaatattaattttattcgctcattggcaaaaaccaaatcgtgtaagaacagaaaacgaattttaaaacgcgccaccgccgatcagttgctcacgcttgaagaaatttgcttgaacatcctttgatcgcgtttcaaaatgacaacacgccaaagaaagcgtttgtcgttaaaggcgttgattaaaaggggagatgaaagtgatgaagaacaagtttttaaaaagaacccggctagtgaagcactctccgaagatcagcggcgtcagtttgcggaggatcaacgccttttcaccattccaaattcgcaactaaccaatgagcaaaagagaagacggcttcagttcgtatttaatcgtaactccgcaaagtacggtgttcacggggacaccgttttaaataacgcgggaaaccctataaccgacagtagtgtcgcccaagctctcgactatattatagaacgcagagcgggacgaattccacagtttagacagcccccaggaacaaaagttattcgagatcgcattaaccgtgacctaattttgcgaacatggacggctccaccagtaccaccaagggcacccaaacggagattaccacaagcagagcaaactccggaattaaatcaaaaatcccaaaagctcagaggaatgaggcaggcgagaggcagggaacaagaaggattgacacttccgtttccaacgaggggagtcaagcggaagtcgacggctctgtcagcagtagaaacggaaattccaaccaaaagccaacgtctccgaccaaagaaatggacaaatcaatagaaaagatgttagaacggttctacaatgacccaaaatcccctgctgcgtttgccggtgtcgaccgattgtggttggaagccaaaaaggaacttggaaataaaattcgtaaaaatgatgtaaaacattatctggaggggcatcgcacctacacattgatgaggccaagacgcataaattttccgcgcgctagaacaacggctgccggttttatgaccgactgtcaagtcgatttggctgactttcaaaccctttctcgacacaacaggggaaatcggtatttaatggtagtaattgatgttctttcgaagcggatttttgtgacacctcttcgtaccaagaaggctgatgacatggtagacggctttaaagaagtgttttcaacgatgccaatgaaaccacacagaattttctccgacaagggtacagaattcagaaatcagaagctgaaaaaactttttgatgaagaggaagttgagaaatatgagagcacacattctgagaagaaagcagcattagccgagcgcgcaatacgacaaatcaaaaatcgtgtgtatcgctactttgcccaaacaaaaactctcaattgggtggacgtaattgatcaaattgttaatggtattaataaatcaccgagccgggtgcatggaatgcgacctattgacgtgaactttaaaaattcacaacaaatatgggaaaaaatgtttggagatgatcagcatatggccctttttggaaagcccagaaaacgagccagatttgtccctggtcagacggtaagaatgagcatagcaaaaggtcaattcgagaaaggttatatacccaattacggcgacgaaattctcgaagttgatgccgtcaaacgccacatgaaaccaatgagatataagctacgtgattcaaagggggagaaatttaaaggatttttctacccggaagaattggcacccgtacgtaaggatgccgagacgacttacagaattgagagagtttttcggaaacggaaaatgcctgacgggacgacagaagtactcgtaaaatttattggataccctgaaagggaatggattcatgagacccaacttgtataaatacttgtaaactttgcattgtatcattattattttttttgtataaatgtctaatacattctttgtgcacttacccagtaatagcccagactacactgagaatacaccaaataagtttagagttcgtttaccaaaacctatttatttcaacggatcttgggtatgcggattacacagcattaattatgcctattcttggccatcaacgattggaaccttagatgatcagtggatcaacatacattttacggatggtttagataatgaaaggcttaggattgttcgagtacccgtcccgaaagcttcaaacacaacaattgaaaatttaagaaattttcttatttcaacactaaagaaccatgctgagtctctcgaaaaaattataaaagatggttcaca

SEQ ID NO: 19467 - DNA, 3738 bp, Heterodera glycines
gaaaagaagaaaaaggaaaaggaggaagaagagagaggcaagggaaaggaagaaaaagggaagagttagagagggagataaggaaaggagaaaaggggaagagttatagaggaatgagagagagagagggagataaggaaaggaggaaaggggaagagagaggcaagggaaaggaggaaaaagagaagagagagagatacaaggaaaggaggaaaggggaagagttagagaggaatgagagagagagagagaaggaaaggaggaaaggggaagagttagagaggaatgagagagagagagagaaggaaaggaggaaaggggaagagttagagaggaatgagagagagagagagagagatacaaggaaaggaggaaaggggaagagttagagaggaatgagagagagagagagaaggaaaggagcagaaggtgaatacagcgacaatcagcagaagcccacgccttttagctattttgttattgctttggctatcaatttgttctatgccttttcttgctttatttttgcaatgattcggcttttccgttaactgcgattgcgcattcaaaaaccaaaaaactatcaattatcaaaaaagcgagcgacccacagcaattttctcgtgaataaaaacgagacgaaaagcataattaggtacttttttaaaaaacaaaaacgaaacacaattattagaattaattttattatgaaagaaataaaaaatgaaaattttcaagttaaaatttcaacaattataaaagtcataattaatatagggactggatttatatgaacaaaaacgatgaaatatgtgtaaaatgaccaaatatggacaaatttttaaaagcatcattgtggaagccatttttttgcatattaatgtaaaattgttgctctgagagtattcggtggcaccaaatgatgccactggaaaaaattatgaaaaagaaatgatttgttaatgatagattttgcaaatgatttcaattttggagcattgttttgataattctttcttataaagataacggtaccataacaatattcaccaaaccttcagttttcggtgaaactaatgacggaaaatttttgcatttcggagctgtttaatctgatgaatttgggtggaaatgcgtgcaaaggcaatggatgtgctttgctgaagtgactgacaatgaaaaggaaatggggagtgatcaatcacactgatcagagttcatagattcaccgacggactaacgccgaagggatcgtttcgatgccattcatttgcttaccttagccgcattctctgtttttttacttccctcggagaaaatttaaaaattttcatctgtaatagagaaatatcaatcaagtttttgttttttgttttgtgattgattgttttgtttttgaaaaaatttccatgaagggtccaatcgcattttatgagcccaataaaaggcaattcgcaatactttcctttgcctggcttttatttaaagccgagttagtataaaataaatataattgtgggaatttcggaagattacattagtttcataatctgatcagaggccttcttttagcgtgccgttcgtctctttcgtgaagactttcacgttgcttccgtcttcaatatgatcagcggttgtctgattccaccggcaccaaaaagttcaaattcggtggatgaaaacaaggacaacgacggacagaacaacgcttttctatccaaatgttgttgatcgtgctgagacaaaagtacgaaagtgcaagtgatcgaagtaaaagcaaaataattatttaaaaattatttaatttaaatacataaaaataaaatctcaccgattttttgatatggttacatattataaagttttacttatgtagcgattaaaaaatatttaaatgaattctttaaatgaatgaaagatttttttatattttttttgtcatattaatttaccttttctgtttataatttttaattgtgtagccaatataatatatattagcaaattaaactttaaataatatattattaataaatttaaattaaataattactttgcttttcctttgatcacttgtacttttccgtacttcttcataccacccaccgttgttgatgatgagaagagacaaatgaaaatgggaaaatggaggggtgtggtcaattctgattgtgaaagttaaatactttcttagaaattaatcagaaccgttacaattcaacaaaatttaaaagaattatttctccaactaattaattaaattaaaattgttttctaattgttagagatcgacctgtacctggatccaggcctgaatttttcctggatccaggtacaggtacaggcaaatttttggcaacctgtatttttcctgtacttttgtacaggtacaggccatttttggaatttagtacaggtacaggctaaatacgaaaaaacctggattttcctgtacaaaattttagaatttattatttcaagtgatcgatgtttttttcaatttttcaaaaatgatcaaatatatttaaagagacataattatagtaaattagatattttaagatgttcctaagcaattaattgattttttcaaacctttgtttgatttttaaaagaagttccaaaaaatacaggtacaggccaattgggaaatacaggtacaggctttttccaaaataccgagctctattgaaagccaaaagagtcccctttatggtttttcggggggcctaaaccgcaaaagtccaaatatgaatacaagccaccaaaggatttcaaattttcatttcaaagaaaatcctgaaaatttgaaaaaaaatcgtgctacgccttggtttggaattttaaaattcaaattccgcatccaaatagaaatgtgaggcgtcttttctcattcacaattaatacttccgtgaatatgctcgcatttctaatacatttcttaaagcagcagttccatctattctttccgcctcgcgtctctgctgcgccctttgctccaacgattcaaccaatctcctcgagtttctagacgaacgacaggccacgcaagcaatgaaaatcataaacggaactccaaaaatgacggtgatggcagttatagcaatggctgcataaatcattgcatcgaacacgggccgccaaaagggatcagtgggcagaaaaaagggcggcttagtgacagcaaaagaattgttggaagaaatctgttgaaaaataaataaaccccaaaaaaccgccccaaaaaaccaaacgaacagtgtctgttgttgtgctggtttgagtttggtaaataattttacaaaaaattaaaaatagtttgaaaagtactgataaaataaagtttagagttttctttttccagattgcgagagcaaaggacatgagaactataaaaatgtttgctttttccatttgcctctcattatttaaaaatatttctaacataattattattgtgcccttttgacgtccttcgcaattctaatacggcaaattgtgctaattgccacaaaatgaaccgacggtaatgagttttaaaaattacaaacttcatttaactactgttttcccgcattttcagttggctgtgcagcgacatttggatgaacattctgccgttttttggtcgtcaccaactcggcctcaaattggcactgatttcgccacgtttcgacattttagtggacaaacatttagatggccaatcacaatggacactttggcgaccaatcaaaa

SEQ ID NO: 19468 - DNA, 1676 bp, Heterodera glycines
ctttttcatatgatgttagaaaagataaataatcccataaattctcctgatttttctctatttttaaagctttatttgctcaaaattggtcaacccttaggctagatatgaatttttcaatattcgcccaaaatcccgagggccaaaaaattgccaaaaaataaagaatttttaaaaaattccaaaaattatgaaacttaaaatagacatcatattcgtactcagcaccttattttaccccagaaaaatatttttcacccccattttcgtcagaaaaaaaatttccgaaaatttctagggggcctagctcgaaaatttttgaaattttccggccatataatacactattcgatagcattttaaaagctctacaattttgctctaaggcaatttttcgctaaaaccaacccctgacgagttatgggcccgggactcaaatgtcccgcttaggccaaaaattttttctatttccggaaaaaaatcgaaattttttcaaaaaaaataccattcgatagagctcgaaaaactatgttttggaagtggtcttcgttttcccgggaaaattcgttaaaaattcttaaaattcaaaaacccaaaaaccgttttttaggcctagctcgaaaaattttgaaaattttcgaagttttaaaacttggttggatagcctttcaaatactacacattccccccccccgaagaaaaaaattttaagaaaaaagggacaaatttaaaaaaaaattgcataagtttttggtttatttcttaactttgaccaatgtatactttcagtttggcttacatttgcaaaggtgtcctgcgtcgtgttctgctcgatgtcgtcgagttttgtcccattcgggtgtttttcccgttgtattttatgtcaaatttctctcttaatttagcctttccttcactctgatgatatcgtcacaatgacttctttggaacaaaatggacacgtccttttgctcagtgggggcaccgatcggcgcttagctctctcactttttaagccattggccactgaaagcattaacggacgtaatcactgacaatgagtgtcttttttcttttctttaccccccccccattttagcaaattgttttgcttcttcgttcttttgtctcgattcgtcgattgtccaccgttcaaatttggaatgcgtttatgtcgttgacgattggccttggcacaatgaaacaaccgattccggcaaaagggacagattaattttgagtgtgggcgggcgttctgagatttgtgcatggaaattgcaagtcgacaatggaaattctgacaatgaaccaggaaggagtaagaagggcggtgaaatgtgccatgaatgatgggctgttaagaatgccttcctcagctgcactttctctcgtccactgacatttccgcccactcttcgggtgcttctcctccccaggactgtcgtctgttggccgttcgtcaccttttgtacggcccttttttggcgcttctttgttctgatggttctctgcggttggttttactgctgtcccatttctgactcgattatatgctttttattatttgcttcagaattgctaaaatgctctgttcttttcgtcatcgttttcccactttttccctcatttcttccaaatggaccattcgcattcccttcgcttgccatgttcactgc

SEQ ID NO: 19469 - DNA, 1017 bp, Heterodera glycines
cattccttcgcttgccatgttcactgcttgggagctgctcaaacatagcaaaagcgtgctttgcacagccacggatggtcatttatatgcatttgcaatttccgagtcaatgcttcaaaaacattttggcgattgcgaaaccatggaatccgttgacaatgacaacagccaatcgtcgcatttgaactcttttttaaaattgcatttttctccttttctcgttgaaaagtgtggcctttcctcacttgccacagccacagtatatgaggtattttgcctttgttcacatattttcaaaattgaagtcactgttccacataggacaacagcatcattctgattggctctgaaactggaagcattagcattttggaatggaaattgggtcggaaaacgccacaagaagaggcgccgggggttgtgctgttaacacgcggagattggcatgcttccaccataacaggtggaatgagcttcttcccttttactgtgttttctttaagctctccgagcagtcccttcccctccctcgtcgtttttcattctcagcgtttctctcgactgtcggcttggactcggtctctacgacactctccgtcacgaggttctctcattcagcaacagtacattccgtccgttaatccatcgtcccccttttcacagattcggcctctccgtctcttccctttgtgcgtgtcggaccctgcttctctccttgtccttcctttcactggtggtcattcgccgtcggattcctctttccttccccatacgtttacatctcaacaaatcgattgttttgtctcaggttacggtattgaacatttacaactgattgtttacagtactgatccaaataagtaacagtttctttcattcatttttgtttctattttgcttttgttataacctaatgaattttttgttggatatgagtaatcttttcaattaaagatatatatctacctctttaatttacgaatatttatctttttaaattaatttatttagcagttt

SEQ ID NO: 19470 - DNA, 3582 bp, Heterodera glycines
  misc_feature (167)..(167): n is a, c, g, or t
  misc_feature (2684)..(2684): n is a, c, g, or t
aaaagagagtcgaaagtgatagacttagacgatttccaagtgcttttatacaggaaaaaaagcatttctgtagattagaggttgacaaaaaaaaatattagggtggaaaaataagtttttcgttgctaatttaatggggaaacaactttagattagaaaaagaattntaaaaaaaacaaaaatgaccaaagcaattagcatattaatgatcagcattcttaaaaatgtgtttaattaactaatttcaaaaaaaaaattttgcaaatcaagagtcccgacttaaattatcaaaagtaatcactaatcgaatattttgtcgactcaaaatctacaataagtgccggaaaaaatttgggcagataaaaaacatgatgcaattaagttccaatgagtggaaagagagtgccaatgttagttacctatgctaatgacttttgagtctaatttcataaaataacaattattgtgaaaactcacatttaaacccaagcgatggcaacagctcttccaaatttggagttgactcaattttgaattttggcaaaaagacctgaagaattaaaaaatgagcaaaaaagagcggaaatttgccatttaatcaatcacctcaactctaatcactggtgattttttaatcattctgatcagtttggccttcgtcagttcccccaacacttttgtgagtccgtcgtttgaatttggcaaaacgatgaaaaggtatgcgcgcattccctcccacaagtcccagtccgatcaaccgcgatcagttgttcgccttcgccttgttgtcaaccgtctcaatgccatcccgggggtccacccaatccaacagcgaggcgaaaaggacattcactgctgttacccatgcccagatcagcccgaaccagaaaccggcattcaactgactggaagaataaacggggaaattttaaatgattttttactccgattttcgaattttgatcaatgataaaagaggttgaaatttatttcacaagcattaaaatttgaattttcgcctcactttcgcaatttgtggtcaatgctgtcctccggctcttccatcgaattgccataaacgagttctgtccgctgcgcaatgtccgcccaattgtacatttcggccacctgtcgatgcttcttcaacgggcagggcaattcgccattctcgcgccgacggatggcatccaaaagaccaattgcaattgctgtataaagtatttggattataaatgagtcaaataatgatcgaacaaccaaaaattattgttaaattcaatgggaatcaacctaatttaaagttttaaatttggctacggtaatggccccaatctactattgattttggtactgtaatttcataaaataattggacaatgcctttcggatttgggtcgaccaaagagatgaattccggcggcaaaacttcgggaattcctccaacgcgagtagacaccacatgaagacttaacacaaaaaatgaataaaaattgaattcaagaacgaaatgcaccaaaagtttgatcagaggcccaaaaaatttttaatcatcaaaatttaattatttttttagcaattttttctgatgaccgaagggcccagcgacgcttaggaatttttttataagattctaaatgttgtaaaattctccatttttcaatgttctgaagcaataaaattccggaatcagggagaaatgatcaggtttgatctatgggttggaacagtacccgcaactcgccgcttcaacaatggccatgcaaaatgcctcggtgagcgatgtgttgagaaagatttggccttggacaagcgcatcacggacctaaaaagaaggcagcaacaaattaattccaaaaaacaatgatttgaataagtacaccaccgtacacctaccgtatcatggggaattgtgcccaacgttttgacgcgttcgtgcaaccgacaccgttctcgcatttcctcaatgtccactcgttttggaccatcgccaccgatcagaaattggactgaaatgcaaaggacggtgataaagcattattgaaagtattcttggaatcccgatttccgataaaattttgggtctcaaaatgccattcctgatatccgttatcgaatggttccatcgaaaataaaaatattgtttgattttaaattatttttgcaaaataacaaataataatttctaaaaattattgggaaattttgaaaagattgaaaacaaaaccccattaatttactaattaattataatcaccggttgggtgccgttcacaaatgtccgggatcacttccaccaacaaatcggcgcccttccggtagacgagtcggctgagcaccaccacagttgtgcgcttttggcacgcgaaaagggccggatcgggcgtgaacagtgccgagtcaatggcgttcggaatgacgaaaacgcgctggggtgcgacgcccgcccgcagcacagtgttctccttgctgaaaaacttatggcatttatcaaaatgaaaggaatgttattaaggcaataatggtgggtcggtcgtctatgtgatcagaaaagggagcggaaacgagagggagtgagagagagagagagagagagagagagaaagaagtacaataaggttgagggaagggtagctatgtcgttatttaaaaaacaatttaatatttacaatagagaccggaatttntgaatggccgggaccggggccgggacctggaaaatcgacccgcacggcatcccgggaccgggtctcccgtttttccgggactcccggtccccggtctcattttttttgggccggggccccgccgggggacttttccaaattagtgcaactttgattataaaaattaaaaaaaaatatgataatcttctattttagctttggataggccaagcaatgtaacgaccattttgtttgttttcaaagcaacccgggaccgggtggggggtcccggcaaaatcccggcccgtgctccgtattgagataaataatttttaaatcaaaatttcttgtaagttttgaagatgcatttttgataaaatatttcatttttaggggtgtatttttgaaatatataataaattgaatgttaagaagttataaaaatttattcatttttagaatatttaacaaaggtaatcttgataataaaaattatatcaatgtataaattgttagtaatcaaatgtatgtaattaattttgaatgattgcagtaaatattgatttcactcataatgatggttttttaaaagaatgcccttttttgatgtttttaaataacgattccgccccaccgtggtgaggaggaaaacaaaaaggcgaggggggggggggataaaaacgacgaatgcggcgctgctttgtgagagaaagggttaaggagccagagggatcgaaaattaagggagagagagcgaaggaaaaaatcaatgaattttttacgaccatatttttttaaacaaattttcatcaaaaaattgctagctttgtggtttttggacaaatttagtgggaaatttgcttcacggcctccccctcgcttctaaaggacgccattttggccccctaggggggggggg

SEQ ID NO: 19471 - DNA, 2649 bp, Heterodera glycines
attagcagaatgtgaaattctctcatttgttacttattgatcattttgtctaattcgcaaaattacagctcattattcgcgaaatataaactgaatcagtgtttgcggaatgaccgagctgataatcgccaataatcttcgattacaattttcttggtcacctttttggaattccaccatttcaactccttatcctctaaatataaactgaatcagtgtttgcggaggaccgagctgataagtcccaataatctccaatttacaattttcatgatcacttttgtgatattctcaatatttcaatttcttatatccaaatgtaatctgtataagtttacagtaggaaattgtaatttgggggttattggcgatttcaaatcgatccttccggaacactgatgctgtttatatttagagcgtaatgagctgaaaatgtcagaattcaaaaagtggggtcgcgaaaatagtaaatctgaggttattggcgcttatcaacctgatccgtctgcaacacttaaacagtttatatttaaagcctaattagcagaatgtgaaattctctcatttgttactttatgatcatttttgtctaattcgcaaaattacagctcattcttcgctaaatataaactgaatcagtgtttgcggaatgaccgagctgataatcgccaataatcttcgattacaattttcttggtcacctttttggaattccaccatttcaactccttatcctctaaatataaactgaatcagtgtttgcggaggaccgagctgataagtcccaataatctccaatttacaattttcatgatcacttttgtgatattctcaatatttcaatttcttatatccaaatgtaatctgtataagtttactattaccacaatagttgaaacgcaaaaatgtgaaattcaaaaaatttgagttttcgactttctattcgaatttgggtccagggttcgaaattggtcaaaagggtgccagattcgagttcagcaacaccaaaaacccatggggagacatgccaaattggacacatcagctgaaagaacaaaataaattacttgatcagcgaatttgaacaatatacaaagaaaaatgaataaattccatgtaaattaattaacaagtttgcattttctcaaaattcgcagataaatttctcatacttccaaaatgtattaaatttgtcaattttatttcatttttaaatacggaaatagagatatgaaacaacaacatttgtccaacgacgcactaaaatcggtaactgacgttggcaacaaaatcgttcacatactgcgcctcaaagaagcaaagatataatgtcttttctgggttgaagttaccttaaacgggatatcgtggtgatggtcccttttcgttttgtgtatcatatcaaacacgatgtcctccacccttaaatcaataaatcttcatattagacacctaaacaaagcttacagcagatgcccctgaccatcgaaacggtcgaattgcggatcatccggttcgtcaacttcgacaggcattttcaaattatggccacgaaaatcagcatacaacttcatattaaaatgagaattataaataaatgaaaaagtcacaaccttgagaagaatttgttcggggaattcagcctcgatcgtttctacaaattcggcaagactcattggaccagtgatctcaattcggtcgacaggagagtctccaggagtcgaacttcccgtgtcgctttggtgcattctaattagacagaaaacttaacggctaaattttatttaataaatagttaatgttttaagaggataaatggtatgtagatcgaattataggacgttcaaacaaactggaaatgcaaataactccaatatcataatacagttcacttttagaatgataacttcaagcgaaaaatgtcaaatttgtaccatcaaatttattgtcaaattcgtatgctgtgtaatgtcagtgggacaataaaataataattaaatagggcagataattctgcaacaaaaagagaaaagtttccgggtgtagttccaaaaaagcgaatggtttatgatattgttaggtgtgttcaagtagagtcaaagtccattgccgccgtcattcaccaccaaaactgtggatgttcattcagccaacactaaacaaaatcgtagcggaacttctcgcctccgggctcgcccaggtcgggcagcgaaccagtgacgatggcctttaaaatggaatggcttttcgtgtttccgggaaaaccatggcttaaaataatggaaagaaccaacctgaatgacccattcgctggacacggccaaaccgccccgttcctcgaccagcttggccacctcggcctggcagtccgtctccgccagcagcacatcaacgggaggctcaactgaagaaacaaatccaaaataagtgtaataattcactcaaaatgtgtacttttggaacagaattccatcttttcctcaaggttagcgctcgatttggaggcaaatggttcaccaggaccaatgccgactaatgttgcgcccaaattttgcaggatcggtgtccaaatttcggcaaaactgacctaaagtgaaaattgtaatgtgatattttttcaattttcagtcatgttacaatgccagggtc

SEQ ID NO: 19472 - DNA, 938 bp, Heterodera glycines
  misc_feature (912)..(913): n is a, c, g, or t
gccggccgctgccagtccacctctctcccttgcctgcgccgactgctgccagcactcagcccaagggagccatccctttcttcgccggccgctgccagcactcagcccaaggtaattttataaataattgcatatttcggtgtccgtatttaataacccaggaataaatgggttgattaaggccttagaatccgagagtaagacgatttttataatgctcgcggacaaatatggagttttacacattatctgtgcctatcctggaataaatttactacatttttaggaaagcgagtaaaaggaagctcgaaatttataaagcagattgtctgtcgagttagtataataaattagtgaattctcgctactcgccgaccgctgccatcactcggcccaagggagccatccctctcttcgccggccgctgccgtccacttaatcccttgcctgcgccgaccgctgctagctctcagcccaagggagccgtcgtctttagccggccgctgccagtccacctctctcccttgcctgcgccgactgctgccagcactcagcccaagggagccatccctttcttcgccggccgctgccagcactcagcccaaggtaattttataaataattgcatatttcggtgtccgtatttaataacccaggaataaatgggttgattaaggccttagaatccgagagtaagacgatttttgtaatgctcgcggacaaatatggagttttacacattatctgtgcctatcctggaataaatttactacatttttaggaaagcgagtaaaaggaagctcgaaatttataaagcagattgtctgtcgagttagtataataaattagtgaattctcgctactcgccgaccgctgccatcactcggcccaagggaagcatccctctcttcnngcggcgctgccgtccacttaatccc

SEQ ID NO: 19473 - DNA, 761 bp, Heterodera glycines
tatgggtttttaggctattaaaaatgaaaaaaataataattttaaattaaaatattttttattaattaaattcaattaaaataatggtaaagaaaatttttaaaaattttgatttcagggggggtcttggaattttctgagtcccaatattctgtatttttttaaaataaattaacaatcttttaaattttttgcttttaaatcgctgtttttgtggaaatgttttttcaaaaaacttttttggaacagtgggagggggcggggccggcggtgccgataggcgccgccggaaaaattttgaaattttgagcgagatttgttaacagaatttgtcaaaaaatgaccaaatatttggttaatttatgggtttttaggctattaaaaatgaaaaaaataataattttaaattaaaatattttttattaattaaattcaattaaaatagtggtaaagaaaatttttaaaaattttctgttccatcagggaattgaaccgaagagacaaataatgaaagtaaaaaggtttagccacttgaccacttataaatacggcagcacgctataaatgaaaataaataatttatttattttttctcaaagatttctccttcttcaccaattcccttctcttttctcacccagacccccattcttaccagtgcttatttagtcccgtcgggaccgggactggcaaaaccgggaccgggatttctgtttttccaaaaaccgggaccgggatcgggacctgaaaaaaccgggatt

SEQ ID NO: 19474 - DNA, 2406 bp, Heterodera glycines
aaatcacttttgcgagtacgcaggttgtgcacacaaaattcgggtgcactaccccggaaattaaaaaaaaaaacaaattcttaattattgaaatttttttaaaaacttggagttttttataagaaaaaaaaatttgaaaaaattatcagcgattttttggaaaattttttgaaaaaacttagtaattcattgtaaaattttgataaatcacatgaaaaatttttttaatttttttttcttgaaattttcttataaaaacatttctaatatttaaaaaaaaattatatttagggggggggacgacccgggggaaatataatttttttttaaatcttagaaatattttacggtgaggggctgggggaggagggaaacgaaatgccacaaaattcgagggcaaaacgccaaattgaaatcgaaaaattaaaaaataaataaaataaacttttttttaatcattttaatgaattaaacaattggttttcaggtgttgatgagtgtcccgattatggaatgaattcggctagtgacgacgaacgtcggcattttctgcgccgttattttgtccattttggccaaccaattggggaagagtgtgaaatggacaaaatgttgtgcaaaattcggcactttgaagcggtacattcataagcacaacaaaaatagtgtaactgttcattgtttttttccttttcgatatttcccatttactctaacggtctgatcattagctctctcgttgcattatactcactctaaccgtctgaccatgacctctcctccccctttccctctctctctctctcactgtctctctccgccttgtctctctctgtctccctctgtctgtctgtctctctatctcggtgtctatcgtttactttaacgtctgatcctgtactcttttcattaccaaacatctgatcatacattttctcattggcatacccatctaacgtctggccatgtactctctcgttgcattatattcactctaacgtctggcccttgtgttctctcatggcgccccctgttttttaattacttttaatgctttttctatcactttacaggcagcccattttttctggactctgtgggccatccatcaggcagcaaaatccgcgattcaatttgattacatgctttacgcgatcacacgccatcgttactgcactcagcttatgacctcattaggcattgctaaaaataattagcacaaaagcacaacattaattgatttttgggtaaatttttattgggtctgtccttaagaaaaaccaaattacgcatccttaatcggtcttaaaaagttttatatgtatatttttcacgttgtctatactttatcaactctcttaatctgcacttaaaaattataattgaccgtatctttctttatctgttcttcctgtgcttaaaaactgtttaattgctcctattatttatttattttttaaacctgtccttaaatgttgtttatttgcccttaaaaatgacattgatttgctcttacattgaccttttaatcaagctggaaaattaaaaatcacgacaaatttctgtaaaacaagacactcgaaaattttattttgaagttattgaacaaaaaaaaaaaaattcaaaaacccggccgtttgattacggtactaccgtatacccttcgctttatgggtgtttaaccttttttattttatcttaccatacaaataaaagaataatttgatacaaaaataaaattaaaaattattaaagaatgatgatagataaggaattaggggaagagatcgtcgtcagaggacagttgaaatgattaatgaggatgttcataattttcaattaaaaattgatatccaatcattgaggcctccttaaaatttcaaggtccgaaaatggattttttggggaattttaatataaatttttaggaggtctaagaaatggtcttatttggaattgagtttttcattggctttcgttggtttttttaaaatttccaaaaaattatgggaggcctcaaattttctaaagtgtaaggcattggcttattatcaaatcaattcaacaattttgcacctatcgctttcttgccgcgatgatgatctttcgcacacagaaaatggcagttagggtgaagagaattgcttaaatttttagaaaattatttgaaatttttcaaaaattaaaaatttttttaaaaataatacggcatcatatttacccaagagaatgacaaagatcagctgcgctgtcataatggcgacgcccaatttgactttgaacagacactgtaaaaagagtagattaaataaatctgatcagtttaaagtgatcaggaatcaataaataattaatgagcaagggtggtgatcaattggattgaaaatattgtctcgaaagaaattt

SEQ ID NO: 19475 - DNA, 981 bp, Heterodera glycines
ctggagggttgagccccagtgattgaaatgcaggagcttttagtgccagtgattggaatgctggtgggttgagtcccattgagtcccggtgaaatagtgggattggaatgctggtgggttgagtcccagtgattgaatgctggagggttgagtcctgttgattggaatgttggtgggttgagtcccattgattgaaatgctggtgggttgagtcccagtgattggaatgttggagggttgagtcccagtgattgaatgctggagagttgagtcccagtgattgaatgctggagggttgagtcccgttgattggaatgttggtgggttgagtcccagtgattgaaatgctggagagttgagtcccgttgattggaatgttggtgggttgagtcccagtgattgaatgctggagagttgagtcccagtgattgaatgctggagggttgagtcccagtgattgaaatgctggagagttgagtcccgttgattggaatgttggtgggttgagtcccagtgattgaatgctggagagttgagtcccgttgattggaatgttggtgggttgagtcccagtgattgaatgctggagagttgagtcccagtgattgaatgctggagagttgagtcccagtgattgaaatgctggagggttgagtcccgttgattggaatgttggtgggttgagtcccagtgattgaatgctggagagttgagtcccgttgattggaatgttggtgggttgagtcccagtgattgaatgctggagagttgagtcccagtgattgaatgctggagagttgagtcccagtgattgaatgctggagagttgagtcccgttgattggaatgttggtgggttgagtcccagtgattgaatgctggagagttgagtcccagtgattgaatgctggagagttgagtcccagtgattgaaatgctggagggttgagtcccgttgattggaatgttggtgggttgagtc

SEQ ID NO: 19476 - DNA, 1155 bp, Heterodera glycines
cgctaggtgattattggagcccagaaaaaattgtagattcagaattttaatgtaataaatagaagaggtacataaatctagaaataagcatattacagtgattgggaagaaagatctaagtgattaaatactgataatggagtacataaaataagcatattgcagtgaaagaaagatttaagtgattaaatactgaatttggggccatcaactcctttgtttttgccagagtttgtgtgccacaaataaaaaatgcgggaatagaggaagaagaaccaaacaaagatgaacgatgaaaaacagtttcaggaagcgcttggtgattattggagcccagaaaaattgtagattcagaattttaatggtaataatagaagaggtacataaatctagaaataagcatattgcagtgattgggaagaaagatttatgtgattaaatactgaatttttggggccatcaactcctttgtttttgccagagtttgtgtgccacaaataaaaaatgcgggaatagaggaagaagaaccaaacaaagatgaacgatgaaaaacactttcaggaagcgctaggtgattattggagcccagaaaaattgtagattcagaattttaatggtaataatagaagaggtacataaatctagaaataagcatattgcagtgattgggaagaaagatttatgtgattaaatactgaatttttggggccatcaactcctttgtttttgccagagtttgtgtgccacaaataaaaaatgcgggaatagaggaagaagaaccaaacaaagatgaacgatgaaaaacactttcaggaagcgctaggtgattattggagcccagaaaaattgtagattcagaattttaatggtaataatagaagaggtacataaatctagaaataagcatattgcagtgattgggaagaaagatttaagtgattaaatactgaatttttggggccatcaactcctttgtttttgccagagtttgtgtgccacaaataaaaaatgcgggaatagaggaagaagaaccaaacaaagatgaacgatgaaaaacactttcaggaggcgcccggtggttggttattggagcccagaaaaattgtagattcagaattttaatggtaataatagaagaggtacataaatctagaa

SEQ ID NO: 19477 - DNA, 944 bp, Heterodera glycines
acacatcttcaccaaataatggggccgatgattaattgatcactgagccaatcacttttcactgatcagagagagagagaaaggaatggaaagagaataaaggcagagaaagagaggggaaaggactgacggggaaaagggtggaacaaaacacacacagtcacaaaatttgacgggtgcgggggcggaagccaccagccaattgttgtctgattgatgggttttgattgcttaattcattgatcagtcaattttctcaccaaaacgcatcattagcgctgatcagagtgtggatacgtcatagcatccgtccgatcacttttcccgttactaccaaactgattcgaatccctctcttcccgtctctcttccgatcagagtcatccgtgccttgtgcctgtgcctgatcgcccgccggcttcccgccattcgtttgttgattggtgtgattgatcagttccaaatcaccagcacatattatcgcggatcagtggcggcgcaccagcgccactgcccgatcactttctcatgactccacacacacactcgcacacatcacaactgctgatcagattgttctctcgtaccccggtcgatcagtagcaatcgtttgtcgctgtccgcgtttaccgataccctttgctactgatcatacatttgagcctcggcgaggctggcgccaagtgcggacagagagcgaaaggaatgcgctttctctccctctctctttctctctctctttctttctctctctatcttctctctctaccctctctctatcccgccgctctctctctccccctctctctctgctttctctgtatgttcatcaccagtagcattaacaattgttattgcttatcacacaattcaatgggaagattgtgatagtgagagaagaagcccccttctcgccgggggggggggggggggggggggggggg

SEQ ID NO: 19478 - DNA, 2299 bp, Heterodera glycines
  misc_feature (249)..(249): n is a, c, g, or t
  misc_feature (2197)..(2197): n is a, c, g, or t
  misc_feature (2210)..(2210): n is a, c, g, or t
  misc_feature (2215)..(2215): n is a, c, g, or t
  misc_feature (2257)..(2257): n is a, c, g, or t
  misc_feature (2270)..(2270): n is a, c, g, or t
  misc_feature (2287)..(2287): n is a, c, g, or t
ttttttaaaacggaaatttttgcccggcaaaaattttcattcaaaaaattttttggggggcgacggccggcggggggaataaattgcaactgacatttgtaaatagttctgggaatgcattggggagacaccattcccattcacattattattaaatggcattcattccttgacaatgactaaccccatcccggcgcccggcgttatttaacccatccctttaaacgattacaaaaaaaaaccaacaanaaagaaattacaaaatgccaattcccctcgggggaaaagggactcaaatttacatggtgatgctattgtaatttattttaaattaggtagataattaaatgtacttcaaatttttaaatagttaatcccttcaagaaataattaattaaattaaatttatttttaaaaattaagaaaattgatttcctttattccttcctttttttaatttcaatttaaattccctcggggaaaaacggactcaaatttaaattgtgatgccgctggaatttattattaaaatgagtagattatattaaatttaactttaaataattttcaaacatttaatccttataagaaaagaattcattaattttaaattttttaattaaaaatatagtgtcctttattccttttcaatatttcaattccccgagggattgaatttaattggcaaaatgaaatgccaaaagggttttttaaatttattcattcaagaaattaaagctgagaaattaattttaaaaaagttttttgccctcacaatttttaaataattcagagaacttaagatcgattttcaaattttttaaaaatttatttgaaatacaaaaatcccttattgctcggactaatctttgaattgataatctaatgaattatgaataaaaaaacaatatttctattccattcataagagtgactctctctctttttttttattattttggcgttgtgttacgctgaaaatccgtccgtccgccggcgtttttcatttttcccccggggcgccgcccgctgcataaaaatttataaaaacgacccaaaaattatgcacaaattatttatttttattgtcactgttatcgccgccggggatcagcaccaaacggcagcaccaaaatgcattcattgagcagtgattaattaatttatgcatatttattttctattttttgctgtctatcggcggaaaaattatccaacggcgaaaaggcaaatgaacaaaaaatggagaaaatcagtcagtatccatttcagtttttaagtaattttagctgtagttttgggctctttggtctctcaattttctgttattttgtagggacaatttattttttatttatttattttttggtccgatcggacggtaggacaaaaacttcccgaatttcctaaattcgtgccgaaaaagctccggcattccagaaacaaaatccgcggccccttatttttaataggtttgtaaagtctttaaatttttagaaaaataaaataaattttaaaaagttttaattcccatgattcatgtttgaataaataatttaaaatttatttttaaaaaattcttttttattattttatattttaatgataaaaataaaattttctctaaagaaaatgatcattttaaaagaattaatctgttactttctgttttaataaatttaaaattttaattttttattaattaattctttccaaaattaaaagaataaaattaattttcccaaaattaatttccaattcaatttttgctccctttggcattttgtttcatttccacaaaaaagcaatctttggactctcaaaatttaaatccgtctttggccaagtgtttgagggatcacacaccgccgccggccggcccagtttggcactaattctactcagaatttgctgcccaatggtatttccccgctaatccttccccccccccatggcttatcagctgctaaaagcttaggaaaaacgcatataggctaattgcgctaaattattctcacggcattttagcgtgtgcccacgattttttgtgctaaatttcatctgaatccaaccgagggccacgggactgagttggaacgggccacattttgatttaaaaatgccaagaattgcgtttttgtttttttctaaaagtaaaaggttattttctagtgatgctcaagaatctcgggcttgngtaaactttttanattanaataattttaatgtttatctaagattttttgaaaaattttcnggtttcgtgtctncgcgcgagaaaaatctncgggtttttttg

SEQ ID NO: 19479 - DNA, 1078 bp, Heterodera glycines
  misc_feature (1052)..(1053): n is a, c, g, or t
atcacacttattttttctttgtttttcgctcaggaattttctgggtgcatttaatttcctcccggtcgtttcctccacccccgagaatttttttacgagaaagtttcaagaaaaaaaaattttttttaaatttgtgattttttcgaattttaaaaaataggaaattttctcataaagaaatagccggtttaaccggcggcgcttgatttttttgaaaatttaccggcccggcaaaagctcgaacccgtccgggttttaaaatcctattttactaaacatcatttcattaaattcgaatgccattttttagcccacttatctcgaagttgcgcaaaactgggtcgtccaaccgttcacctcaataaacgccttgctgaccatcggtgaaattctggttgatcaggtattgtattgtatcaatacaaaaacaaattctttcccccaatttaaaaatgggaaattcgatttttcatggatttttctcacaaaaatttaattgacgtcttcccccaatttttcctctttctcccaaattaaaaaaagaaaaattaaatttttcacaaatttttattaaaaaatccaaatttttctcccaaaaggtcgctgccaccgaaggggtgcccgtgctgcgggccggcgctttttgcatccaacaacgggcgccattctttcgcctcagtgcgccgctgttccgcaacattcaaatggacgagaaaaatgacgcggacattgcacgaatgatgtgggattgtatggtgggaacatttttggaatttttcaaaaattagaaattatttattcattatttttaatgcatttggtatggcattggcacttttcggttttgaatgacccgtgaattttgaattaaaaacaaaacaaaagatggaggcgtcttatagtattgcatttataagaacatttaagggaacaatgcaaaaaaaattcagccattttggaaaattttttgaaaaaatccggccacaaaacagaaaggtaccatagcactttgggtgggagtcagctgtgtttccacctttcctgaagatttnntaattttctttgagtttttttatga

SEQ ID NO: 19480 - DNA, 1089 bp, Heterodera glycines
ttgatcaaatttttttaaacttggtatgtagatagagaatttgtagggcttttgtatgataccaagaatgtttaatttggtcgattacaaaaggatatgacgattttttgtcgaaaaaccaaaaaattggggatgcctagtagttggggttttccctttatctatatccccattttattttgtttttgaacttaatcgggttatcccggtcctcccctatcggttggttacccgacacttgcacctacatatttttctatgggcgagggtcgacgcctaaattttacgaaaggagtccagccatgtaaatcgtcgaattttttttttttttgctcttcaaatcactttcttttttgcagcacgcatttttcaaaaaactttggaggaatattttaatgaatctggctacgcccttgttagtgattatgcaaaaaaaaaaaattgacacattttcccattcgtttttttagtttcattgacggcaatttcatcgcttttttcgcccgtcttcgtcctcttttcaccgcttgtccaataaatttggacattacaaaaacaagacacattgagttaattgcgctcaacttttggccaatggtcgacaaaagcatttgtggcctgcctttgtttgccaaagattttcactgtttgcgcaaattcgtgccgtcatttctctgcgattgtccaccactgtgtgttgtcaatatcttttatgactatctgtttcccgaattgccggccgatgacagtgccatggcgtcggatggccaagcgttggccaaatggctgttcactgcccatccggacaatgtgccaaaggttttcgaatgctcgtggggcaggaataataaggacgacggggattggccgttcaaaattgctgacttcaaagcggtaaacttatcattaattaatgatgtcactcaacgaaatttcgtcactttctttaatcgtgcgaggatttttaagggcgaaaataaggacgaaaagctttcaaatttaggggtatacttttttaaattgttctttttattatgaaaataatttcagattaaggcaggcaattttattcactgattgcagttacaa

SEQ ID NO: 19481 - DNA, 3030 bp, Heterodera glycines
ttagaaaaaaaaaattttttgaatttttttaggcaacctaccccaacaaaaacagcaacagttgcagcagcagtgcccggacttggagtgcatttggaacaatgtgtggtcaaagaatgagtcggtccgtgccctttaccctccggcagtgtacgcctcgctcaagtcgttcatcggtcggactcgttgtgacgggaggacaaccgaattatgttgacggtcagtctccaggccccaaccccccccccacccccccaccattaaatttttaaattttttgtggaatttttttttcgtcaaaaaagtaatgacgaatggttggcctatagagaatttcaaaaatatacatttaaaaaacatttaaaaaaatatacatttaaaaaaacaatgacaacgaacgattttttgggcgattttatttgaagggacaaattaaaaaaaagagaaatttgactgaaaacaaattcgatttgagaggattacttttaaaaatgttttgaccaatttttccaaccaaacagaaattgagtgttgcgagtccatcaaatggtactggctgaaccgtcccgtgttggacccggagatggacgactgtactgctccgcgtcgctgaacggggcacatcggcgggcacgatgagcatttcggtgggtggggggtgccattggtttcagggcggcggttggcggtgccgttggcacaccgcgacggcagagccgaagcggcggaggtgcgggcattgcatacggcggacgccggtgccgcattacaattggaactttgcggcggcggtgccgacttcaacaaccgggactcggcactgggcagcgatgtgagtaatttcattttttgtgccgttttttgttttgttttggaaattgagtgtttctggcggtgccgagggcatccacaggaaaatttttgaaaatttcttactcaatttgtctgatgtgctctcactcacaatcagcacttgtggtcaacaaaatatatcattcattttttacttttttaatttcgtcaaaaaaattattcatttttcagaacccaaccagcagaagtggcaccatccgttgtcggcatctccaaattgacccggacaccggacgatgtcggacatgctcataccggtgagcagaatgaacagagggtcatctggggaacagtacgtccccccctcccgaaatttttttttcaaacagtaatttaaggaaaattaaagaaaaggcatcttgaaaatatcagcgatttcttctttcaaaactttatgatgaatttaattttttttttttaattttctaaaatattaaaattttcctattgatttattgtttttccaactttgttagaaacaaatttctctgatctttttcaaaagaaaaacatttgataatttgatttaaataaataaaaataatatttctctccgttccagcccaacaagttcaacccgtacagcaacagcaactgccactctgatggactcgggtcgtccggtggcggtggtggcctcaacgcgtgcgctccaacctcattctgttcgttttgaggtaggtgtttatgtatgtggtggttggtgctgcacaccaatgttttaattttaaaaaattaatccattttcatggaaaattttcaatgattttttaaattttttttggcggattgttggtgggcgattttcatcatttcccagccgaaatgaaaaataatattttgagtcaattggcgtcgaccgtttttcttcccttttttgcatttgccttttcatttgcttttatttgtccattttttacatattttttatcatttcgtttattttcatatatatttatttgtttattcattctttcatttgtttgtcttaaacagatgggttcatcaacaaattgtgctgataaaatcattttttgtcatttacccctcctccgtcgaatgatttctctttaattgaatcaaaatttacaaatatatatacctaatcctattttattttccttattatttgcactctctctccccaaaatgctttataaaaatcccttttcattcaattttaggtaattagggtaaaagccggggggatcgccgccagtcaaacggtgataaaaaaaatcacaatttcaccgataaaattttaataaaattgtaaattaattccctattactttgaatattgtacagaaaacagctcgacatttccatacagtatgcaaaaagcaataaagtactgtaaaatcaatgattgagaaagaagcgagagggggggggggagaagtgacaaactgaaaaaaacattgtgagaaaagagacagacagggcgagaaaaggagaaagacggtggaaaaaggagaggcagagagagagggagagagagagagaaaaggggagaaaacaggagacactgagagagagaaaagagagaaagagtgcactatttaaataacggcagtgcaaaaaaggaataaaatgataggcgattggctgataatggcggaccgacggggcgggggggggagaggggaagggcgactgacgcgtaaacaatcccattgccccccccctttcatcattctttttttccccccgcaatttcttcatcgatttgactctttcgtttcattcattttgcttaaacgtgtgccaatatttgttattgccattaatttgcaattaaattaaattttaatttatttaaatgtaaaataatcattttttgtgacctcctttaatttttttcgaccaatttttagtgaacattgtcggcgcgggtcgtctcttcaagcgtcaaatgtgcaaagcgttggggcaagcgccgggcattgtcacgcgggagggaattgcaaaaggcgtgcggatcattgacaacggcggacagtacaaagcggcaattggtggcgaacggtgagtggggggggggggcgacggacgaacgttgcgctggtccaaaaacaatcgtttgggatgggttcgagtcgacttggcctaaagggtttttcgggcatcccatggtattctgttgtaccctcatca

SEQ ID NO: 19482 - DNA, 1705 bp, Heterodera glycines
aatcctcaatggcattgttcaatgcttccattggcgttgtttcgggatttgtttggacacggagcaaaattttgtgttccaaggggtgggggtttcggtagccggcaaaaagcactttcggatctttgaggagctgactgaaagtatataaaatggaaagccgaacaagaacttaactcactgtttgaggaggtttccgagggtgtggtcctccttgttaaaagtaaacaccgccgcattcggcacttttgtgtccttctcaatgaccacctttttctctccatcagccaacagaaacggctcataggcagcaggagtattcatattcaagaaggccgaaaaaatgaaatggaattttattgaataatcagcaaatgaaaatacaaattgttacaaacaaaataatgagcaagttttgttaaatgtgtgatttattcgttcgttttgcgaaaatgaaatggcggagagtaagtgattgtttttcagaaaagacaaaacaaaaaaatttttggacaagacagtgaaacaattaaaatgtgatttatgaaattttgcctcgaatttaaatttgcattaattaaacaaacaccaaaccatgtaaaagcactgacaaaaatggattttagcacaatagcaaaaatattcaaccgtcaatcactgtcgtcctcgctgcccttcttttgtgccgaaatcattttgccgaaactgaacgggtcttcgtcttcctctttgtcgtcctcgtaacaaaaatggccatattttgttgcttcgtcaccgtaatgatctgtttgtaaatcattcatctctctactatttgaatattaaactcaccgaaattgtcgtccccacttgtcgagtcgttttcatattcgttggtgcgcactccgtccgcgaaactgataaatttgccgttctcttcgtccgggtagtcatttttgtagtattcttccgcgtttgagtccgattcgtcgtcgtatccgtccgcgtctgagtcgtcctcctcgtcctgtccgccataataaaacaacaattcgtcttcctcgtcttccgtgaacagcacaccatccattttgctaatgttatggcttccactcggcgctctctccccaatcattgcaaagtttttcgcaattgtcgtagtcccttctacgccagaggcttgcccctccgaagaattccactggtcgttaagtcgcattttcttggtcgattgaattagcgtgccgaaaggatcatcccgccgcttccgtctcagccgaatcatccttggcatacccctgggatggggtcttcgcgcttgcccaatctgttgatgattagtgaaagacgacgaggacacggactggtcgagatcacacccttcctgctcagcaatcggagccaaattgaacgatttcggaggaatattcattgtcgacgaactttctacattttgtttgtttgttttttgaatttataaccaaattaatgatactgatgagattgaacaatccaaatttaaaaaaatcaacgcatgatacagatagtctatcatcaatttatattgtcaaaaagaacatagataataatcgccggtttgccgtgtcaacatcgttcgatgtgttcttttgtcccgtctcttcgctctctcagatcactgctgctgacactgcacgtgctgtgccccgcccggccccgtcggcacttcgtcgtcgctgctgtcgtc

SEQ ID NO: 19483 - DNA, 837 bp, Heterodera glycines
  misc_feature (779)..(779): n is a, c, g, or t
tttttacatcggtccttttcatcaaccatttctcctaaatccgaaggaaacttttagtacttatttgattgtgaccctcctattgtggaccagattcaccttcacccgagcattgatcacatcgcgccgccatctgttggatcattccaggcccaatctgacgcgtgcgaaagacctttccgcttccctgacaacggtcacatttccgaaccgagccttgttttccaccaattctgaaaaatttagcaccacattttatggatttaaatgaataatccgcatttcgcccgccctctcacccgttgcacgttttgcacagcactttcttcgtcaattgcaattttgtattcttccctttgtacaggtcttccaacgaaacttgtaaaggctgaaccgtcgtctcccccttgcgcgaccgctgccttcccccgctaaacatttgctggaacaacccgcctccgccgcccataaaggagggcatgccgcccccattgagcatttcgaaaagatcttcatgattaccagcgccttaaattatgaagctttacataaaaattacacaattgctctgttttttcattgaaaacctggaaatgtcatttctgtgtatggtgaacgtcgaagttgtcaacttataaatcgaacagcagaataattagaaataacaaatctaagacaaattcattttaaagcaaaaaaatttttgaacaatatatatttattactcaattatgttggaaataattagaactaataaagatgctttgtttttcatccanaattttttctgctgatagagagggtgtatatggaagaccaaaaaaagggttacctaaa

SEQ ID NO: 19484 - DNA, 1802 bp, Heterodera glycines
ttttttcttttcctcaaatgttacgattgcccaatcttctcagtttttcttgtcaaatctgttttccctcccttgatgaattaaacacctcaataatgaccctttttacttattcaatcgtctgatcctttgtcttgtgttttggtttatgtcccgggacaaaaaatgtgatttatttactctccaaaatgtttccctttgttaattaatgagcgttcttttctttccacccttaggaatgggccctttccttcagggggtttgtttggggaaatgaggggaacattttcgcatccgaccgttttgcacagacgatcagatttggccgccgtgggccttccacggtgctatgtcgtcatataaaaaccctcaaaaagggcgttatataaaaaaccctcaaatggttttttttgtgtttttattgatttttccttgtgttttgggcgttatataaaaaaccctcaaaaagggcgttatataaaaaaccatcaaatcttattgttaccgtattaatttagaaaaaacaatcgtgccaataaaataaaacctatataaaataataaatcattttaaataaatattttttatacaatattgacattaaatgtaatcaattattggatttatgtaaatgttacgtcatctaaaaaaaattattcgctagatttatattttttattattcatattaatggaaatgcatggaccatcaaaagccgtatattgtatattatttattttattcatatttctttttaaaaatcggatttacgattacattactggtggaagccgtgcttctttttgatgaaatgtcttacaatttgattgatttgagggttttttatttttgagggtttttatataacgactcagcaccgtttaatttgctatcgaatacgcaataacaattcactcgttttatttataatttttcgtattgatgaatttccttcaatttattaaattaaaacgcatgtccataaacatatgcaccgcactgtacctatttttaactgtgatcaaaatttggaagtccttaggcctaattagcagggaacggaattgatcccaaaagtttctgaaaattcaccccctaataaatgaaaattattttctcaaaaattcatctccaaaattatttatttattttcttgacaactttaaacttaatactgatttggcttaattttgttgctttttagagtagggttcgagccccgcccccgtcacccccgcccccgccgggggcgggacaggttttttgggctcacgacagctccccagggttagaagaaagcgggacgtgactttggccaaatcccataatggtaatcaaatttcgcccaaaccttcccctccatccctttcaccctctctctctcccccccccgctctctctctctctctctcccagctcccatcctctcttattttctctctctcttcctctctttattttgttttctctctctctctctctttctttcttttcctgtctctctatctctccccccccccctctctctcccagctcccatcctctcttattttctctctctcttcctctctttatttttctttctctctctctttctctctcccagctcccaccctctctcgttttctctctctctctctctttctttcttttcctgggtctatgtctctcctcccccccctctctctcccagctgccatcctgtcttattttctctctctcgtcctctcgttattttgggttctcgctcccagctcccagcctcgctcggttgcgctctctctctctctctgtctttcttt

SEQ ID NO: 19485 - DNA, 1354 bp, Heterodera glycines
  misc_feature (7)..(7): n is a, c, g, or t
  misc_feature (14)..(14): n is a, c, g, or t
  misc_feature (18)..(18): n is a, c, g, or t
  misc_feature (44)..(44): n is a, c, g, or t
  misc_feature (160)..(161): n is a, c, g, or t
gcttctncatagcntatncagtaggaaaaacactttcttttttngtgtttgcaaacaaaagtttggacttttatttacatattttagtagatattttgcaaatttgaatatctgttagaaataaatttaaaattcgcccctatcggcacgcccccccccnncaaaaaaattttttttttcttaaaaaaaattacccaaaaatccctaaattttggttactttttagtcaaatctgtgcaatttatgtcaaaataaatattatcaaggcgatcaacgaataaaagaatgtggagccaaagaaattattcataaaaaatattttttttgtgagatttttggagctaattcaaagcaaacccccgccccgcccccgcggggcggaattatcgtgcccccgccaccgcccccgcgactctgacccccgcccccgcgaaaagccacctccgcccacggggctcgaaccctactttttagacaaaatttacgcttttactttgaggtgtatttttcgtttttattgccacgccaaaataggttaaaataggttttttaaaacattttttaagttttaagcttctaaaaacctagaaaataggttaggtataggtactaaaaactcgaagtagcttaacaaccaccaaaaaacgtttttcgtaataggtaaaaacctaaaaatcgtatgttatgaagcgattctaaatagttgaatattcatttaattattttatttaacaattgtttatttcattttactaagcaaactttttcttctgttgcaacgaataatcggcacaatgaaaaggcagaaagaagttaaattcaattgaattaatatttttaaaaatcaaaatgtgcaattaaaaaaaaactcaaattggactaagtttttcgctgattcgttcgttcgcgtggggattttttggcactatattaagaatttaaaaaataaaaataaataaatatgtaaaaaataaggtctaatttaaaagtatagtaaatttaatcaaatttggaatctacctaagtttttttcacaaattccctacttgattaatatgcttaggtattttgctggattcattattagggctaatatttttagggttttacctatttttttctgagctcctcgtggcctgaaacgcatctcaatactgatgccctacttttttaatttttaagtaaaaatatattattaaggcgccatttgggttatttaatatgaaatcacagcataatttagtattttatttagtttttttaattttttaattaatatcatagtgcccaaacttcatgtcgcttcttccgtgaacgttctcattttaaattaacaatttcaattcatccataa

SEQ ID NO: 19486 - DNA, 1236 bp, Heterodera glycines
atttacatggctggaccccttcgcaaaattggccgctgacccgcccctcgacccccttccccagaccccttcgcaaaaatttcggttgacccactcccctttttcatgtatggtaccaactgcactagtaccaaaatggccaattttttaaaaatgattacaatttgtgcccattcgttttcacagatacatcgaccgcaatgccatcgcttttcttcaccatttttgccatcttttcacctctctcccactcactttgttcatttggacaaggaatgacaacatttggccaatgatcggaaaaaacatcaatggcatccatttgccggtcgactttttccaccgtttgcgccaatccgtcccgccaattctcaacgagtgtccatcgcttcgcgttttcgcctctttttttgactacttttccaccgaatttccggccgatgatagtgccgcggcatcggatggccaagcggtggtcaaatggcttttcactccccgtccggacggtgtgccaaaggtgttcaagtgcttgttgctgaaggatgatgcgagtttggtgacggttgtggacgccttcaaaacggtaatttacaaaatcattttatgttcgaagctgtacagaaggatcagtttttgtacttatccagtttaggtggcccaatgctccacataattgagttaattcagtacttgtacagtttggatatccctggaaaaacgtttttattattaaaaacataaaaacaaattatgtagtccaaactgtacaactaccgtaaattctagaaattagagtccccctcccctttgttttttaatttaaaattccactatttttcggaggcccccaactgccggaggcaccgggggcttaaagtaaaaaagtgccaagtctgaacatttagtttttagtaagaaaatcaagataaaatttttttgaaaacactaaaagttcatcaaaaaaaaatcgctgaaaagttttttcaaaaaattttttttagcttggctggcgactttttctgttttgaaagatacatacacgaattaattataaatttaaattttgcacatctttaggcatttctcgatgaaacttcttttcccgtcaatttcattgttttcatttcgtttcattggccttttgccgacgccgttgtcctttttgagctgaccaacgaatctacacgagaacaatttgaccttgaaaaaactaacgaatattacgaccatttttct

SEQ ID NO: 19487 - DNA, 1657 bp, Heterodera glycines
  misc_feature (853)..(853): n is a, c, g, or t
  misc_feature (887)..(889): n is a, c, g, or t
  misc_feature (892)..(896): n is a, c, g, or t
  misc_feature (898)..(899): n is a, c, g, or t
  misc_feature (901)..(902): n is a, c, g, or t
  misc_feature (906)..(909): n is a, c, g, or t
  misc_feature (912)..(915): n is a, c, g, or t
  misc_feature (917)..(917): n is a, c, g, or t
  misc_feature (924)..(927): n is a, c, g, or t
  misc_feature (930)..(934): n is a, c, g, or t
  misc_feature (936)..(936): n is a, c, g, or t
  misc_feature (938)..(938): n is a, c, g, or t
  misc_feature (941)..(942): n is a, c, g, or t
  misc_feature (944)..(944): n is a, c, g, or t
cgatatttcgtgaagaaagtggagagttccagcgcaatgtcttcggtgaggagtcggcgaatgatgcgcagaaaattgacgacctcttcatcgatgtacctgcagaaagtagacagatagaaaaatgaatttggaaagcaaatgacgatcaaatggaaattgatcggaagctgtgggcaatgtacggcaacggagtggtgggcagtggcatcgtattgaagttggagcccttgattgtcgtcatgatttcatgcagccgattgttccgtcttcttgccactagttatgaagttgcacgaagcgccgtcgtcatatgcggacatgtctgtcagccatagcgttttaccgaacaatgggcagcaaaaataccgggctgagttcgacaaagtttgctccataagaacgtctacgcacaaaagtaatctcttagagtccagaataagagcattcagcaaactgcctccaaatcagttataagttcaatttattccgccaaaaacgtatttaatattatttttcgcctcccatgatggtttataacgatgttggggaggaaataagcaaatcgtacatttcagagcattcgggatcaaaaaatcccattttaaacaattttgtttgcggcgcatttttccaaaaaaacttttgggtattgggcaagagggagggtccggcggtgccgataggcgccgccggaaaattttttgtaattttgttctgatttgttaatagtttttcaccaaaaaaggccaaatttttgcgatttttaaagcgattgttaacggatttttgtcaaaaattccaaattttgacacaaatcttatattttttcttgatacatagtgacatttcnccataaaatttcaaaatttttttataatgataannnatnnnnncnntnncccnnnntcnnnncntttcttnnnnatnnnnncnantcnnancccctcaaaaatagcatttctgcattaaatttttttgatttgattttagtgcatataaaagcatattttgtgggttttgagaataaatgcatatttcgccatttttgcattttgagagcatatttcggtcatttttggcaaattttcataagaaaaatgcgaaaaaagcgaaaaatacacccctaaggacctactatttggaattttttttaaaatacacccttaaaaatcgaaaaaaattataaatttttataagaacttttgtaaaaaaaaatatttttataaataaaaataattttgtttagcatacatataataaatagagaccggatttttatgtgctaaaaatcctgaaatatgtaataaaatatgtgctaaaaaatgctgaaatatgtgctaaaaacccccaaaaatgccaaaatatgtgctaaaatatgtgttaaaaattgaaaaaataagtgtgtttttgcataaaaattcccaaaaatctcattctttatcatttttagcccatacaacgcaaatcaaatacatttcgaagtgtttggggtaaaattgtctttttttgatacatcatttctataaattgaaagttccagcagagaacttcgaaatccaatgacgaattaatgaattctagatttcattattttctactatcgaaaaaaaaattttttaatttgaaaaattatgctaataattacgaaaaaagt

SEQ ID NO: 19488 - DNA, 2829 bp, Heterodera glycines
ctgctgctgccgctgttcgtcatcgtcgtcaattggttacggtaaatgtgcgttttcgccccgccccctccgccgccgggcgcaaatcgccgccgaccgacggacgaaaggcacaaagtgaacgaacattgggggggcggggcggacggactttgtggctgcgaatggagggacaaaacggcggagaaaagtggcaaattgaggggagggggaatcattcgtggcgaaaattgagaaaacgccaaaaatatttttactgttttaatgccaatgccattttgactttgagtgaatttgtcccctaaatttgtgtcgatttcgttttattttaatttatttatttaaaataggaaaattaaattctgattttgcgacttcaaattttacgctttcattgaacaatgtcctgttcatcagctgtgcagccgccgtcaagtaagtgaacgaaccgtaaaaaatattatttaaaaaggcaattaatttttatttttattattatttaaatttaattaaaaatgcgtttttaaattgcgcaatgctttttaagcccattaaatttgtgttggcatcaaaaagagatatggtaaagaagccaaattggcaaagtcacttattcttttgacaaaactgtcccttttttaaatggcgtctaattaatccgtgccaattttggccatcatttgccatccatcatttccttttttgtttgatttttccgacattcgctctctctccaatttcccaattgtccatataaaagggtttgtttcaccgtccccctcccatttccccctcccccattttcgctctgttccatgctcaatgtgggcactcactctggacagcgtcgtcgtccttctcgacatgtcctgaagcacttcacggatttgcccccttaatccaatcacatctgtccttcacaattggtgaacacaaagtgaagagggacagcagggcaaacacagcacagggagagagagagagcagtacaactgcagcagacagaacaccacacacatttgcacacatattgttttgcggtcattgacacaaatggccgtcgtcaccatttggggggacggaaatgccccgggggggggggggaggggggaattgagtcgttgtgatggcaattaatgagtgagtgcaatgcaaatttggcaatttggacaaaaaaatgcaaatgcctacgggaaaatttttgccgatcaaattacgacggcgtcaatgatcagacaaactcaattctcattcactgatcattttgggaatatcatctgctgattctgagtccgtttcattcatttttccctatttatttaaaaattccgtagttcaaaatgctctcccccattcatttgccatgccaaaatggtcgcctcttgattggagaatgaatttgtccctgaaatgccattattacacaaatgccccctcccctttcccaagtcgagagttacgccgtccattggcaaagtccgtccgtctacggcacttctgctgatggcgcttctctcaaatccgccaaaaagggcgaagaatgtttgccaagttggcacatcgtcgccgctcttcacttattaatttctgtggccccataaaatgcgggggggggggaagtgtggtgggatttgtaatgtgtgggaaatggtggaaaaagaggagacaatggcatttatataatttaaaaatagaaaaaaagtcataacggcatttgaaatggcatttaataaaacgcattttaaaattgtaaaaatggcatttggaattgtggaaaatgcggtgaaaatgggaaattttttgcaaattttcaggtcggattttgctggacgtgccctgccgagtgtgccaagaccattcgtcgggcaaacactacggcatttttaggtctcaccgctttttattgttgtgtttttgggccagaattgaccaaaacttttagttgcgatggatgcgccggcttttttaaggtcaaaaataaaaatttgatatatatttttgtgtatttttaaaaaaaattcagcgctccgttcgccgacaaagggaatatttgtgcaaaaataagggaggccccgtggagggacaatgtccggtggacaaaacgcaccgaaatcagtgcagggcatgccgactgagaaagtgtttggagattggcatgaacaaagacggtgagaaaagtgggggaaaattgggggaattttgattaacggacaaaaaatttatatttattttttaaaatgaattaataaacatttaaaatgggttttggtcctttagtaaaatgaggaaaataaatcataaattgagcaagaaaatttaatttacttatccttaattgttgaactatttttgtacaattagaaattctctataaattataataatttcccaactaacatgtgccccgttggcttagtggcagagcgtctgtctagtaaacagaagatcgctggttcgattccagcacggggcattcaattattttttgaattttaaattaattaaatttgttttttaatttcgcagcgtttcctttttatatttttaatctgtttttagctttttccatttttttaatattcccttctttcttgtcattttcttcttcgcttcagctgttcaacacgaacgtggcccccgcacttcgacgcttcgccgtcagttggcgttcggactcagccagcagttggcccaacgtcaccaccagcggatgttggccaattctgcggccgtcaaaaaatcgctgcgtcttccgccgccgacgacggcaatggcacattcctcacggcacaaaggccgtcctcgtgccgggtgagcaacaaactgatt

SEQ ID NO: 19489 - DNA, 1038 bp, Heterodera glycines
  misc_feature (994)..(994): n is a, c, g, or t
ttcgtaggatctgcgatcgtccatctcaatgtatggagtattctgccgaagggacgcaggaatgcgaactggtgtactgtcactacgtaagagaggaggactttgtgcggatgagcaaagagctcaatatcaccagcttataaggagagtgaatggtgtggaaaagcctataatgaaatgcaatgccaacataaagaaaataatggcaacataatgccaaaatagttttttataagattgatagtggaaaatcgccatccttcgctacaatgtctgataccgaggagacaaagtacgaaatgcgcaagaacgaggcgctatcggtgccattctctactcagacccagcggaagtggcacgagacggaatagagccgggtagaatgagccgaattcattcattcactccttaatactttctatcccttccccccagggcacactttcccttccgccgtttggatggtatgccaatgccaatgccaatttgatttggttctcacttgtccttttcagccaattggcggtgttcagcgcggctcactgaaggaattgaacggcgatccgttgactccgttgctgcccgcccgtgccgatttcttcaaagaacgcactttggaagaggtgatcccacccaatcaatcactgatcaatcgatcaatgcctttccataacattcattctcaaattctcaacttctaattaattccccgtggcttttctttttcaatgccaatgcactgaactgactgatttttaccttttatccttctaaggctcaagagcaaaaagtgcttccgtcaattccggtccttccgctgagttatggcgacgcgacccaaattttgtcgcgaattgacggaccaaaagtgccgccggaatggcagggaaattgtggcaatttctcttaccgtgtcggacccaatcttgtcaaaggccaaaggttgaagcttgaggttcaatccaaaatggagacaaggcgagttcagtgacangttccaataatgcccacttcagtacggcacaaatccccgacttt

SEQ ID NO: 19490 - DNA, 2007 bp, Heterodera glycines
ttcacttaccgaaacgcctcttggctcacttatccgctcttctcaggcgatacgaattgccttttgtcaacgagcatctcttcgacaacaacaatttggccgtgagaatggccaaatttgaaatgatcaatgaaaggggagtttaggttcacaaagcagtgggacaatattgggcggagctcggccgcgcattcgccgattctccgctgttgccaatcaacgccactgtttttgcgcataaacttttggccgactatgttggagctgtgaaggaggtgatgaatgatgaactgatcgtttacatgaatataacgatgcatttgactgatcaattgatcagtgagtgatcagaagttttgactgatcagttgatcagtgagtgattaaaaattttgactgattaattgatcagtgagtgatcagaagttttgactgattaattgatcagtgagtgatcagaagttttgactgatcagttgatcagtgagtgattaaaaattttgactgattaattgatcagtgagtgattagaaattttgactgattaattgatcagtgagtgattagaaattttgactgattaattgatcagtgagtgatcacaaggcttttgactgatcaatttatcagtgagtgatcacaaggcttttgactgatcaatttatcagtgagtgattaaaaattttgactgaccaattgatcagtgagtgatcagaagttttgactgatcagttgatcagtgagtgattaaaaattttgactgattaattgatcagtgagtgattacaaggcttttgactgatcaatttatcagtgagtgatttaggcttttgactgatcagttgatcagtgattagtcatcttaatccttcccattccttttcagtccgttttgtctcttcacttgcgttttcccaatgcttctgcacccgccgttcgtcagttgtccaatttgttgcagaacgtccgtcttttcattgagcaagcggaaaaatttgaaaaggaattgtccatggagaaggaaacgccgaaattggcacgggcaaacgcgcgactgcgcaagttggaccaatgttttgtgaatccgacgatgggtttggcacgagaagagccggagaagtaaggggacgatttggggaggggaggggagtctttttgaatgcttgtccatattttcgatcatcacattggtcccacatttctttgttttatttcgctttttccccatttttttgtcaggcgccacgtgctcttttcaatggccaaaggtgactcttaccaagtggacgtgatggccgcagttcagcagaaggtaaatgtacacaccaatcagcttcggttccattgcctctgatttatttgctcaaataaattaattggccgactttttgggaaaatttatttgttacgacagattgtgcaattggcgaatgccaaaagtgagaagcaaagggccaacagaggacgcgaattggcattggaactgacagtcattcagcaggccacgctttgtgcggtgagaacactcagagagacaatttgagcagcgaaagaatggcgaagaaacagacaaataaatgaccctaattaactaattaatggaaagtgacacattttgagatggaattgctgacgattgagaggcttttagccacaaatatttattccagtggataccctcgactaatttcactttctttccctttccgatcattttcaccgatcaaaaggatttgcccttttatttaataatccgtcaaaaaacccatttttattcaatgttttgattggttttccattttgcttcacatttcgcgaattcgtgcctcgtcaaattggtgattcaattaagtaaaatggaaaaatggtagtgatgttggtgaagtgactaatgacgaattatgggggggggggggggttggaagttcacatcgacagaacattcccagcaaaagtacgccggcgccggcggtttgtacgtgcgcttttttgtgatttgatttcgga

SEQ ID NO: 19491 - DNA, 1227 bp, Heterodera glycines
ctctagaagtccaaattggctgaaatggcattcatttcgacaaatgttgccgaacacttttatcttctatattatggctaaccaaacatcggcggacagggatgtttgtgccgtgccagaaatagcgccctctgcccttacaaatgatgataatgtgcaaatgagcaaaaaaccaattgacgccatatggagatggactaattccgatgataatgatgatgatgcttctcgagcattataacaaatgccgagacatttaacaattcgagaccttcccgagttttttttggtcgagagtcattttgttttgaaacgattctcgagacttgggctcataaatatgatggaaaatgacgagactttaaatgagtcaaattcgacacgttttcacgagtcgagagtcatggcacttccgtggtcaacaggaaacccggcctaatccctttttatttgtttctattgccctttatgacctttaagttcgccatatgctggcactatttaatttgtattataaatacgctgaaaacgatggtaaagcggcaaaaagtgccgaatgaagaagcatagggcgccactaccattttgagcgagacctttccgataaatgtaagtgccaaattgaccctgttagacggcggcaaaatgtgctaaatgccatgtggattaaaaatgttcttttgacatttacttttttaggattcattttccttttgcaaaagaaaaaaaaaagaaattgcagtaaatttttttatatttgtgccattctgctttatgtattaatgtggtgaaactgagcctgccaaattggctcttgaaagattaattatttgatgcagcccatttttaaaaattttgcacaatttttcttaatcaatttcattcaaatttccaaaaatttcctcggcgctgactagcgggcatcttcggaccctcattttaatgcagcattttttgaaaatttgatccccaaaaatgcaaaattagttatttttggcgaaaaacccggttataaaatcctgcttaatttgaaaaataacactaaaaaaacatttttttccccgaagagcaacaaaaaaaaaattcaccggatttccgccccgtcccactaaagttttctgcttacgagcctgagttagtacaattaatcctttttcattttttcaccaaatatagtgccgccaacttggcactttctgctgtttgttttaatgagctgaaattgag

SEQ ID NO: 19492 - DNA, 995 bp, Heterodera glycines
  misc_feature (746)..(746): n is a, c, g, or t
  misc_feature (911)..(911): n is a, c, g, or t
  misc_feature (943)..(943): n is a, c, g, or t
gagatttcggccggcgagattccgtcgccgagattccggcggcgagatttcggcggcgagatttcgtcccgtcccccaaaagggtgccccttttgcgtggcactggatttataattggtgtccaacaacaatggtttaccaatgcatgcacttacttttgagttttcttaattgccatgctttatccctcccttgtgccatgccgcgttccctcccccgcttttgttcggaccagcgcaaaatgcttcacgcatggcttgtttcacgcggaagtaaaaaaaaaaatttttttttttcaaatttaattcaaaataccaaaaagttaaattgagtttaaaaatcgaagtttctgttgctgttgcgtgactgaccacagaacatttcatgtgctttaaagcaaaggcctcatttttcagggttaaaatgcgtgggcaattttaaaattccgtaaaaatgatgaaattttgaagtttaatggcatgttcaaaagtacaaattggcttgcgaattggaaaagcatccttcaacataaagcattttcggctctatttcagttaatgagttcacttagtgaccatccttagtttcttaggctataactttccaaaaacttaaagtctacatattttttttttaataactactcgtcgagccgtcggaattccgatttccgcattttttttcttctttttttttgaggcgtcggcacatattccatgagtaaacattcgcttatgccaattttntcaattttgtcttatcctaccgatggagtagcgaatgctttaagttcacacttcatttagttcattcatttcatcaaatctttatactaaatcaattttttgttgaggttgagaagtgcaataaacgcacgtcacataaagtcgtcgtcaatttctttttttttncaatgaatgccaattgtacatacatataagcnacaatttgttggcacataagcaaaaaaaattttttttttttattttacacat

SEQ ID NO: 19493 - DNA, 1552 bp, Heterodera glycines
  misc_feature (1404)..(1404): n is a, c, g, or t
  misc_feature (1459)..(1459): n is a, c, g, or t
ttacagattacacatttcttactactgtacatacagtccgcccattgaccgattggttgtcacagattataaatgatcacgattgaggctccaacaaattgcgcaccatcaaaacacatcacacgacaaaattgttgcacaaattttatgaacagaaatgaagtgaaaaattcgtcaatttaatttgaaaatatttataggaaaatggaaaagaattttccataaagtcacaggaaaaaagtgcaaaagataaatttgtaaaatatgagacaattttgctcttatttggatgggcaaaaataattttaaaaaagcaaaaagtaaaaaagagagaaaaaagcgaaaaggaagaaaaagagaattaattggctttatttttgttgcttttggtccacagcagcacagaaaaacaaatagacaacaacaacaaaataatgacgaaacaatgttggagaatacgggaccggggcgggaattcctggtcctccgaggtcccgattcccggtctcagattttgaaaagctcatgtcccggtgccggtctgttaaatgaattaaaagtgtattttgtttgaagcttatagcaagcagttttatttgacttttttttttaaatttcgcccaaaaatgctttgaaaatcaaagcaaaaaatgtccaacttttaattttttagaaaatctgaattcttagtcaaaatttacattaaccctgtttgtcctgaatttttaaatataaatactttccattcacaagaagataattcataataattaagttaagggtgaaaaatttaaacttttaaccattttatactcaaaaaagctggtcaagataaatgaaatatttccatttttagggggcctacttttaaaaaattaaatcgatccataagagatctatttttcgtgtacatatagaattttatggtggtgttttcgcagggttatttaccaaaaattgcaaaaaatatatatgccgaaatatttacactaacaccaaatattttaagcctgttgatcattcgattagtttatttggcccatttatatttaacttatgataatttaatcgctttcataaattcttatattatttgcgaatgttttttttctgtcatttcattatttattatttatttatttattattcatttatttatttatgcattcactttgctttgttgcatttatcacatcttctcatctcgttgtccaaagattcattccttgaattgatttggccttacaattatttatattccacattcatttattcaacaaacaaagcgactaaatatgtaacctaaaggcctatatttaattcgaaattaattttgattaattatttacatttaattatttaatactaaaaaataattagatgaataattatattacgctttanaaacatgcctgcaaatatatttcgaggtgccgaccctatggaagtgtttgataanattatcacaaatgaggccccgccaaaggcacgagttggacatgtaaaaactaagtttaaatacaataatataaatattcaatggtaatgcaac

SEQ ID NO: 19494 - DNA, 2369 bp, Heterodera glycines
ttattttattttcagcaatttttccaaatctgagcacttcggaggaaatgagtgttctgattgccagaattgctgagctgaatcgagtgaacacaattgaaccatcaatcgcaagcagatcggatgtgttagggcaagacagaaacggtaggaaatatttaatttttctggatactgtaataatccaaaaaattctaagtcaatgatgatgggacgaccagcttttctaacggtaacaacagaacaacaacaatcggcggtgagaaagttttattttttcgtttaattttttttaataataatttgttaaaagttaatttctgaagttcaattaaatgcaatttgaggagaatcattgcttcataaattataataattttttttaaaagacaagatgatctaataatgaaattacgtaaaatttatttatttttaattttcagacagaagaaaaatgacgaaattgttcatgttgacggtagtgaacattacggtaacagtggcactgatcggcttcattgcggtggtttaaatttagaataattccttcttcaaatatacgttatattcaataaagaatcggactgagaatgcacgaatcaccgcattggaggaacagcaaaagaaagatgaaaattttgttgacgttttgaaagaccgatttggaaagggtaaaaatgaaaatttaatttataaattttaatattttaatttatttttttgcagagcttttaaaagctgtgcatccggacattcgcaagaaaattgctgaggtggaaaagaacaaataggtttaaaaaataaataaaacgaaaatcagtttagaacttttcgaacccaaaacacaacttttgggatgtcaataccagtcacactgatctcgaaatctttggctcgggatctctgaaagtgcattacaaaggcgatggaagcggtaagtggattgatttctgattaagtactaaggatgtgtgcaattaaggttttccggaactaaaaaatctcccgaattacgagcgggttacggattttcgcaatttatttttgtccattgagctggtttggcaaaactctttatttggaataagttttttgggcttttactgaattatatttaaaaaaatacaatgtggaatgaattttatttatttattttttaatacaaataatttttagtaataaatattttatagaaaataacattaaggtcgtcgctctgtcttcgctaaacacccaattttgttctctgaatccggcattttttattttgaaatcaaaattaaaaactgcaaaaggtagcactaccatatgaaacatatgaaaatggttgatttttattttcaaattcagtctttgctcaattggactcgccaccaaagcgatgccattggacggaagtgttggccaaaattcggacagttgcgcatatcaaagcgatggccaattttgggccaatgggtcaacgaattttggaatgccaaacttttctcaaggcgatttcgtcggttgtggcattaatttggccactcgtcgggtcattttcacaaagaatggccaacctttgagttgcttattttattttaaattatttatatttcaattattttaagatacttctgatttattcctttcgccttcttttgattttccattgtttccgttcatttctttaaacaattctggcgatttgattgagacaaattttggaccaaaattcaaattcgaccccgcaaaagtccagcagcaggtgaaaatgagagaacagaataattataaattatttatttaaagtaaattttaagttaattctcaaatttccacgacaaaattattgggatgtcaatgcttgtaatgagaatctccaaatcattggcaacaaaagtctgaccgtccattttcacaaaaatatttctggtattttcactaaaaataatttataaattctattttttcttaaaaaaaggtttttattccgtcttcgctaaacattctattttgttgaacaaggatttgtccaaatatttttactacgaaatttcggtcaaaaatatgaaaaagtaagagatttatttttattttttttgaatatcaaatttagctgaacttatgaaagtagattatttaatttttcatttttcagttggatcaccttcggatttgccgttaaacagcagtcaaaatttgaatcaataattcaaaatggcacttatgcgtatcaaagtagaggctatttatggattaacggagaagaaaagagaataatttcccaatattcgtacggtgaggaagataccgtaggaattggcgtttatttgatcactcgacaaatcgtttcacgaggaacggacaatctttgggttggcaaataa

SEQ ID NO: 19495 - DNA, 1155 bp, Heterodera glycines
gggagtccaagaaaaaaaatgctattccatataaaccaactaatgaaaacgattgagtgcccgcaaaaagagagttaaccttttgagaagcgaaccgttgcattttgaaataattagggacaaatgagggattgggcaaaggcaaagttgggatgggagaaagcgaggtttgcacagccgaagagaagcggtcgcgcaaatcgaccccgaaatgttagccttagcgccccctcagcagatccgcggaatttttcattcaattcgaggaaaatgcaaacatcggacggacggaggaaacggacgcgtttctcaaactcaccacggagacggacaatcaacattctcatgcactccatcaagtcacgcgaataaaccatcaaaattcaaatgctctcttctcttcctcccccctccattggccatctctccgatgtttcccccattttccttcctcgtccatttgtccccttctcccctccttttgctccattatcctcgtctcattattttcttcctcctctttatttatctgcttctgatcaccttgtttgtcttctcggccaaaacctttcttggtgacccctctccgccgccttccctttgctgcgcctgcgaattctcttccccttttccctccgcctctccggcgctaagatttgcgcgtcgccggcgcaaattggtcaaatgttgacccatctgaccgaaagcacttcagagagagccaaaatcaacacgcaatttgcattgaccagccgaaattgccaagaataagcggagatacgacgaaggattagccaatttggtgaaggaaataaggcatgaaagaaggggagagatgaaggcgaagaacgaatgaaaaacggcggatgacgacgaatgaacgcttctcgggggacgagggggaagatgggggtaatcagtgtcaagagagagaggggaatgagtggccgaagaaggagataaagtgctaaaagtgaagtcaaatgaggaagagatggaagagaaaaacggaaaggaaagatggaaaatagaacggaaaatggacgaggaaatcggaagggaaagagaagggaagggaggggaagggaagggaggggaggggaggggaggggaggggaggtgatttttaggtgtgaatctgcggattaaaatcaa

SEQ ID NO: 19496 - DNA, 425 bp, Heterodera glycines
gaatgaatgggggaaaaaggggggaaaagggaaggaaaggggggaaaagggggaaaagggaaggaaagggaaggaagagggggcgaatggcaagagagaaaattaacaatttgtgcctatttttttttgatttttcttaaattcatcgaccgaaagattaacaaaaaatgacccgttttcagtaaggcattttacaataaatgccgaaattggctttaatgaattcttttaattacaattcccacagtcatttctctcctcacaattagaggacaaattgtggcaatgctcaagagtctcgggcatcattagcaattcaaagccgcaaaatggaggaaaacaatgatttaaagccaaggaaagaaagagcattttacgtatttaatttctcacatttcccattaaaaataaataaataaaaattc

SEQ ID NO: 19497 - DNA, 2382 bp, Heterodera glycines
ccaagcgccgtgtctcagagggagaaacggaagggggaagggggaagtacccatcccggaaaaaagaaaggcccttcttcggttcatcaatttagacgagatcgatctcgaataatttcattgatttgttaaataaatttggatgttaatggttcctgtgctagtaattcacaagatctttacaagttctggtcctcttcctaaggtcatactttcttggttccgtatccgttttttcattgacatttttctcctcatcggcttcaatttctggtcttgtttccggctctcgggcgtggatttcctctaaattttcgccttcccgggattcggggtccatttcatttcggattcacggacctttccgaactgacttcttccacatattgtgtcgtatcaaggcaccttttctctccaaatggtcgcgttcacatagtgcagggacgacacaaaatttatccacgctatatcatttcgttcaagtgtagtattttcgccttagggtagaaaaattagcataagtttggcaagtgtttctttacccgttcacttcgatggccaaattcttgtcctcgccgatcctctcgagcatgccgtccaagaggaagttgccatgtttgtactcgccgccagggctttccacatggcgaagagtccatccgttgtcgcgcatctcttcctcggcacgccacttgaggtattttcgtgcgatggcactctgcttcccacgcttctcgtagccaaggtgggggatgatggccaccctctctttgccgacgtgcgacaagaccacgaagaacttcatgcaggcggacgggatggtgatggagtcggtcagctcctggctcgttgcagcggcgaacaactcccgcattttgaccattccatgggcgagaatttggacatctgaagaaaattgcatatttttttcaagattttcccgatttttacctgctttacagtagtccgcaatgacctcacggaggtcaaagggcgtgttgcggttctcctcgtaccactgctccaacttcttgcgctcctcagggaagtgcccgccagggtagtagtcctcaagcggcggaagagtgtccagcacaacaccataatttgccgccttaattttttttttttttgattttatttatttattgatttttttttttttttaaattttaccttgttgaacttgtgtgggaagtactttttgttgtccactccctcgatttccaagccgaacgtcttcacaaaggaggccagcttgatggggatcagtttgtaactgaaaaataatcgattatttatgttattttacactttttacctgtcccggaagatggtggtagtgattgctcctctcttgcgggccttcatctccagcaggtgattcccctggcgcacgagttcgggacgcacacccatgcgcagcatctcgccgtagatcagcacgtgatcgtaacgtgacccttaaaaatcgataaattttccttttatttttgttaaaatttatttacctgcgtgtgcgtatgcataggtcgtcacagagcgcggtttctctccctcctcatcgtagccgagcatgtagttgttttccgcgtcgttgtcgtcgctttcatcgtcttccgcttccatgtcgaggaaggcatttgcagcaggattccgaccgttgttgttgttgtcaccacgcttccgtttgcggcgcttctccgcagggtcgatgccgaggacatcggcttcgaagtgcaggagccacttggtgaaggccgtcagagggtcgtccaccacgtaggctgtttccacttcagtatcgtagaactcgaacggcgcctatgcgaaggttctcgtcattccacagattccgcagctccggtccagtggctggtcccagatgccctttgcaatgcattccgtgcaagtgacgtgcgcgtagcagaagttcacctgaaagaaatacctaattttcgtatattttgtgttttatttacctgatgtctgaagcgcaggagttcggggtccggcttgaagtccgtagtgcattaaaaaagggagtaggggatgcgcgtgaaatgttgaatcttcgtactgtacggtatgtaatattattgtggcacatggcaggggagaaaaatcatgaaaggattcatattgcaatgtagatcgaaaaattagcggataggggttgcgctctcatttccacgaaaaagatccacgggcagttcaagcaattttactgttttaaaactaacattttgtttggattttttgcaaataaaattgaaatatacaaaaacaagttcttaaccgtgaaaaacaatgatttgattttttaaagaaaactcattgattcatttaaaatttgatgaggaggaatgggattttcatgca

SEQ ID NO: 19498 - DNA, 2934 bp, Heterodera glycines
ataaactgggtacaacctcctcccccccccccaaaaaaaaacacttttcacactcgaaatttttaattgaataataattccaaaccttgaacgaaaaatagaaaatccaaatttttgaattccgcatttttgtttcaaaaacggcttacgaattcgaacatttgaattttcaacttttttgttagagtcagtggttgtgaattggtcgaaagactccgaaaactacaggaaatatgttttatgataaagaaaatatatcctacggtattaccaaaatactttttccgttttggttaattttgagtgcgttatgtacttttacagcagagactgttgtgctgctgccaaacgtgcagcaaaggctggcaaaattcatttggcaacgccggaagaggacgacgaccaagcaatcaccatcaccgtgaccagtgccaagaatggtgccggcattggtggtggtggtggtccgccagaagagagtcagccattgctcagcaaacagacggacgagttcgacggcacggcatcagcagaggggggccaagcggtcggtgggggttcatcaacatcatcagccgtttaattgccatgtcagcggcggagaaaaagagatggccaaacaacagcaaaaacagagagaaaatcagttgttcaaggacatgataatgttgtaataatcacagagttcccctttttaagattaaaaaaagtctccaaatctgattttggccccccccccccccaaaaatattgtttttaacacaaaatcgattgagaaatatttacttaaaaacaacatcaatttttaattctttgatatcattttgataacctaacaaataagtgttttttaatagctcacaaaatttcaaaaaattttcatcaattttaaatgtgcttgggaactctgtaaaaacgggagtcttttattaactatcacgtgtcattttcataatgatggtgttttgcttcacacattgtcaaattgtttttgttttttgtatccatttttgagagtgttttgcttaccctattttgctaggagttaccattttggaatcaaaaaaatatgcggaatatactcggatgtcattcattattttttcttttttttaccagtcagcaaccaattaggtaattaaaaatggatacaattgcatgagaatgcacagcgcccgcctcgctaaaatcgccatttacacatatttatttccttgtttagttttccgtttagttttttctccctttcatacctctttttaaatgttttcttttccccacacatttcgatacattttaatcaaatgcaacagggtttagactagagaccggaaatttcaaatttgcggatcccgctgcgggactggaactcaaaattttttgcgggacgggatcccgcgggattaatcccgcaaatcccgcatttaaaatttgcgggatcccgtgcgggattgcgggattttggaaaattcgaaaaaatttcaattaaattcaaaaaatttccaaaaatcaaaaaatgctgaaaaataaatttttaggggctggcgggatgcattaaaaggggctgatgggtcgactaagatttttcgattggatccgacggtaaaaagttgatcggaaatcaaattattaacggttcataaatatgactatttttttcttttcaaaaccacttttttgcggtgcaagaaatcggaaatttttcaaaaaatatacaatataataaaaaaatttctaaatattttaataggctaaattttttaattcttaaccaagtaaaaggtatttcacaaatgtttttagtatattcgcttgaaaaaattcccgcgcgtgatccctttccatgccggtctttattctacataaatccccacaaaaaaatcttttttttcattcattctggttgatataaataaaagataattttttttaaatggatagcctttttctccctctttgtttcatagcatgataaattgtcctcattttcaacaatggcgccgaaaaagcgtttctccgattccgtagtttatgggtttgagagagcaaattctgacactcagaatctaaactttcgtttgataccaagaagtaggcattgatcaagtaagaaaaaagttatggccaaagaaactgaggatgatcgatcattgattggatgcccaaagtgcaataaagccgaattccctgctgcttctacactgctgctgttcagcatccagcaaaaatgttggatttagtaaaaggtggataagtcatagggggtggaatggaatatggtgattgtgggacggagataaggaaaggggcaggggtaggggttgctgctaataattacttatacatacaagcggtgagagggagaagaagcaagcccatactgatgccatcttcagtagatccgaggatgcgatataattaatatacacagagactaaattgttggatgaatgatgccggaattggtaaaaaaaatgaatgaggtaaagccggttttgtcccaatgaatgggagagagagagaggaatgtgtccatggaactccgtgaagcagcagcaaattaagtgatgggaaaaaataattcaaatccaaaaaaacatcggaatttttcaaaacgtaaaaggtgataattaatagagaccgagatttccaaatctgccggaccggaccggactggtattttcaaaaaagaccggaatctggatccggtctctcataatccggtcaatccagattttcaaattgccggatccgtaaccggattggtaaaaatttaaaattcagttgttaatttgggaaacaacccgcaaaatgtcatcaattaaatgtacagaaattataacagtttaataaaacgaacaaataaatagtttcaataattgtaattcatttggggaagagatttgttcaaaaaaataagtgatccttaggcaa

SEQ ID NO: 19499 - DNA, 2747 bp, Heterodera glycines
agcccgtacttggccggcgaggttcaccaggccgggcccaccgaattggcccacgtggcacttgttggccagggagcaaaattgacggacgagaaggcggttgcaatccaagcagtgctctgtgctgccattggtcaaactggttcgtttattttaattttgaagaaaaaaaccattaaaattaaattttttttaaaatatcgttaaattaccgactttccgaatttaaaaaaaaaatatcgcaaaattgctatacttttccattggtttaggacaatacactgacaatttgaacattgcggcgccgggcgttgttgcccaacatgtgttcaaggcgtccaacctcaaccagttccagctgagcccgatcaatttgctgcacccggacactggcgttgtcggcgtttatctgtcggccgaagggaccaaagttctgccatttgtcaaagccgctgcccagggcttacgcgaaatggcatccaaaccgatcagtgacgagcttctccaggtgagaaaacattgttttggaatgcccttactgattgcaaaacgaatttggcaacgaaattaccattaattccattcagttaaaggttttaagcctagtagttccgatttcgagtcctgtcaggatttccctgaattttttccatcaatgtacctggggtcatggtcactaaaacaaggttctattatatagcccggaaatccaattcgtgttcaattcccgaatccttatccagactcttggtctttaaaaattctttccttttatggcccaccatcatttttttgatttttttttatatgacaaaatcccaaacagatcgccaaacggactgcggaaatgcaaacattgaccaccgccagctgttcgtcatcgtttgctgctgaccaggcgtgccaattgttggccaagggcaccgcactgacacccgacgaattcattgcccttttgaagacagtgactgcggacgatgtgaaaaaggtgaacccaattttccaattggatttcattacaaccgctaaatttgtagcactacgtcccccccccccgagaatgtataaaaaaaactttgatttttttcttgaaaaatttctatgttagtaaaaaaatttaaaaatttctcggggaaaacgatgcgggggaggaaacgagctgctcccctaaaaaatagggttcaattttccatttgaatttttcaaatttcatcttttaaggctgcttcccaactttgcgccaaattgtccatgtcagcgtacggaaaagtggaccaagtgccttacctggaccagctttaaatgtgacggacgaaaattttaatgagtgattgaaaagggtcgcgccgaaagagaggcatatatataaaaataggaattgcattcttctgctaatatgtagtgtttcatttttttgtgtgtgttcccgattctttgttatgtgcagtaaaatctgaattaagcgaattgttttcattttcacggttttttttcgcgtattttaaacaattttttttcttattttccgattgtttgttttttaagcaattaacaaaactttttgcatttgtaatgttggttggacgtgagccggaattcatcaaattggagtcgttgctgagctcggcactcggtgcccgcgctgattgtgacgctgctgctgctgctgatgatgagccaaaaccgttggccgtttacatttgcggaccgccggggaccggcaaaacggccacagttggggcggtggtcaaaaaattggagagcgcacacaaggtgaggttttgttggacattatactgcacttgcttttgtgcatttcaaagatttaatatgactcttgcagttcactcgaccgtaaaaaagacactataatttgacaattttaagcgtaatttcaaagaatctatgtttcaaaaaaagagccaaaaatgttcggaaaccattttttctaagttttcttgtcctaacttttttttgaaacagttaaattctttggaattttgcaggcttgagctcttggagctatccaaatgatgcaatgaattctagaaaaagttttatagtgaaaattgtctaattttttattttatagccgtgtaaattgcaataaactttatcacaacgacgtattttgattagaaaatggcaccgtttctgcattttttgccaatttgaattacaaaattacagtttgagtttcaaaaacaattttgagtggcgaaaaatacggacacaattccttgaaatttaagtttcacttcgtttctgtcaactgctactccacacagtcatcgtccagtttggcaaaggaagtgctctccaaattgggccacaacgacgtgacggcgaacagagcgaatcggaaactgggcgaagtgttcgacagcaccaaaaagccaatgtataattcaaataaaatgccatcatattcaaatttgtgccaagttttttaattgggtagtttgcgaaataatatgtttaaatcgaatttttagtctcattttgttggacgaggtggacaatttgcagagtggcaagtcgaaacaattgctgtacactgtttttggatggcccactcagtccaatggacgcgtaaccgtgataggtactcaaaatgtcatttttaatgtttttataccaaaatccattttttacaaaattttgggttggcatttatcagtaaatcttctttgttcggttataggcatagggaacaccttggatttgacgcagcgacaaatgtcact

SEQ ID NO: 19500 - DNA, 3557 bp, Heterodera glycines
  misc_feature (12)..(12): n is a, c, g, or t
atataatttaancatcatcggcatacatttttatgcccctttttgccgcttcatttgtaataaaggacggcagatcatttctaaaaattaaaaagagtaatggccctaagacacttccctggggcactcctgaaaatattctgaaactgtctgacaattcttcgccaattttaaccttaaaactccgattttttaaaaagttagttaaaaaattatgaatttttccttcaattccaatctttttgattttttgaagtaataaatcaattggaacagaatcaaacgccttgacaaaatcaatatagattatgtcaatttgttgattcttttgtatagaattatatatatcgtccaccatttttaatatttgggttgtagtcgatttattttttaaaaacccaaattgttctttatcaaagaatcttgtactgttcagaaattctaaaattttgctactcaaaattcgttcaaaaactctacagacagtgctggttaatgaaaccggcctataatttaatggatcagttttttcaccttttttgaaaattggtaccaccaatgatgttcgccatatttccggaatttgaccggaatccaaaattagcctaaatatatctgctaatatttttgtaattggttctgcacaattttttaataaaatgtaaggaacattatccggtgaagtggaattacgccggggaagtcttcttaatatattccaaattattcccgcattcaattcaatgtcagaaagtttaatcttattctgtgttgattgagtttgtggaccattaacaattgattttcttaaaagacttttgaaatatttctgctaatatcttacatttttgaacattgctggaaaacatatttccagcattatcaattaacgtaggaatttcattaacttttgataacttatttcgaataaatttgttaactgaattttgcccctgggaaataatttttaactcttgttcatttcttaatttgtacaattgttttttcatttccctagaaataattttgtaatttaaaatgagatcacttttttcagggaatttttttacaagcttatgcaaacgtaatttctctgaaaataagtttcttattttttgaggatacgattgttttattatcgattttagaggcctattgggtataaaaatatcatataatttcagaactttatttaaaaattctttatatttctgttcaacggtgaacactgagtttattgataaatcaattcgattttcaagtaacgcttgacttaatttcgaaaaatttatatttttaaaatctctataaacattagaattattacgactgaattttacttttattttaatccgaccattttgtgatcggaagttgaaaaattttctagaactgtcaattcattaattaattctaattcactagtaattactaaatctaaaattgctttttctctggttggttccttaacatgctgtatcaattgtctttggtgcataaactcaattagagaattagacgccttatcatttattttttttactttattttcatcccataatatatttgggatattaaaatcaccaccagaatatggtattttcagaatcgctttggtccgaaatgaatttgagtagctttttagtattctgaacgttacaatttggtggacgatatatatttataatttgtgttggtttttttaaaagtaatttaatgtgtataatttcactttggaattttgtcccagagaaaagtgtctgataagggatcaaggtttttaatagaattgccgatcctccgccctttttttcagttcggtttgcaaaaacaatttgatattggccatttatcgtaagttccgcttctaccgtatttctggagtttaaccaggtctcattgatcagaattatagtggggtcatattttttgactatgtattctaagtcagatattttatttgctattgatcgggcatttattaaaaggcaagaaatccagggattattttctaccatttttccaatttttttgtttggtttgctcgcgtgtccctagcgagttctgagtgggcgggactctctcagagatctgatctccaagtcaaccacaaaatacttatactcacctgcggcaatattggcctgataggcttgttgccggagggagtataatattttgagctcgctttgagtcatatctctgcgaactttgatgtgttggggcacattgggcaattttttcacagcattacggaaattataaatgaatttatcgcgcgaatatttgtccgtaaatggcacttttaaaattcggtccctttttacccctccatcagtccgcgtccttgggtggcgatgaatgtccggcgacagtttgtccttgacaccgcattcatcggcaatttgctccaccagcgcccgttcgtcgattgcctccggcaatttttcaatgactgctcggttggccttctccttaagctgctcggagttgatgattgcatcggttatcatccgtgaaacggcgccattcccagcgaagggcggcggttgaccccattggagttgagtgccgttgttggaagtgtgtgccgatggtgaggatgagatatgctgggggtcagcaaatcgattcccataccgattctcgcccgcaattagccattccaccaacttttctaacttttctagtcgttcgatgactgggaccaatgtggggttccctgacccttctaacatcttttcaagtcggtcgagacgggcgagaatgtcctccccctcatttaaatttggggaattttgccgtcgttttttggtcatttagtacgggaatgaaatatttggagaatgaaaaaaaagaatgaaaaaaaacctaaagtgagacgtgacaatttttggttacaaccccatcagcagcaaaagtgcaaaaattgttggataaaaaaggatgggcgaacagaatgacagtgagtgcaaaataataatgaataaaataaattcaaaattttaagaatgttctaaaataaatatattatagaaaatcgaaaaagtaaccaaagacagggtcattttttgacaaattatgttaacaaatcgcattaaaaattacaaattttcccgacggcgcctatcggcaccgccggcccccctttcttcccccaaaagtcttggaaaaaacgcgccgcgaaaaaagcggtgttgaaagcaaaaaaaaaaaaaaaggttaatcaatttacatggcggacccagacccccttgtcttgcaaaaaatctgaattttagtgttctttatcctgaatttgaaaaagaaggctggtcaacctgtacatatacttctgaaaaattctaatgctaaaaaacaagcactcgcgtgaaaattgaataaaaatttcatatttgaaaaattttgtccaaaaatttttacgtcggaaaattaccggtttttaccggtaccgttaccggtaccgatggaaaaagttggtaccggtaccggtttttgcattaccggtcagtaccggtaccggtttttttacaattaccgattaccgctcaactcta

SEQ ID NO: 19501 - DNA, 2866 bp, Heterodera glycines
aatggacgagttgcagaaatgcccaaaacagaaagtgaagagtgcgcgagggaagggactgttgtgtgccattgaattggacaacggtaagtcggaaaaagaaaggacaacagagagagagaagagtaagagagcgagagagagaaagagaagaggggcagacagacagacagagagagggcgagaaagggaagggggaaggaagagagagtaagcggagagagaggatagaagagagagagagagaacggagaggaaaggataaagagggagagagagagagcatgtctgtgtgcatttttcaaaattaccctgacgaagaatcagtattccgggaaacctctgacagaatccggtcattttctgggctctacaaaaaaataaaatgtggaaaatttgaggcattgacgcttggcaaatgtgccttcgtctaatggacaacggagtattggcaaaacaaacgcacgaacacacaattcgatttgctccgccattggttggttggattgaaaaccaaaaattaataatattccatcataattttaattatttttcaggtaattaatgaaaaggacacacgaacagtggccaaaatcatcggacggacattaaatgcattcgattgattgtgaaaattgtgacactaatacatatccaccagggatgtgccgagccagacaaaatccgattccgattaaatcgccgattccgattatggccaaaaatccgattaattgcgattccgattcggcacgtccctgatatcatccactcactacaaaagtaaactgtattgccatgaaagtactatatatgtttttaacaggaaaaaagagaaaaatttaacatggtcctacattgcaagatttttacaggcaaaaatgttgacttttaaatctcccttaatcagggcgaagtggatatcttattcttgttcaatgtgccagaaaacggtaatagtaccgatttaagaattttttgcgacgcatttttccaaaaaacttttgggaaatgggcgaggggggagggtccggcggtgccgataggcgtcgccggaaaattttttgtaatttcgttctgatttgttaacagattttcaccaaaaaatgccaattttgcaattaaaagccaagcgactttttttcacttttaaaaacgcttttttgcggggcccttcttccaaaaattttggaggacatggggacccggcggcgccgataggtgccgccgggaaaaatttgtgattttagtacgatttgttaacagatttttgtccaaaaaatgaccaaattttgccaaaaagcttattttcttgataaaataatgacattataccataaaatttcaaaaattatgagtttatttaagaaatcagaacaaattttggtcgctaccccaaaatcagaacatttctgacaaatcagaacatttttattttatcagatttggaccctccaaatcagaacattttattttatcagatttggaccctccaaatcagaacattttattttatcagatttggaccctccaaatcagaacatttctgataaatcagaacagatcacacccctgttttatatggactaaaaaccttcaccaaatcaaaaaatgttaatgcagaaatgctatttttaagcccttttcttcatagtgaaaaggacacacgaacagtggccaaaatcattggacggacattaaatgcattcttgtgaaaattgtgatattgatatccacaaaaataaactgtaaaactatggaaatactgtatagatatgggactgggtcgttttggcgcccacgttttggcgccagcgcgagtttttttattataacttttttcattgttggccaaatctctaacaatcttggtatcaatcgaaagcccttcacaagctctattagccttacaaaaaacaaaaaaaaatttagcttgtaaaaaagttattaagaaaaaacttccaaacttttgggtttttttgtaattttatgttataacttttttggtaatgtctaatcgcgaaacaatagcttagaaatagcttctaaacacgttaagctttcgaatgataccaagaatgttaaatttggttaacaataaaaaaagttataatcaaaaaactcgcgctggcgccaagaatgtcggcgccaaaacgaccccgcacccttaccaacgcatcccaaaacgccaagcacatctcataaccgctaaaacgaacttttgcgggattttcgaaatttgaaaaattttgtccaaacaagcacaaaaagtatacttatgtatatacaacacgtacctctctaacaacagaactccaataaattttttatatttttcttgtaaaaattttgtataaattacatacagtcagggaccaaagtatttgagcaaactatgcaatggaaatcggcggctctctcgaagatgaacctatgaggaggagaaggagaagaagagggcaacaacaacaacaacaaaataataacgatgacgaagacgatgatgatgataatgatggtaacgaggagggagacgacgatcacggtcatgatgctgataatgaggaagaagaagaagttggaacaaatcggtcggtcagactttgctttttcgacgctgaaacgtcccaagatttaccacttcaactgcgtacaaaggttgtacagaaacatgttccgatgctcattattgccgaaattatctgcgaagcgtgtataaatgaaggaatttcggttcattctggtgttggacaatacgcaaatgggtgtgtgtatgtggtcctcctgcggaaccagggggcgtcgctggtgtctcctcccgttctgaaaggacctggggatgaacatgctctaccggccaacgtcc

SEQ ID NO: 19502 - DNA, 1182 bp, Heterodera glycines
  misc_feature (12)..(12): n is a, c, g, or t
cagaaaagtgancgcattgcggcgcaaactgtcgcccatcaaacgacggaatccgttcagcttttggtattcggaaaagggctgaaacagagggggaaattcgaacaacagttcgggatttctgaccaggtcggcaatatgagtctctcccactcggaaggaccactttgccctctttgtacgcctcgttgtgcttgtcaatgaactgtttggcgctataaatattgggtatttcaatttcaaattaatttagtattttcagctaacctcaaataagtcagcatccgttcgttctccacttcttggtccgcgtatgctttcccttaatttttatctcgtttattttccaattccttatgacttgccatgcttctgtttgtaagcattccaatcggaaaagccgcgttcgctaaatcatttttatttttaatagatttttaaataatcatttttcattattatggccattttgtccatgccattcccatccctttttacatcatttgacgaagagcagacattcgttctgtcggtgttcgaatgtccgttttccgttggccaatgttctgcaattcgatcgattcgtccgagtcggccaattcaattgcacgctcgcgggcacgccaactgaaaatggcataattagcagcaattagtaaagtaatttcataatttattattacccatttgtctgaagtagaagcattgataataagaaaagaagaaacattttacttgctttataaaattgggagaattgaaatatttgtctgtctaagctaaattattttttaacataattcttttaaatttcgaaatatgactaattagtcatcatttgttatgtaaaaaggggatagagatgatgtgatgcgattttatgaaaatgaatgaattggttgtgtcggatgatgaatgtagtgagagtgtcccattggtgagtgaatgttttttagttttccttgcaaatgaaagacgcaatttttggggaaagggcgggggaggcgaaggggtggacagcaactgacttctccgatgccttaggacgatgaagattaatgcataaatagagagcttttgcccgctgtcccctccctccattcatccgtctttcgttatcgataaggaaaagcgattgggggaggagagagagagagggaggaggagttaatgaggggggag

SEQ ID NO: 19503 - DNA, 1395 bp, Heterodera glycines
  misc_feature (22)..(22): n is a, c, g, or t
  misc_feature (1316)..(1316): n is a, c, g, or t
  misc_feature (1336)..(1336): n is a, c, g, or t
  misc_feature (1344)..(1345): n is a, c, g, or t
ggcccttttcccgaatttggcnccaattattcctcgccatatttcactcgcaccgccacttattccttcccgaatcattaccattggcaaaacgaccgtttctacagtgccttctttcgcgcgtcttaccgtagtactgactacagtcccgagagtctctacagtagtcggatcgcttaacgctgaatgaaaataattctgctgctgctggtagtcgcgcaaaatgcaaagcaaagaaagtgacgatttacaattaatcatttttactgaaatgataaaacaattcactaacatgatatacgaattgtgtaggttttttgaatgtttaaaaaataaacacatttattttttatttagtcaatttttgagtaacaaatccgcatcaaatagcaaaatgcaaaaaaaaaacttttaaactcacgaaacactcactcattagttatgtatttgtaacaaaaaaaaagtaattatttttttcctgatcatttcataaagttaaaagatttatttgttttgccattcttttatttttattaaaatttttcatttttattttcttcataattatttgccgattcggaaaatgaatcatcatttataactttcctaaccgaacatcatcaattaattaattaattgctctccgccacctctcttttcggctgttccgttgcgtcgaatgttttatgtaaatttctgcgctttttcaattccttccaatcgcccgctttgaactgctgctccaattcctccaacgatttgccgtgcgtttcgggcaaataacgccacgagaaaaacaacgcacaaagtccgatcagagcgaaaatgacgaaggtttgcgattggccgatcagattgaggaaaatatgaaaataaatttttttgaattgccaatgaatgggaaattttacgggaaacatttggtcgagaacgcaagcggtgccatagacggccaaaatcgcgacgccctttccgaagccgcgcatatccaacggaaatatttcattcatcaaaagactgcaagggaattgggccgagaaacaaataaaaaattaatcattggctgattaattcgctataatttgtcaaatttgtgctgtctttaacctggcaaccggggaacagcttccctgcacaaaagtcataaaaacgagcagaaggccaagcgtaatccaaccacgggtcaaatcctgcgccagcagcgcagaaacggcggcgatggccaaatgcacgccgatgatggccacctgcgcgaccatcattagccaacggagggacactcgcgggaccagccaaaggccgacggacattgcgancacggcaccatctgacattntggacgannttgcacaatttaatggcgggggataattgaaaaatgaacgaacaccgatc

SEQ ID NO: 19504 - DNA, 3177 bp, Heterodera glycines
  misc_feature (60)..(60): n is a, c, g, or t
  misc_feature (87)..(87): n is a, c, g, or t
  misc_feature (126)..(126): n is a, c, g, or t
  misc_feature (2173)..(2173): n is a, c, g, or t
ttttgtgcctatttcgccattttgacgatttttcagatttccggaaaattcgttaacaanaatgcaataaaaatgaaaaatacaacnccctaagaatcgacttgaaaattttttagaaaataaacncctaagaattgaaaaaaaaaattcacaaaaattgatcctcaaaattcaattattttttaaataaaaatttttggtttaaaaatttatttttatcgaaaacaactttaaaacaattgaaatatgtataagcaaaataatttttattaatttttacgtgtttcactacctaaaaagcgttaataaaaaattttttttgcctatttaatgcctattttgcgattttttgtgcctaaaaatcgcatccctactaattagagtaggctttcatttcatcgcttcattcattcggtgaataatggatttttacattaaataagaaattattatatttatttatttcattttttttatttttacaaatttttattggtgaatagagaaaattcagtcatttttcaaaatttttaatcattttgttttttaaataaatatttttgtctttttaataatttctgttcgagaatgtctgttgatatcgagaattttaattttcttaaacaattttgcttttaaggacaattaagggtatattcttctgcaaattgagggaaatgcatttgattttcctactgattttgccaatcctttggccggccaaccatcgaatgccatggacaaaaagtgccaaaacattctgacaaaatgccaaacgactcaagcaaaatgacaaaacactctgacaaagtgtcgaatgattctagcaaaattcccacccaaattgccgtcgggacagattattttttgctcgaaaaatatggacaaaaaattctaggcaaaaatagcaaacacaatgaacaattgaaaaggtcattatagggctaaagaaaaaaaagtatctgctggaggaagtttttgctaaaaattcaaaggtaattaaaaaagggtgatgtgtaggacagtcgcttgtgggacccatatttccaattagttgatgggtagagagaggagattgatatagatcatcaatagtaaatatttttaagtgtttgctttaatttaatataggattcctgatattaaataacaaataaaatttttggaaaattgatcaaaaatggggaggcaaaccggactagtacctgtttttcattaaatttgttgtttttgccttttcattttcaaatgcttttttaggccgtctttgcctcgcgttacacaatcctcgcgctgttgaaaaagttcaaagttctcaacataatattttttggcgattttggaatcggtgccctctgggcatttaacttattttaaaaatgtttattcttttgccaacaaaatttatttgcaattttctctttaattctctgacttttgagcccaatttcgaaagatcgccaaaaaaaaagaaaagaaaatactgtttaattcgtctattctttgcagaagaaaattttcaacaaattgaagcgtcgtttgggcaccgaagaggcgaaaatggccgatgtttttgccaattggtacttttggatttttaaggttcgcttttcattttttgggtcatcgaaaacctttcttgttttcccatggaattccaattaccaaatgttttttagcatttgcctttgccttatctgatcagagtgatggactgttttctcgtggaaggtgactaatttcgcttaattattaacacattgcaattttaaaagacaacaatttttactttggtcagatggaaggattttttatgaatttcgtgggatttattcctcataaaattcggggaatgctttgatgtgccttcgcttctcaaaatttttactaaattttcacccaaaaatgaatcattaaaacggtttaattatttgttttgtgtgtttgtttaggtcagaaaatgttggcccgtgccgcactgaccattctctatttgtggtccaaacagcaggacgagccgcacaaactgaaaatgatggccaattccacgcccaccgcaacgccaaaggcaccgccgctgggcgccgccgccaattcgcccctcgggggccgaacgaccgccggcccactcgaagaccagcaaatcttcgacatttcgacagaggtgccattngggggtggagatttcttttttattgtactgtagtagggaccgggagggatccaaatgcaattcaccggtgggggtcataaatttaggggtttcctttggccttttgtaaaattatttaaaacagttttccctaaattttctctcatttcacacacattcacattaaaggaaatgaaatgctttcctttgctttaaaatcacttcattcagattttgattaccaattaaaaattccacgtattcaattaataataacattttttcccctttttttgcttatgcattattcatgagtcataaaaaaacatatatttttttcatacgctcctttcgtaattttttctctaatttcatagcaattgcttagaaaagggttttctattcatttacacttttgattgggtttcccaagcaaatttttggctttttctctttatttttaatttattttttctctaaattgccaattttgctttcattctcagatttccgacgttgcctgcagaatgccaatttcggtgcaaactttcctcgacattgggtcagttgatatattctatatttttcaattaatgccattttttgcgcagtttttccatccgtcgttttggcaacagttttttgtaccgtaaacagcgccattacgaagccaaatttcgtaatttggtggctcgacaaagggcacaaaagaacgcccgacaagtggacgaccgcatttatacgccgggtaaggaaattcagaaattaactgagtgggggggggctgaaaaccgacaaaaaatgcaccattattttcatgcttccgccgctacaattaagcaaaatttttcccatctttttttggccattttatgggttttttcctttggtggtgatttttaattgtttcagctttctcttctcaaattgttgacgaagaagtggccagggaactgatgggtgcactccccgcgcggttggtccctttttatcataaaaatttaggaattttttaaacaactcga

SEQ ID NO: 19505 - DNA, 2281 bp, Heterodera glycines
  misc_feature (90)..(90): n is a, c, g, or t
cactattttttactatttcgacattttttggaaaatttctcaacaaaaatgcaataaaaccaaaaaatacacccctaagtaaaaaatttnacaaaaaattaggattttcttgaatttttaagtcttataaatcatagctttttggtgagatgattcatctcttagcttctgcttaatgattacttctaatcttccaataattaagaaaaaattcatccaggtttcattgcctttttatcgaccgaaaattttattttttggcattttcttctgtaaaactcaaactttgcctcaataagtcaaaaaaatcacgaacaaaagtcgcaaaaactcaaaaaagtcataaaaatccgaaaaagtgtaaaaagtcaaaaaaagtctcaaaaaatgcatgttagaagtagggatcggatttttagtggcaaaaatcccaaaataattaactaaatagtggcaaaaatagtggcgaaaaagttccaaataattacttttaatagaaaacttttaagctctgatggggttttgaacaagcccaatttcgagaaagaattactcgattgagtaaatttcggcataaatttgaagagaaaaaaaggattttcgatgagagacatattttgattttggcagcaaatgtccgaaaatggcccttaagaaatgggccgcaaatgtccgaggcgcaaaagacggaccgcaatgaggaaaaagaaaattgcagctgaacaccatcagaaacaacaacatcagcagaagcaagaacattggaaggaggagagacggaagagaaagagaggaaaatggaggagaaaaaggagcagcaacggaacaagtatttctaatggatgtcggaaatcccccgccaaaatcccgaaaaataattgtcacatttttgaaaggaaaattcattcattcgatagatagcaaaccattttatatatcttaattcatttcttctgcggctgatcactgtttttgttcttttgtccgtcactcatttgtcagcagacgacgcccctttttcgctgctttgtcccgcttcttgttcttcttctgctggtggcggagacaatggcctaaattaagcgaaattttaattatttaaacaaaattaaatgccttttttaattgctcacccaatgcaattagtgtcactatcaagccaaatgatcacagtgttccaattgttgccccaattttcatctttctgaagctgaacatccgcggcctctccaattttgcatcgcttcattatccaattctccaagtcattttcgttttctttggtcaatgtcagcttttcctttgtccattcgttcaccaattcaaacggcaccatttgcattgacggcacgcgaaaagaaaaatgaatttggtaactgacggaagaaatggcattggcacggagaaaatgctaaacaatttgaaaacaaaaatataggcaatcaaaaatcagtgatttgttgaaaatgttgggccacacctccttgaaattgttgatccaatcagtgttcgtttgttcgtagtaattatcgcaacgcaatcgcttgggttgtccatcgtttctcggagagtgcaaccatttggacaatgcttggccagcagaaattgttgcatttggcccatcaaaatcaccaccaaacgcagcgggcgacaaatcaccggaattgattgaattcaattggttgagatcggtgagaattgtcggtgaaatgagacgacgcaaattgtccaaatcaacaccattggtaaagcccaaacagcgaatgtttgtcgaaaaaatgggccaaatttcacgacaaaaaatgtccaaaatcggctggccattcgtagagtgtgatgatggaatccacaaatgtaaattggtgcctcttttgtcgaaaatttggtgatttgaacgaagaaaagcgatgacggagtgatcaatgtacctaaaaatgggatgaatgcttttattgccataaatctctgattccgaattactcaatctgaagattcttaaaacggattttgctgggcaacggacggtcgggcaatggaaatggcacaaatttgtcatccaaccacacagatagtttcggttctggtcctttgtccttgcgacgaatttcgattgatctccaaattgtcaattcgcttttgccattgaaatgtttgtccaccaacgcattgaaacgtggcgaaagaagtgccaatttgaggccaagttgaggacggtcaaaggatgggaaaatgtccatccaaacgtcgttgcaaatccaactgaaatgggaaaacagtttag

SEQ ID NO: 19506 - DNA, 2208 bp, Heterodera glycines
aaaaagataaggaaggcacaatgaacgaatgagtgaattaatggcacacattgcggtaaaaagtgccgcgccaccattcactccccgagggcacagcggcaaaatgcaatcaatatcaattttatctgctgtcattaggcatatatttgtgtttgtttgaaaatgccgccagcgccgctcatccgaaacaaaaaagtgcggtgccgccgacgatttgtgcactgcgcgccctcccctccccccgcctcagggcatttatgcccggagggacgggcagataattagcaaattgcgcgaaatattgtgccatcgccgtcgtcatctcgcgggagacattgtgccaaattgggtatcaaagcagcgtgcttggaaaatttggataaataatggaagaaaatttccgaaatttaaattttttgatatttaaaatttagtagaaattcaaatccaaaaaaaattgtgccaaaaatgtctgacgattttaatcggctgatgtcgtcaaattccattcacaacatcacacaagagacggacacttgtgacattgagccgtggattgaagactgggtcagttttggaaaatttaaattctttttaaattttaaaatcagagtttttcaagcaatttgtcagatttttttaatgaaaaaagcatgggattaaattggataaaaataaaaaaattacaaatgtatcaactaaagcaatgctcacttttgttgtaataaagataatgtcgtgggaattgctcagccagcccaatacgctaaacccacagaataagaagcggagaacacaacaattcttgaaattttaattggctaatcaaaaaatgcctgaaatactcccgttgaaatggatgcattttggctcaaaatttccaaaaatttataaataaaaaacaaaattattttaattcttcatatctttcgatagtactaaatattctctattatcctgccaaaatacaaaaaaatctcgttaattttccaaaaactaatgacaaacaatgttagaaaaacctgcatttttgagttcctctggccataacttttttttggaagctaacggaatttttttgaaaatttgctggctaatagtgaattcttagagctatccaatatcaattgcaaatttgctgctttttattccctatttaggcattaatttggattaaaaaaaatcatccatttttagcatgaaactccaaaggcacgttcccacacgacgccgtcggaattttaccaatgcatgagcaacaacagcacaagaattgaacttgtatgcccaacatttgaatttggcgctgcttttttcaatttggcattttgtattatcccccaaggaaaagccgaagcagcagcagaaaagcaccagcggaggcggcacttctctgctgtttcgccgaatgtcctcaaatgacattgatgacagccactttttgtgagattttaaatctcgctcgaaactgatcggggcttaattatgtagttaattatacacgattagcatttcaattttctttaaaaaattccacaaattaaatccggaaagttttccgagttttcgatttgtttagagctctacttttagactgataaaccaaaatttgtcacgtcatttctgaggttgaaatttagtggtataccttgaaattcgaattttccgaaactcgagattgagaccgagaattggctccgagagtcggtcaaaaaaattgggcaaaaagagtgttaattaaccccaagaatcgaggtccgagaattgagccgagacttaactcatgaccataatctcctcccgagaagatttgataccaagaatagaagccaagagcagattattagccgagagtcgagactgacacccccaaaaagccaaaggatttctcgggtcgaataacttggcactttctgcgcttgcgaaaaaagccgagattttcccagcctatctatgatcgggatttaccatctctgtccatcttattaaggaaggacagcccaacgccgtgggaagagcagcatcagctgccctttgatgcgatggtcggcagaacgccgccgacgggttggcatttgccgacaaagacggacatggcaacgccgcaagcgaacatgctgaccacgctgcggggccgactccgctccatcgtgttgtccaaagccaaaatggtgaaatgggaaacaaaatttttataaaaaagcggaa

SEQ ID NO: 19507 - DNA, 2727 bp, Heterodera glycines
ttgccttaggcaacattgggcaccaaccatcccacaatttccggtgaacgaccgacgggggtgggcagctacgggttttgcaaaaattgaaatcccggatagagaggattttgcgtgaataatccgccaaatccggtccgaacaaatgtgcaattcttatttccattgcaaaatgtaccgtaagcgtgccttgggcgcagccttctttcattttcttactgtacaatccccgctcattttttcaaaaggatctttaacaaaaacagaagcgatttaggatttaccaaaacaaaaatggtattgattaaatatttgaaataccgcgcatttggcgttatgtttttttttgtttttgtgattttcgcaacgccggtggccgccgtttccaagaaatgtcagaggtcgcttttttaaacgtaaaatttgttaaaggtttcaaaaaattcacatttttacatttctttcgtgcgccccttcaccaccaaatcgacaacaattttcaaaaatgggcacggaacatgacgatgacgatggtgaaaaaggggtgcaacaattgttggaacagttcgtcgccgagggcgccgtccaattgggccaattcacgctgaagagtggccaactgtcgccaatttacgtggacctgcgtgtgctcgtctcggtgccgaaaattatggcatggatttttttaaaattttttactattttaaaattgttttgctaatacggcgtgaaaacactaaaaaaaattttaggattttaatcacataaatcacatatagtcaatcaaatcgtgtccaaaaatggggtccgaattctccggctcttcgcccctctgctgggacccaacccaacctccacctgcatattcaagaaaattcacatttgctgttgtttctcgcattttcattttgttgaatttcagtaaataattttagggaaaatttcgatttttatcccaaatttctgttggatttttaatttacctaaacaaaatgcatataaaaaatcactcttctcactcaacagaaagaagctgctcgctgtctgtgctcggccattgaactcgctcagctcgactttgattacgtggttggcgtcccgtttggggccattatgttggccacagtgagttgctttctgacccctcggaaaatatgaaattttcaattcaaaaattagggacgattttccgtaaattggaggcccaatttttgttagaatttgctgaactcgaaaatttttaatttattgtccaaatatatctcaaaaatcgacattttaggataaattaacactcataaaattctccaccattttttagttggtctccgcctcgttggacaagccgatgttgttgaagcgcaaggaggccaagacgtacggcaaaaagcagttgatcgaaggccgtttcgaggcgggccaaaggttcgaacggcggcgacggtgcccaaattaggctagcaaaaaatttttaaaccggatttcatatttttacaaagttttcacgcttattcccctcccacctgaccgtccgtcatccctggcctcggagttgaattagttttttaaatgctcaaaataaaaaaacttcccacccttttcggtttgaaagggtaattaggaaatttttaagaaaaaatttgtttgaaaattttacagcgatttctatgcaaatttttgagaaaaactattttgaaaaaggcgctttaaaaaaattgtaggttgaaattttctcataaatttctaaggtttttctagatttgcaaaaaaaaaaatagaaatttttccggggggggggagggacatggtgacgcacccaatttaggcagttttccaaaaattccagcgcactgatcatcgaggacgtggtcacctccggtgccagcgtgttggagacggtggccgccctccgtgcggttgggctgcgctgtgtgcacgtcttttgcgtgttggaccgccagcagggcggtgagcagcgactgggccgggaggcggacattgttttacggaggtgggggccaaaggggagggggttttctaaaaatttacacaattttttcatgttttttttaatatttgggagggttcgccaatcctgaagaacgggtgtccctaatttttaacttttttttaaatcttgggctcaaaaccagtttttagggggtttcgaggctgctgattacgtatcttaactctgatttgcccaattccgaaccccggaccttaattcgaacaaaaaaatgagtttttttcaagaatggattttttgaggtaaaagcttctaaaaaaatatttatttttttatttctttcaatttgttttcctttttttgtaagcatttgccgttttgtgactcggtttcctttatatatgaatttttaattatcaaaatttctcttttaaacaaatttttccgggtttggacaaaattttttccatttttcaaattaaattgaatattttttcagtttgctttccatgggttcgctgttggactttttggagcagtgcgggaccattgacgcgggcaaaaagacgcaaattgttcaccaacttcaaaacccgatctttgacgacagcgccacgcatttgcaggagcaaaaaacggagaaaaatgaaggtcaaacggaaatgtttttttaattaatttttaaaaataatttttgtttgctttttatttttccgtttctaaaattagaaattgcattattctttgggtatattagt

SEQ ID NO: 19508 - DNA, 797 bp, Heterodera glycines
agaattctaggtttctctttaaaatttcaaaaaacttcattgagcttaaaaaatgttatggccaaaaaattaggatttaagattttttttaattttataaccatatctttttttatacttaaaaaattgaaattaatattcagataaagaatagccataagctttgaccaggagatattagccaagttatgaatgtttatgtgtcacattttttgtttttataccccttggcagatttacgaaacgcccacgttggcggatttacgaaacgactcagcacgcgtgttttgtaaggggtgtcctcaatgaggcgtgtgaaaatttttgacctgtacttcctctgctggacggcttgtttattttattaataatagagcttagttaaatggatttgtttcttaaatttcaaagaaatacacttctaaacaccgaaattttggaaagaaaaaactcgaaaattgtcaaaaattatatttttggttttcgtgaatttaaagaatcttcaaaatttcatagtttaataaaattttcaaaattttttgcccattgctaattttttttgtatcagttaaaagaaatcggtttttaaatgactctctaatctgattttggctatgaaaaatagaggagcacttctgaaattcaaatttaagaaggaaaataaatgggcttcattcaaattcgaaagaaaaaaaagtcacgtgctgcggatttaaacaaaaacactcgctcaacagagtcggcgtcagtaccaactgcgccatttgcacgacacagagactctttaaaaatgattc

SEQ ID NO: 19509 - DNA, 2051 bp, Heterodera glycines
  misc_feature (6)..(6): n is a, c, g, or t
  misc_feature (26)..(26): n is a, c, g, or t
  misc_feature (41)..(41): n is a, c, g, or t
attttntaaagagaataagaaaccgncgaggaggaaattgnaatatttaactgaatcttgttaagattttgcatattaattcgcttcaaaaaacatttctttcaaaaattatcattaaaaatctaaatttctccctgaatccaaaaaataagatgaaataaggacaaagagcttaaataaggacatttcaaatttgtaagatttggaccctcaaaataaggacaaatcttacaaataaggacaaagggtaaccctgacctaaattgccttttttagcatacaaaaaagggtcttttcaatgtttcatttttaacaacgcacaatcgcaccaattacacaatggaaatggacgaatttgtgagaaagcaaaagttaaaatatgaagcacaacatacaactgcatcatacacatcagtgatgccgcgggttgagaaaattttcgggtcgggcactcaaaaaatttcgggtttcgggtcgagaaaaacctcgggtttcgggttggcatcactgatacacatataataattgtgaaatgaacaatatttcggtgtcacattatccattaattaatttaattaattcattcatttctgctgctgaccactcggcccaggggaagcgtcgagaagactaaaacaaaaaaaatgaaacgatttaaatcggaatcattttttgttcacccattgtcgattccgtggtctccaatgccaatgtaaatttggttccactggtcatccataagcaattccttccattgtttctctctctcattctgcgcaattggacaacgggtgagcacaaagcgttgctcactactacattttgacaatgccaattgctccccagtcaattcgttggtcatcaaaaatggcgttaacggcgaacattgaaagaaaatggagaagccaacacgagaagaagcaatggaaaatgcctaaaaatgggccaaaaagtcacaaaaaagaattgcacatggttaaaaatttcatcagtcaccgctttgaattgttcaattcttgacgaccattcattcgctgataaattcacgttgtactttagcaccttcggcacaccgtccggacgagacgaaaacagccatttgaccaccgcttgaccatccgtcgccatggcactgtcatcgggcggaaattcgggcagaatgtcatcgccactgaacatgacaaaacgaagcgatggataatcattgagaatggcgggtgccaattgacgcattcggcgaaaagcgaagttcggcaaataaagcagacgaatgcaattgcggagcagtggccaattggtggacagaacgaacgccaaaatgcgaacattttcagtgacaattgtcaaatatgttggagatgaagcgaaaaagcggtgaaaacggccgagaaatgtgagcacattgtggtcgaagtaactgaaataagaaaaagtgatcaaaatatttcaatgtatcgccattcttacgagaacgtaatccgtttgaatccgatgactttgttgggcaacggaatctgagggattggcaaacgcttcgaattggcatcgacaatttccatttccttcctgccaaacaatcgcttcttctctcgaatccaaaattctttgtccaatatccatttgcgtgttttgaaatgttcgtccacgcggcggtcaaatcggcgactgatcagagcgattccgaggccaagctgagaaggcggaagtaaagcgaacacttcgagccaacaatcggcggagatgaagctgaaaaaaggaatttttcgattttttcaaaattttcggatttttttacatttcttttttgttttgacgtcgtcgttttttgacattgtcccaaaagaaccaaagaatggtgccacagccgaccaacagaagagacacaacgtaccaactgaaaaacgaattcggggaaatgactgaataaagaatggaaaaacaaagaatgggccaaagtcattaaagccaaatgtggaattttaatttcattttgaagttttaatggggccgaacgatggggtaaattttcaaataaaattatgaaattcatt

SEQ ID NO: 19510 - DNA, 2851 bp, Heterodera glycines
atttttaaagctaacaataagcatatctcaattatccgatggcaaaggaaattaaatttctataaaaatttaacaggagttaatttattagaaaatccatcaaaaaataatcggcttctcctcgacctattcaaacagctgacagtttgccaagttctttttaaaggaggcactgaagcaagagcccagctgtgaggttgaacccgcagaaaaggacgacgtggcatgcattttgtacacaagcggaaccacgggaagaccaaaaggtacaaatattctttaggttttttctagagtagaccgggatctggtactgaaagacgggacaactgagttcctaagtcccggtttttcaacccgaaaaggtcccggtccaggttttgcccaaaattcctggtcccgctctactctagttttttctaatgcaaaaatcccagaatttttcttattcagtaaaaaaaaattacgtattttttcaaaagatgtccaaaaaattcctagagaaaaaatgttatctaaaaataaatctaaaaaaactataaacattgccaatatgtgcaaaatccaattatacaaaaaaattccaaattttaacaattgaaaaggtgccatggtcactcacggcggtttggtggccaatgccgagacgtgcactgacatttggcacttcagcgaaaatgagtgaacagaatgccaaaattttatttaataaattaaattattttaaaaaatacagtattaatttgcacgttttgcccttctaccacatccacggcctgttcatcagcttcaactgcacgctaatgtccaagtcgagttgcattttcttgcccaaattcgacgtggacgaaacaattgcgtatttgcccaaatcgaccgcgatgatgggcgtgccgacattttacgcgtcggatttttttaaaatttttttttagtattttttctagacacatttagaaaaaagtaaatgctttttcatcatttttaaaaatttcccaaaacttgcggtttatctcccgtgtaaaaaatttttcgagggacaattggttaattttttgattggtttttgcccatttttagtcggatggtcgaacacgcgggactgaatcgggccgcggtgaaaaacatgcgcgtgttcatcagcggctccgcgcaactaacgccccaagtgtttgagaaattcgagacgatgaccggcatgcgcattttggaacgctatgggtgaatttactaaaattttaaaataatgcgtgtgcttaatttatacatatgacagaatgacggaaacattggtgtccacatcgaacccgtacgagccgattaatgccagaacttcgggctcagttggccaaccagtgaagggggttcaggtaaatgttgacaaaagcagaaaaaatgacaattttcaatttaatttcaaatttaaaggcccgaataaacgtggacggagtcattgaggtgaaaagtccgagtctgttcaacgggtatctgaacctgccggagaagaccaagcaggaattcacagcggacggcttcttcatcaccggcgacatgggcgaaattgaccaaaacggtgaagtttatttattattatattaaattttattatttttgaattaattaataatggagaaagaaatgaatttagttaatgtatgaggagaaaataccaatgaaaattcgtaaaaagttaatgaattttttaaaacgattgaatgtttaagtgcctttgtcacaccccaaagttttggaaaattaaaaaaattatttaaggatttaaagtataaatttctgttgactttttctgctcccataaatgatttgttcgtgtaattataaaacttaattgtttgtttgttttttaattaggcttcgtttggatcaaagggcgccaaaaggatttgatcattacggggggactgaatgtttacccgccggaagtggaggacgtggtgaccaacattttcggcgaaaagctgaaggaatgcgcaattattggtgagaaataaattattattaatttcgtaaaaattcttttttaaatttaaatccaaatttattaatttccttaactttttactaactcagaaaaagtacatttgttttctaaatgccaatttaaatgagtaaaatcatttttttattttcattttactaattatgccgtatttccgaattctgtcgttggcattctcttccttaaaaggtgttccgcaccccgactttggcgaggcggtcgtcgccgtctgcgaaccttccgatgccttcgcagaaaagctcagcggcgttgcgcaccaattgacggacgatgagaagagtgccttccgtcaaacattggcaccctacaaaattccaaaggctgtccaatatatgccgttgccacgcaatcaccttggtcaatcacaataatatttaataaattagatggacatttgagattggactaggtccagagaatgattcggacttggccagggttttttgggctttttcacagaaaaatgatctatgcaaaatcgatcggtggggagaagcgagagtaaatgtatagcaaaagtgccaacccagtaaatatttactagagaccggacgggatcgggatcccgcgggattaaattcgggatcccgacctcgggatccgtcccgaaggattttttaaattcatcgggattgatcgggatcgggatttcatctggatcccgaaccgggatccctcccgaccattttaccaatcccgcaggatcccgcgggattgaagtcacgataatttttagaaaaatctccattttttaaattaagatcttgaattttaaattaaaaaatattgccatttgttaatttttcttaaaaa

SEQ ID NO: 19511 - DNA, 1602 bp, Heterodera glycines
tatatagtatattatgtatttgtgcttttaaaatatacaattttatttatgtaaaattattaaaaaattcaatattaaataaataaaaatagataaacaaaaataatagtatgtattttataaaaagtaaataaagtgtattttatacttcaaaaattttggtttataaatggaactgttgcatgaacgctgttggatttttttgttgaaaccaaaaaattggaatttatttgacccaaaatttttgaaggttacgacaatattcactgtaggcttgtcaaagtaaatttgttcattatttgatgagttttacgcaacgaaaaatagggtcaacaaattcaaattttcaatataaaaatttatttaattaatgaatttaaaatcagttgtaaaacaacaaagaataatcagtgattattaatcactataattttttgaatgatttcatacattaatttttaattgtaaattatgaggtaattatttagattgatgataattaatactaatgagtgaggcaaatcaccaccgatttaattccggtaattgcactgatatttattacactctttttttagcatgggaatattaaaaacttaatattggcaatttatttactcttctgaaaaaagcgatacttgtatccaaagtttatgcttgaaagagttttaaaaacagttttattcattctcaaatggcctttgtctgcagccaaaaccttttgttataataaaatggattttatagttttttttcttcgtttttggttatggaaacccctattaacaatggacactttagtacccgattcgtttacataaaaaagggcaagtgtgcctctaatttgcatttttctcatcgttttgggccgttttaaatcgattccgaccattttaaagtaattttaagtttgagtcctcaaaccggatatttacccttttttgtttttcattttttttgaagggaagaagtaccctcaactatgttgaaatttgaggattttttggttttatcctacgacccttaggctaaccgagcttaaatttttatcagacatacttaacaataaacattagcaaataaaaatgtgtttttttatatctttcccaaaaattgtccaaaattttctgttactctaaaattaaaacaaaaactaaatttaaattcttaaaaaagaatggatttaatcgacttgataaattcagatttcattcatcttaacttataaactcggaaaaatcacatataaaaacgtagttatcacccaattcttaaatagaaaaattattttttgtttttccaattcaatccaataattggtctgtaaaattcggtccacaaaaatggctgtttcttctaatttttgtttgcataaaatggctttactactatattagtattacattcatacatgtatattttcattatttttatattatatatgcttcggaaaaaaacatatattttgaattgaggccgagacgttaaacaaccctttcgtaaattttcacttaattttatacaataatgatcttctttttttacatattagtttacaggtaacttggaagtattttaaaataacattatttatatgaaaaa

SEQ ID NO: 19512 - DNA, 1178 bp, Heterodera glycines
cttaagtgtcaattctttttcgcatcacataaaaagaaaaagaaacaattggcaggaccaataaaaagcaaaagagaaggctaacaaaaaaaagaagcgacagaaaacgtaaattaaaaatgctaatgaaaaagtaccgtataaaaggcaaacgaaggaataaacaaattaatgaattgtgctgtttgacattcattatttttctgttgcaaaatttgcataattacataagttcggcaaaaactgaataaatgaaatgataaagaaaatgcactcacagactaattaactaatgaaaaaaatatattcaaatttaattgccgcagggaatgcccctcccccccctgcccaattagtttactcagttgtccgtgttcaggtcccggtcccgctgcactctagtttttgttttccccattcccccatcgttgtttattcagtactgctggggacgacaaatttcttagaaaagactaaaactttttttcaattttgaattgaatagcccacgtctttcaattcattcaatgttggcttcttcagctcatttgtcagccaattttacgcttcacacatttgttatttaagcacataattttcttccaattcctctcataaataaaacttggcattcgttgactaaattcacatgcaaaatttttattacataattctgctaggccttttcatatttccattgctcaaaaattataggtaagggaaagaaaaaagaaaaaatggtcaaaattgcttcaaaccgcaatttttagccgaaattcaatcgtttccgcttttgcctttcgttaaaaataaaattcatggattgcacttagacaatgacggctcctctccatcaaagtgggggagagaggagaggggaaaggggataggagagagagggagagaaagagagagagagataggggggggggggagagaaagagagaggaggagagaagacagagaaaggtgggggaatagagataggggataggagagagagggggagagaagacagagaagggcggggggatagagagaggggataggagagagagagagagagggagagagagagagataggggggagagagaggaggagaggagaggggaagagaatagagagaagggtggaggataaagagaggggataggagagagagtgagagaaagagag

SEQ ID NO: 19513 - DNA, 3155 bp, Heterodera glycines
ccccccctttccattccggtttgattttttctatgctttcaaagcgcacaaatgcattatgttgaatgcttcggatgtgttcgagtcgatgttccgttttgatggcgaaaacgcaaaggaaaaaagtaaaaaaaaaaattggaaaatcctttcaaaataaaaaaaaattaacgagcatctcaacacttttggcacattgttcggctgagcagtgaaaagccatttggccaatgtttgtccatccgacgccatggcactatcatccgtcggaaattcagtgaagatatcgccggcatataaacagacaaagcgaagtgatggacattcgcagaaacggcggaaataatccgtaaacgcaatgccataaatgtttttaactacataaaaatgaatagaaaggactgattgaatttatttatagtcagtcgtcaattttacgatataatgattgatgcatttgaatccgatgactttgcgtggcaattgaatttgcggaattggcaatcgtttccaatagttattggcaatttccattttgttggtgccattttctccaatgttgggccaaattcgaataaattccaatgtccatttgcgcgtcttgaagtttatatccatatttttgacatccctactaatgattgtgacttagatttaaatggattaaaagctagagtttaagacaggagaggccaaactaactaaagaataacaattggtcacctatttacatacctaacataagaaaaaagagaaaagatcctgagaaattagcaacgatttaaataattaatttaatttcaaaatgaaatgaaaattgctcaattttaagtatcgcttgctaccccataaattgtttataaattattaatcgcgaatttaatgccaatctttccttctcaatgtggctgcttataccttaatttttcctacagcattttgtgttatttggcatatgatttgaacgaatcgctttcaatcctcctctgccattgttaagtgtgtgttttttaatcacttgtacaattacaaattttgcccattttttggcttcactttatgcaattcatctgtcgttgattcggcgctgatcagccaggcgacttatcatcactgatcactgatcgaaggatcaagttttttggtgagagggcaccgaaaatgagcgtcgtttttttgatttcatttacgaattaattatttttaaatttgttataaatcatctaccgatcatcctaattgctgcattttatcacaaagtaatatgatattaaaaactaattgttcataagttatttttattaaatgaaataattacatttaaaattaccttttcaataaaattaaacagataaaatagaataaattatttgtctgatgagtcatagataacaatttttagagaaaagcggcgcttccccccacccaatccgatggttcggcttaatcacccacaacacattcatttacataaaccaatgtttttattttattttcacttatttttactgcttttattgcatcggtgtgtcctttaacagaaattcccattcatttccatttcaactctttttttggttttttattatttttaaataacttttattttattttattaaaatgcatcgtgatcatacggaaaggaataaaaatgcttattcccctcaccaattgccatctgacgagtgttaagcatattaatcgcttaatttaattcatttagacagttcaaagccactccccccattccaatcttttgcttgtccgccgattacgatgcttcttcttcgctctgtccctcttctgtccgcttgcctttccttctttggcttccttttgccgcctcccattggtgcataaaaagagcaaatttcggcaaaaaacactttcattcccaatttcttagtcggcctgcaatgcaagcagtaccccgagctggagccggggacaaagttcagcaccgaaccaaaggaagtggactgtgaagggaaaaacgacatctgcacggtcacgaactgcaaggacgggtcgaatggtcgacaaaaattaaaataataaatttgaatataattttaaattgctttttttgagtcgccatcccatggtacacacacggcgactgtgacattgagagtcgctttagctgcgacaaattgggcgcacaatgcacggccaaaggtggcactttttgttgccacacatgcaaagaagacctgtgcaatacggaggacatttggtaaaaaagtgaagtgaccaattaatgtattaccgagaaaaacagtcgaaaatgccattgtgaccggcaaccgaacatttatttatgtggggaaagggtaattttaaatggaacgaaagttaatgatcagcaattagtgagaatgggaggaagctgaccgcttacgtcatccaatcttttttgaccgttttaatgtaaaaattgaataattagtaatgcattcattcttaataaaccgagagcataaggaatataaattcgagatgtttccaaactatttttgagtcctaacaccgctgcgatgcgtgccggacagcaggtgatcgcacttgtggtgccgttgttggtcgctgtgtttgcgatccatgccgccaaaagtttaattaccttattttgtactaattgaatttttgtcccttttcatcgaagtcggcttttgagaatggacattggacgacgcttttgctgcgcaagaacaaacagtgccaaaattttgagaaagtaccaaaaaaatgtgaccaatttttaagggtttaataattattacaatttatatatgtatcatttatgttatttattgattattatttttgtaaaaagtgtttattttttgcataccttaagaattgtaaattaaaaggtttcactcatttgcaattccgtaaaaaaataaataataattaacatgggtaaaaattccaaaaaattttgaaaatccccatattatcttaaatatttacttggaaccctcataaatttatcagtaagtgattatcttttaatctcaaaaagaatgaaaacgaaaagtttaaaaaggaaaatatcagttgaaaagggacggacagaacggtgacgggacgttagtcaaaaaccatcaaaataattttatgcgtagctgatcaaaacgggcgttagtcaa

SEQ ID NO: 19514 - DNA, 2977 bp, Heterodera glycines
aattagaagagaaaaatgatcatgatgaagttaaagagtttattgatgcgcggtatgtttgcccacaagaagcagtttggagaatttttgaattgcctatatatgatagaagccattgtattatgtctttgcctgtacacctacaaggtgaacatatttgttattttgacgagaatatggaagaagagattcgtgaaagaattgcgaatggttctgagttgatggcatattttgaattgaataagacaaatgttttggcaaaaaatttattttatcaccagatacctgaaaagttttgttttaagaaaggaaaatggacagagagaaagacatattttaacacaattggccgaatggtgaaggtgtcaccggctgagccggaacgataccacctgaggctgttgttgttaaatgtgaagggagcatgctcctatgatgatttgaaatcagtttttgatactaatggcaatgcaaaagtttgtgaaactttttcagccgcatgtttagaaagaggtttgattagaaatgatgaagagtggaaaagagcattagaagaagcagagagttttgagatgccatggaaattgagagagttttttgcattgattttagtccattgcaatccggccaaaccggaagagctttggaatatgtttaaagactcattgtctgaagattttagcaggaattttagaaaagaagtagcttatgctaaagcttatagagaaattgcacttagcattattaagactggaaaaacgcttgccgattttccaaccatggaacagataaatgttgatgatgatgttgaacaagtgtttgacctagccgaagaattggatttgggacaaagaagttatgctttgatgtatgatgaacaaaggaagattagtgatgaaattttgcatagagtatggaatcctataaatgaacctgcgttctactttcttagtggaccgggtggaactggaaagacacatgtgaacaagacaattgtacatatgctgagaggacagaagaaaaaagtttgtacaatggcttttactggcatcgcagcaactttgctgcctgctgggagaacattgcacaatagatttggactgactttggatatgagtaattagagtattagtccaagctcaaaagcttggcaagaattgaaagaaacagatttgtttatttgtgatgaagcgcctatgataaataagcgcgcaatgagaactttggatgagaaattgaaagagataatgaataatggaattgcatttggtggtaaagttatgctttggacgggagactttcgtcaaacccttccaattcagaaacatgccacgagagctgagatggttagttcgaccataaagagaagtgagtactggaggttggctaaaagatataaattgacgaagaatatgagagctcttgcaacagagcaagaatttgcgagagatttgttagagattggcagtggaaaatggaataatgaaaatgatgagataattttgcccgagaattgtattagcaatggcgatttagcagaagagatttttggtcaatgcattgtcttagaaaattggaatgaaatggccagaagtgccattttagcaccgaagaatgttgatgttagtgaaatgaacaatagagttttggatatgttgcctggagaagaagttgtgtatacgagcatagacttagctcaagatgagaatagacaaagagcagatgattatttggatgagtatttgaatgctttgaacccttcggggtttccgcggcataagttgagactgaagaaaaatgctattgttttgttaatgcgtaatttgaatatagaaatgggtctttgtaatggtgcgagaatgaaagtcgagcaattgcaaccaaatttggttgtgtgtcagattttgactggagacaaggcaggtcagactgtgtacattcctcggatcacgctttgctgttctgaagattacccttttgacctgcataggcaccaattcccgttggtgttagcttttgcaattacaattaataaggctcaaggtcaaacccttgagcaagttggaattgatctgaggaaagatgtgtttagccatggacaattgtatgtggctctttcgagagcaagggcttggaataagttgagaattagattagatgatggaaatttagagagaaaggtaaagaaatgttgtgtacagagagttattagataatagtgattagatatgtgttagactagctttggctttagatttagtattgtattagaattggttttgcttagacaaatctgttgttttttgtgttgctcaagacagtgcgaacacaattcaaagtaagtcatccttttaatttcataattaggtaacctttctccaaataattgttcataacacatttgtactacctagcgggggatgcgccgaaggcgctgactccgctagtgtatataaaaagaggggaaaatgctaaaatagcttaaactgttggcccgtatccaagtgttgtggttggtgtgctgtgtttgcttttaaaacgaagactggtcagaaagagaagtgacagaaaggagaaaggaagcgaaagaatcgattgaacggagaggaaaatgccgaagagagagagaagaaaacgggaaagaataacacatgggaaagagagagaaaaaagggaaagagagtgccaaattgagagggtgacgaagagagaaaatgccatgccggaggaatggaataagcaacgttttcagcagtaaagaaagaatgaccggtcagcgaaagaaaactagtgggaatttagaggaaacaacagagagtgagaatgggagagaaagagcgagagagaagaggagagagggagagagataaagaggagaatgagtgagaggggggaagagagaaaaggagagagggagagagataaagagagagagagaaagggggagggggttaaacttttcaaaaatgaaattgat

SEQ ID NO: 19515 - DNA, 2500 bp, Heterodera glycines
gacaaaaatccaggaaaatccaggtccaggaaaaatccaggttgccgaaaaatggcctggacctggatccaggaaaaatccaggcctggatccaggtccaggtcgatctctagttgttagcatttttcaccaaaactatgcgaagttaatttgcgattttcattggacttctccgtgaaaacacttatttgttagtaataatggtgatagagatcgaaaattcctgagaatttcgattcgagcccaagaaagagtttaatgtttacacattccgaattctttaaatttttatttggtattttttttatttacttagaaccatgaacatagactactgatcatgctcatatcatacacttcacattaatataaaataataaaaataaataaataatattgaaaatatttgaaaatattttctttttacttttcttttgattataaatgcaataataaattggttttattaaatatatattttttacaatatgttaaattaaggtgaagcaaattaggatatttgttaagtgttctttggtgactcacagattagaagtgcaaaagatatttattttattcgagattcaatttctgagaaaagtctaataaaagagtttgttaatttaaaaaaatttctttaatttattttattattatttttttggttctccggtcgaattcgaaaactttaatcaattttaaaatttctcattttattaagatatataattaatgaatctcgcaattgttaaattatgtcgctgtttaatacaatatttttcctttgttttttttctctttttatcctttccttttgcgtccgtcgccttaaaaggggcgccccgcggcgttacgaaaggaaagggaaccgcccaactcgccgaggccaactcggcgcgaattttcgttgcggctttatctcagccaaactcgcaaactcgccgtaccgaattggccgtggtgagttagccgtggcgaagtgacccaacccaaaggaaatgctcctttttagctgttcctttggtgctgcgacttattctttggtctttctttcttatttttctctctctctttctctctttgtcttattttttcctttctctgtctttctcctcacccttcctcacactatttcgcggtcactcttttcgttctgtctccaatctcttcgccttcactcagctcagctaatgtccgtccgtttgtctgtccgtccgttgctccattctttctcttcgtctctctgtctctaatcgtgtccctctcccactctctctcccctccgtccccgcgctctctcttccccccccccgctctctccctttctctctcccatttccttttctaattctattgatttcctcttacatatttttggtctttccttcctctcttattattcctagcattattttcgccatcaaaaccctttaatttctcaattttcttctttccccttcattcatttgttagcttttccattcttcggatagctaaaaattaatctttcttgaatttacctaatttctgagtcgcaaattaaaattgaaattttaatgtttttcctatgcctcttaatgtcttattagggggggggggggggtgagggaggcaaagagctccctgaaatacttcaaaaatcaataaaaaaattttcaaaatgaaaaaaaagaagggaattaaggggcggtggtgctaataggcgccccttaaaaataaagatgagctcattttaaatttaggctgatttgacctctcaaaaaagcataaaatgagtctcaattctcgcagttggctgtgatctgatcttttcatacttttttttaatttttttgtcttttccatggaaaatatttatttattggatcatttaacaaatttgaaaatttttaagtgataattataaaattaaattaaaatattttgggcttcgaaatgaaaggtcggacgaatatgccgcttgaagcagtgctggcacttgtccatatggtcaaggctcgccagcaagaattacgcaatcacacgaaggtggggggggggggatggcacaaattcaacaaaaaaagcattaatttataatattacatttattttcataattaatataattatttcatttaattttcattattattttgtgttaaaaatattatttaattaatttaattttaaaacattaatttattataattaaagttgtacgggtctgggaattttggaaaaaccgggacttgccaggagggccagaaaggccgggagtcccggcccgggactggcgcctgaattttcaaccgggacggggtaccgggataaagtgggaattttacaaggaaaaaatccaaaatttaaatttaatattttttaggtgaaatattataaaattaaactttcctattgtttttcatttcataaaagctcaaaaattaataatttaataaaacaaaaatattgaaattaagcatcagcaggtgtcatgccaactcgtacaaaaggcaactcg

SEQ ID NO: 19516 - DNA, 1100 bp, Heterodera glycines
ctatttttgtcggtattttaattaaaacaatttatgattttgaccaaacatttgttgacttcttctcaatttggctcatttgagtgcttaataccattttaaattgtggcgcttaatgacaaatttcgtcgaaattccctccccccggcgcttgcctcaacccgccgcttatctctctgtgtgtataaatttgtccctttttggccaaatgtcatcattctcccgtaatattttcattgggttttatttgtacctaataaaataaaaagaattaaaatataaaatttaattattctcctaaacgttcttccgattgataatgaatgataattaggggaagggtcgctccgttcctaaaatttattacccacagaataattgggctatcttttgtctttggcctcaaaataatctttttcccggctgtcactgcccattggttctctcaaattggctgaatacccaaataaatgaggcaataatttggcaatgggacaacaattaatttattattcagtaattaatacccataaatttaatagtaattattcaattcaccattaatgttttttatcaattccaatgtttcgctttttaaaacttaataatcagttttttaattcaatattaatgaacagaatgtacaaacggacttattatatttctgttcttgtcgtcgctttcggcagttcgttttctttttacaggcaatttctttacaaaatttaattaatgtttataatttttagttatgatgttgtaaatccggctcaaaagtaacatttaggctaaattaatataaaataaaaattaataaattattttacgttttccccttttccgcttaatttttaaatgacccccccccccccctaattagcattgtgatgagatggctgaatgacacttatcgggcacggggacaaccaaaatcggcgtccgagcttgactttgtttggtctgtggtggtctccagcatcgccgtcggcgcaatttgcggggcgttgtcgacaaagtaatgagaaaaatagcaaaaaataattattgaataaagtttttatgaactttttttttttgctttttagggcattaacggaaaa

SEQ ID NO: 19517 - DNA, 1190 bp, Heterodera glycines
taaataaatgtttatttttcaggtgctcggtgatgctcagaattggcccgtcgcttttgccttctccggccttcccgcttttattctttgctgtgtgctcccattttgtcccgaaagtcccaaagtaagcttattcattaaattatattttttttcctaattacctccttcccctttcatttaagttcactttgttgtcccgtcgcgaccgcgtcggcacattggacacattggcacggctggtcaatgttcacgagggacagaccatgttcgaagcattgcaacgcgaaggacagagcacacaaacattgacagtggcggacggagtgagtgatttgaggggaaaagcgaaaggaatgcactgattgatcgaacactgataaagcctctttcgcagaacatcgatcagtccagcgcaatgtctgccgcctcaatctgccgactttttcgatcgacggaacttcggatggcatttctgatcagcatgtgggtgatggttgcccaacagatgaccggttgtgctgccgtttttgcctattccaccgatatgtttctgaatgccggattggaaccgtaagaaatgcaaaaaaaaaatgggaagaggcattagaatttatatttcaggtcaatcgcgcgttacagcactttggcaatcggaattatgtactttctattcgcttgcagctccgttttcttcatcgaacgaaaaggtcgagtttaatttaaaatataatttaatgaaaaataattaaaaagaaatctcaatcagaattattcaataatttaaataaaagaaaatgttttaattaatattttaggtcgccgtgccctctctctgttccaattgacattggtgacaatttcactcagttttatgagctttttttcgtgggtacaagcatcatcgggggtaatttgggtaattaattgttttaattaattgctttacccacagagtaaaattgccagttatggttccatcatggcattgttggtttacatgtgcgggtacggaatcggaagtccaattccgtggatgattgccagcgaaatattcccaaccaaagtaaacaattttaaatttgtataaaaatgccattggcgtcttttttacagtaccgggccagcgcagttactgtggccattacgatcgcgtggactttggcatttgtcatttcgttggcatacct

SEQ ID NO: 19518 - DNA, 2509 bp, Heterodera glycines
  misc_feature (105)..(105): n is a, c, g, or t
ggaatcggctcatcgagcagaacgacttcgatctgaaggagagttttctttgagggggaagttttgatagtttggagtactacaaagtgccacactttttaattntaaaaaccaaagggggacccttttggcttgcaaattaattttttgtttgaatattttctaatcatgaaaacttatccacattgttttggggggcctgatcacgatgacatcaatttggaccattcctaatccttaactcgaacaaattctcatttttcgagtacgactttttgttccagttcgagttagggattaggaattggcaaaattggattcatgatcagagacctaaaaaacctcccggtaaaaattttttttgcaaaccaaaaaggtccccctcattggttttttaataaaattcaaaagtggccattttgtaagtagcgcctaaaataaaaataaaattacgcagagataaaataactggaagaaaaactaaatcttggcttaccaaatacagtcccaaaattttactttttcaaaatattgcacaaagattttccaaaattaaatcagctggacatcaaattgaaaaataaactccacgccaaatcctacaaaaaagaattttgattcgtggcggggtgaggtaaacgaactgctcccctatactaatactattaatgttccaaaaaatataaatagaataattttataattcgacaatttaaagttttaaaaatttactaatattcaaacaagtttttgtatttgtttgtaagacctaccactctgaaccccttctccaaggggttgcaaacgtagactccgttcctgacaaagttctgttggttggtttcgtataaaagtgcctgcgcttcctccaacttccgcttccacaatgatttgaagcacagcatggaaagatggcatgtcaccaggccgagaatgttctcgaggtaagcaatcgccgtcagtttctccgcctccgcgtaaatttggttgagatcagtgacaaaattcagccaaatatccctgtcaatctgaaaataaccaatcaaacgaagggccaaactgttaaacatttacgtaatgttcgagctcttcaggaaagtctgtgctgaatttcacaactaatgcttggctgtagtcgcgttggatgtaaatttttctgcgctcattcaacgccaccttccgtttccccaacaaatttgaattatttaaagacatcagaagtgattttgctgttaaaaaagaaccatttttatgtacaaatttattcagaagattaaagtcaacagagatttgtgtacgaaacggaagttaaaaaatcaaaacggaccaaattaaaaggaagagaacacagaaaaaacgacaaatataaatttaaacagagggaggagacacagagaaaagagcgtaagagagagagtaggagagagagaagagagagcgagcactatgggtcaagcccagtgttagacaaaattactcataacgccaaatagcgcatttggcgtaaatttttgcgcgctatttcaaaatttacactggaaaatgccttttttgtattttttatttgatctgccataactcgcttcattcccaactaaactgaacaaatttggtatctaaaaaaagattttgaaaaggggaatctttttctaagcgaatgttaagtaatttgtcatctcagaaaaaagttgtgggaatttcaaacttttatcatgttataactcaagtcctaggcagctctttctaaccaaaatgctaaatttattcttttttctattgattctaaatgttcaaagtgattttgtacccttataaccaaaattattagaattttcgaatttggtgttttttcacgtgttagagacatgaaaatagtacgccaaaaagagagaaaaagaaatgcaaatttttttcatcccatttttgtaatgttctaggccgaaatttttactcaaaacactgaaagtttgttcataatttttttctctatcgctatgcaaaatttggtacggatttaacataaagaaaaaaagttagacatagaaaagtaaatgttgttttttacatcattaaaatgaagagatagtacgccaaagtgagagaaattacaaagaaaaagagaaacgacgagatagtactaggcttttccgctgacccacaaaatgtccagcccacgaaatgtccaagtctcgaatttgagttttttattattcagatgggcctaaggttaggcaaggggtaatataaagggtatattcgtattcagcgaccccgaaaaccctaaaaatcctaaattaaactcattttgtttttataaattttgaaaaattttggacatttcgtgggtttttactcttttggacatttcgtggcttggacactttgtggggccgccggcttttctctgcacagtggggcgtacccatagtgtatgtgtatgtgctcttttctctgtctctctctctctatctctcggtctttgtctttttgttttctttactatttatct

SEQ ID NO: 19519 - DNA, 2826 bp, Heterodera glycines
  misc_feature (2719)..(2719): n is a, c, g, or t
  misc_feature (2724)..(2724): n is a, c, g, or t
  misc_feature (2745)..(2745): n is a, c, g, or t
cttcaatgaatcgtcgtagtggttggtgtttaatttaattttaaatattcttattttaaaatttaatttttttttttttttttgattttgtcttaggctcttccgtccatttgcttcacaacggacagtcgccgccttcattttcggctgcaacaagtccacatgagcaacaccaacaacaacaacaacaacaacaaaatcgctcacaacaattttcacccatttttactgttcgtaaaatattgttaattttttagtattttcaagtttaatttttctttttttttaattcaaaaataatattcaatttaaaaaaaaaatttcattttgtagcaatcgccaaggcaaaaggcattttgtgtcgaattggggcgccgagggtgcaaaattgtgcagggtaattaattaattagatttaattgattatttttgaagctaattttattgttactaataataataattcacttacagtgacttatgacagagctgcacaaaattcaaaggaattgacagtgacacggggcgaaattttagaggtgaaaaaatgtgaaaatgttttaatcatttaaaattttttaactttttttttaactaaaggtgctcaatgacacgaaaaattggtgggaatgtcgcaacataaacagccgatcaggtgaaattttttgccggttcgatctgatgaatctgatcaaaacaaaaaatgtgttttttttaccgttttcactaaacaatggcacccgccggaaggattttatacaatttttaattaaaaagcaaatttttattgtttttctttcaaaggttatgtgccgcacacaattctcactgtactggacgaaagtgatgaatatgacggaccgcataagaatgaggtgaaaaatttggttgtccaattaaattctctcagggctccagtctcgaaatgtggttttaaaaatttcataatttaaattttcacgggacgggtcatttcgccgcgggccgtttcaccgccgcctataacttttggcggcggcgaatggtcggcggtgaagtgacgacctcgatctagggatataagtaaatgggtttcaattacgtaaacccgtaattaagggggaggggtctaaacacaccgtaattcctaattttcgtaacccgtaatccataattgcgtccagccctgatccccgacaattaaaaataaatctcaggcctttcgctcaaccaccgccggctcgtccaatcaccaattcccatcctccggcacatcgacgcccgaagtgatcagagaacgacggggacggaacggcgaatttcgctatttttaacaaagccaaaattgcaatttgttaaatgcatatttgtttatgtgtagaatcattttcttgcttgtttttctattctttttattttgttattttaccatttttatggaaggcatttaattaattaattagctaagcatttagccaattaattaactaattggtcacttttttcccttgattgatgagagttgaaattttcattctgtgttgctgctgccgtgttatacgcatttgtgctgattcgagaaagtctgtatcaatttcattctccatttaatctctctacttaatccgtgcattgtaattaatctaataacttctatattattaattaattgataaactaaaacaaaaaaaacatttattcacctattttagcattaattttcaactaattaatggtgccctcttattttaagttcattaattatttttccaagtgccgttctctcgatcaaaaatttctaatattaattgtttatgcctaattaacactttttccacgtcttatgtttgcttattcatttatattacatatatttctaacctcatcagctcactaattaattcacttgtttaattaattagcatttttatacgaattgctaattgttgtaaaagaattttatggccaaatataaaaaataaaatttgataatttaaatacatttaaattacaaataatcaagttatattgcgttttggatttattttgctttccaaatggcactgacaattgactcggcactcatcggaatggtccaccgccgttggccatcgaccacggacactttgatgggatttgcttttggattgatcagtaccaacacacgattgccttaaaaggaataattttattttaaaataaaaatattaattttttcaacgtaattaatccgaaaaatcaattaagcgacttttcgatcactaattaccgccgatcgtttcaaatgctacatgttcaatttgttcttggtagccaattgttgtaccattcaataggacaaaatctcctagaaaatatatttttaaaaataaattatttaaattaaaaaagtgttaattactgtatgaatgaatattttcaattggacggtcctctaattgggtgccatttgcagcgaaaaggatggaggaaagaacggaagaatttcgtggcacaaaatgactaaaaattaaaatcaaacaattttaaaacaatgcattttatgggatttcaaaaaaaatacctgaaatgtgcaagaaaataaaacattggctgcttatagaattggtcagaagatgcattcacaattaccttaattaattaatttaaattgataataaataaataataatttaatcggaggcgggacaaaatgttgccgaagagtttttggaccataatttttgttcctttgaactanattanaacattcttggcactgttcanaaaagattgaattcatagtttttttagtgtcgtaattgaatttttttgaattttgttttgttgcttaaactccaaatttat

SEQ ID NO: 19520 - DNA, 1545 bp, Heterodera glycines
cgcctcatttgataaagttttgtccccaattttgcagatgtgacgccgctttgggactgctgtcaatatggtcaattaggacatgtgccgtgcgctgatcgcccatggtgtcaacatcgaattggggacggactctggcgaatcgacgctgctctgcgcatgtttcgaaggccgttttgagattggtgagtcaaatgcatggatgatgctgccgtgtaattattgccaatgttttcccatttttcagtcactcttctcgtcgagaatggcgccaacgttaatctcgcggacagcgacggaatgacgccactaattgtcacttgttactttaccggaaaggttgtgaacaagttgttgcataatttgtgactgaatgttttttcgcgttcatagattgacattgtgctcctgctgcttttacacggtgccattgttggacagacggatttcactggtgcaattagtctaattgccctaaaattattggattaatattcccttttttcaattttagggatgaaatttgctcttttgggagccgccagggcgggctatttggaagtgtgtcggctgctggtgaacggatgggcagcggatgtcaaccagcaaacaattgacggcaccacagctctgatgcgcgcgagcggtcggggacacgtggacgttggtgagaaaaattgtgccaaattttgacaatttttcttcattttcagtgaattttctcgtcgaacatggcgccgaccttgaccacaccgactttgatggatacaacgcgttgatgtgcgcagtgaagaacagaaggacggaaacggcacttcatttggtgacgatcggcgcgaacactgaccaaattggcattgatggtgagcagaaaaagtggttaaaccgcacggcttttatatgtaatttgctcccatttacaggcaaacgggcgcgcgacttggctgaagaaagcggacttgccgaaatgattgacattttccgtgccgcggctgagcagcgggaaaacgccgatgggtaaaataggatgtttttttgatccaaaaaaacaacaacacattttcaggcatcagaacgaacattaacagcggcggatgagagggaatcgcggctcaaaagaattggacggatgtgccgaattattcggaagatattctcgagcacttatgtattattgcagtgtatttgttcatatttgaattcacttgtcgtgtttgtctgctctgattgtacataaataacaatttttttatttaacaaaaaaataataattataggtatcccaattaagaatacaaaaaaggatcgatcgatcatttctgaaataattcattcattcttcccgatgatcactgcttggccccgctgaactcgagaacatctttttcgttgcttctattcgtttcagacaatggcctaaattaaatgcaatttaattcggtgaaaaggtaaatttcaaaatggcaaatgccactgaatcactggggcttacacttacccaatgcaatttttgaaggcacacaaatcaaaaaagatattgttcaa

SEQ ID NO: 19521 - DNA, 3641 bp, Heterodera glycines
  misc_feature (3576)..(3576): n is a, c, g, or t
ggggatctctagagtctttcctcttcgtgttatatgaaaagattccgtcatccataattgcactgggaaattccacaatccttcactattcgtccaattttacttgtcgaatttttcaggacagcgcgtgaacgaaggggcggaagaccaactcgccgcagcagtcgactcagtgggcgacggacgatgagagaaagggaacgaacggacagagaaaagaaacaattcgtccgtctgatatgttttaattgatcaaaaaggaaatgaatcggatggaatgctttcaaatgaatccgactgcgaatgggcactgctcctccccattctctccatgcttttgtgagcattcgaattgcccgtggggttcaatgtgggaagtccattgctccgagtccgactcgtacgaacaaaggccggccaaagtgcacggaatgcggggaagtcggtggaattggtagagaagacctctggcctgaagcagtcaaatgggaggcatggaacagaaaagatgaaaagcttgggaggaaaagccttcatttcgaaatggcactcgccttgcgcaggatgagatgggcatccatgtgcatggacagcgaagagaagtaaaagaggatttcgtcatgtggcagattttggtccacaacgtcgggcccataaatggaaacgacggcacacgcaatgaacagatggaagtagttggtgcgatagcgtgaccagcatgccttggagcggatatttttagaaaatatccaaaagtatattcgaaacctcccaaatttgtaaggagtcgcgggagggaaactcccgcttgaagaagagcagaatccaccggtggacgaacatcaggccgggcgcgtccccgccgagcttggcaaggtgtgcatggaagtcgggcacgaacagacgaagcagctcacggatgaagtccaattggacttccatttccgaaggctgttctccaccattggaaggtcggaacagcgtttgctcaatcagatgcacaaaacaccaataggtcaacggctcgtcttgcaaagtgcacaaaagtggggccaacaaatcggacattccctggggagaaaaggggccaaatgaaggcattttcaatggcacaagataaagtgacaacacaagagccttggcagaagtgccaacctggatgtagccgatctccggattttttgtagcataagtgagaaggatggacctgacaaatgagtgtgttttgtttggtataatccccgccacttttccccctcctcatcatgccaattttgcaaagtttggaatgccgaattcgccttccccccattgccctcccccccttttcccctcacttcatcgtttccaaattggggttttcttcccccgcaaagaatgagttgcgtctgtccgtcctcaacacgtccttcactatgctttgttccacccccgccatttgctgctgtttctctttttctttttggtgcgtcgtttcgcctttcgttttgcgcattcgctgccccttcagcttttggtattgcacaaacatttcgtttcggatgttttcgcgttgttccgtcgtcgaattccatgggtaaacgcgcaacaaaaaatggccacaattctttgcgaagggtcggctcaatggacgagaaatgaatggtctgaacgggcggagaagggcactcattagggcaaaatgcaccattcattgccacagttggcattggcaaatggacagtcagttgctttgggagcgaaccctcgcccccccccccccccgccctcattatttgcctttctgatggtgaatccgtcctccacactcccatccgcgctcacatacgaccgccacatttcccagcccaatcgctcgtaaaggccatcctccgggtccaactccgtcctggccaactcagtcccgggactgatcagcaaatgccgttcttggccatttgtgtgtggcgactgaaatgtgcgttcattattcggttttcctttgcacattccatttgcccctctttcacttcgtttccgatcgctgactttgcctttacggcgttccatcgttcgaacagttcggtgagtctgtccaaccccgtgtgatggaagtggaatattttgtactgcgagtcgaggctggcgatcaccaattgtccgcttgtccgttccgcgtccgaataaaacacgcgcatcgatcgcattttgccttgacaatgaatgcatcgttatttttaggcaggactttgacatttttccaattatctcttaaatagttcgagagtctcgggtctactcgaaaacagtatcggtggcaccatttgccaatgtacccaaattgacggagaatagtgaggagggcgcgcgtccgcctccgcccttctgccgccgcctctgctgccccttttgctgctgcgtctgtcccttcccttctccgtccgcctcctcaatgctttcatcggccaacattaaattgtgttcccgtgcgaattgttctggaattacgccgtgcgttaatgtcgcggcacaatttttccgcaaggcatccaaagattttgctgaaggagcggcgaacgatttaattgcgtttaatagggctcaattagcacttttggccacttcctgctgctcgtcgtcctccgacgatgagagactgtcgcccgtggcattgccaaatttgtcctcctcctcctcttcgtccccatcttcgcccgaagttggctcagaactttcggactaaggcgaagctcatgatgatttgagtgaactcattattacctgctgatcatagcgaatgttatgctgtgcggccgttctctgctgctccaccggagtgtttgggatcaaacaaatcgatgggattgacagcttaaattgtttaagtggccaaggccaaattggccaatcaccgcccatcaccaactccgatcagagtttgtggcctcggtcggctttggccctcctcctcggtcttcgccgttgtcccattgatctgttcccgaccaatgggtccctccgctccatcggtactttttacagcactctgaaggaaaagcattgcccacggcttcggtgtgaatgtccaattcgtcccatttgtttctttccctttacctcgccgtcgtcacttccgattgtcagcgaccgattagaacacgtgaaacgggtcacttgggccccgcctttattcccccctccggcttctttttgttcttcggccccgtctttgatgcgtcccctcaggggagaaacgcaacgaatgcttaagggaaaagagcgaataaatgaaaaattaaaaaagaaataaaattaaaatataaaaaataacgaatcaccacaataacaaagaaaggcacaacagaacacaacggaagaagaagagcagttgcagaagagacgaaaagaaggacaaattgaaaagtgaaggcgaaaaaaggcacaaagagaagaagccaagacgaaagttcagctaattgtaagttgtctttcttaatgccgacaatcactgatcatcccggccgtaagctgtgccttggattttgccaatggcaatgccaatgccattgtgctcttctcccaataaatgccaacctnggagggagttttctccagcagagcgttgggcaaccattgcaagatcaaagtgatgccgagctgat

SEQ ID NO: 19522 - DNA, 1741 bp, Heterodera glycines
tgttaatctcgggaggggggggggggcacgggtatcctttattgatcccccaaaaatggacctgtttcgcttgcattgcaataaacacataattatcgaaggaaattgacaaaataaattattaaaataaaaataaattatttatttcaaatgttatttgaaagttgattataaatgcgttgattcactgcttattgtgttttacttttctcttgcttttaccctttgctatttattgtcattttccaaacaattgtttagttttggccaaattcatttgccggacaattggaaaaaaagagatacaagcaaatgaatggaagggaaaagaacagaataagcaaaaaatattaaattataaagatgaataaatacgaaaaggttaataatactaaattaggagaccttaattagttttattttctcatttctggcataattatcagcttgtttatcttccgctcaaacattctcttatcgtttaatcacattaatgacttcctctttttacataatcattttgttttaggtcagcgacatcataaaaacaaataaaaagtgaagcaaaagcgaaataaaattttgtattttcgttcgttttttcgtattaatttaatgcaatttaaatttgtgtgtttaaatttgaattattattttgttaattatttgacactttgctgatattaagtgctttttgttccgtctaaatgtctttggcctggaatttcttcacactttctgcccgggtttcctactgcaattattgtgactacaaaaaggccaaattttccacataaaaccgcaaagaaacaacacaaagtttaaatgttggcaaaaagccgtcaatttgttggtccacagcagtgaactgtgtgaggcaccggctcaagctgtacccgaacctgctggagaacaatattctgacggaaatcgaaagagatggagaacgatttgcccgctgaagagttgtgccaatgcgaaagcagtggaaagcgcaaatttgagcggagaaattcgagccaatgcgaacagattatttggcgaattgatacattttgaggtgcaaatgccaatttaaaaaaactaaaagcattcggcacaaaatgaaataaaaacatttaaatatttaatatattcacttattaaattcaccaacaaataatgaaaaaaagccattattaaacttaaattcatatttattgggtttgttattaaattcgaaacttcgtttttcaggaaatttgttttgaattgaaatgaccaatgccacaattattggcatttacatgctattttgaatgaattctgaatgttttgaattttatattagattggaattataaagattagtaaattccattttgacaatttcagtccgtcaaatgattgcgtctgtggtacttcttgctagagttgagcggtaatcggtaattgtaaaaaaaccggtaccggtactgaccggtaatgcaaacaccggtaccggtaccggtaccaactttttccaccggtaccggtaccggtaccggtaaaaaccggtaattttccaacgtaaaaatttttggacaaaatttttcaaatacaaaatttttattcagttttcgcgcgagtgcctgttttttagcattagaattgttcagaagtatatgtatattgagggtgaccaagtttttttttcaaattcaggataaagaacactaaaattcagatgtagacctcaaaattcagattattgcaaaacaag

SEQ ID NO: 19523 - DNA, 984 bp, Heterodera glycines
catattttccatggaaatcctttgatgtacacagtttcgcttttacgttcacttttaatgatttattgcgcaaattccgacactttttcaatttccatcaaaattgttccattggatttgttgggatcagaagggaatttctccggttttcatctttcactatgacatcaatgaccaacatcattctttccctcttctaagaagacgacgatccttccgggctgatggtgtaaagggtttcctccacccctaaatagtgcaaatagctatttcgtaaaattgagtttattaaataagatagttcgttcattttctattgtttattaattttatttttaaggttaccgtgttccctataaaatatatacaacttccttaaatatatccgctaaaaaaatccataaaataatcatagttgcttctttttccaattatatttagatgggtaccgcctaataaatatgaaattttttttccctgttatttttcaaattcaaacttttcagcgcaggggcgaaaagcaggaatttgtaccgattgggccaaaaatgacaaattttgttgtttttgggtcaatttttcaaaaaataataattcaatgagtccagcggtgccgatgggcagattcttatttaaataaaaaacaaataaaaaataattttggattattttcacttgaaaaaagtaaaatttgaattttttttaaatttttgaatttttaaaaattcccggttggtcccggacgaaaatcaaggtcccggtcccggcttctcaggttccggcaagtcccggttttgcccaaatggcggtacccgatacactctacttaaaatccgtttcaattttttgccttttcaccctaatttgcgcggcgcgcagtccctaattatatactaggatatggaaagcaatcattcaatataagataaatatctcaatcgagttcacagccgaaacactagccgcaaggtctgaaagtcagct

SEQ ID NO: 19524 - DNA, 1250 bp, Heterodera glycines
ttctatttttaggcttcttgacgaaactcccgacccgagtgatcagcagaagtgaatgaatgaattgttgagaagtgatcgatcaatttgaattatttaattattgacgtgctcataaaaattgttccttttttactgttgttggaatgatcaatcaacctatctgtctgtgtaaatcattaggataaatttagcgatttcctgaaagatttcgaaaaaaccaaggtactgaagtttccaatcgggactcagttatccattatcaatacagtttgcaaaaaaaggcaccaaaaatcgtgaaaatgcactaaaatcccaaaaaaggcatataattttttttattagtgactttagggagcaaaactcgtaaaacttaactaaaaaacttaatttggtcatttaaatgattattaaatattttacctaatacttttttcgaataagtaaaatttataaatctaaattttttatcaagaaaaaaatgaaattttggcaaccactttttgagaaaggttttcaattcttaggggcgtattttttgaaaaattttcaattcataggggcgtattttttgaaattttctcaggtcatttcttagagggtgtatttccccggttttatttcatttttaatggaatttttcggaaaaaacgccaaaaaaggcaccaaaacggcaaaatgccaaaaaaaggcatttaaggcacgaaaatcccgaaaacggcaaaaaaaggcataataaaagtcaacgtagaagcctcaaaccaagtggaaaatgcgttttttatgcttaatatatcggaactagtgcgcagaaaaaaaggcatatgcctcaaaatgcgagctctaattatcaaaaacaaagaagaaaatgaactatgtagagttgagcgggaccgggaccaaaacacgaacaactgagtaccaaagtcccgggtttttcccgggtttcccagccaaaaattcccggtacgcgaccggaattcaattttaggtaattatgcagtttacaggccctttttaacatacattttcaaatgcctataaatctgttttagaaaataatgaaaataagtgttaaggggttttttgggtcgctgatcacgaatagagcacccatttttgccaatttcgaaaccctgactccaggaaatccaagtccaggtcgacatggaatccaagtccaggtccaggcttttttcaaaataccgagcaatgataacgacatagcaccggggtgggttaggttcgga

SEQ ID NO: 19525 - DNA, 754 bp, Heterodera glycines
taaatgtatggagaaatcaagttttcaattttttacgattttttgaaatttcattattaatccctaggggtcgtatgagacgggcgtctggggttcgaatccgcttggctgcgattatttttttaggtacttgtacagtttacccccataaaaattttctaaaattatttttgggtcatttcttaggagtgtattttcccgatttttttggcatttttaatggaatttttaggaaaaaacgtcaaaaaggcaccaaaacggtaaaatgccaaaaatagcataactttttaaaaaaataatttaaaatcgaaaaaaaacaagtagttgacaaaaattattagataaaaatcaatgcttttcaaaatctgagctcagttcgtgatcagctcattttaagcctagaaaaaatacccgacaaatttttaacatttttttttcgtcgggacaccaattcttaatattgccaaaaagggcgctaaaaatatgcacacatttaaaaattcataaaaaaaaacttttttggcttttattttgaagaaaggagctaacaaagcatttctgcattgaaattttcgattctgaagacactatgcgtcattaaaaaatcagactttgacgcttctcaccaaaataatttaaaaattttggcgttatgtcaccattttctcactattttattaactatttcgagatttttcatcactaaaagtcgcggccctagtcattaaaaatctgtcgaaaaataatccccccg

SEQ ID NO: 19526 - DNA, 1676 bp, Heterodera glycines
  misc_feature (33)..(33): n is a, c, g, or t
  misc_feature (106)..(106): n is a, c, g, or t
  misc_feature (117)..(117): n is a, c, g, or t
  misc_feature (188)..(188): n is a, c, g, or t
  misc_feature (204)..(204): n is a, c, g, or t
gaaaatcgcattttgtcattttccatcttttantagtcgttaaaattgtttacacttttttcaaaaaattctttcattatttaaactccgactcaataaattgtcncatcttgaacncactgattatatgaataaatttttcaaaaaagaggtaaagcagccgataaagatttgcgaatgtaaaaatnttataaatttgctgcncattatattcgttgttgtgctttttgcgcatatcatttaataattgtagaaaaaatactgaagctccgtagctgtaaaaactttaattttggagattttgttattcaaaattatttaaaaatgttgttttgatttttagcgaatagatcgaagagaataaaaatagaaaaattaatcaaaaaggtttaaaattgaagaaaaatcgcaaaataataattaattaaattcacaaaggcccgaaaaaattaaatttcaagaatatttgcggtcgttttagcttctttttcactttaaaataattagcttaactgcttatattactactatatatttttaattttaagcaataattgttattaaattattttttttttgtgaactaagcagcagaatttttatattttttaaattcaaaaatgaaaactttttgatttgtgagtcaatttttttaaggattttggtttttgtggatgtggataagcaccgccgggtaaaatattttatttaactatttgttaaaaaatattcattttaaatggctttttttaaatcctttcccttactcgtttttcaaaatggaaatgttcttgacaatttgctctaaattcagcgattctttatggctcaacaataaacatgccaaatcattttttgtcgtttcatttaacaaatcggccaaactttgctttgacatgattaaaacattttctagctgctgttcataaatcagtgccaatgtttgtcggatgccaaaatatgccaacacaatgatttcttttatcgtttcaaatttattcagtttatttgcggcaaaaagctgaaattaatttattttcataattataaaaaatacataaattaatttaaatacattttctctttttaaaaatacgaccttttgacaggaatcattaatatttggtccattggcaatcacatcaaaattttcagaaacattttccaatgttttgcggacccataacacaatgaagtttctttctttttggcattgattaatcttaaataaattaaagtaattttaatttaatatttcaatttgttacataatcattggtgatgtattttttatggtacggggtttccaattgtccaattatttttcgaaataattgcatgtaaaaataaagcgctttcaatttcttggtttcaaatgtttcggcttcaactatttttctttcaaatattagaatgttatttggctggacagatttcattctaaaaaaaatgaaaatgaattaaaaataatgttatttttaggcaaatgcctaaatttgggtgcatgtaacattgagataagcataaaaaatgagtttttagcttggtttgaagcttttaggatcaattttataattgctatttttgcctattttggacttttttatggttaatcctacatatttcagaatttccccaaaaataaaaattgattccctaaaaaataattttttttt

SEQ ID NO: 19527 - DNA, 1482 bp, Heterodera glycines
  misc_feature (1458)..(1458): n is a, c, g, or t
ccaattcagggccgatttggtccaaaatttggccccctttcatttgctcaaatcccgaatcaaaaaatcaaagtgaatttagcattttgttgtggggaaggacatcattgggatggttaaaaggcaaaattcagcataataaaatgccatatttgactcacggaaaaaggaaatggaataaaaataaaatgtggttattttaagataaacataattaaccataaaatataaattgttattagagactagtgaaacaattgctggagcgggaattgcgtcaaaatcccgtcaatttgtaacgggactcccgtcgctatgagagggaataattcaaaaatttatttaaacaaaaaacaaaaatacatttactcaaattttgaaagataatcttttttgttaaagaaaaattttagaaaaattaataagcacaaatttaatttttaatgctatttcccaaacatttttagggaagctaaggaggagggaaaaaagaaaattgagcggttaaccgatttttgtcataaaataatgaaatttctcggttttttggtcaatctcttaataagaaaagaaggcttctgtagtccagcgatggcgatagtcgctgtcgggaaaatttagctaattttgacctatttcgaaccgggaatgccatcaaagtcccgctcccgtaaaaaaaaatcacgcaaggaaaaagcacgggatcgagattcccgcaaaaatctcgcgggaagtcccgatcccgccggtctcaagttgttggttatacatccattttgtgccactttttccagagcacatttttagaaaatcaaagtgctcataaaaatgcatctctattccatttaaaattaaattatatttgtaaaatttaatacataaaagttttttggcttgctgtgcttccatttgctgctcgtctaatgcgctgtttcccatttgttcttccaatttctgctgcctttcgtttgcattttcataatcattgcttttctcggtcattttttgttgtacaattgaccaattagaatttaaaatttccatgtcattttcaattttattttcacgtgcctctccaaacattgtagcctctgatgatgatgatggtagtgataatgatgatgatgatgataatgacggaaaatgtttataattggggatgaattgattttgttgcaaattttgcgaatggcacattaatgacgaattgtccctgtgttaatataataattcagaaactgatttgataaaataacattaaaagcaattttttcaagcacttttctatcttatatactgaaaaatccacaaatttaattatcagtttatatagaaacgattaaaaaaccatagggggaggggtgattaatttttttaaactgttttacattttcagggtcaatgaataaattaaaagcatcttattaatttttcaaaatttacagtcaaaacttttgnttttttgggaatatttgttaaatt

SEQ ID NO: 19528 - DNA, 1017 bp, Heterodera glycines
tttaaattcttcacggatggaatgcgactcatccacccccaatccatcgtcccattcttcggaaagtgtccattcgtcggtgagggtggaagatgaattgcaaatgggctaattttggcagcacaaattgtttaaatagtctgctgatgcaacagatccattaaaaattaaattcagagcaaaatttcatttttaaagtgcctaaataaaataaaattttttttttgaaaaaaggtttaaaaaccataataattgcatctaatttttaataattaaaaaaaataatcattttgagctttgtgccacattttttttatcggttttgacgaaaaaaaaattcgaatttctgaattcagttcttcctccgaaaaagcatgaatattaagcatttaggtgaaataaaactttcattcgccttttcttttaaattcaatttatttcattaatcactcaagtgttattaatcgtttcataaaaacctttatttagaagcaattaatggctaattaagaaccaatttgatcttcattagatagagagattttctttaatgaaattttttcgagaaatgattttattatcacaatgaaatgtgccattagatttggttggctaattagtccacgtttaacttcaaaacttaattttgaaagctgatgtcgcgtgctcagcggtgccaaccgctcgcttcgttaatggacaccgtttttttaatgcggcgtcgccttttcgaatatggcgtaatttaaatcccccggggtggccacgcatttggccgtgggcgtgccccccctcccccccggccaatttggcctaatacgcgcgtccgtccatccgtcctgccaattgcccatcatttcgcgcccacttatccttccttccttccgcccccgtccattttcattattattaccatttacttttgctctctctcgtcactcctttcttcatctcgtcatatatctttctaatcaccacaacaaacacatcactctcacctaaaaactgtggaaaatg

SEQ ID NO: 19529 - DNA, 1558 bp, Heterodera glycines
ttgattgaacttttacagacagtgaacagcgggggaaaacgtcgacattaaagtgcataaaaatggccagaaaagtgcgtctgcggccaaaaagtggacatcggcgcttcgcgttgtttccgcaatgacgcgcttgaagaatttgccaaaggcaaaaaaagcatttttaattgttcaaatttattttaattacctaattattttctaaagaaagagaaaaaatatgacgcggaaagtcgcgggtcgtccttctccacctccaccgaatcaacgccgagcagaacatacccaccagcagcaacagaacaaggtgaggtggtgggtagaaaagaaatgatcataataacctaaaatttgcaaaaaatagaagtttaccaaaagccaatcattaggggtgtaaaaaaagtctcgagtctcgaaaaccgagaccgagacttaaaaacccgagactcgagaccgagaccaaaaaaacccgagacttttctcgagtcgagactcgagaccgagagtctcgagcagcactacaaattagccgtttcagatgttcaacagaatgccgtcgttgacccggtgtatttggcgctcaaacaggcgaccaccaaatacggcgccccatcggtgggcggttgcagcagtggccgaggtgggcaaaatggtggcgaaatgaagcaattttaaaacatacaaattgaatggattattaaggataagctttaaccgcttagagaaaagaaaagccggcgatcactttaaaagtgacgatcgcttcttagagaacaattgagaatatttggttttttgtcaagaatttgtaagcaaaagtgccaaattatccggccaatctttaaagcgcatcaatgcatttttcttcaacagaaagtcgcagaaactcgcaaaatttggcatatgccgcgactccatttgacgccgagacgttgcgccatagtgcgcgcaatctgtcgcaaacttcgctgtacgactcgggcaaccattcggagaacgaattgatgctgctgctgctgaacgctaggtcgggctcgaccccgcaactgcacggtgagtggggccaaacggacgatgtcattatggtcaattaattcctgaattcaaatttaaaaactttgacagttttcctacctattacctagataccatttatacctatttcgccattttattacctatttaaggattttcagaaaattccttaccaaaaatgcaataaaaatgaaaaatacacccctaagaattggaaaattttctcaaaaattcattacccaaaatgtattattttttattgacaaaatttttaatttaaaatgtcaatattttctatgtaaatataatatttaaaatattgatttacaaacaaattgaaccaaaattttcctttttgtttgtttttttttcaccaaaaaagagttaataaaaatttttgtttacctgtttttctatatatttcaggatttttgtatctatttaatatatatgttttgagtttttttatacctatttaaatatctttttcgcgattctttttacctaaatttcccagccc

SEQ ID NO: 19530 - DNA, 1638 bp, Heterodera glycines
  misc_feature (1624)..(1625): n is a, c, g, or t
gttttcggggcagtccccctgaaccgatgcgcccagatttatggggagaccgaatccttcgggaatagcttccctatagtctgtactttaattctgcgttggatttttgctccccataaatgtttgagtaccccaaacggacacttgaaaaaatcgatttttttgttttcggggcagtccccccgaaccgatgcgcccagatttatggggagaccgaatccttcgggaatagcttccctatagtctgtactttaattctgcgttggatttttgctccccataaatgtttgagtaccccaaacggacacttgaaaaaatcgatttttttgttttcggggcagtccccccgaaccgatgcgcccagatttatggggagaccgaatccttccggagtagcttccctatagcctgtactttaattctgcgttggatttttgctccccataaatgtttgagtaccccaaatggacacttgaaaaaatcgatttttttgtttcataaatatttttttcagaaagtgctctaaagcgcaccaaattttatttacaacttaattttagcactctgatgctttaatatcaaaaaggaagatggagaaaaaattttttaaaaaatttttccttatattttggttatatcgttttgcttttggtggggtgcttggaacagtggaatcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttaaaaatttttgttgaaatatttgtcgtgctctgaagggcgtgggagggggggggggggggaaggcccaccacgaggccgcgaagcggccgagtgagtaccttcggtgcaggaaaatattaaggaagagagttcattatttatttgttttttgcaaaattaattcataaatattttttagaacgtgctctgaaacacacaaaactttatttacaggttagtttaggcactcagatgctttcactatcaaaaagggagatgaataaaaatctaaaaatttttaattgctttttaaacgagcgaaaaactttaggcttaactttttttttataaactgatcagaagcgaaccagattttgcgagggcatcaaaaagacaaggaaaagcactgctatgatgctaactccagtaattctgaatttaaaattttttattaatttttaaagcttcactattttatttttttagcaaaattaattcataaatattttttcacaaactgctctgaaacacacaaaactttatttacaggttagtttaggcactctgatgctttttctatcaaaaagggagatgaataaaatttttaattcctttttaaacaggccaaaaagtttaggcttaacttttttttcagaaactgatcagaagcgcaccaaactttgcagggatactgaaaggaagagtaataacctattttaaatattatctagtcagatcatttaaataatttttatccaaaaaannatttttttttggg

SEQ ID NO: 19531 - DNA, 1461 bp, Heterodera glycines
tgcttcataaaatgtataagtcaatctctcttttaatattagattttgtaatttaacgttgtcccacttggctatgagtttcttctgcagcaaacgtatggggttttctaattcaataaatttttactttaacaggatttcatattttatttcgtttcttataatttttcttggccaacgaagatgatttcttttcattttctgtaggtctcgaattagtatatttaacaaaatttaatcttttttcttttcagatattttacattgtttttcgaagttatgttatctaaataattattttatatagagttttataagttttgattcatccattaaatagtaaattatataataaataaataattaaaatgcattattttttgaaatattttaaatatttgaatgtatataattattaaagaataaatatagatacaaaaccggataatgtaaatatatttttctataaatgtatatatatatatatatatatatatatatatttatttatttatttattaattgtatatatatatatatatatatatatatatatatatatattaaatatatattttaaaaaagcaatttaaaatgtatttagttttatagttttaaacaaatattagtttttttaattattaaaaataaaagacacataaaatatctgtttaagatattaatatttatgtacatttatataatcctaacttcgttattcaaaagaaaaagatgagagtgggagatagctaatcccatcttgaagcaaatttatattttatattttcttttaaattcaatggcatttagagtgtgaatcgtaaataattaatttttttaaatctaaaaattaataaggagaaaattaagccaataagttgtgaattgatatatgatggagatatcctacttgtgtcacttgtggccaatgcagccgtttttagcgagtgaatgcgcggcatttagcgctctcgggacggcacttcactctcctcacataaattattatttttaatcaaattaattttttagctttattaatgtttataattgtttttatttttattaactagacaatatttaattttttaattcattgaatagttttttgaattgatttttaataattttgaaaaaattctaacttctttttatatttatttaaataaaagcattaattgttttaagatataataaaagtctaattgttcttatatataataatagcagtaatttttattatatttttttggcagtttactgttattttaatttcttgaatcccttttaaggttggatttttctttgtttcaaatatgttttgacaataaacttttttattttccattgcataataaaacattccttaataatggtttatttaaaataataaaacctgcagaacccaagaaagaaagtttaaggggagcagaaaaaaataaccccattattttttctttt

SEQ ID NO: 19532 - DNA, 1667 bp, Heterodera glycines
  misc_feature (1532)..(1532): n is a, c, g, or t
  misc_feature (1613)..(1613): n is a, c, g, or t
gggtaacattagaaaataccccattatttttcattgtacatttttgtgttttttttcctaaaatttccaaagccaccgatctatgcaccataaattagattggttaggattaatatctttaattgaattacccttatacatttggctcgaatattgaaattgtagacaattttgtgatttttttcttgttttagtttatgggcatttttgttgtaactaaaattttttttttattatttttattttgattttcggttgtataaatcggatgttctttttgctatgtttctaattaactaagcgaatattttatttgattatttatgcttagtgtttatttttaaatattttttatttttctatattatttttaaattttctttcaaacgcgtagattacgatgccctccggacagtcatccccaatccaatccttagacgtgttgaagttgggaagatatttgtacggcaagtcttcgtcgcctgaaagttctttacataatttcagaaattttgcttttattatgttatttaattttacatattttttctttgctaaagaaatttggtattattgtcccagatgaacaaccgctttttacgcttcttcacgagcttgtcttcgactttacatattaaataattgcgagattatttctctagtatttactacaagcattaaatataaactttaaaaaaataaatattacattttatttcaataaagctttttttaatttgaataaattttttatattcaaaatctttaaattttattttttactataacgcgcgattttatttcataacttgaaaaagaaaagaaaagataaaatatctactctctttcttttatttctttcaatattaatacatttacattgtaattttggaattgtattttctaattgttattttgcagagaaattttcaatttttttgttttttctaggtaacattttttgagtattttttcgacaatactatcgatcggacctctttccggtccacattttcacaaaatattaaaaaattttatttatcatctaatttttgggataagtaaaagtattttatttatttcaaagataaatcacaatttttatagaatagtaattttacttaattattctataaattaataattaatactgttactttggacggccgtaccgcgttgaagaacgccgccgtaaggaaagggctgcaagggcggctgcttttcgcagagctggcagctttttttagtctggtcattccaaattgttgatcactcattgttgctacttttatttaataaagcaaaaactatattcaaatcaatctattcagtttgtgtaaattacaagggtaccaccgtaaatgtactgtaagtatataattatgatataatagtttactgtagaatgcttactcttaattaaatgaaaacaaaaacataagaactatggaaaaaaggttggttaaacatatactgctacaaatagagaattctcaagagatacaaattcacaagccagtgacgctaattanaaatattaagtcgcaaaagatagcttttaacattaaccaatgccgtaactagaatggcgtaaataataaatgagaaaattntaagctaaatttaaacaattggccggaaatgagttccatgaactaagtgaattt

SEQ ID NO: 19533 - DNA, 2422 bp, Heterodera glycines
tatttttagcgttttattgcatttttatgtgcgaatatattgtgatttttcttgaataagcgtacggccataattattatttgaacaaaaattactttctttgtttccctttttaatgacagtcacacgattgtcaccggagatttggaggttcacgtgacaagcgttggcgtcccaaacattttgttggaaaacataattaatcttaattagttttacatttcaataaggaataatggcgaagaattaaaagcacacaccataaaaacaaggacaaataagatctcttaaatttttttatgacctaggaaaaaacaacaacaaaaaatcaaaaatcaaattcattaccgatcagcagagaaagaaaatatattttaaaaaatttgccttggccgtccctttggcaaattcggtggcaaaaacccaaaatttgaattttacttcttaggcaccgaaaatctggatttcctggagaaagctcaggctggatccagccataacaaatctggatttttaggtccaacacggaatccaggtccaggctttgttcaaaatgtcgcactatattctttagtaccggttagtactggtaccgccggtattgaaaaaaggtaccggtattccattaaaaattcataaccagggcttataagtgctaaaaactgccaaaatagtcaggtttatctaaaaaaaaacccccaaaataggtgctaaaaattgggaaataggtgccaatacaatattcttttttggcaaaggaaagaaaaaacatttttataaatcgcaagtttctctcaaattaacccccgaaaaatatcccaattcgggaactggggatcccgagtatccctaccgtttttccaatttcagttttggcatctttgttctgattttcctcattggcattgattatttgtttgccttctttgctgttagtgtcggacatttgcttaaatatggttagaacccatttacaaaaaattggctattcctgtataaaattgtttaaaaatttcagctaaattttccactgatagcgtctcgtcaggctctatctttctacaaaacttaaataaaattcgagcatccatacagtatttccaatttccatttttgtctcttcctgctgatgcttttcctcatttgcagtgtctcgtttgtctttgatgattatgttatcatttcaaaaaaactgtttttacctgcatctgaagaaggctcgtcaatgttttttggcactttgccagtgccatttgcgcattcaaagcacagccaaataatggcaataaaaagggtaaaaaataaggagcgattcgtcattttgttgaaattacaaagtgatatctctgatgaaaaataaattttaattggcaaaaaaagattcaattgaatttgctaggaaagttcaattttacgcttttcaaaattatttgctttttatgcgaattatggatgtaaaactttaaaaaatattaaaaagtgggagaaaaataataatatatgtcaatgaatatgaaatattagagaagctatttgaataataagaaaggccaaatcaatgaattttgctgcattttgttgaattttctctaattgactttcttcataaatatttgtaaatgctttcttcaaacaagcttttgatttatttttatttaatttattaataatttttatttatttttattaatcaataggtttagaaaccctttaataggtttaggttcagcccggcacccacccataacatttgatgttgtgtttctgagtatgcctataaatattaaataataaaatgttaatcgttgtattttgcatataataaaagacttcgaacttttatgaatttgagattaaaatttttagaatttttcaattttttttcaaaaaaaattttctttttgaaaattccggttggtcccggtcccgacttttctggtcccgataagtccctttcccggtttttgtcaaaattcccggtcccgtgcaaccctacactagactaattttttcctttccggtggatttataatagggttgggcccccgacgtcggggttggaaaattcggggttcggggttgtcggggttggaagcgtcgggggtcgcgttcggggttcggggtcggggttcggggtttttcaatttttgccttataccatatagtcaaaaaactttatattatttttttattcattaataatttatgtgcttttttatttcttaattattttagtatagaattaattaaaaacgcataaggcatttttaaaatggcaaattttcagtgaataaaaaatgtcaaaatttcaaatttttcctccggcgcctggcccccaaataaaaatagagggattttattcaaagaaatgccccaaaatttctgatcacctttctttttgtttttcaaattatcttttttc

SEQ ID NO: 19534 - DNA, 915 bp, Heterodera glycines
ggaaaaacgggaaaaaaccgggaatttcccggtcccggtcaaaactggtcgaaaccgggaccttgatactcagttgtccgtgttttggtcccggtccaggcgcactctagaatagatcaatccacgccataaaaatatttaaaaatttcaagaaaaatattaaaaaaatttagagcttttttttaaacctacatagatgatactaaaaacaaaatttgtgaatctccagaaaaaaaaacaaaaaacttaaatttttcttaataattactattttcggccctttcttttggcactttcgccgcctttacgcttctctttttgttcagaaattgttggctaaccaccggggccaaagcccgatttttgaactcccatttatgttaagagaatgcaaaaggaaattattaatagcattattgattgtggtttaaaatttcattctttgcacttttaatttgatttcatttaataatttatttttccccaccttttagcttttgccagcacacaaattaattctgaactcagcttccgatgtttttgaggcaatgttccgttttgactcccaaaataaaaaaggggaaaatggtatgacaaatgaatttaatgaaattaagaaaaaaatttcccaaatattagctccctctaataagcccgtggaggtcactgatatcggagttgatgcgttcaagacaatgttggactttatttattccgatgatttgagtggactgaacggagacaatgcaatcaaagtgttttacgctggtaaattttgtggaataaaagtttatttaattaattaattatttatctagcaaaaaagtataacattccgggcttgttcactccgtgtttgcaagttccaattccaaagttgcacaatgttttcctcgcttatgcccaggctcgtct

SEQ ID NO: 19535 - DNA, 1528 bp, Heterodera glycines
atagaacattttttatatttttttactttatttaaattaattaataaaaaatatttcatcttaaaaattattattttgtctttcttaaacagcctaaaaccgcaaatttaccaaaatatcggtgggggggggggggtaaatttcttacagaaagacaaaaaaatccgaatgaatggcttaaagacatttttccagcgggcccagaaccgtcgctgtctgtgatcagaaaaagttttggaaaaggaatccaaaataaaaaaatttttacttttcaatttcatggaaaattcccccctcctaatttgaaataaaatgcggtgagttaattttagctcaatttgataaggtagatttgtgagaacttaaatcttaaatataattttttattttaattttagaatttttaatttcaggcagtttaaaaaaatttaaaaaaaaattataaaattatataacaaatatttttggtatttatttattcttataaaagtttttttttgttgaagaaaaactattatttaattgaataaaattaatttaaatggaaaatttgatgcctcaatggtggccaatgagtaacggttgaattggtcaaaaattcgatgcataaaattgtgggcctgcggatcgccccaattgttttctcgcgcatcaattcgtttcgcgtgttccatcagttcagttcctaattaaatatttaaataaattatttttatattagagaaagttatttattatttttttcgaaatttaaaattgtcaaaataattagaaatgtgtgattttaaaaaaatgttttccagcctattttataagatgtggattatgcaaaacatattttattgaaatgttttcagaataaaacatttcttcaaaaaaattttttttttttaaatgggcgacttttttcggaaaagctattaactgggaaaacttttttttggttagaacaaaaaaaaaaactcttcgtttcgagagaatttttttttctcaccaatttcaaaatcggcattttgattgcgaaaacagttgtgccggattagcacattgctggacgagaccaccaacgctgcatatggtgttgaacacggtttcaagaatgggaatgggttcagcaccgtgttgccgcgtaccgaaaagaatgaaacttttaaaaaataaatttaaaaaataaattatttttttttaaattaaataattcatttgtcaattaggaaaagatagagaaaaaaatgagtaagatttaattttaaatagttctaattaatgaaagtaaatttagaataataaaaataagagattaaacttagattaacattaggaaaaaattatcataaaaattaaaaaataaatgtttaataaaataattaatttaattattagtgaaaatggaacaaataaggttttgaattttaaatcattttaattaagaaaaggggaaatttagaataataattaaaaaaataaataaattaccctctcttaaagaaaataatatattacaaaacatctaaaaaatgataaaaat

SEQ ID NO: 19536 - DNA, 1073 bp, Heterodera glycines
aaataaaaatcgaaaatagataaattgtttattcaaaattacagtaatattttaacttatgaaatttaaatattaaaaaatatttctagttttatgaaatttaattaaggcattaattacatattggccagtaaaaagaataattatgtatccacaaatcatcacttatttcattaaaaaatagaaaaaaagagtaaaataacttcaaacagcttacctctgaaaataagttttgattcataagtatataagtataagtgaaaaagctaatgtaattaaacatttaggaaaattaaataaatcaaattcgaatttataatgaaatttcaatttcatattgagaatgagtaaaacattttccataattttaataaaatataattaaaactaattcttttaaatattggaaaacatttatatgaattttaaaaatatttataaaaattataaagtcaatgttttaaaaaatagaaatgattgactactttatcctaaaatagaaaagaaaatttaggaaaacacatcgatcatggaataaagaaacagggaaccatttcagagaggttcttgttgacttgtcaaccattttaattattttccgaaaaatagcataatgatacgaataaatatatgaattatcacaaaaaaaatttaaaaactcaagtccaatcaaagttttaattataaaaatctgctaaatttttcgcttgtttactaatgctgatgcggctcgtgctcagtcagtgattaaggtgcgcataagaaatcgatgatgataataaaatacaaccaaaaaaaaaaaaaaatcaattttagtttaaaaatgaaaataagagagggaaaaataataaattcattctatttaaaataagtttaagttttattggaaaaaattattatatttttacaaattaaaaataatgcatagatactaggcctaaattttatgtaaatatatattttttcctatattcttatggacaatagtaggaaaaaaacacaaaaattcattaattgttttactataagacaacacataaatatacgaatttaattaatcaattaattaatta

SEQ ID NO: 19537 - DNA, 2473 bp, Heterodera glycines
atttgccatccctcgacttaatcgggcaccatttttctgaaaatgaaattctcaactcccaaattgattgtacatacctatcagtcccgatcaatcacattatcagtcccgttttaggcgagcgccgatttgggcgatttcccgcccccaaccccactccattaaatccccaaacattctcccgtgatgatcaattccattcccccccccccccaaattccatttggtataccacaaaaccccacttaactcccccctccgcccgcattcttcactactgctgtggtgatggtaaaagtgcaataaaaacagggttgccattcgtccttgaatggcaaggacttccttgaaattgggccctctttcttgaaaataaaaaatgtccttggatgccaaggacgtccttgaaaatgaacatttagaaaagttttaaaaaaatcaaagaaatttgagaaatctttgtaattttcaacaatattttgattaaattatggcattatgtcatttaaaaatgtaatttttgagaatttttgaaattttatggcattaagtcactagtcactatttttcttaaaaaattagccaaaaatcgcaagttttggtcatttttggacaaaaatctgtaaataactcgcattaaaaattacaaatttttccggacccccctatcctcaaaaaattttttaaaaagcacgccgtaaaaaacccattttataaacaaaaaaagtcgttgcatggcttaaaatcgcaaaaattaggcagtttttggtgaaaatctgttaacaaattgcattcaaattttcaaaatttttccccggcggcgcctgtcggcaccgccagaccccccccccccccttttcccggaaatttttggaaaaagcgcgccgcaaaaaagcgtttttaaagcagaaaaaagtcgtcgtaaatgaagaaaatgataagtgaaaacaaaaaaatgttggaaaaaatccattccggtgaaaaatacaagccatttgaataaatattaaccattttgcattgcatataataaaaattttaaatgtccttggatttcatgaattttccccactatgtccttgcaaatcggcatacccgtccttggaaacggagcatggacgatggcaaccctgaataaaaactaaacatacaaccctaagaatcgtaacatatgtaagtgatttcatcagtgataattagggctgtcaaaaatatgtacaaaaaatgttaaaattttggtatctcctttttgaaaaaaacccgatttttaggggtacatacatattcaaaaaattttatttttttcacaagaatttttataaattttcaaaatttctcaaaaaaattagaaaaaatgataaaaagtccaaaatatgtaccaaatatgtataaaaaccccgaaatatgtaaataggtatgtctaaaaatctcttcctactatttagaacatggagaagccaggaaaaaatatgtatactagtgataataattacttttttacaaaaaacttttaatattacataaagaaaatatttttttttataccaacaaaaaataataattaattatactgaaaaagtatcgcaacaataatataatttaaattaaaaaaaattcaaacttaattgactctaaaaaaatacgcccaaagaaacgaggcagagaagaaagcgattaaacttgtgagtgaacatgattatattcaacaacatttactttaaaacacattcataatctagaactttgaatattttgggattaaaaaaaatgtgaagaaattaaaaagatgattaaaaaattagttgaaaaatattagatttcaattatcattgaaattttcaagaataatttgttaaattaattaaattatttagtgtaattaaacttgaaaataataatttttagcgttccattggccgcaatgtccgaggcgcaaatgtcatataaccgttaatagggcttatatttatatttgctaaaaactttcaaatttaggatgtaaaatgacaaaatttattcaaaaaggtgaaaaattagaccaaatcaatattgagctaaataatttgtaaatcataaattcttgtcaagaataaataaataaattttggtgattgaattttgagaaaattttcatttgttagggggtgcatttttggaaattttgggtcgattcttaaaaaccacctctccacacattgaaaattaaacatttttatagaaaaaattaaaaaaaattattcactcaaaaaatataatttatttttaaatacataaaaattatattttatgattaatgaaccaaaagttatagaattaaaattttttaaaataattttaacataaaaaacaattacaatttttaagtggattaaaaatattataatttatgaagaattatctattttactataaatgaataatataattaaaagttaattaaatatagttaattttatgcattaaattaataatt

SEQ ID NO: 19538 - DNA, 2628 bp, Heterodera glycines
tatacagattcgagatggtatatacaaaaaggtgtattcttcgagagcttattttccttaatatgaatattaaagattgtattcatgcatattcataaaaagtgcattagtcgggtgatttattcataaatgcgcatattcgaaaaggcatacaaaaatatattcataaaagtgcatattcgagagggcatatttcagaaaaaaataaattctgtgtcaggtgctattttcacaaaaaagaaaattcgtctggttaccaaaagggcatattcgagaaatattaaagcaatttaattttctgtaaattctcattttcataaatttttcaaataaggaaaatgaataacaaatcctttgcttttttgcttttatattcacattaatgcatctaaaagatgctgaaatgttttaaagtaatgttaaatttaataaatttttaatttttttctggttacgcaatttccattccttttagaccattgtaaattttccatttttaggaatgtatttttcgaaaaaagcattagctcgctgcttcttcctacggttgttttaaattttaaacatgctaaattgtgtcaaagtcctttttttaattagggttccaaattttgttatcacttagcgtggcatcggcatgcctgtcactttgttaaggcgcttttacccgcccgacccgcttaacaatgccaaacagaaaccaaattcattattgataccccttttgccgtcttaccgtgaccggaaaatgtgccagttgaaaatgtgtcattgatacaaataagttaaaagaaagttctgtagcattaagtattgtaatataaaagtaaaattctataataacattgttctaaattccgaaccccggacccgaaatcgaaaaaaagtcgaaagtctaaatatccgaaattgaatttttggtccaaaatcgatttaaacacatggaacacatggaagtaaactgaaaggccatcaatcaatccttcaatatgaaaacatttacgcattttttaaaccaaaaactcaaaatttaataatttggattatcgacttttttgttcgaattcgggtccgtggttcggaattggcagaaatggataccggatttgtggtcagtgacctccaaagcccaaggatttgtttttttatcacactaaaatttcattgacgcattttcctggaaccgtctgtacaatgtgatatgaaagacagagcccattgggcctggcgcagagtgggccaactgcttatatgttagacaaatttaacaaaatgtataataacaattttttatgttggccaaatccaagaataaatggtttcattcatgtaataatatattcctttgtgaaggcctattcataaaaatatacattaatccatgttattcgaaagggaattttcgtaaaatttaaatgcacataatttgtataaatcgttcttttttattaaaatttgaaggtaagaaaaatgcgcaaaaaattcttcgcttttacaatttttctgttcatcgttttgcaattaacggatgctgaaatgtcaaacggtaatgttgtttttaacaattaaatgaataagcattaataatctttttacgaaaatggctttaattaaaatgaaaatttttcaaatttttccgaattttataaccgttataatcggacattcacttgatccatttttcataaattttactgtatttccactggagttttttgattggaattataaaaacaaaattttatttgcttttcatggatttcaaaaaatttatgtcgtaatttggtatgttcaagattcaaaattaacattttgttcaattttcaaaatctcttccattttgaaagtatttgatatgtttagagaagaaatatatttttattaattaaaatttttatttcaatttcagaatacaaagaagcgtgcaatgacacatgtgctgctttaccaaagcagacttgcggtcgtggaaggccacaaagtaacagtaactcacagataacttgctactgtaaatggaagaccagcggatgctgtttcggagaagggtgtgtaccacgtgaacaaaccgcagatgaaattacgctttacggtcgcaccggaatatgaagaaaacaacagcagaagcaacaggcaaagaaacctgaacacttccactgaccaagatgatattttgacattttcggaatgcaaaatttgttgcgatgttatgccatttatgttacatttgttagcggataaaaattgttgtcttaaccagtaaaagaattcgaaagcgagcgaatatggatgaaattatgcgggcacaaaagtttataaacttgggatcaggttcaggatcaatacattgtactcggatttaaatacactggtctattccgtttatcagactcatagaaaattcggacaaaattcgaacctgttcgggttctctagaaaaattttttacttcttggaagagctgtgattttattttgtttatttcttattgattatgcttaaaaaattcattgaataattgataatgtcatatattaattggtgagaaacaacaaatgaacggttaaatggtaacgcaaaacggaaaacaggtgagtcattctttgaaagcatactaaacaacataaa

SEQ ID NO: 19539 - DNA, 1249 bp, Heterodera glycines
  misc_feature (67)..(67): n is a, c, g, or t
  misc_feature (1050)..(1051): n is a, c, g, or t
  misc_feature (1107)..(1107): n is a, c, g, or t
  misc_feature (1109)..(1109): n is a, c, g, or t
  misc_feature (1116)..(1116): n is a, c, g, or t
  misc_feature (1122)..(1122): n is a, c, g, or t
gcactgtgctggcgactgtgcctgcagcagaacaaaaactgtggcacatcgtgccaaatgaactgtntagcaattatggacagccacagacagaagcgattgatgtggcgtgatcattttgtgctaatgatgccaaaaaggcataaaaatttgacatttggcatgagaagaagtcaaatttggcaaaaatttaactggccaattcggaaaaagcgcaaaacaaaatattcgtcttcatcttcaacaacgacgacaacacaaattaacggtgctgctcgagcaaattttaaagagcaacggcactttttgagcggaaaacagccgatcagatcggtttggaggcgggcgaaagttgcacttggcatggaagtgagtgaacaaatcaattttaactactttttttaatgttttaattaacttggaattatttttttaaattttttaccagttttgggaataataatataaaaacggatttatttaagcgcaatagtgaagtgttggtgaaacagttacacgtaaggacgacagcgggtgtttttgttgcgattcgacgcccaattcgcccgcctccgccgccgccaattttcgccgacaaatttccccatgcttttacctatgccggtggaaggtgggtgatgggaggcactgttaaaataccaaaaaattttgaagattttaaattatgctttttctgtgtacctattagcaagggtgtctggcaactccaaagtaaaatgtgaacccgaaattccggaaatgggtcatttgggtgccaatgttttggcaacaaactaaaaatttaaaaataaattaaaaaaaacacaaatagcagcattcatatttaaaaataaaaaatatataaaaggaaaatataattcttcttttctcaatttttaacaaaagatttcaaagggcaattcttcgagaattttgtgcaatttctgataggcctactcattttttgctgaaaattttcccaaaactaagtattttttggaaaacttttaaaatttatgccattttttggggatggcccgatcaagtatnnatgatcaagtgggtggtaaaatgtttttctgatcagcatcaaaagttatcttattngntagcagntatctnctctgttttagtgactaaccaccaaaagggggggtgaagtttgagaaaattatttttagccaaatattcttttacagaagaaatgatagtaacattagaaagcacattttaaatgctacaaaaagcc

SEQ ID NO: 19540 - DNA, 1095 bp, Heterodera glycines
agcagcaaggaggagcggagatgaaaaagcaagaacagcgggaatcatcagcagatgaggacgaatgggacagcgattaaacagaaaaatttcgatggatggaggagtaattaagcaaaaacaatcggggctaattagcccaattgagtgccctgaactcattcacttcgcaatggccaagtcgttttaactgtcttcaaatcagagaatccttcctaatgctattttgccttccttgtcactttttgttgttcaattctccgccgattacccaaatgtccttcgaaacgatcgcaattaatgctcaaatcaattttattgcatcagaaattgttcgagtgtttgtttatgcaattgtcaatcatttcgttgaactgctggtcaagtccatatttatgtatttattcattgacgcacaaaacataaatttttggcgtttattgttgaaaattggaagaaacagaataaacaaacattgaaattaatgtcaattagttttttaattgttacaaacattgaaaagggtaaaatgtcatggcgctgttagatttcgccagtgagtgatttcgccagttggatttcgccagtgagtgatttcgccagtgagtgatttcgccagtgaactatttttctttttctcgccgtctgtatttgatttcgccagtaattgaactcgccggtgattgttttccccagataaggcaaaattcaacccatggacaaattttaactatagaaataaacaaataaagggggaaaggtcagcaattggtcatctcgagacgagaacaaacaaatttgcttcgccaatctatttgatactgcgcctaatcagtttctccaatttgttggtcagcggtgtgtgtgttccaaatgtcatcttatcgcaattcacaagaaaaaatttggggttttggctctcgttccttggtcacttttttgaattccgtcttgcgaaccaaaacaacaatttcttcttattttctatggcattgcttcgttttgatcaaacaaaatcgacacggggaaaaattttgctaacaaatggaggatacgaatatgtttttgaggttggaaatttctaataaaagaaga

SEQ ID NO: 19541 - DNA, 1810 bp, Heterodera glycines
  misc_feature (1643)..(1644): n is a, c, g, or t
  misc_feature (1693)..(1693): n is a, c, g, or t
gttgttaatttaaaatgtgaacaaagaatgtttaaagctatttcaattaatgttaacaattgatcggcatttgcacgttttaaaatttctctcctttttttcatcgatttggttttggcaagtaaacgaataaaatcaaaatttttatgtactattgctccaattttacaaaaggccattttttggaatgaaaatgatcttttttccttcttcttcatcgtctttaaatatcccactccttagtcgcaacagggggttagaagcagcgtgcatatcaacgaggagataaccatacggtttattggtcgcaatacggtaggccgaaaggaaataatccaatttccctggaaaaagttgaactccaatgttccgaatcgccaatgcggaatttggagctcgcattaacaccaaatattggacattttgtctcgcaactttaattcttcgtttaaacaaattttgggtgacaaaaacaactgcaaaattcaattctgatggtgagactttttggtgaatagagcactaagatatgattcatcgatcgaaagcaaaagatcgtcaagaataaacaataatggttttggtagacggttaatcaaatcctcagggggcactcccgggtacacattcacaccgcatttttggagtgtttccataaacaaataaagcaatccaatgtgatccaggaaattgatgtgggtccaaattgaataaacaataatggttttggtagacggttaatcaaatcctcagggggcactcccgggtacacattcacaccgcatttttggagtgttggaacaatacttgacatttcaccaaatgcataaagcagtgaagcaggtctagaactaattaactccgaagattcagcaataaatcttattaaaaatgtgcttttcccactccctgatggtccggcgataatcatgccaaaaggcatttttaatttaatttctttattggaataaaattgattaccaatcatattgaattttaacacaacacaacgaatttaataacttaaatagttttttttattctttacgactaattgacgcaatggctgctgcttcttcatcttctgcttccttcttcccctttttcttcggcaaattctggaatgtctttcttttgttggtttgagtttggttcgtctttcttctgttcaccactcattcccatcgtcgctgcagaaatcggtgaaaagaaatcggaggcttttggctggtgctgtcttggttttggtttgggcttgaggtggtccccactaattcccatagtagctgcagaaatcggagaaaagaaatccgaagcgcttggcaagtgttgtcttagtttcggtttgggcttcaggtggtcgccactaattcccatagtagctgccgaaatcggagaaaagaaatcggaggcattactctgcggttgtggaagcgcttttttcaccttgttttcgtcgacttccattcccgttgttgctgccgtaagagcatcaaaaaattcatttgcttctccatgcttcttttgaggaacatccaatcctgtagtagctgccgtgatagactcaaaaaatttttggtgtagtttgctcttccgttcctcgctcatttccctttggctttagttgaggcggaggcggtggnnggcggtaaatgtagaatggagtctcggtctgagtacaacattggagcgnaaaccgtggtcgacattaaaactccaccctttgtacgacatgaatattatttttaagaaaggcatataatatttaaaaaccttaaaaatgtatagcccggcactcataacatagtca

SEQ ID NO: 19542 - DNA, 2348 bp, Heterodera glycines
aattcagattttgaatcccccattcctgaattttgtataaaatttgatccaaatgctcattgtgtttttccaatgttgggctgacaatgatcagatcatccaaatatgccaatgcgaatggcagatatgacaacatgttgtccattattgactgaaatatgccaggggctgatttgacgcagaagggaagacgttcgtattggtaatgcacgcggagtgtagcaatagtgcacagcttcttcgaattttcttctaattcaatttgaagatacgcatccgacaaatcaatctttgtgaaatattttccaccatttaatgtgacaaaaatgtcggatggaagcggaagcgggtgctgattcaattggagcgaatcattaagcccggtggaaaaatctgcttccattcctgttgttgctgccgtaagagcatcaaaaaattcatttgcttctccatgcttcttttgaggaacatccaatcctgtagtagctgccgtgatagactcaaaaaatttttgtgtagtttgctcttccgttccttgctcatttccctttggctttagttgaggcggaggcggtgggggcggtaaattgtagacgggagtctcggtctgagtacaaacattggagcggaaaccgtggtcgacattaaaaactcgacctttgttacgaatctgaatattattttaaagaaaaggcatataatattttaaaaccttgaaaaatgtatagcccggcaactcataaacatagtcaaatggcacgaatcgaggactaattttgaaacgagaacaccaaattgttactccttcttttgaaatgcaccattccgtctcgcactcagtggccttgcactctcgacacttgccaacgatgtcaaatggaattgttcgaggcaccgcaatcctctcgctgatcagtgtaatgccattggtcgtatgactgatctctacagccggcaaaatgttgtccatgataaattttttatcgttataattaatgctcattttttagatgaatgagtttgaccataaatttcgacttttatataccttcccccatcccatggccattaccccgtctttattctctacagatattttctccatattataaaatggtccctcatgtttgttgttcttgagtgatggaccaagccaactaaaagtaggtcattgctcgagaacgtaaacattatggatgatatcattccagcgtcattcttatttgtttttcctctcttttctaccttttttttcttaatttagcgatggcacgacaaatgaaccttcctctgtttaaacgccccaaaccgactgtaagacattttcacgttggccaggtacataatattttaatattttttcaatctttagtttttttaatatttcagttgattctttttgaaaccaaacattcagcaacggggatttggtgtgccgttttgctggtgatgttttttctagtgtggttcctctggtgagtttaagcattcattttatttaaacattttatatttattttattttaaagatggtcaatggaacggatgtaccctggcacttcgtcaatgaaacgaaggacggatgaggatggtaaacaaaaattttgataaattatccgccaatttatcttctgcttatcgataataaataaataaagaaattttccatatttatgaaaattaaaatacaaaatttttatataaaattttgaagtaaataaattttaaatgaattattgtttgtagttgttcctaataaaataactaatttttaccccaaaatattttattgatcagagaaaaaattaaaataaaatttgaaaaatttaaaattaatcattatttaaaataaaaataattaatcctctttaagtttaatcaattcatttccattttctccaaaaatctctttctctgttcgatcctcgccccattttactaacggacaaagtcatcagaggcctgcaaaaaaaataaattcataaatggtttcgcttaattcattactaccttacctttcgggctaaagcgcaccgaacgcccacctccgacgcgcataggactttctgtcgtgcgaccagcgctaaaatttttaaaattcacttaaacaatgcacggtgcgtactgtaattttaaaaatctaccatattcttcacgctgaacacagcaagcggacgcccaacctcctcctcgccgatgcggacaggcgggcgcgggcgagagcgtcgagcaggcggagtccccgagcgagggcgaggagcagcgggagtgccttgacggaccctcattttcatgaaaatgagccagaaaatggccacctttgaaaaaaagaataaatcaaaaattgg

SEQ ID NO: 19543 - DNA, 2372 bp, Heterodera glycines
  misc_feature (41)..(41): n is a, c, g, or t
  misc_feature (2251)..(2251): n is a, c, g, or t
aagacgaccaacgaaaaacgtggccgaaattgcacctttcncaagcgggtctctgctcagcccgtcgtcgccgcctcttccgctgccattggcacttccgccgcaaatgcgcccaatttggaaaggaaataaaaacatggaaattggggcggagagagaagggaaatgcgaacggagcaacaaaaagattggattattattttgttttccctgttgctcttaattgtatggacacacacaaattgttgctgtttttattttgtttcgttgttggacggaccgacgtcggtcctccagcctaattataattaatggtgttgaaattacataattacgtacatatatttatattgttttataccataatttacacggttattaaattccgtcgtttcgtcctctgacttttgttggtgactcggccaatttctgtaattcctttcattctttctcatccgtttgtttttggtgtacattttcacatcctttcccatcgtttagctttgattcactttttcgttcattccatcgcttttagtggcgttggatgggtgtgggtgattcttccaacaattccaagccctcccccccccccctcagtcattccgttattctgtcaaatccacgtgttcagctgcgtgcggaataataaatgaatggcggcggggcattgacttttcaccaaatttcaggacacaatttgccattttcttacacattacaaaagcgaaccttttaaaataggcctaaaaaattttaaaatcagttttttggcaaaatgccgtcgtcggctgtccaacaacagcccaagtcgctggtgcaacaatactcccaaattgtcgccgccgtttcttcctattgggtctgctccattggccttgtgttcctcaacaaacacttgctgagcagtcccgatctgaaggtgccgtaggtgtcactgactgatcaatctgtgccattggccatgtgtgttctttctatctggtcacttttttgatcgggtattatcggtgccgttctgtctgatcactttccttgatcgggtgaacatgatcggtgccattgccatgtgccgttctctctgatattttttgacctggtgatcatcgatgccattcggcatgtgccgctctgtcctccgatcactttcgatcgttctcccgtttacctcaatatgcctctttctgtccgttcagttgaatgcgcctctgttcgtcacgtggtatcagtgtctgacttcgctggatttctgtctgttctgctctctcctctccaaatggttccctcgtctgatcaatttccccgacatgtctcttgaccttcgcttgtcccgggaagtccgttcgtccccttttttctgtcttcccaatgatcattgattttccttaaggttttgcctttgtccatcgttttcgtcgcaatgatcagtttcaacaatttgtgcctcaaatatgtcggcgtgtctttttattatgtaggacggtctctatctacagtgtttaatgtggtaagtaagcactctttatttttgctataaataaacgaaataattcctgtgcaatgtgagcaccgttggttcaatggtagaatgctcgcttcccaagcgagtgacgcgggttcgattcccgcacggtgcatcaactttttttccatttaaataattatttttatttttactaatttcccagatttgttcctacctcattctcggccagtccacctccaaaccggctttactctgttgtatgatgattattgccggcttttttctcggagttgaccaagaagatgtcgcgggtgaattcttcaccattttgtgctaaaattgtttacccaaacttttcctaattgcttttcgttaattggacatatttaattagcgtcccaaattcgttataattggcacatatgtctttaagactccggtgcctttttcccccttcgaatgcgcttttaaatgcccaatttcccctccctcccccaggcactctgtccgtcattggcgtcgtctatggcgttttggcgtccctttgcgttgcgctgaatgccattttcaccaagaaaacgctgcccaccgtcgctgactccatctggcggttgacaatgtacaacaacttgaacgcgtgccttctcttccttccgctgatgcttgttgccggcgaatttggcgaagtgccctactcgccgcacattgtcaagctgaacttttggggcatgatgacattgagcggcttctttggcttcatcatgngctatgtgaccggtgggcaccagtgccgttgtcattcaatggcaaaccaaaatggctaaacagaagcattcaggatggcaatccaagtgactcggcctgacgcacacatcagcggcacgca

SEQ ID NO: 19544 - DNA, 823 bp, Heterodera glycines
cgaatttttgaagtgaattaacaaatgtttaacggggcggtgacgcaacccatgggaagaacggcaattcaaaatcggagagtgtcgattagcattaattaatcataattaattcattggcacatcccccccccccccccgtttttgattggttcgatttccatgctcatttatgtatttgttcagcctgctttgaccattgcaataattgtgtgatttttgattttttgtttttattttctattcattttgcccgccctttgactgttttatttggatatttttaaatttattaaatgataatgtgattgaatcatctcattccattttgggtcatcgcatttttgttttcgactcattttctcgcactttgtgtgccaatccaactttctgtgtgttttttctttcgcgcgccgtccttccattttttggcgacttttttcgccgtcgtcatttttcggagcagaaaattgtgtttgtttaacactaaaaccaaatccgcatcatttaatgtgaaaatggcaatcaaaatttggcgcgggacactaaacgggggggggggggggacggaggagggaattcattcgatgggcggacggacgacgaaacgccgccgccgcacctttgcccatggaaaagcatctgggcctcaattttatgcacaaagcatggtcaatgtagttcagttctaatcgcttttgacccgttcatttttatttttgaaaaatgccaatcattcgccatgaagcataatttggccatagactggtgaatgattgccaagatgactcccattgtccccccgatgaaaaatgatacaaaa

SEQ ID NO: 19545 - DNA, 1086 bp, Heterodera glycines
cttctctctctctccctctaacttttctccttctccctctctctatcgcgcgttttctcttttctctttctctgtttctcgatatctctttctctcggtatctctctctcttcctctctctccccctctctcttctttcacttaacttctctctctctcattttatttttcttctcctctccctttctctgtgtctatccgtccctctttatctctgtatcataattcctctctctctttttccctctcttatctccccctcttttttcttttctccctttttcttttttcttttctctctctctctctctctctccccctctccctctcacttttctccttctccctctctctatcgcgcgttttttctttttttattctctgtatttctctgtatctctctctctttctcactctctctcttcctctctctcttttactctctctctctcttttactctttcttacctctgtctctctctcttcttctcttctcttatcttttctctctgtcctgcttctcctcttttctctccctctctctctcctcttctctctctttcttctctttctctctctgtttttttcaatccattattttttatactcataaaagcatattttaaattaataaatttaattcaaattcattaaggaaaaataaaaattacattttaggaaaaagcaaaatatattgtaaataaattcataaacattattatttgttaaaaaattttctttctgtcattttctattttttttgcaagtttcgtgtcaaaaaaaaagtcaagtttaaaatgatacgtacggacagcaccaaattagtatagtgggtatttgataaaagaaaaatcaaacaaaaaggaagaaattatataagaaaagaatggaggaaaaaattgaaataagacaaatgaaattaaagaattaaggcttaaccaataaaaattttacaaatccaaaagtaatgaaaaattctaattgttcaaaaatttattggaaagaaaaatgaatataagcaaaaaggaataaaatattccaaaaaaaatgacgaaaaattatgaagaaatttgcaagaaaatcgga

SEQ ID NO: 19546 - DNA, 1010 bp, Heterodera glycines
  misc_feature (36)..(36): n is a, c, g, or t
taggtccacgctgatgacttttgctcggaggcgtanaattggatcgcaataattacgactatcagagtgaaaattggcaacatcagagacgaattggccatcattcaagataaattatataattttcgtatttaattgtgagcaatgatttaaatttgcaaaaagattccgtttaaatagaaaaaatttgtaaagaattgtgaaatattttgggaacgggattagcattgggctgactaatctgtgctgcatttaatcacatcattagtaattcttaatctattttgtttggcgttgtgaaactcgtttttacgaattttaattttccgtcaaccataaattatttttggttaaatggcggcggaaaatgcttgcacataaaattgactgtacaaacattttttgcattatttctgtcatgttgcatatttgctagttttttgagaaaatttgttgatttatgtaatttttttaaaaaattctcttaaatggccattttaagtaaactattatcaaaaattcccaaaatttcaaatttgtggcaataggtatgttgttttttctatctgtgactttttcattcattcaaaattttattgcttctgttgtatattatgtaattaatttctccattttcagtacatctatgacctcgaagatcaaacattttttttaatgaaattcattaaaattccaaattttttgcggcggcgccgcggttcctaaaaagttagtttttttggaagaagcgcaactcaaaaaacatctttatagattttttaaatttggattttcccaaattgctgatttttgaccccaaacgctgattttaaaaattttgatttgggagccctgcataaaatagcaaaaatcatgcatttctaatttaaataaatatgaaatacaaaggaaatttaatttaatttttccccacaattggaaaaatctgtcatttttcactagcgctgaaacaaataatgaaaagacagaacaattcgcgaagaaaataa

SEQ ID NO: 19547 - DNA, 782 bp, Heterodera glycines
atacacatacatacaaatgaatatacacatacgataatatacacatacatacatatacaacaacaattatacacatatatacaacaatgtttatcctctcatttccgtagtgcgacatttgcgggcttgaaatcttcttcaaatttcaaaaatttcgactttttgcaattttcatgtatgacttgaaaaatgccggtaatcctgtattttattggtcccataaaaaaagagattaaaaagttgtttttatgcatttcggagtaatactcgggggttttcgggggcgctgatcacgaatatgatatcaattttgacctatttcgaatcccgaacccgaattcgaacacaagtcggaaattaatttttcaccaaaattcacatgtattgtccaaaatcgattcaaattcactaaatggccttgaatctttattttctattatattccgttcatttgaataagtttgggacaataaatgtgattcttggtgaaaaattaattttctccttttgttcgatttcgggtccggagttcggcatagataaaactgaagttagattcgtgattagcgaccccgaaaaaccctaggaaatgcgtttcaacaattttttaaaaattttttataaaaaaatgttcgaattcgggttcgggattcgaaataggttaaaattaatgtcacattcgtgatcagagcccccgaaaacccccgggtactactccgaattgcataaaaacaactttaatctctttttttatgggaccaataaaatacaggattatcaaa

SEQ ID NO: 19548 - DNA, 1063 bp, Heterodera glycines
agaaaaaatcactatctcttcttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatatttatttctccggcctaatccagaaaaaatcactatctctttttttggaatattttacgtctcaaacgggtgtgcatttaag

SEQ ID NO: 19549 - DNA, 1357 bp, Heterodera glycines
  misc_feature (957)..(957): n is a, c, g, or t
  misc_feature (977)..(977): n is a, c, g, or t
  misc_feature (1024)..(1024): n is a, c, g, or t
  misc_feature (1047)..(1047): n is a, c, g, or t
  misc_feature (1063)..(1063): n is a, c, g, or t
  misc_feature (1077)..(1077): n is a, c, g, or t
  misc_feature (1095)..(1095): n is a, c, g, or t
  misc_feature (1119)..(1119): n is a, c, g, or t
  misc_feature (1131)..(1131): n is a, c, g, or t
  misc_feature (1142)..(1142): n is a, c, g, or t
  misc_feature (1208)..(1208): n is a, c, g, or t
  misc_feature (1232)..(1233): n is a, c, g, or t
  misc_feature (1246)..(1246): n is a, c, g, or t
  misc_feature (1261)..(1262): n is a, c, g, or t
  misc_feature (1279)..(1279): n is a, c, g, or t
  misc_feature (1284)..(1285): n is a, c, g, or t
  misc_feature (1300)..(1301): n is a, c, g, or t
  misc_feature (1336)..(1336): n is a, c, g, or t
  misc_feature (1341)..(1341): n is a, c, g, or t
  misc_feature (1343)..(1344): n is a, c, g, or t
agctgatcaagagctttcgaatgataccaaatttgtccgaatttgaccgtcttaaaggttcagaggtcccccttttcactcaatttttcgagttttgaaccggttcaaaaagcggttttttggcatttccgcaactcgacctatttttccatgcttagctccttgagacgaatcgattggtatatcatttgacccatttttcacggggcgttcactatagtttatccaaactgaaaattgctaaaattttcgaaaatattcctaaggggctgggaaaatttttttgggaaattgaataggcctctaaaaaagaggacaaaattctctatcggattgccttttataggttcagcaaatctgttcgttcatatttgcttttttgttaggccatattcttttggcataacaaaggaataaaattttattattgaaaaaaacaattttttgttaaaaaaaaatttgaagcaatatttttgaccgatattatatattaaaatattttcccactttcacttgcgtttccgtaagaccattttccttggccaatttgtcccgttgagaagcactcaaatatttgttggccacaaattcgcgctccaatctgtccaattgctcagccgagaattggaacctttctttcttttttggcggcacttcgacctcaaccgaaaagtttttggcatttttttgtacttatcttcactcacttcatcgcattccatcgcgtccatttggccaaggcaatcggtggcggacggattgaattcaaaaataaaatagaggggacctgaattttgaaataaaacctgggcgaggcccctggatttccgacatgaacattttgttcagggttcttgacggaaagtcctattttgggtactttcctgttttgaggccacacccaaaaatttaaatcaacaaaaaggaacgcgcaaaataaacaaggcaaggcgcgcngcgcgtaacactaatgaggnaggcataaatgcaacaatagcagataaattccgtcaaattgatcagnctgataagggaaatacaattganggaagacatattttgngaatgaatgtggtnggtgaaatgggatttggnccaaaactaagggcccaaaacacngataatttatgncatacacagcngagtggggaagcggcgggcttgtccgaatgcctaatttatgcggtgagaatgtgaattttgtgcgncccttttgttgattttttaaaatnnttttgggtgtaanctctcattaacaggnnaaggtaccaccaaatantgttnntctgttccgtttggnnggccggcttgggggggaaccgaataaattggacanccgcncnncggattttggaca

SEQ ID NO: 19550 - DNA, 1936 bp, Heterodera glycines
tagaaaagatcaggcattctataagcaaatgtccacgaaaaaccccacgaaaaaatgggcgataaaatggaaaataaaacttttttcattatgaatgaaatgatgcctttcttatgctgatgttaaaaataataataattattatttccattttatttacgcttataaacaaaataatgcagaataagataaaaaaaaatctttttggtccaactaaaatttttgtttatttatttgatattaaatagttgtccgattttatggggtctaatttaccggtagccctgggctttcgggtcaccatgtttattgtgtacatatgtatgtggtaactttcatgatttctgtgagaaaatgttggtcaaaatttgctgcccggaggcccgaaaatttttattaccgtaaattttgaattcccaccctcccttttacaatacaatctaaaatcactatgttttgcattaatttaattgagaaattccctaaggcataattgggcgtcgttttgtggcaccatttctttctctcctcctcctccgtctcattttcccccattattaatgccacaaaatgtgtgctgtgttctcttaactttttgactgtacttggaatggcttcacttattgggttgacctaaccccaaaaagcgttcattgacaatgagagaaacattttagggtgggacgccatccaacaacaaataaatgccaaagagaattggaaatggtacagtaagacaggtaggcttggacattgagagttgaaaaataattttcaacgatttttatttgttattttacaataatatgaagaaaaaaatttaagaggggtcagtgccaagcagtttttgttgttgcagcgtttttgagttttggcaccgcattcctatctaattcttgcattttatatcacgcaacatctatagtagggattggcatttaatcatttaaaatatttcaaaaatcaacaacaaaaaaatttcatttctcattaaacaaaaaggatacaaattaaattgaagaaattatacatatttaaaaatatatttttgagccgaaaatgcccggggcgaaagcggacggggccgaaatgcctctgctgatgactcggttgaggtcaaaccaataatttgcttaataactaacgcccattcccagcacagtccgagtgaggggtcagtcagtagagcacatttatatgtagtggttaataatggacgaaaatgagtcacattttgaatgatgatgaggaggaggagagaaggaattgtgtcacgaagcccctgcattaatttaaattagtaaaatattcgaaaatattttttttaaaatcgttaggatttttctagaactcaactaaaatattcatattgtttattttctattaccatttaaaataacaaaatttgaccaagtaagttttataaaaagttatgcccacaattacaaataaaaaaacttttattcatataatttttgaaatttttcatgccaacaagaacattaagggctcccgcatttgctgtaattgagcaatttgtttttttaataaagctaagggtcatgaaaccataaaaattcatgggtttatttgcatgatcacgcttcatggaccacccaataaaaaaactatttatttttaatttatagatttaaaaaaaattttccatgtcaacgaccgatcaccggggacaatttggtgccaaggaatgtttagtaagcgaacattttgtgtcagcttatttggccaaaatgcgaaagaataataaattggtctttgggaaattggccaataaaaaaatagaaaataaaaaattgcgtcattaaaactgtaaattaattttaattgtaaagaaacaatgccccaaaaaaaagcgacgtcaatttctacctgaacaaatagagcgattggatcaagaatatcaggctaacaatta

SEQ ID NO: 19551 - DNA, 2055 bp, Heterodera glycines
  misc_feature (1996)..(1997): n is a, c, g, or t
  misc_feature (2016)..(2016): n is a, c, g, or t
cgtatggaggttgttgactcagaatcggtgaaaatcaatttccggaaaaatttttccgcagacgttcgaaataacacgcttccgagttcagattcgtgatcagcgaccccgaaaacttatcaaaaaattgggttttaaaaataaaaaaaaatttatcggggcgtaccgcacaagtaccaattcgtcacttcctctcgggtcgtccccccccccccccccgttcaatttcagaaacttaaaaaaattcgaaaatttcacaaagaaaatttttgaaatttttcagtattttttcaaaaaaagttattaaaatttttattatttactttatctagaaaaaatatttctggaattttgtggcaattaaaaaacctcgagtttttacgaaacgacatcaccgcatttgactttgaagtacggcacagaagcgatcattttattggcatttgtagggaaaaattttaacgcttttaaattttgaaacattgactgactgacattcattttctatttgttatttttgcattcctcggtttttctgggatcgtttcacttttttcttaccgagaaaatttgttcaagtattaacctctgtttagtttcatttcttaatgtatgattggtttctctgctgcagtgattttttctttaattttcatttatcgcattttttggcataaaattgggcgaaaaatctttttgagctttaaaatgtgaaggacagcctttaaatatttctgagttttatttaaaattattatacaattgaaatttattcgcgtgattaatcataaagcgttgctgctactcagccaatgcaattggaaccgtacaattgaaagacgattccgttcaaattgcttaaatcttcctcatctttatgctgatccgtctccccaattgggcttcgcttcaacacccaatcattcacacagccaaattcgcgttcttttttcactgccagcttttcttgggttctttcattcaccacttcaaacggcacaattggtgccaatgcgcgaagttgaattttaataatgtaattggcagaagaggtggcacggagaaatgcctaatgaatcaaaggataaatgacacgtcacccattggccttttgcttctgcatgtaccggtcataaatgtacatgtgcaagccgtacgccgactcatccctcccccaatcctaagaaatgaaaaatttctcgaaaattcatctcaaaatttatttatttttcatgacaagaattttttgattttaacatatgtttctcaatactggtttggcttatttctgctgctatttgaataaaaatgttttcatttactccttaaatttcaggctttttagaattattttccatttttaatgactattttatggatttttagagcctaaagcctacctgttttgcaatttttagagcctaatatgtataaatcctagtcattagtcaaaaaactataaaataaaaaaactgcttataaacttgttcaaaggcaatttttgtccacgacaaaaatgtttactacggagattttgccgacctttttcaatttgttgatccattcgaagtttggtggtggtcctttgctataacaactcattccgcatgtcaatcgtttagggcgaccatcggtggacggaatgtgcaaccatttggacaacgctttgccaatttttccatctgtcccaccatcatcagcaaacatgtcggagaactgaccaccggcataaattgaactcagattgggattgaactgaattgttgatgaaatgaggcgaagcaaattgtcccgatattcgattttggaaaattccaaatggcgaatgtttggcgcaaaaatgggccaaatttgttgagccataacatcccaaatctgcttgtgtttagcagtttcgtcgatggaatgtattattgacaaatccaagttggtgcctcggtcaaaagcttgcttattggaacggagaaatgcgacgacactgtggtcgatgtactannagggatgcttttggcactnatgcacattaagcgtccatcgccactttctttggtcata

SEQ ID NO: 19552 - DNA, 1429 bp, Heterodera glycines
tagcgcgatagcgctttaaaacatcagactaatgcaattaatgttttaaaataacaaatgagggccatatattaccaagccacgcatgcacaccatagccaactgggcaccctagttatatatacgttagaatgataaggcaactcatcttcaaaaacaaaatctcgggaacggctaagcacaccgggctgaaattttgcaccaaggggtaactcgagacggggcatctgggaaaactataggttttccggtccaagggccaactgagtaccagcggctcgaaaactgactttgccgacagtctcagtgttacgaaattttttgcttttgctttcagagcttagcggaccccaaaaggcacaccccccaactgtgctctacaactttgccagcaaaagttttttgatcagaccaaaggcctggcctggaaaaatggcagaccgaggtcatctcattttggacacttcagtaccaggcgaataccgcgtccgggtttgatgcgagcgagggggcgccagcggactttttgtagagctttcgaagctctatctatccatctttaaaaattttaaaaattttcaaaaattttcgagctaggcctaaaattcggtttttcagtttttgaattttaggattttttaacgatttttccggggaaaacggagaccacttccaaaacatcgtttttcgagctctatcgattggtgatgtttttagaaaattttcgattttttcccggaaatagaaaatttttttggcctaagcgggacatttgagtcccgggcccataactcgtcaggggttggttttagccaaaaattgtcttagatcttttttgtagagcattttaaatgctatcgaatggtatactatatgaagggaaattttcaaaaattttcgagctaggccccctagaaattttcaaattttttttggtgggccaaaatgggggtgaaaaatttttttctggggtattttgaggtgctgagcacgaatatgacctttgttttttgtttcggaatttttggaattttttaaaaaattttgaaaattattcattgtttgggcctcgagaatttgaggtaatttttgaaaaatcataactaaacttaggcttgtccaattttcatagaataaagcaagaaaaattgagaaaaataaggacgattttatggactttaattggaatttctatctgtaaaattaaaaaagttattccagaaattctggaaattttcgaatttgcagaaaaaaattcagaactcggttctgaatacctattttcacaaattaaataatgaaaaaatccgcgattttttctctatttataaatttatttcatattttaacccttttttcaaaaaaggtataaattaaaaggatttcggaattgcgacaaaggggggagcacttggttttgaggggaaaa

SEQ ID NO: 19553 - DNA, 2559 bp, Heterodera glycines
agctaatagagaaatgatagggctatcgaatgataccaagaatgtttaattctgttgacttttacaaaagttgtggacagtttttggttgaaatttccatttgatggtttttatataacgacatagcaccctatgttttacatgtttaggtttgccccaattttcttcctaatcccttgtttttctcttttttattcatttatttatttggactacacccaatttgtttttgacccgattcattttgttacaccaactcattttttgattcaaatgtcaaaatcgaggcacaatcgatgaaattagccttttttgaatttggtttaacttaggaagcaatgcttttgaagttggttagcacatttttgttgtattttgtctgtttcaattaatttcgaaaattttttttttcgtatttttaattgttttcttttgttttcgtaaaattggagtcataattcgcgaaacatagtgttcatgtcatattaaaataaaaaatttcatcaaaaaagaggttgagagaaactcagaaatttcaatacataaatttgtcaattaaaactataaaaccacaaaaaccaaataaaaagcattcctaagttatagcttataggtcaaagaatatttaatttggtcgattcgactcaaaaagcgagtttgcccaaggcaagttggttttgccatttattcttctgatcattagatcccgcgttttgaggcaaatgctttttttttttttgctaacttgatatggccaaatacgcacgaaaaactagtttttagcgtgtttgaagcctttaacttgaaattggtgccatttttgctttttttgcaattttggtgtcgaattccggacacgtaatttttctgccttttttgacttttcatgccttttttaaatacggatctattcagtaaaccccccaagatattgatttatatagatagactaagaaccttcaccaaatcaaaaaagattaacgcacaaatgctaagtttaagcagccctttcttcatagcataagcacagaaatatgcaaatccacataaatttataactctattcctaaatgaatgttttttgcggttaaaagagcgtaaaaaccgagaagacccattctcgcttctataaaaaatttcttctttatttatcaattccatctcacagcaatttttattttaaaatacgcattttaatgtataaatctgtgccttccgcttcatttttgattaatgagttcaatttttattaagattttgccgataatcaatggacattttcaccaattatattgttgttgaagaaaaaacatttaccatttggaacaaaaattcatatttccaagactgtactcaattcgcaacactgtaacttttttgaattttattttgactgaattaagccccatttaaaaactccaatatgattaatttattttagtagtttcaaagttgatgcaaacactttttcattggtaatcaaggacaatggcaatgccaatcagtcgacggaagtgccattggcacaaattaccatttggggttggagtaacaagggggagcaggaggcaaaagaggtgagtgagtgcttaatgatcattgattgatcaataattcctccggcaaaaattaattatgtgaaaatgatgatgccaggagggtggctatattacagtttatggtcatattttatatcttcttacttgatcaatgcctaggttcttagtttcaaacgaaagcttgaagtctagagttttataaccaaattatactttttgctcttttcttgtatttagagattgccaagactttaatctttcgttgatacaaagaatatatgattgatttttgtatgaattacatattttataaaaatttgaataatacaattctctattatttccccaggtgaaaattctgaacattggagggaaggcaaattttggcaacattgggtgctcaaatggttctcagcagatggctaccattatcatcagaattctcaaaaagcgcgagaagaccgacacaaagtgagctttatgaaaatttaggaattaatcgattttttaaatttttcttatttctaaaataaatgaataattaagaaaaccattttaaattatgaattgagaatggaatttccggttcagtccgccatgtcctccactcagttcaccggacgacgatttgactgttcaagttggagaacagcaggtgaagcgccaaattggcactataagaaattcaaattttttgtgggactcgttcccgcaaatcccgcacgggttctcgccgccaaccgtagcttttgtagtcattcacaattagcctctgaatgttagtgaaaaatttgcatttttggcattaaattttgactggcaaaatcggtggcacaaaaacacgttgcataggtcgagtcgagcgagcgagctgatcgagttttgatcaaattgacactgggtttattgatcaatcttgatcaaattgacactatatttgtcctcaggtcacggtgtgcgcgccccattggctgaatgtcccgtttcgccctagtgatcc

SEQ ID NO: 19554 - DNA, 2408 bp, Heterodera glycines
  misc_feature (2158)..(2158): n is a, c, g, or t
  misc_feature (2299)..(2299): n is a, c, g, or t
gttgaaactgtcaatgactttcaacaattcgcctttttcaatgtcaaattgcactcaacaattctcgagagaaatgaactcaaaaaactattgaatttctagttccaacttattaaataaatcatataattattttgtcttttcacttattaatgcagtatatatgttcaatttaattgcaaataaagtccacccaaaatcggctcaatttcccttcaacaattggttaaaagctaattagcttcatcaatccataattgggcgacattgaaatttttatccgtataaaaaatactatggcaagaatgagagaaacgagcaaagaaagggctcatagagtccaatttctcatcggttcatccaattaacaccatcttcgggcatcactcccccattccaattttccatcaacagtttttgcgccttctttttatttagatctcagtctttctgaaattactttacaattacctaattgaccaattagtgctaattgtgtgcccaccggtcggcctctcccgccacttttctcccgccctccttcaactgttccgtcttctcttttccgtattcctttgcgctctcatatcgctcttgtgccccctgcttcgcgccttcgtacccttccgacgctttttcgcgcgctgattcggcgtaatcggactaatggttatataattccggttttaaataataatagaatttcctaaaaaaatcaccgctttgtccttagtttccgtggctttgtcagtcgccgtttccttcgcagaagaaaacgtatcggcaacctacaaaatcactcttccaacttttttctctttgttcttacagaattcggtgctacagtacccctccccgccttaccgagtccttcgcccccaccagccaatccttcgtgccttccgccgcgttcgacagagtgtccttgcttttctcgaagatgcctttgtcctcctcccgctgctgttcgttcggcggctgctgcacagtcacttggacaaagccaacaacgataaatgccaatgctgtaacattgacggcagtttaattgagtttaattaatggggaggtcagtacttaccccaaatgagcaagcaattaagtgctgttttggaatgcattttcaaataagcaatttaggaattgtgtaatttgttaaggcttaaaacaatttaaatttcgaggatttgaaaaaaacagatattcaggataaaagacaattgcgggaaagaaaaaaagaaaaatgaatcggtcgatggacgaccgaccgatcctatttatgtatgtgtccatgcttcttccccctctcccgggaggcaccacaaatgtttttgtttaccattaggcataagcgttcgacactccttctccttcttgtttttatttttaaagtaaacaaaataagcacaactgttaaagtgatgtgatctctgaacagcgagttttacacaatattgatcagctccttccttttttaagcttccttttgcttatgatgagtcattttgatcaatgatcggctaaagttctttcattctcaatacataattgtgcaccgtccgagctgacttcaaagcggaccaggaaaaaacgtcgccagccgaaacgtcgccgggcgaatttttggaccataacttttttcctactcaaccatattaaacattcttggtattgttccaaagcttatgaaaaactctattaatctacaaatttttcaaaattttttattaatgtacaaaaaaaatcagagcaaaaaagttcgaaatactaggtttttgagttccttctggccataacttttttgaaacttaacgaaaattttttaaatttagcctattaatagtaaacacataaagctatcgaacaacaccaagaatgcataatttgatttacaatgaacaaagttatggtccaaaaagtcttccggcgacgttttggggtgcccccacttcaaaggacataatttgaaaagataccaaaaaatataaaatatcatttattagcagggctgcaaaaaatatgcatgaaaaatgaccaaaatgtgcacctaaatatgcaaataaagccgtgaaattgcacaaaaatcgcaaaatatgcacaaaaaaaaactttaaaattaggggtgcaaattcattttaaaaatttttctcatatattnttatcggttgtttttcaattgcaaatcaaaaatttctcaagattttcggcaatgaagctcactgttggcccactcgcgcatccattcaaatttggatttaattttaggcataatcaaaaattttttctaagagatattcanatcggaaaatatttgacgaaaaatggcaaaatatgcaaaaaaaatcggaaatatgtacaaaaaatggcaaaatatgcatgaaatatacagaaaaacccaaatatgcaaa

SEQ ID NO: 19555 - DNA, 871 bp, Heterodera glycines
caaaataggtgctaaaaagggaaaataggtgccaaaaagttccgaatttaggggggtgtaaaagcgtaaaattttatccaaaaagttaacaatattaagccaaatcagtagggaccggacttttaggcatgaaaaatttgcaaataagcgcacctaaaataggcacgaaaaatgtgaaaaaggcacaaaaaaattacaaaaacgccaaaaaaggcacaaaaaattggcaaaaggcagcaaaaattaacacttttgacaaatttttatattcattttatcattcgacattctaaattctgccccaaactctaaagctaatctaatttatcaacagatgaacttgacccagctgacatccttggcaatggctcaacaaccaattcttcgcaccgacaatttaaagcggtacggtcacttttacatgagacatttggcgtttccaattttaaaatgtcatcagtagggcatccaaaaatatgcacataaaaagtgaaaaatatgcacataaatttttccaaatttgggcaaaattttcacaaattcttcaaatttgttaaatttaagcataaaaatctcgaaaatagctaaatatagtatgaataatcattttagaagcaaaaatacaaaataaagtaaaatttatttattttgaagaaaattgaaaaaaaatggagaattttctattttttggcataaatttccaattttttaaaaagttacatttttcattagaaaagcccaaaaaatgatatttttgaaaatttcttcggttagaggcaaaatggcagctttaatagagggggccgttttaatagaggatttgctgaaaaaatgctcaaatatgtacataaaatatgcaccaagtgccaaa

SEQ ID NO: 19556 - DNA, 1736 bp, Heterodera glycines
taataaaatattttttcattttttgtaaatttagcttcatatccttttggtcactttttgggcaaaatttgttaacatattcaattaaaaatgcaaaaattctcgcggcggcgcctatcggcgctgccggacgcccactgtgttccccaaaagctttgtcccttcctttttagccaatttttcaatttttactaatattgttgattggttttaattataatctttaaacatttaaagaaggcagataactgcttgaacttgagtgaagcagcaaaagcaaaaaatgcaactggccatcccccatttatggaaagaatggtatgaaacggcgttaaatgcacaaatcgcatgtataaaaaaaatagagcaatttagcgtaatttttaaaatgttttagcaatgccaaacatagaagttgagtttgccaaaacttgtttggcctcatttgtggcgatatgtgggatggccaaaaggaaaatttatggatggcttaagggttcgtaaagtaaaatcatattttaaatttaataatttttacataaaaagaaataaatgttgtaaaaattgaaaatagtttttaaaatttcttttttttcaggtaaaacaatgtgcaattactctttttaaaatgtgatgccatgcaagaaagtttaatgaaatataaacatcatacagaattaataatattaaaaatcatattgaatcttttttatttttatactcattgtttatttattaataattaattaattattattatgttttgttgtaatgatttttcactgcttttttatgttactcaattttcgtgttcttttcatttagttacatcacttcgttatgttttgttaattattttttattcctttttttaaattaattactacattatttgttaattttaaaagtaaaaagagccagaggcaattaattatccatattgatgttttattaaatttaagattcaaatatataagcttatttcaaagttgattcggtgaattaatatttttgcaataaaaaatatttattttactttccaagcattgattaaatgaaaatttgaaatcatttcagtttaggaatttcttagtttgaaaaaatgtgatcgctttattcctctgttcatacattgacgaatttcaaaattcagcatggaattcgagtgggaaattcgcaactcaatttagcggaattggagtcagaaggcaaaagtgacaactgctcgcgatttgcctcgaaaaagtctcgcaaaacgtcggcattcaaattgagaaagaaattctgaaaataaagaaaaaagggtttaaaaattcattaaaaatgcataaataaatcttagactttacaatttcaattaattttttttttggttattaattttttgctttaacttttaaatgaaagttttgattagggctacgatttattttcaaatttaggggtgtaaaatagtaaaattttaaccaaaagtcaacaatattaatccaaactattattgagatacataattttcaaaaacaaaaattctcatcatgaaaataaacaaataaattttggagatgaatttttgagaaatttttcatttctcaggggtgtgtttttgaaaatttttggatcggttcttagtggtgtattttttgtttttatttcatttttgttaacaaattttgggcaaaacgtcaaaataggtgaaaatagtttttttcaaaaattttagttttttgttgctaaaa

SEQ ID NO: 19557 - DNA, 976 bp, Heterodera glycines
atttctgaaagtgttactttgtgccaccaaatctttttgctctccttacctcggttgatgttgagcgttccttttccatttataagtcaacccttgccgataacgataatcgaatgcgtttttcaccccaaaatttggaaatgtatctcatatgcaatttcaaccaataaatttgaagaaattttacattcaattttgaaaaatttatgtccatattttgaattttgacatttttgccattttatgtccatattttgcgatttttagtccatattttgcaattttatatccatatttttggactccctaatgatcaatttgagcatttttttttttgttagaaataagcattttgtgaaattctgaacgtgaaaaacgaagttgatttttttgcggcgcttttcccaaaaaacttttggggcgcaaggggggccggcggtgtcgataggcgccgccgggaaaaattttgcaattttcaatgcgatttgttaacagattttgtccgaaaaaatgaccaaattttgcgattttgagcaaatttttgcttgtaaattaaggatttttacggtccggcggtgccgataggcgccgcctgggaaaaattaagaatttcgaccatatttttagcatattttcattaaaaaaattctttaaattgccaaacattatgccaatttatcaaaatttaaaagactctgaggattttccccaaaagcctcaaaaatcctgaaaatttctcaaaaagccaaaaaatcctcaaatcctcattttccaaaaaaatcctcattgacctatcaaaaaaccacaaaatgaggataaatcctcagatctggcaaccctgctaatagagaatctcaagagctatcgaatgataccaaaaatattgaatttggttgctaatgagaaaaggtgttcgcaacggcgccaaaacagtcggcgccaaactgaccggttccctgtacagcttacgaaccat

SEQ ID NO: 19558 - DNA, 1703 bp, Heterodera glycines
aaagtgatcaaaattgaagaaacaacattgatgagccatcaaatttgatcaaaactatgaatcgttttcttctttctataaaatgatcagtgattaccggcaaaagaaaacgaagtgatttgatggaagaggaaaaaacaaatttttttttttttgaccatgaatggactaattttttgcttttttaaataataatcgcaaatttttttaacttgaattcatttaaaaataaaattgcatattcataacgaatcccggcattttgagcataccggatcctggcccaaaaattttcggccctcccatttctaatcccggtttctttttcataccacggtaatgctaattcaaagcagaaaaataaatttaaacaaaataaattgtaatgaggtaataaataaatgacagaactaatataaaacaaatcaattacagtaagcaatcatttgtcttaatttcttctttctgtccatatgccgggccgcttgccgcttctgcacaacatcatttcccaccagcacaatatggtcattgttgcaacagtcaaattaattatggtaattaggccgagtatgatgagggacaattggttggtgattacggtagaatgaacaggcattgctactgtatgcttcaatgcggtgttggcattttgcaaagtggcaagcatttgcgtattctctacgacctaaccaaaaacaaaagttaattaattaattaattaaaacaattaattaattattttttcaatttacaaaaatttgctgtgcatagaaaatcaaaaaataatttattttttaaatttgttatatattttcattttttcgattataccgaaaagaggtttttcatttatattttttaaattttgattttttggaaatttaaaatctcaaaaatttcttttcgctaattaatctttgtgcttaatttcattttttaatctaattcatcgccaaaaaaattaatgcttatatgttcactaaatattaatgaattctaaaaagtttcattatttgctatattatcccttaattaataaattatattgcctaaaatttgcataaaaccgaccataattggtcttgtgaacacgtccaccttcgtgccaccattttgttcatctccaataacttggccactttcgttttgctgtgcttgtgcaacgctgcgcacctttcgctgccttttcgacttgcgtcttcgagtggtgtactgctcggtgacggtgtgccgtggcacagttgcggcacactttggcggtgttatgccagcgcagccattgtccaactttaggcacaatgtaatttggcactgaaaaaagtggacaaacgaataaatgaatgctgaattaatatccgaaaaataaaataggcaaaatgttagtaggcgcttcgtgtgggaaccgaaccttactcctccatccattcccaacagggctgcttggcgtaattacggattactggaaattacggcgtttttggacccccccccccccccgtcattatggattacggaattcggtaattgagaaactgatgccaataattacggattacgggtttccataactggaaatccagtcacgcccagccatgtttctcaaccatttagctatccatggacattcacaattttttatagaattgattttaatttgcctaatataattttcttcttgaacatttattaagaatttacct

SEQ ID NO: 19559 - DNA, 1054 bp, Heterodera glycines
  misc_feature (968)..(968): n is a, c, g, or t
  misc_feature (991)..(991): n is a, c, g, or t
  misc_feature (1018)..(1018): n is a, c, g, or t
taatgagtagggctgggatttataagtttttgcttattttttctgcgcctttaactcgacgagaaatgcacgaaaaacacattttttgttcgaaaattttgcgttttaacgcacttattcgagcttggaaatgcttatttcggatgttcgcccttaaaaatgcatattttagatgttcgcacttaaaataagtttttgcccttattttggcgtttcgtgcttattttcgcacttatttcgcgatttttgggaaatttttaataagaatgcaataaaacgaaaaatatacccttaagaatcgaacaaaaaaattttcaaaaaattcacccctaagaattgacccaaaaaatttcggaaaaatacacccctaaaaatcgaccatctctacccccgaaaattttgaaatgtatctcatttgtaactgcaatcagtgaataaaattgtttgccttaatttgaaattattttcatataaaaaacagcaatttaaaaaattatagccctaaatttggaattttttcgtgcttattttcgcacttattttgcgattttttcgcccttatttaaggccttattttggactttttcgcgcttaaaaatcccagccctattaatgaggtatcttttggtcttcctcgccaaattttaaaatttgtttggggcaagccctatccttgccgacctattttcaagacaaaatctttgaatttctctgttttttggtcattccaagccctggtggcatttatttgcaaaaatttgaagaaaaaaaatagacacaaaaatctattttctgggataatttttattctaaaattcctaatttctcatttttatttccccacttgcctgcttccctagttggagctattctgcgtggcctaggcctagatctgtgttttaaattcttaaaattttcaaaattcccctctgccaagcatttgacagccctcgcgctctgtggcctangcttttttgaaatttcaaaattntctccgctaatctttggtccccatggnctagacacattggcatgccattttgcaaatttgcaa

SEQ ID NO: 19560 - DNA, 1008 bp, Heterodera glycines
gcatttatcatgcttttatttattatttcctaacattttttttttacattttatataaaaattgtctttttaaaacttatttatttaaaattttatacaaaaaaatcgctagaaaaaagtgaattaacaaatgccattttgggatttaaatttaaatttaatttaattgtggcaagaaattttgtctgatttggccatttgttttgtcgatgtttgtggccattttattattgttttttttcctgacaaattttctaacagaaaaaaattttttttttaatttatttatttttaatttttattagaaaataatgtcaataagaacaatcattttagttcatataaaaaaattgaagcctatttttgcgctatttcagaaattattttcaaaatttaatttcaatatttaaaatttaatataaaattttttttaacaaaaccaaaaaatatggtgggaaaaatgtatgtaaagccaagcaaaattgattttattgcgcttaaaatatttcattgaaaagcacaacaagccctaaaaatgtttacggagatttatgacatatttttggccaaaaatttggccctcccccgcccattttgggcatggccaaataattggggcccagcagggccggccacccaccgccatgcactcaattgctttaccattttggccatctccaaattcttggcattttttcccattcaattttcttccactagactgaatgacctttgaaaagcgccatttttggtccgaaaaaattatttaaagtgttttttaccccattttattattaatatttgtttaaaattattttttttgtaaattaaaattttatcgaaaaatatttaaaaagcttttataatttttattgataaattgtttaagtcttttttcccattttattatgaatatttgtataaaattattatttcataaattaaaaaacttttaaattgaattttttatgtgaaaatatttaaaaagctttataatttcattatgct

SEQ ID NO: 19561 - DNA, 1444 bp, Heterodera glycines
aaccaaaattattattattaaaaatagaaataaaaaataaattattttttactttttcgatttaatgtccatgaattttttaataagaaatgctaaaccaaacattgtgaggtaagcaaaagtactcactgtgatgattagtaaaaaccgatagccaaatggatatcctaaatccaaaaaaattaaatatataaaataaaatgacaaatgattttttaatttaagcaaatcgaaggaggataggctgctacatttttcaattgagaaaaattctgagaatttttttgaaaaatttttggatttacaaatggcccaaatactttttttttcattagactagggttgcaaccagggctggccgtgattgaatttccaatcacggaaatccgtgagccgtgatcacggggctttaaaaaaaatccgtgacccgtgaaccgtgatcacggcaccccaaaatccccgtgatttccgtgatccgtgagccgtgatccgtgattataaaaaaaaattttctaatgattttttatttaaatttatttaaaaaacggaatttaatcgcgggaaaaattcccaaaaaatgttttaaagaaaccaaaacatataaaccgctttttttgcggcgaccttttccaaaaaatgactaagtttacgatttttggcacttttttgaggaaaattagagctttttgtagaaatctccaaggaaaattttttatttttaactaatttattaagaaaatttttcaaatttttcttaaatttaaccaaaaatctatttatgtagagaaaaaattttgattaggcctgtcgttttaaatttagcgacggagagaaaaaatagggtttttagcagtttatatgccaaaaatggtaatttttctgccattttggggtcaaaatttcaaaaatacggtaaaatggggaccgtctgccggtggtgccgacaggcgccgccgggaaaaattttgaaattttgagtgaatttgttgacagattttgtccaaaatatgtccaatcattggttaatttattggtctatggacgtttttaaaaataaagaaaaataattttcaatgttatgaaatttcttgttaattaaatttcaattaaaattatcaaaacaaaatatataaattgtcctatcccaatggggaattgaacccaagggacagacaacgaaagacagaaggcgtaaccaccagactacatatatatgtttactttctaatttgtaagcagaaaagaatttatttatttttctcaaaaaattcttcacaccactttcctattttcgtctcaataaaaattccctatataaaatgccaatcacggatcaaaatcacggaaaatttgaaaaaatccgtgacccgtgatccgagatcacggcaccccaaaaaccccgtgatttccgtgatccgtgagccgtgatcacggccaggcctgc

SEQ ID NO: 19562 - DNA, 1561 bp, Heterodera glycines
cataaagcaaagggtttttcgtcacaaaggaaattgtggtgcttctttattagagaccggagcgggacggggaaaaatctgttaataaatctctctataaatttctccggcggtacttatcggcgcatccctctgttactagtcttttgaaaaactggcggcgcaaagagagcggtttgaatagcagctaaatagtcaattatatgttgcgttaacagatttgcttcccgatctatttctgccctttgaaccattcggaaaatattatgcgccctttcaatgcatccctccagcccttataaatttcttgttcaatccttcagatattttctagtttttcgaacttcttttaaatttaataaaaaaagatttcgaattttcctaaatcccgcaatcgcgcgcgggatcctccaagttctagaggcggaatccgcgggattaattgcacgggatccccaccttcaaataattcagatttacaatccggcattgcgatccacctcataacgagaggaccctgctttttaattattatcaaccatcaaaaagaataacccccccccccccccgcccttcagagcacgacaaatatttcaacaaaaatttttaaaaattgactagagcaatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaaatcgattttttcaggtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttgggatggtcaaacaattatggggagcaaaaatccaacgcagaa

SEQ ID NO: 19563 - DNA, 1610 bp, Heterodera glycines
ttaaaaaattttattttttaaatttaattttaattttataatttcttaattctttgcgtaaattacgcaacaaatctcaggtttttcgtaacaacattaacgcattcgcgttcaagctttttcaagaggagcctttccgagcagcatttcggggtatttttaaaagaaaaattataattaggaaattaatttatcgaaagaaaaaggtgaaaagatattaatttcgttataatttattctttcaatttaatatcaaaatgatttaatatagcaaaaaaaaaaacggtgaaaaacttataagcattttttatcgaaaaaaatataaatattcaaaaaattttgaactattgaaaaaatatttattgtaaaaatccaacacaaaaacaataaatattaaatgaatttcttttttccaattagcgcaccgatgccgaactaatttatcaaaaacatcggccaaaagtgagcttgcccgctttggctatgaggtcaaattcgacacagcaaaatgcggcagcaaatgcacaccggcgcagttcgtccatggccgatttgggaggtgcaaaaataaatttgtgattgattaaaatttttaacatttaaaaatatttatgtaaataattttaaacggagaaaatgaatgcttttagcaaattttaaaaacatttttgtaaatttttcaagacttggtaaaacaatgaagcaaaaaaaaaaaattagacattcaaatttattaataaataatgctaaactgtttttatctaatttgaatatttttttaattattaaatttaattactttttcgctcgaatgaaatcggttggccatgcaatgaaaacggcggcggaagatgagttacggtatgaaatcattcgatttgccgcccgaactacagcacatggcattccgatggtaaaaatttattatttttagagaacagcaaaaaaaattaaaattttaaaattaaattttaaatttgaaataaataaaaacttgaaattctaaatttatcaaaatattatagaaaattaaagacaacgttcttaattttctggcaaatttgggcagtattttgaagcaaatttctaaggacaaatcctagttctattaaatgcatacaatcaaagatttaaaagattaaaagatttattaacaaaattttaaggggttcctgaaaagccgagtttaaaatgaatttgaataaaattttaaggctttcaataaaacccgaattttcaggaaaatttaaaagaattatattgatttacttaaacagacactttcagtgaaaattatatttaaaaaaactttggaaatcaaataaaaactaaggccgcgcatgccaccagatggtacgccaaatggatgtggatggccatttctttggcatcggttggcattttttgctacaatgtgcacggggtgctgcaaaaatattggcgcaaggacaaaatcaccactgttcaggtgagaagaatgtaaaagaatatttaaataaatttgacattatttaaaaagtttaaattttatttttttatttataaaattatatttcaatttaaggaatgtgattaaatgtttttgtatttgatttctaggtgggagggat

SEQ ID NO: 19564 - DNA, 1349 bp, Heterodera glycines
  misc_feature (72)..(72): n is a, c, g, or t
cagttggacacagtgccaaaggttaaataaaacgccagaaattaggggaaacaaattaatttttaatttttnaagaataatgtttcgttatgcatatgcaattacgatcgccaagactcatcagtgtggccgtgctatagcaaagcgtacaatttttaaattgattattttttatttaaataatttttaattaatttttttactattttttcaagaagctggatcgaatcaatgtgtccagattgtaatggtaattgttttcctttttattcgataaatgacaatgtttacaatttctttcccaaataagcaaaaatgtaaatctgagattttgaccctaaaagtaaaatttttcgataaaaaaattttcgggcgcatggaaaatttttggaaattttgtaatttttaataagattaaattaattagtttgtaaaaaaaaaatagttaaaaaatcctcaacactcgaaaataaggacagaaacatagaaattagatcaacttataaacattgtgcataaattaaacattttaagacattggctactgtaatctaccgtacaccaatggtaccaatcctttgccatgtttatgtcagaaagtcggcgcatctgaattaaaaatatataatttaaatttaattttttaagaacatcaattactgtctgttacgaccggaaagactgaagcgaatttgggaaatccgagggcgcgcaataccagacgaaggtgtttatataaaatacttaaagaattaaattaatcatttaaaaggttaaatattatttagctattatatttaaaataaaatttatttaattgtttatattaaaattcaaatttattttaatgcatttaattaattgagtatttatttttaaataaaaaattataggctcaccgtttcgttctgatttcttggcccaattgaaggatcttggctatgaaaatatgactgatgaagtcgcaattacaacgaaaacgcttgaaaagtgaaaatattgctaattcattaattattattaaattaattgcacttattaatgattaatcagtacttattattccgaaatgggccctatttttcaatatatttctttgcgcaatttccaaaatttgaatttttgaattatgccaggctttttatttttatgcattttttgccaggctcgtgctcacaatggccgggctgccggtggaacggcgcattgcgctgtcctacggtcgcagtgagttcatccggatgtgctcgttcaacggacaacagtgcaacatccaaaacggtgaagcctaattagtaggactgcaaatttcatacaaatacataaagttcctgcattctccgtgctct

SEQ ID NO: 19565 - DNA, 3346 bp, Heterodera glycines
aatttttttaggtcgattcttaggggtgaattttttaggttttattgcatttttgtcaaggaattttccaaaaagtgtctatagtgaaaaaataaacaattgagcaaaataaaaaaattataatttttcaaaaaaaatcgcggccctattaatgatgcttaaaatatttttcattttaaattattataagaacataaaaaatgagaaggaatataatttgagatataaaaataaatttcttacataaattactcatttgtcagtctaaatgtaaataataaaaatacataaagatcaaggtttaaaaataattaaaaccattaaaattgaattttaaaataaatattttttgaaatttgtagtaataaaaataaaaacatatatattatataaattataccatgtggatatgcaaattcgatattaaataaataaataaataaataattataatcatgataatcctccgatggagaaaaagggagaaatgcctttttgcacatgaaatattaaaattaaaaaagaaaataaaaaacaataaaaattatcaaatagaaactcataaaaaaaactaacaaaattgaaacaagccaaaagaaacgaaataattataaaaatgacaaatcttaattaattttacaataaaaaataagaaataattaaaagaatataattcaatattttagattttacagaaaaataaatgaaaaaaaactaattaattttaattaaacaaaccgatgacacctgttgtaaaataaatttaaaaataaaataaattttgtgaatttataaaataaaaattatagtaattaaaacaaaaatgagtcatctttgtcattttttgaacaaaataattaaattttcattaacttatctaacggcaccgccgtacccttctccttccccaagtttttcgaaaaaaaacattgcgaaaaaatatttaaaatgcaaaaaaaaatcgtcactcttttttatttgagtttttagggagcaaacacgtaaaacttaaccttaaaacttaatataggcgagaaataccttcgccggggaggaaccgaaattccccgcatttgtcggagaccaaccccattttgagaagacaaaaaatttgggaaacaaaatttttcattttgaaaaattccaaaatgctgatttttttactttaaattttgttttttgtcggttcaaatactgattttcaaatttttcagttggcagtcctgtttttacactaataaaatattgttttaaatagtttttcatgtttttattgcgtttccttcgcgctacattagtttttaaaaaatcttattttcgggttccgagttttcgtttttataaaataaaataattaattaagttttattttaaattaaatcattttcacattattaggtaaatataaaattttccgtttaaagaaaaatttgctgacggattattcagtgaaggattgtccatcactgacgaattgtccgtaagccgcccacacgtacgcatccaacacattgctgtggcacgcacaccgcacgcgtccgtccactgtctgcccctaggcaaattttcgttccttctccctcccccaactatttcctttgcctttcttctttttcacattatccttttcttttatgtatttattaatctctctctctctccacaacagattttgctttacgccaaatcaaatgaaggcacacagagagagagagagagagagagagacaagaagggacaaccaaattagtatagttaattgaaaaattaattttggaaagtttttcgtgggttaaatttttggattttaagtttagagcactaaagtgtcctggtttttcaatttatctgattttgaggtttagaaacaaaacagggaaattctgattttaattttgttgttaattttatgctattttggcttcacttacaggccttattcgtaatttccaattaatttcttatttgccaccaaattcatttatttcccccgcccgtaatggcagtgcttagcaaattgacaagttcaacagttaccaaaaaggttgttttggcaacacttgtggaaggcattggccgtgcctcgggcgaaggtaaaattacggaaaataattctaagaaataaataaaaaagggataaagataatcaatgaaaatgaatgagaggtgcttttttctataccacgtccaactgatctcgttttttcggctgtgtgtcccgttggtttaaactaaaaaaattgtaaaaaataattttcatttaactgaattatgaacctcacccccccccccccccctacaaaaaaataaattaattaaccaatggaccgccattttcattatttttcccgtactaaaaaatagtataaattgtttatgggccaacaaaactgttgctgattgtgagcatattgaattatttcatatttaaaacaaaacaaagaaaatgggaaataaaaatattttccataaaattttccaaacaattaaccgaaattcctacaatttttcccaaaagtgtgcattgttcggcacggacatggccacgtgttccgtcggcgtcaaggccaaatgacatggaacagggccaaagacaattggtgggttttttgggctgctttcttgggtcatatcggtcagattttatcccggacaaaaatataaaaattaaaataaatatttcccgacggttgttcgaagcccgccatttttctatgcccgaaaaacttgctgaatggctatttttgtccgtttttgggtccaaaactgacttttgaggattttatggtcaaattcaaaacaattaattatttctgaggggaaataatgcgaaacttttgttaagcaaatcctttttaggcacttttacgttgtcggcatcggctttatcccctgcttattgaccattgtcttctgccatgtctattacggtatgtttcgttgttttttttactgtgaaagaatttacgggagtaagattttttgcaaatctgactgtgttttctggcgatttcgatattttaaacaaagcctggattggcccagaaaaaccaaggcttgtcctgacttggatttttgtgaaatttgttttaaaatgcaaataaatgtttaaaataaacaattaattgtttaagagaaataagtgacataacaataataataatatatttttaaacctatttaataatttttttggtattagtaaattaaattaaagtatttctcacttggaataattaattcataattagcacaaaggaaaccaggggttttggtgcgttacctgaacctgggttttttctcgtgagagaattcctgggacctggacaaaaatccaatccaagaa

SEQ ID NO: 19566 - DNA, 2408 bp, Heterodera glycines
aaatatgattcctaatagtttttttaattgacacattttatcatttttaaagaaaatccgtacaaattgagcctagtaatcccaaaaaccaacctttttgttgaaaatctgtttacaaactacacctcaaattttcaaaattttccccccggcggcgccctattggcaccccccgggggcccccctcttttccccaaaagatttttggaaaaagcgcgccgaaaaaagtgatgtgaaaagtaaatctgaatttctaataatattcatcatttagtccaaaatgattaattgtttgaaataattgaagaaaatttgatgaaaatctcaggtcccggcaggtcccggtcccggttttggcaaaaattcccggtctcgtcctactctagtttttaccccgattcgtttttttgtgttatatgtatattaactgtctgacttctcgctgtctgcactcctacataaatataagacaaaaaccgaatcaggtaaaaacgaatttgccaaaaacgaatcgtccgtcgtccatttgaccccttatacactaagacggagttggcgaggcggagttggcccattccgggtatcggagccggtcaattcagtgccgacgattcagtgccgacgattcagtgccgacgattcagtgacgacgattcagtgttaagacgattcagtgacgacgattcagtgacgacgattcagtgtacgttgaaaaaccgacaattcagtgtcagaaaatttggcaaaaaaaattccaaaaaacccaaaaaattgcaaattttattaattggaaaacataaataacgcggtcggccagtgtaattgttgatgagggccggttccgtctcaaatatttttggactcaaattttttaaaatcaataactaatttagaaaaaaaaagtaaaaattcttttacttcgcagcctaccgcagcctaaatatacctggttttttaaaagttgtggttaattaaaagtatattcgaaaataaaaattttttgaaatgaatttaacattgcaaatgtccagtaattctgctcgggattctcagtcttggtcctcgtgtcgggaaatttagcagccttaatgtgtccagcactttgtttgcagcgaatccggcacccattttggaccccgaacccgaatataaagattaatttacataaatttcgtctaattttcaaaaatacaccccctgagaaatgaaaaatttcctcaaaaattttgttattttatacgcctaaattgaaactttaacacctattttgaggtttttagaaccgaaaacctaaatattttggcagtttttagttttgaacacccaaaaatattaggcatattaaatatcagggctgccgaaaacatgcaaatgttttttttcctgccttttccatgctataaataataggaaaaacacgttctttttttgtgtttgcatataaaaatcggtatttttatttgcatatttttgcatatttcgagatttttgtgcatattttggctacttttcgtgcatatttttggcagcactgttaattatatctcaactttctgttcacattctgaaatttaaaaaaatttgggtccaaaaatatttgagacggaaccgctcttttactactaagacggaaacggccccagatttatttagcatagagtataacaatacagatcaggcagaatttctaaccactcaatttatattgtatttttagtggttttttgaaatttttttgccaaattttctgacactgaattgtcggtttttcaacgtacactgaatcgtcgtcactgaattgtcttcacactgaatcgtcgtcactgaatcgtcgtcactgaatcgtcggcactgaatcgtcggcactgaattgaccggctccgaagttttcgattcgataaccgatcaaaatataaatattttggcatttcatacatataaaatacaaaaattctttaaaaaagcgacaaaaaatgatttattttggaattttcgactttgtgtccaaaaatcagatccgggattttaaatggatcaacaaaatgagtgtgagaacaatttttacgcacttaatacgctcagataaacacaaaaaacgggttttccgcttggtttggggtgtctacgatgacttttataatgcctaactttgcctattttggactttttgtgcttaatgccaattttagtgttgtgcctaaaaaacgaatccctatgcattaccattaccatgaatcctcttatttatatttctcactttttcttattacctgctgatttgttttaatttaagtttttatttttggctcgaaatcaatttttatttaatggcaccgcctgtcaaaaaaaagcaaaaacttttgtccgccgttgaaaatcagcagcaatcgtcgtcgtcgggttcattt

SEQ ID NO: 19567 - DNA, 1100 bp, Heterodera glycines
aaaaaaagagatagtgatttttctgattaggccgagaaataaatataccagctattgaaatgcagtgggcaagcacagcgagtcgcttaaatgcacaccctctgacacgtaaaatatccaaaaaaagagatagtgattttttctggattaggccggagaaataaaaattaccagctatttgaaatgcagtgggcaagcacagcgagtcgcttaaatgcaccccctttgacacgtaaaatattccaaaaaaagagatagtgattttttctggattaggccggagaaataaaaattaccacctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctattgaaaatgcagtgggcaagcacagcgagtcgcttaaatgcacacccc

SEQ ID NO: 19568 - DNA, 3101 bp, Heterodera glycines
  misc_feature (3055)..(3055): n is a, c, g, or t
  misc_feature (3072)..(3073): n is a, c, g, or t
gtaaaagaattttttaaattaaattgaattagattacttttattatttttaaaaaattttagcgcatggacgaagcaccgatcagcagtgggacaagaggttttagcagctcgagcagatggtcaggccgacgaaggtcaagcccaagcccatcacagaagggggtccgcttaaataattaattaaaattgttttcatatttaaattaattttttaataattttaaagtttttatatttgaattttcaaaatttatcaaagcattttatatcttacaaataataaaatgtcatgaaataataatattttttctacgaaagttttatttcatttaattttattttttaaaaataatttaattttattttaaaaataatttttattttattttttattttcggcttttttaaaattcagttaaaataaaagatgaagctgactgaccggtggcttaattgaaggaaatatttattattattttgtttttttccttctaaaactttttaacataaaatttaaacaataaaaaaattataaaatttgtgtttatttatttatgctttagtcccgtactgcgttggacggtttagctgcttcgtccgctgcccaatcgcctcagtttgtgtccggcatggtcagctggcgcatgccggtcactgtactgctccaaacattgggcctcctttcctacaaagaggcatagtcttcaaattggctaaatgtggcaaaatttaatttattcctgatcagatcattagctaattaaaagagattcatttaattgattgcttttggtggcattttgatcatcaaatcaattagtcgatcatgcgagttttgatcagaccaattaattcctcgatcaattagcaacagactttttccgattaattttggccttttgctcagacccattagttgataatgccaatgttggtccgacccttaatcccctgaccaatttgcaacagacttatttaaccgattaatttttggccacttctgatcagatcaattggttgaccatgtgaattttgatcacaaacttaattacctgatcatttagccgatcaaagtgatttaattttgctctaccggataacaactgatcaatttaaacaaaatcgttttagctcagtgatcttcgacgtgtacacccgcattgggatgagttgtgcggacagttgctgaaccagggctattatcagttgatcggccgagcgcagtggttgttgacggatagccaacggaaggttttcgtgccaaaaaaatttaaaaataaattcaaaaattatttttaaaaattccaaatttattttcgcttatttcatttatggaatttgcaaaataaaatataacaactttttctaagcttttttaaaagattcaccataacaaaaacaatttcatgcaaaatttaaattaattatttaaattaaattatacattttaaatgcaattaaatattttcaattaaattattattttaattaaatttagttgaaccgtgagcctcgtcttgcgcagcccattcagctgttgacccgtctccatgttcatgtgttaaaccccgtggacgcaatgcgctcttttctggacgaaggtgacaaaacaaataaataaacaatttcactaatttattaattgaaaaatgttattaaatttttactaattaatttattaaattcaaaatatgatttttgcttttaatttataaaattattgaatttgaatttttgaattttatttttcacttacctaacgcttttaaattttattctttattatattttcaatattttaaactttctaacaaagttctttcattactatacatttgtatgcatttttctttatttaaaatattaattatgaagtattaaattttaatttttaaattatttccggcgttttgtgctttccctacggcgctttgttggaccgcgcgttggccatgcttggccgtattgaagacattgtgattagttccgccgaacagatcaattacgacgaggtgagctcacaattagtagtagacaattactttttaaattattatttattttaaaaatttatttttaattatttcatttatttacattttaggccagcgatcagcttgatcaactgcaggatttggcacgccgtgccaatgttcactatcgccaagtggtggagccggaggcggaaaagcgcatgagcgaggttccatagcaaaatttttaaaaaattccaaatttcgaacattttaaaaccgtaaatctgtggcttttcagatgtacaggctgtcggcacagcagcgtctgcaacggttggactcatttctggtggagagcagcatgagccgagtggaaagagtagggcacagagaataataaattattattatttttttaatggcatcaattttaaataattaattcaaaatattgtccataccacttcaatttgtcttgttggttagcccttttcgcgaatgaattaattatttttgatattttgaaattagaaaaaacggacattcgacaaaaatggcatttacaaaatatgggactgtcgagagaaaaatggatgccatttgtcgccaagatcctaacttttttggcactcattaaattttaattgctttttgaaagtgctttattatccaattaggagttgaagaaggtacatattttcattggccagggattttcaaatttttggcactcatttaaattttactgcgttttaaaatggcctttttcacccaattaggagtcggagaaggcgcgcaatgacatgcgctgggagttggagcagttgaaggaccaaaatgcgcagctgaaaaaggagaaccgggagctgaagcatttgtgcgtccgcttggacggccgcgttgacgttttggagcggaagttcaaaacaatggcacggctgctgcaataatgactggatttgacgaagaaaaagtgtggcacaatttgatcagttaaattgttcgttggcgggccgatcaatcatcgatcgatcgattggttgtgcccgatcaaagtttttgatttttgacactggnttttttttcttgataanntatattacactattttaaaaacatatag

SEQ ID NO: 19569 - DNA, 3259 bp, Heterodera glycines
agagggggggagggaataaatttgcaatgaatgagactttgggggggggggggagaattgtttagagaaaatcgattgcgtgaagaaaaagaagaagcgttttgcggaggagggaccgcagcacaacacagaaacaacagcagcaagaggaggaggagctctgagcagagcaggaccttgaccgaccgaccaatgactaccgactgacttttgctgacgaggggggggggggggggatctatcggaatttggggggaggacgaagaagatgaagatgacacattctctgggggatagggtcgattaatgagcagcaaatgcgcgattatcaatttggatttcgatgggatcagtcagtgctgatgcctgctaaagcgcaagaatgacttcgcggagagccctagagggtgtcaaaattggtcaactcaaaatgaccaatttctctaccgcattttttcaagagaaaattttcccgatttcaagccctttttggtgtggccctccgatcaccatgaagtagtgatctgatcaaaactgtgtaatgtttttttcattaatattataatttaaaaggatttttaaatttttttttttaaattttaaatttgagtttttgttaaataaatattttgcttcattaaaattgaaccgctcgcaatcgccttttttttatttacttgaaataaatttaaaacaacattttatgcaatgggaatcagcaatacaaatacgtacatagaggttgtgcagaattttattcaaaaagagaaaaagggcagtggattagattggcaggaaatgttcagaaaaaaaaaatggaaaatgataaaatcgatggaagcgtacgggcaaaggaatgggatgggatgaattaatgataatgaacacaaaacaatatgtggtaatattgtgtaatacaatacatacatatttatgtacgaagatgatgaacaaaacaatgaaagcaaaaatgtggcgattttggggaaattttcttaaaattgtaaaaaaaaatgtgtgccgaactcaacaagcttctgattctattgcactttattgagtccaatcaactacatagcacaaagctttgggaaattgtttatcttagccttcgttaaactataagtgctttcaaatgataatgccaaaaaaagttcggtttgttcccaacaggtatatataaaaaaagttatggtccaagaaagtaaaaaactcaggattgattgattgatgattggaatcaaaaagtgcaatatgtagaagctttataataacattagtaatatgttcgattgtggcattgacccggctaacttttggcaaaagggcttgttaaataaaaaaatgtaaaaaaaaaattagaataaatcccagaatatggaaaaactgacaaaaaaaagaaagaaaagatcatagactgaaatggagacacgatacagttaggtagctcatcctcttccctaaattgtcctcctccccaatccttttaattttcttcatccattaacagtgttaggaccctcccacattctgcgattgataagcatgctgctgcccaggagaggagccgcgcccgccgtcccgttcaccgtgtccaaaaacggcgccaatgattccatgtgcaccaccggcgccgccgccgcgtccacgccgcctcccgcctcttactcgatggcaacagcggcactgacaattcggcgacaccgccgcactgctgctgctattcgatgggcgtccattttgcaaaaaattttttgaatggccatttacgaccacggcacggagtcctcgtacacccttgcgcacctggatgatcaaacattcattcacctcccctcctgcgctttcaatttaatttttaaacccacccgtcgctctccgatttgcccagtcgccgccgcctgtggaactccatgccaaactgtgcatgccaacaatacacatcgaaagctggttttcggcctcatcgccttcatgcacagcgaatcgtccacaatttggcccttcaaaacacactcgacatgtcgcatgcgaacgccgttgccacatgacacagaacaatggccccatttggcggcacgccttcaaaaaatccaacgagttcgcccagttcagcacaaaccattcatttcttaccaatatgggcatggccccggactacacactttgtagctttgtggcttctccgtctgctgttgttttttgatgcccatgcacttttggtccgaaacttttcgtccttccgaatccacgcattggacaaggcgcgtttggaagccgtcctggccacaactgacggaacatggactccacgtgccgagtttccttagaaaatgttcaaaaaatttagatgcccgttcattttgcgatacaaaatgagatcgactcgaaaacttactggactgatcaatgttgaataaatttttgttgtataataaaactgatcaaatgaaattggattagccataattaactgaccaatggggacaagcggccatttggcattgcttctccacaattcgttcccttggttcgcaatccttctcttccaatcgttgcccatcaggctcacgaacgcacatggcctcccgtcgctgaacaccatcaccacaactgaaaccaaaacgaaattcaattggttggtcttgatcggataagggtcccggattcatgctctattccttttgaacggcttcacacctcactgagcaaggtgaccattgtccaaagtgccatcgtgtgcacgagtgttcattgcacttctccgagtccaatttgacttcagcggcacacattcggacgtccaactcgcgaccagcagcatcttggcacgacgcatggcgcattcggagtccaccaccgcaagagcgtgaacactgtgccataataatttttaaacccatctgctgctgctcggctttcccctcctcactctcacctggtaccattgtgaatacacccaacgtgggcaaggcgttcggttgcactccgtctcgatgggctcgtgtggcactccctcacagaaacgggcgtccaatttgtgcccatttctcgtgtcaatgcaatgcaaatttcgtctgctcactccaccggcaccacaactctcggagcactgattttaaatttaaaatacaatttaattcaaacgattaagtaatgtttattaaaagtcacctgactccattgcgaatatgcccagttcgtctaaaaaccacaaaagattactcagatagaattatcagaaaaaaaaatcagcaaa

SEQ ID NO: 19570 - DNA, 1379 bp, Heterodera glycines
gtggttgtaaaaaaactttttgggttaaatgaattttttttggaagtgagtcaacccccctattagtgctttgctgtgccgagacccggcaggcaatggatggctttcaatctgcaagaaattagatgggcaatatgtggtttgtaaaaaacttttgggtatggaattattttttgaagtgagtcaaacaccttattagtgctttgctgtgccgagaccggcaggcaatggatagctttaaatctgcaagaaattatattggcaataagtggttgtaaaaaacttttgggtaatgaattattttttgaagtgagtcaaacaccgtattagtgctttgctgtgccgagaaccggcaggcaatggatggctttaaatctgcaagaaattagattggcaatatgtggttgtaaaaaacttttgggtatggaattattttttgaagtgagtcaaacaccctattagtgctttgctgtgccgagaaccggcaggcaatggatagctttaaatctgcaagaaattagattggcaataagtggttgtaaaaaacttttgggtaatgaattattttttgaagtgagtcaaacaccctattagtgctttgctgtgccgagaaccggcaggcaatggatagctttaaatctgcaagaaattagattggcaataagtggttgtaaaaaacttttgggtaaggaattattttttgaagtgaatcaaacaccctattagtgctttgctgtgccgagaaccggcaggcaatggatggctttcaatctgcaagaaattagattggcaatatgtggttgtaaaaaacttttgggtatggaattattttttgaagtgagtcaaacaccctattagtgctttgctgtgccgagaaccggcaggcaatggatagctttaaatctgcaagaaattagattggcaataagtggttgtaaaaaacttttgggtaatgaattattttttgaagtgagtcaaacaccctattagtgctttgctgtgccgagaaccggcaggcaatggatggctttcaatctgcaagaaattagattggcaatatgtggttgtaaaaaacttttgggtatggaattattttttgaagtgagtcaaacaccctattagtgctttgctgtgccgagaaccggcaggcaatggatagctttaaatctgcaagaaattagattggcaataagtggttgtaaaaaacttttgggtaattaattattttttgaagtgagtcaaacaccctattagtgctttgctgtgccgagaaccggcaggcaatggatggctttcaatctgcaagaaattagattggcaatatgtggttgtaaaaacttttggtatgaaatattttttgaagtgagtcaacaccctat

SEQ ID NO: 19571 - DNA, 801 bp, Heterodera glycines
cgaatttagggtacggatttgtgtatgtatgaaaaagcaaaaaatgaaataaaaaggaaggcattacacacatttaaatgttaaataataataataattgtgatgataaaaaaggggtctcctggtttcctccgcccaatccgatgagatatttatttattctttctcatgtccatttcgtcttaatttattcattgtttttgttgttgctgtccatcatgtccatgtctgttgaacgttctgtacactttgctgtgcgtgctcagtgcctgtgctgcttggtggcgctgttcggtgttgaagagggccagccgtttgtacttggagccaagttgcatcagctgaagaaaaaggggagggacgacatggacatgaccaagtcaaggcagaaaaggaacggagttgaacatggactttgctgggggttttattagtacacaaaaaattatcacgtaatccaggcccagtttcagttttgtttttcttcaaaatatttaattttacaaagattttctctccttttcttgcatatcagtataaatatgaaatgtgtcttttttaagattttccatattctgaacactagactaaattttattattttcaaaaaaaaaaatttttttttgaccaaatctttggttagaagattttagtccgactttttttaggggggggggggggggcgggtgggaatttcttttaaggctttggtataaaatttgcaatttttcatatttaaaattcagttgtccatgaaaatgaaatgctttttgttgtaaaaaatcaaattattattttttt

SEQ ID NO: 19572 - DNA, 1888 bp, Heterodera glycines
  misc_feature (1745)..(1745): n is a, c, g, or t
ttttggcccgcggaatgtgccgtcgttattgatgttgcttttgccgcttttggtggcgcagcagcaattctggacgtgtaccgttcacccataaaacggtccaacaccttttgctcaaactcccggatggttgccttggtaatcggtttcaaatatctaaaaaatgtgagattttttgtttttgtttttattgcttttaccatttccccacatccctttataaatttttgcattttcctttgcaatttaagcggttttaatataaattgtccaaaaaaagcttacaattaactgaaaggggaaaaaagttgatttaaattgtcacaatttgatcgaaaaagtacaaaaaatcagggagtgttgttaattatgacaactatttattttttaatagccaaatttttttgttttaatttgtgtttcggcctaattgcacttaaaaaaggaaaaaaaggaagtaattctcgggttttttttaattttgttaataaaaaattgctcactcttttgcccatgtccaaaatcggcttggcacgtccaaaatgtgtggtggctcctcctcctctggcgatgacaaaagaccaagatcaatgagactggaaaatgacaaaattaaaaatatttttcggtcggattaatttaacaattaaatcgcaattttcttacgaccaaataaaaattttagcaaattttcaggcctcaaaagaaatcaaattaaaaaaaattctttgcacctatgccaaaaattgagttaaacaatttttcaatccgataatgttaaaccgatcaacaaaaaaaactccaaaattttcagtttttttacaaatttttcaaaaatttttatataaaattattacaaatttgtaaatgatccgacgtccgagctctgttcaccgctgcacagccgtgcctcgcgatgaatgccatagccatgcctcgagtggagttcatactttggcattggccgattggacaggtcaatggtcggataatcgccggtcgacatgtaagtgatttcgccatggattgtcttttggcagtcgacgttcagcgaaatcaactcctcaagctcatgctgcactgactgctgaaatgtttaggaaaatttggtatttttaccatttttttcaaattccaaacaatgggaggaaattgggtagcattttaaccggcgaaaattagtgaaaattcggagtttttacaagttttcgagtcgaaacattaattgccagtctcttagattaaaattagatctatataagcaaaaaaaaaaaaaattcggataaatgagccaaaaatggcagttttttcctggttgcacaattttaaggaaaaaatttgtttatgggactgcaaagagctaaaagagtagccactttggatcctctaaaattttccattggttaaaaagcttttttttctcatacgtaaatgccggatcgtaaatttgcgcctgcaacccggaaaattattgtaaaattggaaaaaaacgaaccaaattatcaacgtcaaatgattttctgcttgaagggtttgagagaaacttgtgaatgttcggatatttgtcggcattgagctcgtcaactttcagttcaggaaaaatgccgaacacatcgacacaaacgcccgaccgtttctcatcatttaaatcgagtcctaaaaattaatgcattttattaaaaatttggagattttttgtgtgttgattgtgagtataaacctttgaggcgacaagtttacccccncccccttttttgaaaaaaaaaatttcaaaaattttaatgtcataaaaacaagtttcctgggcttttcgaggtcgctgatcacgaatccggcatccatttcgaacgattcgaaatcccggacccgaattcgaacaaaagtcaaa

SEQ ID NO: 19573 - DNA, 2495 bp, Heterodera glycines
  misc_feature (41)..(41): n is a, c, g, or t
  misc_feature (86)..(86): n is a, c, g, or t
  misc_feature (123)..(123): n is a, c, g, or t
gaaaagcgattggagcaaatgcttttatcgagtaaaatgcnaatatttgatcatacgacttctttctattgaacacttttcatccnaagtgcttatgtgtgctacatccgctctttctctttntttttgccaatttctcaatggcttcggcgtggtcggcggcggaccgttcggcgggtgctgcgctgctcctcccccttcctccggcgggcccacccctctgacgacggcaaggcggtgaagcgcccggcggaggagttcccggcggaggggcgccgggcggaggggtgccattgggtggcgcacagtccgcttcgtcgtcgtccgctttttgttcagagtccttgcttttgtcctctcttttggcacgtaaaatgttgtctcgtttttttcggcctttgtttccgccatccttcaaaaggaatctattcgctaattataagcagttttgctgatgtgacctttcctccgtcggcgggtgcttttttaccgtccgccgggggcggagggcacccgggcggaagaggcgcggacgacggatcggtgggacatggcaaatcgtcgcagaggacgaggagaacggcggaaaaggcgagtgccaacgaaagaaagggcaggcgaatcatttgggacagaaaatgggccgaattgggaggggagaaagaaaagagtgggcttaaatagagagcgaaacaatgaaaataatccttcaatttaaaacggacgaattcgaatccttttttaataccccaaaattcgtgccaactaattattttaaaacacaaacaaatttaattgcccagccattgaaagagagagagagagagagaacacagattaactggcgaaaaacgctcagattgagaaaggtacgatttgtaaatttataatgggcataattggaaaacaattttacaatgtacaataggtaaagcagaaaatacgatccataaacagctttatcgtctcttccttttccacgctattttcctccccaaccgtatcctccagcagcgttatagtctctgttaccgtatccgtacccagcaacattaccaccatatccattgcttgcggaattgtaactgccgccactgttcccataacctaaagtaaggttttagttcatgctaccgtgtccaccttcccaccagcattaccatatccgtatccagcgccattgttatagtatccgctaccatacccgtagcccgccgattgctgtggggctcttatgtgaatgtgcacccgaacccgctgctgatggtgtcgatggtggtattgctgttgaaaatgggtggtcagcttctttcagaaataattctcgatgtttacttgtccgttttcatatccgccatatccgtaccgttttggccgcgaatgatttgccaaagaaacgactgatggggccaaataatgagacggaactgcaacaattgaggagcaaaggacaaagaggaagagaaaagtgaaaagaaaattcattggcaatttttgagaattattttgggaaaattgcggacgattcattctttttataggcacacaaagtcaagtggaggacgaacgtcagcaacaaaattaaaaggggccaataaggccgaaaaggaaacatttgacgaacagaggcacaattgttgtgtttttgagtaactcttcacatgcgatgacaaatttatttttattttgaaatatttttaattataataaatttaatttttaattctaaacttaagagttatgaataaaaatacctaatgtcttaaaatacggtcaaggtcagacggtaggggtcaactccgtgtggccaactccgtctcagcaatgttcaaaaagctataacttttttctttgttggccaaacttcacaatcatggtatcattcgaaagccctagatgtttagaagatatttataagctatttctcagtgattaatcagctctcaaaaaagttgtcagttgaaaaccgcaaaaaaggcagaattttcgaagttttttatttctatctttttttatagttcgaaattttctgtaatttttagtaggctaatagagcctgtgaagagctttcgaatgatatcaagattgtttgattcggtcaataacttcaagagttatattgactcaaagttggctcagacggagttggcccgttccgaggtcagatcctgcataggtagtaggttcaagaaacttttaaatataacaaacattttgccaaaagcggattttttaaatttgaaatatgaccccacctctccctcccttcggggctttattcctttgttttattttttggttttgccaaccacttaggtatgtaaattctcgaatctaaattccattttaattttatttacaaattttgcaattcataaataatccttttaaatgtcttcaacttttaacaatgaatattaccagcgaagaatgcatgctgaatttgtgcctttaccaaaggtcgttggaattataactttaactttttccaatac

SEQ ID NO: 19574 - DNA, 1843 bp, Heterodera glycines
gttgtgtgggtggtggcggcggtggctgcggaggaggatgtgccggaggcggatgttgtggtcgcagaaaacgagaagtacttaaaaatcataaaaaaattgaaaatccaagaagtggtggggtagagaaatttgtcgaattttttaaaatttaaatgggcagtagtttgcttcacgcaccaaatttgccatttatacggattagaatttcgtatccagattcccagatatcccggattttgttgtagtaaaacccagtggatctgggtttgagtaacatagccgggtcggtttaagtttgcaaatcaaattccagacaagattcggacctgatctgttctcttatatcagtgggtcagggtttgagtatagccgaatcagtcgctattttcctggaaccagtcaaattccagactggatcccgacctaatctgttttattatcctgtttcaaaatatccttggtaattttcattttgaaggccgtccaaccgttattcaaggaccgaactgtgccatgtccacaaactgaatggcgcgaaatcatcagacaggttatttgaattaaatcaatttctatataaattttcaactaaatattttcagagcattttatcatcggctactgtaaaaggacgtgccgacacttcgccaatgaaaattcaaatggcattgacagatcgatttccccacaacaaattttttgtgatttgttcaccgtttgagcaagacaacaaaaatccgagtgaaagtgctgttaacgatggacaccaaatgccaattgaagcgcaattaaggtaaaaactagagaacgggccggtcggttttttttttttggtttttttcgattttcggtttcggtttttaaccgagaaaaaccgaccgagatatttcaaagtttttcggttttaaaccgaccgaccgaattaatcaaaaaaccgaaacaattgaccgacttttttttaatgcgatttgttaacagattttgtccaaaaaatgaccaagtttgcgattttcagcaaatttttaagaaaattaaggatttttagggtccggcggtgccgataggcgccgccggggggaaaacttgaaaattttggccatatttttagcaaattttcatcaaaaaaattcccaaatttgtggattggatttgcggaaaaaacattgataatttcttgttttacaaaaacttagcaaaattttttggaaaatttgagtgaggtaggtcttggagagtgtactaacaagaagaatcaaaaaatttagcaaaaaaaattttcccaacctctagaacaccattcgatatagcttcaatagctctacaattttgatcaaaacaaattcttaaaaatcgaaataaaccgaaaatttttcgtcggttttatcggtttctgttttttcgggtttttaaccgataccgaccgaccgagaaattttttactttttcggtttttttcggtttttatccgaaatcgttcgaccgactctctttgtacggtctctaataaaaaccattttttttttgtttgatagtttgcctttttggtattgagtttactgtagttaaaattttgcaacatccaattttggtcctatttttcaaaaataaacatgttaattagcataaaattcatttattttttaataaaccaatttttaaattgactagttaaattactccacatttttcataacaaataaacgaactcgaccttttttccgatttagttctgccggagatgggtactgtagcgtaatggagagcctactgtggtgccacgctgtttcaatgagtgcttaataaaaatctttttgaaatgttgcaacaactaattaaattt

SEQ ID NO: 19575 - DNA, 1181 bp, Heterodera glycines
ttcgttattattttctgctaaatgccaaattgttttttccatttgttaattatgtctcggctgactccaattttcttacaaatttctttatgattttgttgccattctttgactgaatattttcttatatatatgttatataggttttgagtttcgttgctaaaaccattttctcccggccgaaggccgggagcgccctgaaagtagtggaagggtcttacaactttttgaggagcatccgggaaaactatagagaaaaattcagcgcggacgactgagtcccggggaccgatttctcactttttcttgcagtttagggcctgtaactttttttctaaaacccgaatcaaaaagtgcccgctgtgagggcactcccccaccactgtcctctacatgctggtattttttatttttttattagagccaccccctggcctgcacgcttggctaattgaagtgtgctcaaaatgtacacttcagtaccaggcgaataactcgccagggtttgctttgaccgaaaaattgtttctgagcaaaaatgtgtagtatttgaaaggctatccaaccaagttttaaaatttcgaaaattttgaaaatttttcgagctaggcctaaaaaacggttttcgggtttttgaattttaggattttttaacgatttttcccagagaaacggagaccacttccaaaacatagtttttcgagctctatcgactggtatttttttcggaaaaatttcgattttttcccggaaatagaaaaaatttttggcctgagcgggacatttgagtcccgggtccataactcgttaggggttggttttatcgaaaaaactccttagggcaaaattgtagacttttttaagctctatcgaatggtgtgccatatggccggaaattttcaaaaattttcgagctaggccccctagaaattttcaaaaattttttttgggttgaaaaagagtgggtgaaaaatatttttctggggtaaattagggtcctgagcacaaatatgatgtttattttaagtttcagattttttggaatattttaaaaattctttattttttggcaattttttggccctcgggattttggcctaatatttgaaaattcataacaaatcgaagggttgatcaattttacaggaataaagccttaaaaatagagaaaaatcaggaga

SEQ ID NO: 19576 - DNA, 2339 bp, Heterodera glycines
  misc_feature (1574)..(1574): n is a, c, g, or t
cgcccaaaattcactcctccagtttaattcgaaaactctcgtcgcatctttctctaacggggcgggccttcaaaacaagaatgtaccaacctcggaaagaaaaaaaaatttcatttcagagtccaacatttttatcgtttgttttttcgttttggttttttaaattaaagacaaactatttttttatttaattttttacttgaaaaaattatttatttttggtaacgattgaaaatccagcaggtccatctcagattccgtcttttcttgcgcatggatcaattagtccaattttgttcgtggcatttccaattttgaaaaattcggcacttttccccctccaaaattttgtcatttatcttttctttttccactttttgtgttatcatcattttctgtttcataatcttttttagcccatcaaagctctctctctctccccgtcgattcactacccccaaaaattattccctaatgagaaaataaacaattaattctgatgggtcattccaatacatatgatggtgatgacggtgctgctgctgatgtgtccctcgtgccgttcctttcccccgcccaatgccgccccaataatttccaaaccataatttgtcaatgctaaattattggcccctgaaatcaaatttcaaggattcctcattagttttaatctgttcagcagaacaatggccgattcattgtgggagagcattaattaacgcttcttcgtttttctcgtcagagttagcataaaatttaatatttcttttggcattacttttcggttcggatgtttcacattcaaccggcaaaactgatagttttgcccggccttgtaaattttcgttgaaattattattattttttaatcagggttgccatccgtccttgaatggcaaggacgtccttgaaattgggccctctctcttgaaaataaaaaacgtccttgtatgccaaggacgtccttgaaaatgagcatttggaaaagtttaaaaaaaatcaaagaaatttgagaaatctttgtaattttcaacaatattttgattaaattatggcattatgtcatttaaaaatgtaatttttgagaatttttgaaattttatggcattaagtcactagtcactatttttcttaaaaaattagccaaaaatcgcaaattttggtcatttttggacaaaaatctgtaaacaactcgcattaaaaattacaaatttttccggactcccctatcctcaaaaaattttttaaaaagcgcgccgtaaaaaaaccctttttataaacaaaaaaagtcgttgcatggcttaaaatcgcaaaaaattaggcagtttttggtgaaaatctgttaacaaattgcattcaaattttcaaaatttttcccccggcggcgcctgtcggcaccgccggaccccccccccccctctgtcccacaaaatttttggaaaaagcgcgccacaaaaaaagcgtttttaaagcagaaaaaagtcgtcgtaaatgaagaaaatgatattgcaaatcggcatacccgtccttggaagccgacattgggcgataccaaccctgttcttatttcttanatatattcaaaattttgaaattttatggcagaatgtcactattttatcaagaaaatataaggtttgcgcaaaatttggttatttttgacaaaaaactgttagcaaatcgcattaaaaattacaaaatttttcccggcggcgcctatcggcgccaccggaccatctcccccttgtccccaaaagtagttattttttcttctaattttcaaaattattcccttttcggtgggaattcaatcacaattttaacaattaaaatgagaaaatattgttatttttggactaaatttgttcacaaagtgcactaaaaatttcaaaaattttccccggcggcgcctatcggcaccgccggcacccaaaaccttatttttataaaaagttggctcaaaatcgcaaaaaattggccttttttggtgaaaatctgttaacaaatcagaatttggacatagaagcaaatggcggggccgcaaaagtcaataactatttttttattttgtccaaaaattaataaattacgatttttattatttttgaaggaaactgaaatatcttggtatcattcgaaattttgatgaggagaagttttttctaaacaaatgttaagcaatttgaagagttaaaaaaagatttgggcattaaagaatttattttttgaataactcataaactaacaaaaaactttagaaaataaacatagaaatcgatgctgcttaagtgagtgattccaaaaaaagaaattttgtcttcaaatcaagctaaaagcat

SEQ ID NO: 19577 - DNA, 1229 bp, Heterodera glycines
aaaaattaatgcaatttttaaaaatattttgtccaaaaattgagaaatagccaaaaaggtgaaaaaagtgaaaggtaaagggccaaaaaggtgataaaagttgagattaaagttaaacccagccatggtttatgctgtactataaacaaaaaatacaccccttttttcttcatttttggcgatggataattgagtccctgttcaaagtggacatttcagtagctgatttttttttgtcacaagacgtgagagattttgaaatattgcggattggataattgttttacataaaaaccccaaaatttttaaaaaaaaggataatttaagtccagcagaagtgccgatatatgcgacgacagttaaaaatctaaaaatttagcactattcttaattgataatattaaatttaaatttttgggatttgccaaataatttgttgatgatgtggcacaaaaaaaaactatggcataatttcccattattaaacggaaatatttatttaagaaaaacaaaagcatatgataaaaaactgagtttcaaatgttttaacataatgtacaaataatgggaaaaatcagcgaaggtttaaaaatcagttttaatttatagaaatttaattaaatgtcataaaaattaattaataatatgagataaaatgagatattttattttatttttttatttgtcttaaagaaaatatattcattatttttgaaaatatatttttaaatttatttagaaatctgtccatctgtttctttgggagatgagaaaatattttgctcatatttttttgtctaatgccgctgtcttttttggcttaactgaacaaatttttggaacaggtttgctttttcttgccaaatgattcattttttggagaaatttacgaagaaattttttaattgatcagaattttaaattgataaaaaaataggtcgattattttaatacttattaatttgttttctaaaaaaaacaaaatattaatttgacatcgatgtacaattttattataaattttttgaatattttactaaataagggttcgtgtccgtccttggattcaactgatagcccaaattggtattagggaaattcaaaacggcacggaattatttgccaaccaaatttttttttaatttcgcatttatttttcttaaatttgataggattgatagtatgctattggaattattaaagtaccaccttaggggttgtttgaatta

SEQ ID NO: 19578 - DNA, 1569 bp, Heterodera glycines
ttatacttattgtaattaaggtgttctaaatgcggctgtgtggtggaaattgaaaatgatgagcacaaaatttcgtgccccaactgcaattatgcaatgtgtcgcagatgcaatgcgaattggacggaagagcacgacaaattgtcatgcgaacagttcgccaaactcaaaaattacaaagatgacccattgtaatataataaaataattaattattaatttaagtgtcttaaattaaaaaattattctttttttagtgataaaaagatagcagatgcaattatccacaaatgtattcaatgcaacattagctttgtaaaggaagacggttgcaaccatgtaaaataatatttataaaatgagaaaaaaaattttatttacaaatttttctacagttttaagaaataatgaattttgaatttttaaagaatttcatagaaaaatttgttttttttttctttaaattccggaaataagaaccctggacctatttcgtaagaactaaaattgacagccctgttaaatttttaatttttttttttataaattattttaaaaatttagattttttgtataaaatgcagaactgaacaatgctactgctgcagaaagtcaattgatttatttgatcattattgctggtcatcaaataaaattaatatttaaaaattagaaattaaattaaattgaataaaattttcctttaattaaaataaataaatattaatcattttttataataaatttccctgttttttaaagctgttcggtggaattgccggggaagttaagcgcttttaaatgtaaaaattgtggaaagtgtttgcaatctttggatatgaataaagttgaagcacaaaatgcagaacgcattcgaaaagtaaaaaaaaaaaaatcctgtaaatatttttaatttttttttaattttcagtgtcatgaattcaaaaagaaattttttacacctttttcaaaaaagtttgaccgaaaaatgaatgacaaattaaaaggatccaccagaatgaatgaacaataatcatctgaagaacattgaaggtcaatcaagcaaaaagcattttggtaaaaattatgaacgctaaaaaactaataaatatttcgattcatgtaattttgacaaattaaaggttttaaaaaattcgtactaacaattgggaaagaaatagacttgttcctatgaatttaaattcacaaaaaattttctttaatttatttatatttaaaaaaaaattaacttaaaatccggggtaatattttggaattaagaaaaatatttgaaagaaataaatctattgagttcatatgtataggcgtataattttttaattattctaaagtatatgcgcgtgtgttatttacaataaaatagttttattcattggtctttttggtcataagttcatctgttgattaaccggtttcacttgaattacattgggatgttgtgtttgtcccattattttcgcaaaaataaatcttggtaagaaatccatacaaatttggcgtcgtaatgagtcactggccccaagcattagccaactcgagactccaacg

SEQ ID NO: 19579 - DNA, 1226 bp, Heterodera glycines
aagattaggccagaaaagtggctcctttttttgagagaaattttgcatcgaataaatgctctgcagcatgagtagaggggcggagagcaatggccattttattgttccgagaatttttaaatttcaagattaggccagaaaagtggctcctcttttttgagagaaattttgcatcgaacaaatgctctgcagcatgagcagaggggcggagagcaatggccattttattgttccgagaatttttaaatttcaagattaggccagaaaagtggctcctcttttttgagagaaattttgcatcgaacaaatgctctgcagcatgagcagaggggcggagagcaatggccattttattgttccgagaatttttaaatttcaagattaggccagaaaagtggctcctcttttttgagagaaattttgcatcgaacaaatgctctgcagcatgagtagaggggcggagagcaatggccattttattgttccgagaatttttaaatttcaagattaggccagaaaagtggctcctcttttttgagagaaattttgcatcgaacaaatgctctgcagcatgagtagaggggcggagagcaatggccattttattgttccgagaatttttaaatttcaagattaggccagaaaagtggctcctcttttttgagagaaattttgcatcgaacaaatgctctgcagcatgagtagaggggcggagagcaatggccattttattgttccgagaatttttaaatttcacgattaggccagaaaagtggctcctcttttttgagagaaattttgcatcgaacaaatgctctgcagcatgagtagaggggcggagagcaatggccattttattgttccgagaatttttaaatttcaagattaggccagaaaagtggctcctcttttttgagagaaattttgcatcgaacaaatgctctgcagcatgagcagaggggcggagagcaatggccattttattgttccgagaatttttaaatttcaagattaggccagaaaagtggctcctcttttttgagagaaattttgcatcgaacaaatgctctgcagcatgagcagaggggcggagagcaatggccattttattgttccgagaatttttaatttcaagataggccagaaagtggctcctcttttttgagagaaatttgcatcgaacaatgctctgcagcatgagcagaggggcggagagcatggccatt

SEQ ID NO: 19580 - DNA, 1952 bp, Heterodera glycines
  misc_feature (1802)..(1802): n is a, c, g, or t
  misc_feature (1833)..(1833): n is a, c, g, or t
tttctactgatccgttgtccaattgcgcgagacgaaagcaaatggaccaaatgggaagaagaagcgattggctggcaaattgatgatcagtggaataaaattgacattcgtatttatactgagaattacatcggcgatgggtaagtgaataaattattcaacataaaatttactgtttttctatttttagacttctcgacgaaattcccggccctagtgatcagtagaagtgaatgaattgtattgttaagaagtgaccgaccaaactgaattgtggaattggaaattgacgtgctcataaaattgttttctttttttttgttgactgatcattgatcaactttggatttgtgttatgcgccattatgataaattcagtgatttcctgaaattggaacatttccgaccaaccgagcgaatgaatgcgttgtctgcctaagcttttggcttgcgcataggctttgtcttttatatgagttgccattgtctcgtttcttttttatttggttccaacaattaaaacagtttttctcatattttttcaaattttaatctttttgtccacggctaaatttttaaaagctttaaaattttctttatttttttttttgccaatttatcggcgtcggcgagttgtagtgtaccgtcaccccgggtaaaacaaaaaagtctcagaaactcctccccttaaaatttcactcttgaatgatttggattacaacaaacgatcatttgcccccgcattgggtcgggggaataaaaaagtggttttaaagcgatctgagcaatcacagttcggaatgttcccttgttaagtagttttatctgttcgggcattgtttcattatgagaagtttggcccatcaatttgtttgttcaaattttgcgatttggagccaattagaactagagaccggacaagagggtcggtttcggtttaaaaaccgaaaaaaaccgaaaccgaaaaaaacgaagaaaatttttcggtttttttgattttgtttatttttccccaaaaaagaataaaccttttttattaacggaaaaatgctctttaatatttatattgaatttttgggagatttaaatgaatttttttgcttcttctgcatggctgcagggctaccaagtgtcctgattttttagattggtcctgaatttgaaggtacatatctgaaaaatcaaaaatgtccttaattttaaggtctccgagaaatgtataaaaagggcgatatgttgtaacaaaattttaaaaccaaccggtgcccccccgcctcctattgtctcctcgtcgcgttgacgaagaacagagtacaaaaattgttctctttcttcgcctctctatcgaatcacacagcttttttcatcccaggaaaagcgaaggaatagagaggaaattgccataaaattggccattaaatgatcgattaggctaaaataagtcttccattttttgttattattttaaaaaattcttcagcattcgcattattcgtcacccttttttacagcatttcattcattttattttttttataatttataatgcaaaattaattccaataataaaatttaaattttttaaaaatatgagttgaaattctggcccaaaagcttgcaaaagagaaaataacgattaaaaataaatgtaaaatctatatttataatgtagattggaacgagcaccttctttaaccaataattaatatggaaataattaaaatgggtaaaaagagtttaaacctataaaaaataaatataaaaataattttatttatttatctcattcggatatgaaatanaaaatataaaatattaagaattaagtattanaatttgttattattagatgcaagcaattttaaattactagaataaaaaaatgtatatacaataactcagatgttgatgtaatttacgacattgccaatttaaatttaattttgaaaaaa

SEQ ID NO: 19581 - DNA, 1475 bp, Heterodera glycines
  misc_feature (32)..(32): n is a, c, g, or t
aagtgatgaaaatgttaaaaaaaattaataanagccgtacatcctaagggcacactttgaaccgacggaaacaaaaaaaaccctacaaagccccaaaaagtgaaaaatagaaaaaacaattaatttaagctgtcctaaactggcaacattggctggtcattcggagttttgttgtcgtcctgctggagaaaggcacacaacagacggcccatgaccaggctggtcatctgcatgccagcactggagcacatcattctgaattcaaggggggggggattataaatggaagaattaaattggatttgctagaaattgtataattttaataaaattattatttcttaactgacgaaaataaaaataaaattttttgatcaattgcattgttcatcttttttgtcataaatggcatagcttaggggagagcgggggaaaagcggctaacgcgtcggtgaattttccgaaaaccggaggggggcgggggagggggggctcggagaataacgcagaccgaccagtaaaaaaaacaaattatgtcaactcacttggcaaccataatgccgtcgacgccaaggaaggtcatgaattcatctaaaaaaaaacgaattggttaatactaattagcgccaggaccaatttttcatacgtcggcccctattttttttttgctattcaaaccacctttatttgcggcgcgtttttttccaaaaaactttgtggaaaggggtggagcggtcccggcggtgccgataggcgccgccaggaaaattttttgaattttctatgggtttcggctacggaaattgttcaaatgttaactttttcccccttcgttacgacccccaccacgacgacccccccccccctcctttacagccgccccccttacgacgaacgagggggggggggggggggggtgcgccggcgcaccccttgttcatgtatggtaataattagggcgtttaattatacggatataaaatcgcgaaatatggacataaaatggcaaaatatggacatacataaatttttcaaaattaaggatttactttctcaaaatttctaaagtaaaagtctttaaaatgggctaaatacattgttaataatcattttagaagaaaaaaaaacacgtaaagctaaaatttattcagttttattttccttatttttgacataaatttaccaatttttaagaaaatttaaatgtattcaaattctcgaaaaatgtttgctaaaaaattgattttttgaaaaattttccggtctttggggtcaaaaaggtcaatttagctgttgggggccgttctaatagaggttttctggaaaatgccaaaatatggacaaatatggaaaatatggatatagaaatccatcctagaagctccaaaccaagctaaaaatatgtttttcgtgcgtttcaggcctcccacagtccaggaaaaaaatatggattttcatataattcaacgccctag

SEQ ID NO: 19582 - DNA, 1103 bp, Heterodera glycines
gttttgttgtcattgttggacgaccgctgttgctgctgctgccgatgctgatcacctgccgaacactcgaagtgatcagtgccggtccgagttggccttgaaaattgatcagtaataggacatatataatctgtttaattatgcaatttacatttactaagctacagagcttacatataagcactcagaattttgatgaggaaaaatctgctgaattgtgagtgcccagattgatccatgctcattgcaattagctttttgaaatttcatcattctgttgctatttaggcaattttcttacctagggtaattaacgattaaccaattaaaaattgcgcaattctgagtgttgttattacattaattaatcagtgtatgccaatcagaagagtgctttagcataatgatcaattccgaaattgatcagtttccggttgcccgttcaccaattgatcagtccgacattctgtcgctgatcactgagcttaccccttcactttgccgtccgacgcgccacattggccaacagcggaattgcgcaacatttgcttggcgtgctgttcaatttcctccattgtggcggtggagttgttgcttggtgagcccgattgattgtcgtcgcacacattctcagcttttgcagcagtaagaccggaagcgaccgcggtgaaacggccgtgttgccgctcctccaactcatcgccatcctccgtttcggcaccacactcatcagtcccgctctcgtcccgtcgggtgccggcatagccgaagtcgaactcggggtcgggaatcatctgttgatgtggaaaataaattaaaattagtaagccatcaaaaacaatttcgacgctacctgcaaaaggctcagctcaatcagccgtttgataaagcgattttgagagcggaacaaaagagtccagcaccactcggccagactgagcagcgaaacaaatgccatcagaatgaaccaaaagtagagcatcaggaagattttctcgttgagctgaacggggaaggcaagggaatgaaatggattcacatttgggtccactgcgtttcggcgatggcgtttcggcgctcgcgtttcggcgccagccatgttt

SEQ ID NO: 19583 - DNA, 3026 bp, Heterodera glycines
ttttttattactattaaacccacttttttcggcgcgctttttcctgaaaacttttcggatgcaggggcggtccggcggtgccgataggcgccgccggggaaattttgaaaatttgagtgtaacttgttaacagattttcaacaaaaaaggctggtttttgcgattactagacttaatttgtatggattttcatttaaaaaatgataaaaatgtgtaaattaatcatattttgtcgataggaaacccatgggtatacaaaaagaaaattaaaaatactttaatttatgtagagagattgaaccagggtaaataaaagggaaagtcaaggagagtagcctctaggccatttggacaattggcagtgccacttttatataaaatattaattattttataaaaaaatttttgcttttaacaacaattttcttcactaattttcactcaaacccccattcttaccagtgtattttaatacccggttggacccggacctaccgggtcgggtaccgggtattggattttcaaaaaaccgggtccgggtccgggtaatgaaaaaaccgggtatccgggtctgggatccggtcgggtacccggacccggcctaccctaatatttattgtggaatttaaaaatgacaaaattaatatttcattagtcaaaaaattctgaaaaactaggttagtatgcttttgatgctgatcaaatctttacaccaactagatcagatccctggtgatctgggcacccaaaacccactgaaaacgtggaaatttttgaaaaaaattcgtaaagggttggaaaatttttccggaaaaaattatcaggctcattgttaagaacacaaaatactataaaaaaagtccgcaaaattgttttaattgaaattaaatattaattaaaaatcgaactgatggctggaaaagccgggaatttcccggtcccggttaaaactggtcaaaaccgggaccttggtactcagttgtccgtgttttggtcccggtcccgtcctaccctagtataaaatattgggaatttcttttttatattattttcattttatttttatctgtttttttcatgtccaatagtgttgttattgcagtagaatgcgtttttctttatttgcattttatctgtttgggattattactttttgctaaattgccttttcaattactttttgttagtaaaatgcgagaacaacttaattaaaatgagcctcatgaaaaataatttaagataattgtcgttattttttttatctctagttcatattaataattgtaaattaataataaattaattatttttaattttatttcacaaaatagtttaaaataattttctattaaccattttgatgcttaatgatttgttcttttaaagaataataattcaaaatttcttcttttaatgtttttcaatttaaattgttttcttacttttgttataactttgttgccatttgcattggaatgtagcaaaatattgaaagtttaattcattaaattttatgattatttctggatatattgctccatttatgagatccaatattttattatatgggattttgttttaaattattgttttttaactcatataaaattttattactgtttttttaataaaattaaatcaccgtttatatttattatgttgctcaatggaaaataatttaataaaattctcatcaggatattgatcacgatgagttgttgatttcacgcactgttgtgctccaattagcatattcaatattgttttatttttaaataatattttgattattttcaatttgttaaatttgattttgtatatcaatcaatttaaaaaaatagaaatatcataatttcagttaattttaaatttttttcgattcattctggttttcagccagtttttatgtaacaaaatcgctaatgtccagaaatgcagcgggatgttctcatcagggctgggcgcaattacggattacgggaattacggcctttttggacccccgtaattacggattacggcttacggatttttgggatttttccgtaattttgatccgtaattggctttttgggattatttttcgagacgatttcctgcaagattattttttttataaaaaccaaagtttcttactttttaaaattttttgtcgatttttcttaataaaatcattaaaattttcaaaaaatttgcccggcggcacctatcggcaccgccggaccataatttactcgattttaccttatttttttaaattttgactccaaaatggcaaaaattagtcttttttggttaaaaatagttacaattcctgtttttgctctccggcgctgaatttttttaaataatctaaacaaattttgaccaaaaaaattcttcggatccccccccccccgaaatttttttctgactattaaaatgttgaaataattatatacatacaaaatccaattataatgatcaaaatcgtcgtaattacggattacggatttccgtaattgaaaatccagttgcgccagccctgattcgcatgggccaaaggcactcggctcgactcgggtggggccgaaaatttggaaatgcaaataaaatacttaatttaaaattttaaataaagagtaccaaaaattgaatgacattgtaaaatatcattattaattgtacacactcaagactcttgaatttcgcttaattgtaattaattaacatatattgtaaacgatggagactttttgttgatcttctcaacgatgctagcttttttatagtaggttttatcaattaacactggacatgattaggattatttccatttatttagttaattacgttttttatctgatattttcctatcatttgcaccttttaatcattttatcacaactttatgatctgatcaatttccactttccattttatgatcttatcaatccaaactttccattttatgatcttatcaatccaaactttccattttatgatcttatcaatccaaactttccattttatgatcttatcaatcc

SEQ ID NO: 19584 - DNA, 1264 bp, Heterodera glycines
  misc_feature (12)..(12): n is a, c, g, or t
  misc_feature (1113)..(1113): n is a, c, g, or t
  misc_feature (1188)..(1188): n is a, c, g, or t
  misc_feature (1218)..(1218): n is a, c, g, or t
  misc_feature (1222)..(1223): n is a, c, g, or t
  misc_feature (1232)..(1232): n is a, c, g, or t
  misc_feature (1241)..(1241): n is a, c, g, or t
aaattcgaatanattttttgactgcaaatttttttccttttttgaatgggttcaaaaaaattttaagagaatttttgattattaatttgaagtcttgaatttatttgacaaatccaagacttaaaactgggagaagcaaggggctgtggctgggggcctaaaatttgggccacattggagaattaattctgatttctgaaaaagtcccagaaataactattttttctttccataccttcttgtagagctcgagctgctctttccaatggtcttatcccggtctcgatccgtgccgaactcacaaagttatggagtgaaatgtgaaatattgttttcaccacaaggcattttttctgaaaaccggattcaaaaatctggggtttggtataaccgttttagaaatagcgtagaaaacagcttcgatatcaagaaaccaagtcaagtccagaaaggaatattttaaaacgatttcgttttgttttggcattatgataccgaataactttcggaaattatggaaacaaaattggagaaattcgaataattttttgactgcaaatttttttccttttttgaattgggttcaaaaaaattttaagagaatttttgattattaatttgaagtcttgaatttatttgacaaatccaagacttaaaactgggagaagcaaggggctgtggctgggggcctaaaatttgggccacattggagaattaattctgatttctgaaaaagtcccagaaataactattttttctttccataccttcttgtagagctcgagctgctctttccaatggtcttatcccggtctcgatccgtgccgaactcacaaagttatggagtgaaatgtgaaatattgttttcaccacaaggcattttttctgaaaaccggattcaaaaatctggggtttggtataaccgttttagaaatagcgtagaaaacagcttcgatatcaagaaaccaagtcaagtccagaaaggaatattttaaaacgatttcgttttgttttggcattatgataccgaataactttcggaaattatggaaacaaaattggagaaattcgaataattttttgactgcaaatttttttccttttttgaattgngttcaaaaaaattttaagagaatttttgattattattttgaagtcttgaatttatttgacaaatccaagacttanaactgggagaagcaaggggctgtggctggngggnnctaaattgngcacattgnagaattattctgatttctgaaaa

SEQ ID NO: 19585 - DNA, 2779 bp, Heterodera glycines
tcgctaattgagccatttgaattggtgaacgaacggactaacgagaagctgacactgatgaacgatggagatggcttttttcaattatttagtgattggctgctaaaacggggcccaattgttgcggagacggcggcggtggttcagaaacagcagcagaagaacgacgaaaattgggacaaattgaacggagtgtgcttcactcttgatggtgattgtattgggtgagcagaaagattggccgtatttttgaatccaaatccaaacattgtgttgctgtatcatccgccgaaagctcttcacatgctctattagccttaaaaacgcgaaaagatttcttagcctttaaaaaaaattatgaagaaaaaacttcaaaatttcgaccttttcgttttgtccgttctcttacacggtttatttcggaatccctgttggtccgggtttttttcattaattacgggctatccttttacagaatgttggttctaatccatttcaaattttgcttaatttaggccgctgtctccgccaggtcaaagcaacgaaaaagtgttctcaattcccggacctagtgatcagtggagcagaaaaagtgatcatttgagaaatcgccgattattttgagttatgaagaattggattgatttgatgatattttgttttttgctctttggacgtacgatataaaagtgagttctaaaatttgctcatttttcaacaataactatttcgagattcttcgtcgttaaaaaatcgcaaccctacttattactaggagtgaattttttaattcaatggaaaaacgacggaaatttggatgccaatttgaacaatatccaatttattttttggggcggcagtaactgcattagagccgaaaatggtcgaaaatataccaatcgatagtcctaggtctgtaatggaagaatccaaaagaatttttttgcggcaaccaatccctgaagagttacagacccgagactgaaatggccaaatggctttgggactgaaccgtccaacagataaaaacgcattgaattgcgacaaaatatataccaatcgattcctctcggcatgtaacccacgaatccgaaagaattttttgatgaaaaagaaattgaaaaaagttatgggtcatcaaaacctaaaaaatgacaaaaaaaaacaatttaagtgagccaaaaaaaaacgcttttgaggactcataacttagaaaaatttcattttctaaagtaaaaaagtgccaaattttttatttttttattaggttttcaatgatataaagaaaattttcaaaaaattttttcgaaataaagttgttttatgggttttctgggtcgaagaattcgattcttatatctatttcggcccatttcgaacccctgacccggactcgaacaaaaattcgaaaattcaattttcgaaaaattctaaatatgcagcaaaaccggttcaaatgcacgaaatactttatcttgccttctgaatcgatttttctgagagattaagcacaacaaattgagatcgatcatttctcaaatacaattaattattcattttcgtacacttaatcagacgacatttttgttgctttgatccgcttcttcttctccttctttttcttccgctggtggcgccaatggcctaaaattaattaaatattttatttttcgataaaattcaaatgctgttgctgctcacccaatggatttatcgaaactccacagatcaaatctgacattgttcaaattggcactcggattttcgcggttttcccacttaactggcgccgtcgccgtctccccaattgggcaccgttgcaacagccaattatacacatttaagtcgaattcgtcgatctcctgtttcagtgtcagcttttctttcgtcacttcgttatccaattcaaatggttcaattggcattggttccacccaaaaataaagttgaattttgtaactgacagaagtggtggcacggcgaaatgtctaaacaaaattggtaaaataaaaacaatttgacgaaaattctggcgagacgacctctttgaagctgttgacccattcgaaatttggtggactcacataagcacggaaacgtaattgctttggttgtccattttttgtcggagtgtgcagccatttggccaaagcttggccagcagttgcattgggtccatcgtcagcaattccttctgggcacagatgaccggaattgatcgaatgcaattcatcaagatcagtgagaagtgtcggcgaagtgcgacgacgcaaattgtccaaagcattggcattatgaagacccaaatgacgaatgcttttcgcaaaaataggccaaatttcgcgggtaaaaacatcccaaatcggttggacatacgtatcaattgaatgcacaaacacttccaatttggtgccacttttgtcaaagaatcgcttcttggagcggaaaaatttgatcacggaatggtcaatgtagctgaagaaagataaaaatgctttagcgtacacaaaagttaagactgactgaatctgaaggttcttaaagcaaattttgttgggcagttgacgatccgacaacggaaaatccacaaaactgccatcgatccgtacagacactttcggttttggtccattatcgtttgcatttggtccttcgtcctttacaattctgattgttctccaaattgtcaattcgctttttccatcaaaatgcgtgtccaccaaaacatcaaaacgataggaaagcaatgccattttgagtccgagttgggccaatggtc

SEQ ID NO: 19586 - DNA, 3455 bp, Heterodera glycines
aggaaagcaatacttcgtaagggatttggtggacatcttaacaggggaaagatgggcatttggccatggagagaaagtcgagagtgattctcgaatgtggcttttcgagactgactcccgggtggtttatatgaattttcgagactgattctcgaaatgcctttgctttttgtccctcaactgaccctcgagtccgttggccttccacgtttccattatccgatcggccacctttttgtttgcttctgtccccgcgacgtgcggcttctcagcgaatgcctccaaattggccgctattttatccgaattgatattggcgaagatggacgaacggatatcttaaatcagttcatttttgtatttttattttttccatttttctaccttccgacccaaattcttttcgtttctcgccattttgtgtggtcacttggatgacgagcacggcgattagcagcccggtgataataaccaagcacagagacacaaatgccagaaaataggcttggtttcgcgaaagtcgaaaacgaaccgcagaatccgactttaaattgtatgcatccatagaatcaccaaaaaaagataaaagggaaattatcaaccaaaaataattaattaattagttaattaataaataatatttcaaaatttggaagaaaatggccatatttcttaggaggaatctctctcgttttggtacggcggagaattctcattaaaagagtcaaacagtgaatgaagaaagcattctcattctcaattagtcccttatcactaattaccattttgccattttgccattgtgattttaagcaattttgtgctttcattttctgttgatttcactgataagccaaaaataatgtgaattaattgttaagcaaacactttttttcttttatgtttccgaatttcttaaatagttattagtcatcattaattaaatgattaaattccaaatttcattaaattatttgtggcaattttttaagcagctattaaaatgccatatttacacgtaattgccattttttcttgtaatttttttttatcactctttgagatgccgctggacgagcttttgggtaagtttttttttcattgtcaactaaattgaacattgttagtattactatgggatgacagttttagacaaaaaaatcgccaaaaaagggccgaaaaaatcaaaaattccaaaggcatgaaaaaggcaaaaaattaaaaaaggcagcaaaaaactgcgctaattttctcaaatttttccataattgatttgatgatttgaaatatttctgaagaaaaaataaataatttatttttatttaacttgaaaaatggtaaaatattttttgcaagttccaattgttttcttcacacgattccgttcagtgcccattttcggtgaaattctttaaaattaggggtccctattttaggtgcaaaaaaaccaaaaataagggcggggccaagaaaatgcttcatttggcattccgcaatcaatttcaattgttttggtgtttttgtaatcttaataacttacatttttctatagttttttgcccatttttgaaataaaaaggacggttcttacgacatttttcggtcccattttgcctatgcttttttccctcccctccaaaataattttagctttttaatatacgctacagaaaaaagcatcgtgtctttttttggcactgcaaatcatttaaattttttattaattgatttgtatttgccatcaaatggctggcaaattcgagtggtttcctatattttttaaaacatatgcattttataaagaattgtaaaatatttccaaattcacagatggcgcaatttcttaaaaactttttgtttgctatgattttgttcattgaatttgttgttgttgttgttgttgaaagggaagagaaagtaaaattaataattttaaaatattaaaaaataatttaaaatttaatgacagaacaaaatcttcgaatgcccaaaggaaaatgcacggcctgaacagttgagggaattggacaagaaagagcgaagtgaaagaggtacgaaggaaaacaatgaaaataattaattaattaaaccaattaatttattaattactttatttattatgttgttttattttcgaaaaaatcaaaaatcatttgattttgctctaacatatacaatataagaaaaaaaataataattcaaatctgcttaagaatttgaacttttgtatgaaatgcaagaaacattcaaaaaaatgttttctgaagattcaacagttacttacaataatccaattacaaaaaatctgctcaatcgccgaataccaaaatggcacttcgaatttattgtcgaaaaagcatttcaacttttgagaagaataaaagtaaagcttaatttgtatatctattaaagatcagagaaagcattacattatctgctgatatagcatatcagcaccatctttaacatgatatcaccaaatcggtcgaaacaatttttgcatttttggtttttgaaatattttattattttttagtttgccttttttgacaggaaattttctaataatttagttctcattttaccataattttaagcttctgttccatattttccactgtgaaaaaagaagagaacatttctgctgtttaaaaataatttgtttttttaattaagcaaattgatctaacaaattttgaaaaatggaatcaaacccaagaaaaacatgaaaaagaatggcaaaaaatatcggaaaagggcgaatatttccatcgcaaaatatgccttctgcagggatttgcgcatcgaattgtacgcgacgaaacactgaaggaaaactcagaatggcaaaagtttcatatttcagtggcctccgaaatatttggcatcggagaagaaagcgaatttgaagaggtaattaacgaatttgaagaggtaattaattgatacgtaaaaaacagtggcaatttggggtaacgccaaggcatacggcagcttttatgtgccaatgcaaaaaaccatccgaaatttgttctgtttggccccaacttaggcaatttcgtataaatattcttaacgcacgaataaatacaaaacaaattaacttttacaaaacattaattttatttggaaatgccttttgattttaagaataattttgcaattttaactgaagaggaatacatggaacatgtaaaaaaatgtgaggaatcggaagaatattcaagaaaaattggagattatatgctttcttcgactttgaacaaatcgttttatcggtaagcggcgacggatttgggaaaatttaaattattttaacatttttattttgtattatcaaataattaaaatactttagaatgtgtcttcataaagtaatttcaaattccgaagaattccaacactttctgtgttatcacaaaagcatttgaaaaatacaaaaaatcgctttatct

SEQ ID NO: 19587 - DNA, 1938 bp, Heterodera glycines
ggttttgttatttctgttaccgattgatcatttgggttttttgaatgtcacaggaaaaaaaattgttgttgtttgtcaacacacggttctcgagcagtacaccactgctcaagttgtgatttgtccacacatttttttcatttaaattcgttcttttttttacagaaagtgttgaatttgcatttgattcaatgacgaaaggaacttcttcgtttggcaagcgccacaacaaaacccacacgttgtgccgtcgctgtggtcggtcctcataccacatccagaagcacacttgctcttcctgtggctatccggagaagcgaaagcgcactttcgatggtgggttttgcaaacgaaacgaatttctcggagcggaggactcagtgtgaaaacgaaatttgcaaaagcagaatgtccaaataaacaccaaattcatgaactgcaagcaatttggttttcggacccccccccccccatttacataagtgttacatttcttcaaaaagacccgcaaacgtttcattctcaattcattaaaaggccatcgctttcttccacaggtctgtcaagtccatccgccgacgcaccaccggcaccggccgaatgcgtcatctgaagcttgtgcaccgccgcttccgcaacggattccgcgagggagtgaccgcgccgcgcaaaggcggagtgaaagcgtgagaagagtgaagaaaaaaggcatcaaaagatgatggaaaatgttttgttgttgactgattgttacaagaaaaaaatggtcatttttcattcgatatgtctgctacggatggcacggaattttcctacattttggggcggaattccgacaagcaaagattttaaaatttcctcggctccaattacggatcccaaacattacttttttcttaaaaattggcccaaaatcgcaaaaataaaatagtcattttagggattttcagggcggggaatccaattctgggtaatagttaagatggtagcccctattttttggcggaaattttcaaaatttaaaaagtcgttcaaaactagtttctagaggctttcggggtcgctgatcacgatccgggcatccatttcgcccaatttcgaaccccgaacccgaattcgaacaaaaactcgaaacttcaaatttcgcttttttcgtcggaaaagggtttaatgatcttttattgcaatattcgtggttttcagaatgtttccgtgtattttaatcattttttgttgaaaaaagcgcaccgcaaatcttaaaatggacaaaaatatatggaaatccaatccatgtaaatccgggccctaatcatgggcaatcaccgcacctcattaacgccttctgcaccactttgctgatcacaacggttccttgccggaaatgccctcaaagttggcactgtcggtggatgggtggcggtccggtgaaataggaaaacgaattcgatttcgtaaaaatttaagtttttggcgcaaaattttgggttttttccaatttcgtaaaatttcacatttttacaagtgctttttctatttttgccaacgaatgccgtcctgcggattattatgtggcacaatcggtccccttttgattttgaaccaaagagacaatgtgacctactgtatttgctgatgcttttgcagtggtactgtggcctcaaatggcaacaatcgttccaattgccgatgccatcgttcaccctcagcgtttggcacatttgacggagaacaaattcaacaaaattgccgaatcaaaacccattcattcattttggaaacaattcaatattcagcaaaaccaatccgagaccaaacgagttttatgaattttttaattgtaagaccatacgatcgatcggatacagtacgagtttttgatgaaaaaatatttttaaaattcaaaaattttcattttttggaaatttgaaaaattaaaaa

SEQ ID NO: 19588 - DNA, 1006 bp, Heterodera glycines
  misc_feature (11)..(11): n is a, c, g, or t
actttttgatntttatgttttttcactgtcacttttgtcacccctttggcatgaaaactcgagaatcaagtcgtaatgccatccatcccccagctgaaaatccaatctttggttttatgtcattttaatgaattactaaaaagtaatgctttggctaatttattccgtcaaattgcaaattattgggcatggaatagctgatgaaagcggaccgacagcagttcgtgttttgatgcttcttcacttagctagcgaaagctcttcattaatatttgccataaaatttttggctcgtaaaagccaactaatttatttggtttaaattatttcctaaaatattatataatttaaatatagacaatctcggcttatcctcaatgaaaggcgactgatactgtacttctttaatttgatcatgttactgtttttgctaatcaaaaatttgtctgacattcccaaaatatgttcattcacaaatttatcggcaaaatggtgaatatgaaaattaaaataaaataaaaataaaattggttttcaataattgttcgcttttttgtcgtcttaaatgtcaatcatcatcagaagattgaaaagctaaaaagttttaaatcagcatcaaaagttagataaactttaatatttgaggtttttctgtgctcttaaatttgagcttcaaattttccttcttcaggcgcataccgtattatctctaattatcccccgtctccatttatcccatcgtatctaattatcccctccccccttttctgatgaggttgagaaataatcccccgggggataattagagataacacagaattttttcccgcacatattgcttagtgcgcacacttttttggagataaacattttaacaattttggcatttttccggtgtactgtatttcatatttgattttacatatttatgtattatatttacgattttcctttcatgtgtaaatccaatccctcttcatcatcggcaaataaaagaatataaaaa

SEQ ID NO: 19589 - DNA, 1888 bp, Heterodera glycines
  misc_feature (1793)..(1794): n is a, c, g, or t
  misc_feature (1806)..(1806): n is a, c, g, or t
  misc_feature (1867)..(1867): n is a, c, g, or t
catttcgtgaaaaagcaaaggtaatgctaaaagtggcagacatttgtgtcccaattactatttattttgtaaatgaacaaaaatccgtctgcaaccgagattatcaattaattctcggatgtgactcactccgacattttggctcttttaccgtaaatatagacaaaaacaaaattcaaattgggacacaatggataagcttaggctccaaaaattatgaattaatgaacaatattcgagcctttgctgccgaaaattacacaattccaccttcaagccaagtaatgatcagagcaaacattaaaactgcctcacagccaaaacacagcttagttgtggataaacctgatttaaatttaataagcaatgaccttgggattgtaccaagtgtgtcggctccatttgtggaagatatcccgttgacaataattaatccatcaaatgatcctaagattttattcaaaggcatgcatttagcctatttaaacgaaatagtcgaaaatgatggaattttctacgaatcagaccaggagaaaattaaaagcgggaatcctgacccaaatggattaactgatccatcattcaaaattgacctctcaaaatctgacattaatgaaagagaaagagaagcacttaaaaatcttttagaagaatttaaggacatattttcaaaaagtcaatatgatttaggctcattttcaggtggcgaacatcattttgacacgacaaccgaagctccaatttcttcgccgccaagacgaatgccatataaatacagagatgaattaaagaagcatattgaacaattgcttaataaaggagtaatggttgaatctgagacaccatgggtcaccccttttgtagtagtacagaaaaaggatggtggaattagaccatgtttagattttcgaaaattaaacgaggtaatgatacccgacagatacccactcccgagattagactcaattatggaaaaagtcggaagttgcaaattctacagtagcttggacttatcctcaggatatatgcaaatcaaactcagtgatgacacatcatggaaatgtggcgtcataacggaggacaatgtgtatcaaatgcgatacatgccttttggtttaaaaaatgcgactgcggcattttcgagagccatggcagtggtattaagtggtttagaagactgctctctgtcatatgttgatgatgttttagtctacaccaaggacggtactttttgggaccacctaagctccctcagacgagtttttataaatttaggctttacaattagaaactgagtcctaaaaagtgtgtatttgccacccaagaaatgatgtttttgggtttcacattaaacacccaagggtacaagccgagcatgagtcgaattgaaataattcaataaatgtcaactcctaaaaatcttaaagatgttaaaagagtactcggaaaaaaaggattttacagaaggcatattcctaattttgctacggtagttgaaccattattacgtctctcgagacgagacgtcccgtttgaatggagtgctgaacatgataagacatttaaccatataaaagaattactgtcccaagcaccaaatttggtctttcctgattattcaaaaacatttcacatattttcagatgcttcaatggtcgggcttggtgcagtcttaatgcagaaaaatgaattaggcacattttcggccatttcttactgttgccggaccctctctgcatcaaaacgccgttggcctccgctacaaattgaattatgcgcaattatttatgctnntacgcaatttanaccatttattttttaagtgatatcgaattacatactgaccataaaaccgtagcatttttgntaaaaaagtctgatacacatc

SEQ ID NO: 19590 - DNA, 2445 bp, Heterodera glycines
tttaatttagcgaatttttttcgccaattttcacagtttaattataagttagaaattctataaaaaagaaagaaaaaagttatgtcaaataagtagggcagcaacttttagtgacgaaaaatcccgaaatagttaactaaaatagtgaataaaaatgccaaaatagtgagtaaaaatgccaaaatagtgacaaaatagtgtcaaaaaagtccgaaatagtgacgaatagtgacataattttcagccaaaaaataagccaaaataatttttattcactgattgcagttgcaaatgagttggactgggatttttaagaccaaaaaacccaaaatagttacctaaaaaaatttttaaaattaaaaatttttgccaagaaagtaaatttttgagaacattttttttcatttctaggagtatattttgaaaaattttagcttgattcttaggggtgtatttttttgaaattttttaggtcaattcttaggggtgtattttttggttttattgcatttttgttaaggaattttgcccaaaaatgtcaaaatagtgacaaaacgccaaaatagtgatttttaactattttagtgacaaaaccccaaaatagtgatttctagtgacgaaaagtgacgtccaaatgagaaaattttaacgcagaaatgcgttttttgagctcctttcttcaaaacaatcgagcaaaaaaaaaagttttttcactaaaagttgctgccctacaaataagacttctctccaattgagacagatcgctttgcatcagcttaccttcactaattcaatttggaataatgaatttattaaaatttcttattatttttttctttatttagacagttctatcgagaaatagtggtccgaaaagtcgcactacgaaccaagaacctgtttttgcccgacaattctttgtagtgcaacgccaatttccaccaactgctacaatcgaagtatttccaccacatcaaggacatgagcgacgcgaatgcaagagtcccaaatgctcaagccattcgacaaaatcattgtcattcaaagccagtttttcatgcaattttttcaatgtaaaattttgaaactcttccaatacagccatttaggtatattaagcgctgaaaacatagttaaaagctcaacaatttacaaatgtgaatttttaaaatttaaatttttgtttgaatccgcggatttggccgaaatggatgacggactcgtgatcagcgtccccgaaaacctttgaaaatgtattttcatgacttacaaaaaatttaattttgaactttttgttcgaattcgggttcgggattcgaaaaaagggggcccaccaccatccatagtcttacccgcaatttttgtcgattattttgtgcaaatctcaaatttgtgtgttttcgtacattttttgccatttttatgcatctgatttatttaccgaaattgagaggtttttcttcataaaatgcatttgatcactgatgaattaggtcattttcgtggtgagtcgaagtgacaaaaaggcaaatgtgggcgaagtgacaaaaaggcaaatgtgggcgaagtgacaaaaaggcaaatgtgggcgaagtgacaaaaaggcaaatgtgggcgaagtgacaaaaaggcaaatgtgggcgaagtgacaaaaaggcaaatgagtggtgatcagaagaggcgggtcatttcagtaccgaataatattttaattaattaataatataactattttaatatgttaattatatttgctggccctaattataatttagctttatatttaatatttcccaaccaaattacatttttaagagagaaataatattcataagcatagtttactcttacaaatacatgattgtgtgatcgatataagattttataattagcattcaaattcgagttggttcaagtatcacttcaaagtgatttgaagagtttaaaataaaaatggttggcgtttcacggtcttgatcagcgaccatcttaatataatagagagcctttttttattttataaaaattaatgttagtcttttacggaatgatccatattgggagtaaaaatctgccaaaaatattcctctctatcttgtttttcaaattttatttctggtatgtttggactttcttttgatgtatcagaattggcactcttaattttacaaagatatagcctcaaactacgttctgccaatttaatccctttttttgttagttcagcatgtaattctttaatagttttgattcgcttttcttggtaattttggatcgacttcattgcttcttgattttcaagaaagtcctcaaattttgactttatatttgacgtaaagtcaatgaagcagaggccaacaaaaagtttcaaaagtagacttttcattctatactcattatcaattcggtaataaattattaaagacaaagtaatagtgggatatt

SEQ ID NO: 19591 - DNA, 1788 bp, Heterodera glycines
  misc_feature (1696)..(1696): n is a, c, g, or t
  misc_feature (1764)..(1764): n is a, c, g, or t
agaggtacaacagtgattagaagaggtacaactgtgattagaagaggtacaacagtcattagaaaaggtacaaaattgttaaaagaggtacaaaagtgattagaagaggtacaactgtgattagaagaggtacaacagtgattaaaagaggaagaacagtgattaaaagaggtacaatagtgattaaaagaggaagaacagtgattagaagaggtacaaaagtgatgagaagaggtacaacagtgattagaagaggtacaactgtgattagaagaggtacaaaagtcattagaagaggtacaaaagtgttagaagaggtacaactgtgattgattagaagaggtacaactgtgattagaagaggtgcaacagtgattagaagaggtgtaacagtgattagaagaggtacaacagtgattagaagaggtacaacagagattagaagaggtacaacagagattagaagaggtacaaactgtgattaggagaggtacaatggtgattagaagaggtacaaaagtgattagaacaggtgaaaaagtgattagaagaggtacaacagagattagaagaggtacaacagagattagaagaggtacaaatttgatgaagaggtacaaagtgatttaaagaggtacaaactgtgattaggagaggtacaatggtgattagaagaggtacaaaagtgattagaacaggtgaaaaagtgattagaagaggtacaactgtgattgattagaagagctacaactgtgattagaagaggtgcaacagtgattagaagaggtgtaacagtgattagaagaggtgcaacagtgattagaagaggtgtaacagtgattagaagaggtgcaacagtgattagaagaggtgtaacagtgataagaagaggttcaacatggtttaaaattatataaataaggaaaagttttttattaaagaataaaaatcgaatgcattgaatatttaagaaatttgaaatgatattattttttacagataaaaaataataatgaaattatttattaaaaaaaaatttaaaatttacaaccaatcttcaaattaattaaaagcattgaaaaataactcaaaaataaatagaaaaataatgttacaccgtccggatccgaacctgccccctcccccctcaaaattatgtctcagaatccccaatcacacagggattctgaggtcttgacgatgtcaaaagtaaaatctgatcacgtattcgtgatcagcgtcataaaatagccctaatgacatgtttttggaagatttttggtgaaaaaaatttttcaatcaaaaatcctatgctcacccctttggtcccgaatcccaaaatcacttttatttttataacaattcgcaaaaaagtgataaaaatgccaaataaaatttatattatagagaaaaaaattgcggatttttgtagtattttacttttccagaatatcttttcagaaccgagttatgaatttttttctgaaaattcgaatttttccagaaattctggaataacttttttcttttttgtgataaaaaactcaaataaatcccataaaattctccttatttttctctatttttaaagctttattatagttaaatcgatgaaaccatcaccgagttatgaattttcaaatatttggccaaaatcccgagggcaaaaaattgccaaaaaataaagaatttttanaaaattccaaaaatcatgaaacgaaaaacaaaggtcaaattcgagctcagcaccttatttaccccagngaaaattttttcacccccattttc

SEQ ID NO: 19592 - DNA, 1670 bp, Heterodera glycines
  misc_feature (74)..(74): n is a, c, g, or t
ttttcataaattcaaagagatattctctgaatagagccacaatataatttatctttaaaaagtttcagtttcgnaggctaacaattagagaccggacaagagggtcggtcggtcagtttcggtataaaaaccgaaaaaaaccgaaaccgaaaaaaaccgaaaaactcaaaaaattttcggtcggtcggtttcggttaaaaaaccgaagaaaaattttcggtatatcgtttcggtttcggttttttttgaatttttatatttttccaaaaaagcaataaaacatttttattaacagtaaaatgtttttaatatttatattgtgtttgacgacaaaaattgaaagaaattgaagacacaaccttatcaatgcgtttgaagtgtccgaccaaatatccgacgtaaaagcaatttttgagcattcgtccaattcattttggacctttgatttgacattctgtagaccattggaagaatttttttacgataaattgactcatccttcaatttgtgcaacggattgtttcccatgaaaagtgcgattgttgtcgggttgttgatatcggagaaagatgattgggtgcatgcgatccaatgaattacttttttgtcgaatgatgaaagaccctcttaaaaattaaaaaaaaccaatacatatgcacatttaatataacgtaccacttcctaagaccaagtgtgtttcgattgtccctttctcacctcgcttctgcttcaacaaatcttcatatttcgcctcatattcgctgtttttgtgtttagatttaaggtggtttatagcattggaggtgttgcctttcttacatataatattcttacaacattcggcacattcgtactcgaaatcattgttgttgctttttttataaagcccgatttgccaaatcacacttccagagggcatgttgactattgctgtaatgtttgttttatatcactaaattaaaaagaaatgaaaattagtgataaacttttcaaaagtccgaaaacttaatcaaaaaccatcgaatttcaaacagtatattatgccaaaaattgttattaacgggttatgtcgcttcaatcgccagtcggtttttttcggtttttgaaaaaagtcggtcggttttttcggttttttgattatttcagtcggtcggcttcggtataaaaaccgaaaaaaaaccgaaaccgaaaaaaaccgaaaccgaaaaaaaccgaaaccgaaaaactcaaaaatttctcggtcggtttttttcggttaaaaaccgaaaccgaaaaatacagaaaaaaccgaccggtccgatctctactaacaatcgatttttagctcaaatttactgtttactgtttttcgagtcaaaatttcaataatctagatcaaaaacaaaatattatttgttgtgaaataaattttattaaaaatttaatcgtgaaaagatttccttctgctttttttattttgctttttttattagcagaaacaaatgcatagaattggaaaactcaattggaacctaattgattaaatttttaaggcatattacaccctaattaatctctttttttgcattgattcgaaaaggatatttattcaacatattttataatttcttgatcaaaaaatatttgaatattttattaatgataatttacgttataaaaaaaccatgcaa

SEQ ID NO: 19593 - DNA, 1099 bp, Heterodera glycines
ttcgaccggccgaacgaccccaaattttcattttcatttggcaaatgatgggaaattagaaaaaatgcacagtgttaacaataagtggaaaatgcgtgttttagtatgtgtttgttttttgaatggttgtcacagcatttaaattttcaaaatttagtacttttctacctcttttctctcctgtttccaacttttcactctctctctctctttcccctctatttctttcttttttctcctttcctcttttcaacttttttctccgttttttcccattaatcgtccatttattcccttttccatccgcttaattttaatttgtattttctcattacccatcaaaataacagtacgattgtgtgtgttctttgttcgcattattctcacataaatatcacacaaatctctcaaagttcgcaatttttccctattattacaaattgaaaaaaaattgtctcgtaaattatgcgaaacgaaaagtgcagtcgcctttcgccaaattttttttgggatgtttgttcgaaaatgtttaaaaacgtccaaatgatgggacaaagtccgcttacgacgcctttacttttggatggaatgggtcagtcatcagtaatctccaacaagaagtctcttttatcaatttcaataataataattgttaaaattaaaatagccttttttctccgtcccaattcgacgcgctttccttttcatttgcataattttctttcatttttatccgtccatttttgtcttatgtacgttttccacagttaatcttctcaagtgccacttccaatctttcatcatttttttgtcgcctttgcgcagacattaaaaggggcgaatggggcacattttgtcaaattgcttacatttaatttgcttaattaacacacacatttgtgtgtcccactgacttttgaactgtccattagttcgaccaaatcacacagcatttcatttcatttcgttgtaattccttctctcccttttgcacaacattcgcttttggtcgattgcccccccccctttttttcccttttttttctcggccctttcgaaacactcacatcataaaacaaataatcgcaatcacccctcc

SEQ ID NO: 19594 - DNA, 846 bp, Heterodera glycines
tgatggttgtgtgtgcttttctgccgatgtttggttgggacgtatagcgcgaggaagggaggagggagggagaaggctgtttcgccccaagtcgtcgtcccctgctgcacattcaatccccccattcagttgagaggaatggaaggggagaaaaacgccgccagctcggcagtactcttttttccgctcccctaccgtttcccccccccccacccctcccatccatcgcatctgctccactgggctcagggcggaatggatgggactgctgatgtatgtgtgagaggggaaaataagagaaatggggcgacggggaagggggacggacggaatgggaatggaagaaaaggaaagggtaaagggggaccgacccaccaaccaaccaacaaaacgcgaaaattgggcgggggggaagggggatgatatgaagttctaaaaatacgagaactgatggggtgaattggagaagggaacgggggggaggcgtaagaagacgcttttttgtgggacataaaatgatgcaaaagaggcaaaagtttgattcatttactccgctggtcggatccaaaaagcaaaaaattttctggaccaaaatttttataaaaacatagttaagaggacgaagtaagtcagcaaaagaagcaattggtataagatgaaggccaaaatgggtgcaaatgcaaataaaattcaaaggcaacaaaaagaaaggcacataaagtgaatggatgaaaatgcataggcatggagagatttgacttttaaatggcatttaacgccttcccaaagtgtgcaaaatgtgtgtgaaggggtcgaatgactccaaaaattcgagtcgattaaaac

SEQ ID NO: 19595 - DNA, 3902 bp, Heterodera glycines
  misc_feature (1648)..(1648): n is a, c, g, or t
atgcaaagtttaagcccagaaaatcaaaaagaaattgaaatatttgccaaacattgctttgccgcgttgaaattgtttcaacaattcatcaccggtatttctttatgcaaataattaagtttcagtcagaagcaaaatattcatcaaaattgctaaaaacgcttattctgggctctattgcactttatgaatataaagttacaaaagaaattactcaacaattacttaattaatctaatcttttttggcaattgcctaacgctgagattttatatatatttgcttcttaaagcttttcgttcggatgatactaaaaagataggggtttgttcgaataggacattacggtggataatcgatcaaatgatgacagatcgcggcaatttgaatccgcgattcgcacgcggtttttctcgcgctccaccccttgttttacagcgaaagatttgagaaaattcatttttcctactaatgaaaacaatatcagcagcttactgttttatacaacaacaaattaagatgagcggttgtctcagactttgctcgctggtggaggacagacagtgtctgatcaaagctcagccttatcagctcaaccggcgcccactcgatctgatcggcaacagaaagggaagtcgtcacggcgaagaaaaaggggcgattggatgcccgatgggtcgagtaaatggccaaaatgcgttggtgccgttttgttggccggcttttccggctatatgtgcactttgttttggatcatcttggcccggagtcatattaatccattcacttacttttctgctgatgacctctctgttcattatcatcctcatattccgttgggaacggcggtggtaattgctgtgtacatgtcctttgttgtttgcttggtcagcatctttttgggcatttatcattgctttgtcaagcgttcttattagggaaacgatttttagggttttactttttttactgagctctctatggtctgaaacacaccaaaaacaagttttttttttctttggtgactgtagagctacttatagtgttattagcacctattttctaggtttttttttttagaacctaaaacctaaaagaaatttgaattattttggcattttgccaaaaatttagtaacaaaaatgcaataaaaaaggaaaaacacaccctctatgaataaacccgagaatttctgaaaataaaacctaataaatgaaaatttgtattatttatttccatgacaagaatttaaaattttaaaaattagtatctcaatactaatctgggcttaattttttgctttttggaaattgttttcttattttacacccctaaatttgaagctttttggcacctagtttcctatttttagcacctattttggcatttttagaacctaaaactaactttttggcagtttttagaacctcttcgtatcactaattattaatggggggggggatctgctttatcggtcacaattaggctgggctggaaaattggatccaaacttttaggccatattttatatgactttattttttaattaataaatatgacgataatcattttttgatacatagtgagaaaatttttggttttagctaaaattcttaacaaaaatgcaataaaaacaaaatgatctacnttttttcttcaaaaacattcatcattaatattgatttgttcaaaaaaaaatttgaccaaaaatttacacacgcctaaatttgtggctatttttagataattttctattttcgcgcatatttttgtgcttttatttgacggttttctaaatttaaaatatctaaatatggataacaatttttaaaattgataaaaaatagtcaaaactactatttgggctgaaccatccaataggtagaaacgcgataatggctagcaaaatatatatcaatcggttccttttgcatttcaattacgaatccgaaagaattttcggacaaaaaggaattgacaaaaggaattgtcaacgaaaaccttcgcaaatgaatttgataaaaaaatttaggtgagccaaaaacactcaaaatcacttgaagattttgaactatgtaaaaagcaaattaaataaatccttataaaagcttttggctcacctaaattattattttttgtcaaagtaattttcggaggtttttgaggataagtcagtttgattttgtcagaaaattctttcgggtgcgtaattgaaatgctgggagaaattgtttgataagtaatttgttgatcatttatgcgtctttattgttttttcttcttttttaatgtttggtttttcctttctttattaataattttttgcttgaaactttctttttgccgacccattatttatttatttaatgtaatcactgattttgactttcttcagtccccgtgaaaatcgtatagaattttacaacatgatagccaataaaatttttaaaaataccgttttataaagcgatcacgcatagaatttccaaaaattttcattttatttgttattatccataggcgatttggtccatttggcgttagaaattccaattttttcggcaatccaaatattggactcgagatatttttttaggaaataatcgcttataatgtctaaaaaaattttttaaattttttttgttgtcgcattaacctgtcattttttcgttgtatatttgctgagaatttcttttttattcataaatactttttagccattcgaaaattcaaaaataaattaaaaataaattcttcaataatatgagatcttttagcagttttcacattttagcaccttattaaagggtcgcaacatttattaatttaacttctttttttgttccattgttttgaagaaagaaactcaaaaaacgcgtttctgtgttgaaattttcaattatgatgtattatccgtcactgtaaatcactatttggcgcttcgtttttgctcaatttttggatgaaaattatgtcactattcggacttttggttacttttgtcactatttgtcaatattttggcatttttcaggccctaagcatatcccagaataatcgctgccgagcatatttgaaaatctgtaagcaagatttagaaagataattatcaaggattatcctaagattttaaagatttaactgactatcattgagattactgtaaagttttaagcagggtttttaaaggctcaacacagcagcgcttgttctgaacttttttcggttcatattaaaatccaaaaaaatttaaaaatgcaactatcttagcaccatcctttttctacgcatttttttataaaagtttattcaaaaaaagaaaaagtggacgccccggacggtgtgaatgagtacgagtgcgaaatacaacaaccgcatccgggtgcggaggaagaacaagtggaagatgggaaacattggaaacacaaaattttatttttatttatcgagcaaaccaaagtgtacattagtgctcttacagggtgcgaatgagaaacaaagtggtcggtgccaaacagcggcgccgggataccccccgccccaacaattcattagtaataacctccctcccgacattatcttcagggccttcgtttttctttgttgactaaacataacatcaatgatatcattcgaaagctctggatcttttgaagatatttgtgagctatttctaagtgattaagaagctcacaaaaaagatgtcgcttgaaaaccgcaaaaaaggcaaaattttcgaagttttttatctctatctttttttacagttcgttattatctgtaattattagtaggtcaatagagcctgtgaagagctttcgaatgatgtcaagattgtcggattcggtcagcaatataaaaagttatgctactcaaaacttggctgggacggagttggcggg

SEQ ID NO: 19596 - DNA, 1352 bp, Heterodera glycines
caaaggcgtagccagaccctcggcttcaggggtggtgctaaagtcaaaaattgatttttagggtgtatttttcatcttcaattgatttttattggtgtaaaaaagttaattgcatcatcatgatcagatcatgcccccagggtgactgaaagtaaaattttagcagcccagtggagttaggtctgctctagcaattgtcctacatagaaaagtaaaatagggatggaaaatttttcgcggaatatttttttttttgcttacattttaaaaaatcaaacaaccataacataattgaagaagaaatgcataaaaaacattaaaaataataaaaggatcagtattagtgaacatttatcccacaaagttgcaaaatcccatttaaatttcggtccaaaattcgcctcaattttgtcaccagtgtcgtacaaagaaacgaatggatgaagataatcaccaacaagaaatggagaatagataaaatcatagcagtctgtgaaaaaaggcaattaatttgaatataatttaagaatttttaaattaaattatttatttatttatttccaacccaaacattgtccatttttggtgaaaatgattcgcagagaggcaaaattaacggcaattcctacggtatcaccaacaccgtaggaaaattgggttattcctcttccctctccgtaaatccaaagctcccctttactgtcatatgcacaaatgcccttgcggctacgatttatcccttcaaattttgtttgctgattgacggcgaatccgaagctaatccgactggaaaatgaaaatttataataaacgaatggtaactaataataataacaataattaagttttttgatttctgatatataaataaatttcttactttttcatatttttgaccgaaatttcataataaaaaatgacgggcgaattattgctcagcaaaattgaatgttttgcaaacacggaacacgaacctttagagggaaaaaaagattaggcaaatattgagcatagtccctaaactcaaaaatgcttaaaacggtcagaatcgatgtaaaaggtttaaaatggttggaaaaataattagcttgctctttttcaatctgaaaaagtgctgagaatgaagtaccaattcccgccgggactcagtgagtcacactataaaaagcgctcaaaaaacattttaagtgtgtaaaccggaacgctcacaggttgggcgtgcacgggaggccgtcagcatgctttttccctataagttttttctttgtcatccaaatccaacaatcttggtatcactcgaaagctctttacatgctctattagatttacaaaaaacaaaaagattttcaagc

SEQ ID NO: 19597 - DNA, 947 bp, Heterodera glycines
  misc_feature (105)..(105): n is a, c, g, or t
  misc_feature (167)..(167): n is a, c, g, or t
  misc_feature (188)..(188): n is a, c, g, or t
  misc_feature (933)..(933): n is a, c, g, or t
ttttacatcgattcttacttttttaagcatttttgagtttgggagtatgattcatatttagaaaaattatataaatgttcaaaaataccagaatcatttccctgntaatggacagtcaaattttttcgccaatgatttcgagattctcatcacaattattggcatcncaaaaattttgtcgaaaattnaaaagcatcttaaaatggtgtttaaatttaaaaaaaaaattaaatattgatgattataaaacaattaattaattataaaagatttattttttagaaattaaattttaattcatttttccctttttacctttctcggattctgtactctctccaattcactgattttttccaacatttttgacaattgattctcagtagcttaaaaatcgaatcaatttttaaatttaaatataattatttaatattgacaaattttatttttgttttaatttctcctcgccgtttgtctgttctttttgttgcttttccaattcactaattttttccaaaagtttcttctgatcattttgtaattgtgagaatcgttcttcagtatcagcttaaactataaaacaatttcattcaaaatgatgaaaaataatattttctcctttataataatgttttattacctgcgtttgttggcgtttctctttcttgtttctttcgcccatcttcatcgtctagacgaaactcatcatcatccgatcctagaaataattttaagttttgatataattaaaaaagttagccacattaattcgtgaccggaaaataggtcagtggaaaatgcgtcagtgatacaaatatttaaaataaagttctatccgtttttgaaaccaaaaatgctgaattcaaaaatctggactttcgactttttgttcgaattcgggtccggagttcggaatttggtcagtggccccanaaatgcaaggaact

SEQ ID NO: 19598 - DNA, 3011 bp, Heterodera glycines
atcccatttttcttctgtttttaatacttcaattttttactagattggttcttccatcttgaaatgctctttctatctttttgtaatgtttttgcaatttctttgtcagtcatttttatgttttctttttttgtttgccaataaattttcattttttccattttttcgttctccgttattttacagcgaattccaaattgtttcttccatttttcaattgttgaacggctaattccgattttcttacaaatttcggcataatttttctcccattctttttgcgaatattttctgttttgtttaaattcatttttcattacaatgaatttttgcacaattttgcgtttttgttcatcagtttttgatttgtgatatttataaagtccaatttctttaatccattcataaattttgtgtcgattcgtccccaatttcttcgctattttcgtgtttattttattccattcttttgctgaatattttcttcctttttgcttgattttctcttttattttataaaattttgcaattatttctctttttttgagttcatttcgcctttcttcttctttttcttgccatttttctccaaatattgcatcaaatgacttttgttgaagttttttcttttctgattcaattggaataattagggcaatcaaaaataaaaataataaaatacagaatttcattttcaagattttattttatttttcttcaattaaatggcaattcattttttgaggcatttaaatgattttttttctgattaaaaaactgaataaatcattattttacttaataaaataaggaaatcctgtttaatttcaaagaaataataataataattttatcttaatgacaaaataattgccaattggtaaattaatgattaactaaaattttattactttctactacagctcattcgaaaataataaacatattttcaataaaaataaaataaattcacaatgtaaagagattttagaaaaattaaagagattttatgaaatttcattatatcagaaaattggtgtaaaatggccaaaaatgaaattttagcgccgaaaaatgttgctgttcacgaaaataatagaaacttgaatatttgaatgctttgaacacctgtgggtttccacaaccgaaatcagaaatttttacacatatatatatatatatatatatatattttatatatataacaaaaaattttccaattaagtttacaaatttcggtataattttgtttccattctttttctgaatattttctctttagctaatattcatttttcattttaataaatttttgtacaatttcaaatgtttgttcatccgtttttaattttgacagattaaatttttgattaagccccaattccttgatccatttttgaatatattggcgatttgtccccaatttttcgctatttttccatcaatttttctccatttttttgctgaatattttattcctttttcctttattttttcttttattttatggaatttgccaattatttctctttttttctactcatttcttcttctttttcttcccatttttcgccaaatatttcatatttcgccatttttatgtaaattccttgtaaatattatataatttacagtatagtcgaaaaaactttggtttttaaaataattggaaaaataaatttaaaaaaccagttgacattaaatataagacccaaaatggttaaaatggcattttacgcaccttttttgatccactttacaatcacttattgagtccctccctatccaataccttttcaggcgtaacactcgaaaaatgccgcggcactgcaaaattgcttgataattgttcgtggataaaattttgaaatttttgggcctttgaacaaaaattggaaaatattataaaataaaagagaaaattaagcaaaaaggacgaaaatactcaacaaaagaatggagaaaaattgaaggaaaaatagcgaaaaaattggggacaaatcgaaattatatttataaatggatcaaagaatttggtcttcaaaaatacaaatcaaaaactgatgaagatgtaaaagaataacggatgaagaaaaaatgggaaaaatgaaaatttattggaaaataaaaagagaaaatccaaaaatgagtgaaaaggaaattgcaaaaacattgaaaattggtccaagtaccgttacaagatggaggaaacaatttggagaatcggaagaatgaaacgaatgatgaaaaaaagatttgtaaaattttataaattttatttttaagcatgggcccgcccaacaatcatatttattaattaaaattaatgttttaagataattttttaggcaaatacatccaatttttcttataaaaattaacactggctcacagaagataatttaattgaataaaaaattcaagataattgaaaaagaagcaccgtttcaaaaataagtttttttttaaactacaataagatttgataaatcctacgatttgggttacagtttttcatatgatttttggcaaatttatcctatttttcttttaaacattcatttaaatcctcctccatttacatgaaaaatggtgttaggtatttacaaattcaagtcaatctttgccatttacgacaccgtcaaaaattacaaaatgaaaaaatgtcacattgggaaaatatgaccaaatattgttgtataatcttataataaatctcataaaattatataccgaacatacaccgccggacatattgcctcaaaaaaaccaaaattagtaaaacaatttcttgttggatttatatgggaaaacaaatttgatcggaatttttatttctttatcgcgttaaatagcctggatcattcttttttcgacgaagtttcttctcaaaactgttttttccatcttataatgctattttcaaaattttttcaaaaaattttctcttgggaaaattcccggttggtcccggtcccggtttttctcgcggtcgcggtcccggtcgaaaa

SEQ ID NO: 19599 - DNA, 1694 bp, Heterodera glycines
aataattttcacaataattgaatcccccgctcgcggctcccattggcaccggcaattatttttaaaatataaaatttacttttttttttgccccttaattcaatttaactttcaaacccataaatttattagccaattaaaaaaaagaaaattaatggcaataattaaaaattcaatggaggaaataaaacaataacaaaatggttaattttcaatgatctcattaacaaaatagaaagaaattaaggcagtgataacaaaagggggaatgaatggagaaaacaaaatgttgaggaaattgtaaaattggcatggaaataaatccatattttagatgcttcactatcaattggacggtgatcactatggcagtgatcagttggcaatgaatcaattggaagggtgattggggaggaggacagtccaatttaaccaattacagtattccaaatacataaaatcagttaattattacaaaatttataattttctaaaaaatgggtgtccgaaagctgtaagtaactttttaacatgccaattaacttttaaagtgttgcaaaaacctacacttaaattagaaaacttaatgagatgagaatttggctgggtgtcgccgaggatccccgtttagaatttgttccaagttgcccgaaattcaattttttgcgacctgaatttttttaaaatccaacccgaaacacgaaattttgaaaaggagggacaaaatgcaagttcttaaagattttggccttattatttcgattattcgaactgctgaaaatgttccgctcgcaaatcagcaagcaatttcccattcattttgctaggcccaaaatttggttggaatgctcggacgaagctcttcagtggcttttgcaaaatatgccgcacgttgttctgaagttaaaaagtgtttgagtgtgaaggaatgaaaagaaaatcctaaaaaaatgccaaactgaccgtccaactgctcttgggcttgggcccggacttcctcagattgacccaaaggtggcaagtcgaattcctggatggtggccccgtcggaactgtgaaaaagtatggtgtacaaaatattttggcgttgggtgtaattaattcctacccagtcaaatttaaaataatttaaaattgaattttaaaggaaaattttgtgttaaaaataagaattgaaatatttaatttaatttttgaaagttctagcatttgattttacaagaacctgggcatggatataaatttatgaaaaattattccttttaattcaaaataaggtggaaattttttttaaataacttaattttgctaataaaaaatcaaaaattttcggagattcaaccgcaacaaaattattttcgaaattcaaagttccttattttccccgataaatggcccgccatttccttagaatgattgaattttcccacaaaaataattttaaaaactcttatttttatccattattggctcacgtgctggtgcgccaattgttccgtcctcgcgcggccaagtctcccgctgagtaaagtacgcccggcacggcggtcggactgcaacaaatgccgtgctggtagcacaacgcgtaactgatctgctccaattcgccgagtttgacccgcggttgggccgtgtccacaacgacagtgcaacgcaacggctgggcagtgccctgggataagaaaaaaaatttt

SEQ ID NO: 19600 - DNA, 2739 bp, Heterodera glycines
  misc_feature (93)..(93): n is a, c, g, or t
gattgtttaaattggataaaatgatgcgtaattttgaaataactttgacattacaaaatcattaaactaataaggaattgttttgaaaagtcncaattaatattcattacatccatataatggaacgtacgttttaaactctatttaataaacgtaatccggcggaaccatttagttgaactcacgccattttcgtgggtagtgctaatttgaaaaagtgaagaacggcatgagattttaatgagcgggtgggcgccatgaaaagccttttggcatttttcttcgctttgtttcccctgaatttacctagcctttatctgtgtccattttgcgttaaccttttggctttcattggccttaatctgttttttcagcttccacttaattcattttttaattaaaaattgaatggaatgttaaattgtcagttttgcttaataatacaaataatctttgtgttaatttttaataagcaatcaaagatttatttaatgttatcctcaaatgccagcagacgaataaaataaaagacaaaatgtaaaaaacatctgccaccaattgcttcttttcttctatttactaaatttatagcctttttaaaactaattttttataaaatttagaattgttcaattctttttgccaattccttccaatccaatttttgaatgaacattaatagttttagaaaaggcattaaaaactgaactaacaccaaaatgaacagttccgttttggttgaaagcggcgtccaattcgaaatgccaattttgtttgctttgtccggcatcgaaatgctgctaaatttggtcgagttgcccacctccgggatgaacatctatctgatcggacgaacaccgatgatccatcgcaatttgaagtttattctgctctaccaaagcgcatggatttttactgtgacttatttaattttaaaaaatccaaaataaaaaatgtatttttgcccaaattattttggaattgatttcttataattacttattaattaataattaatttttcattttatctcttttttaattggcttttccttttcctttttcagcgttccttcgcccgcttttccatttgtctgctcaaatttctctctgccaatgctttggtcagtgagcagctccaacccttcaaatttgcttatcagctgagtgcttacaatcgcaattttgtgccgcacattttgatcattgagcgacttatggccaccttttggcgtaaaaattatgagcgatccgtcggttggcacttttcgctcggatggagttcattcgtggtacactttcattacgcaccgtttgaatttccacggtcttttttccgtctctaatcattgctttaatttggaatggaaaataaatttaaattttggtccaaaagtttgtccatttctttggctggaattttcgcttgtcccctttgtttccaattccctgctgaagaggtccaatttctggctttttctaatcccggcatttccctgtgattacggcacttcgtttgaccacttgccaattgcgtctaattgttgttttgcctttacgctcatttctttttgccagttcatttggttcagtttttcgtcgctttgtacaattcgttgtccacaagcacaaaaaacacttcactctccggcttaatcaccacatttgtgctgctgcttttgggcttcattgaactctttgtaattacccctaattaaataataattaaaatgaaataactattatttttaggtttttatttggctatggcactacaacaaaaaggcgtatatgaaaagtttggcaaatgtgaaattgcactgcttaaccgagcgataccaagtgaaagaagaagcatctcttagtcagaagcaaaatttaaaactgttaagctgtctgagaacattcgcattggcaagcaactgatgccaacagtgattcttcagcttgtcaatgtgttggccacctccgtttatttgtccaccacaaatttcggcatttccgtcaacccaaacatcagtgccatggtggtggtcaccgtgacaacactttgtggtctgctcattgaagtcacaatgattacgtaaatggagattaaattatttctttcattaattaaaattacgaaacataaaattccatttataattaaaaatgcgacaaaatgccaaaatatgcacagggaacaaatacataaaaaaaaaattcattttaaagtccaaattttgaccgggcgcccgcctgggacgccttttttcaaaatttgtggaactaataaaataaaaaattggtagtcttctatttcagcttgggattaggtcaagccatgcaacgacctttttttctattcacatcgctttttttgcggcgcactttttttaaaaaattttgaggctgggggggggggttgggggtcaggcggtgccgagaggcgccgccggaaaaaatgttgtaatttttaatgcgacttgttaacggattttgtcttaaaaatgaccaaattggcacttttttgctgtagggcccccgaaaaatattggaattttattaaaaatcaaaggcggaacccttttggtttgtaaattttttttgtcacaattggacccgtccggactctaatcgatagcggcaaaacgaccaaatgcagacttttgcaagttatcaatttttttttacagaataaataatacctaattatagcgcgtaaatgtaattattttttaaatttgcgcggataaat

SEQ ID NO: 19601 - DNA, 1641 bp, Heterodera glycines
gcaaaaaataaataaaacgaaagactcagatttcgaaaattttttgagccagctagctcggcgctcatttcagtgtaagttagtcctttaccggggagtatccctgcaaagtttggtacgcttctgctcaattagcaaaaaatatgagtgatcgaattttcactaaaaaagttaaggatgaatttttgttaacataaaaaaaatccaaccatttaaaagctttaaaaaatttttaaaatgagaattcatgcgagattttctggaaataagcttaataggccttagttaagctgtaaaaaaaattgggggcgatttgaatgagaatagaaagagccaggttcgatgaagttttggtaagccaaaaaaaaatccaaacatttaaaaatctataaaaaatttaaaaatgagaattcatgcgagattttctggaaataagcttaatagggcctagttaagctgtaaaaaaaatttggggcgatttgaaagagaatagaaagaaccaggttcgatgaagttttggtaagccaaaaaaaatccaaacatttaaaaatctataaaaaatttaaaaatgagaattcatgcgagattttctggaaataagcttaatatggcctagttaagctgtaaaaaaaatttggggcgatttgaaagagaatagaaagaaccaggttcgatgaagttttggtaagccaaaaaaaatccaaacatttaaaaatctataaaaaatttaaaaatgagaattcatgcgagattttctggaaataagcttaatagggcctagttaagctgtaaaaaaatttggggcgatttgaatgagaatagaaagagccaggttcgatgaagttttggtaagccaaaaaaaatccaaacatttaaaaatctataaaaaatttaaaaatgagaattcatgcgagattttctggaaataagcttaatagggcctagttaagctgtaaaaaaaatttggggcgatttgaatgagaatagaaagagccaggttcgatgaagttttggtaagccaaaaaaaaatccaaacatttaaaaatctataaaaaatttaaaaatgagaattcatgcgagattttctggaaataagcttaatagggcctagttaagctgtaaaaaaaatttggggcgatttgaatgagaatagaaagagccaggttcgatgaagttttggtaagccaaaaaaatatccaaatatttaaaaatctataaaaaattccccataaatctgcgcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggatttggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaac

SEQ ID NO: 19602 - DNA, 2097 bp, Heterodera glycines
agttcgtttcaaagtagtcaaagttgccaacacgtcattgctcgcacttttccgtggaaagaaagagagacctcgttcatagaaactgacttcgcatgataaaggatttttcctttcattgtttttgttgattgcgattccgaaataaattgttgttgaagctaagaataggcagcagggattgagcgtgaaaaaatgactcccatatgcgcaaaaaaatgctattaatagggcgtcaaattatatggaaatccataatttttttcctggactgtgggaggtctgaaacctacgaaaaacatgtttttagctttgtttcaagcttcttggatggattttatcaatatttttccatatttttgcgatttacctgtgtccatattcccactttttccatattttaaaattttccaaaaaacctctacagagcgacccccatcagctaaattggccgttgacatcaaaaaccggaaaaatttccaaaaaatcatttgttagcaaatgtttcacgagaatattgaataaattttaattttcttaaaatttgataaatttttgtcaataagcaaaaaaaggcgaaaatttcgcttctcaagttgattttcgctaaaaatgtgtaaattttagctgtcttgtttttacctctaaaataattttaaataccatatttcgccatattttaaagttttacgttgcatttatcgtttaaagaaaaattaagaaattaaacccttaattttggaaaatttacttttcatggtaaatttgcaattttgggccgagcgattcaccctattttaacaacagaaataaaaaagtagttaaagataagcatatttatataaaaaacatcaaagcagttacgtctcaataaagcaatgcaaaaaacaattcagttcccgtcaagccctccttgcgccgcttcaagttgcgcaggggtcatctcatcaacgttaatcggcggcgcacctagaatttaataataaactaaataggagtttgaaagctttgggctctactgcaatttaagcgttcaatcaaaaaccaacccccgtttcttagtatattattttttttttaatgcaagtatttgctcttgtcttgtacttataaattgccgagattctaagctttaaaggccgaacatcaaattttcacgaatttcttttttattaacctgcattggccagtcgtcgattttcggcacgtcgctgcgccgcttcagcactcgccctatgcattgcctccacttattcttcgtgctcgcctccattatcggcggcgggatccgtgccggcattttgctgctgctgattgtgaaatttcatgtagatcaatgattgcaaaaaagaaaaagatgtgtaaaatactatcgatgatgcatgcctctttttggaaaatttttcgttcagaaattcacggaacatgtttataaatgttttcagggtcgctgatcattaatctgacataaaattttcttcaaatgaggggagatcgatagtactaccaagggctgtgtagtgtagccccatatacaaatatttttacatttcagaataaaagaagccaatctataggttttcggggtcgctaattgcgaatccagtattcgtttcggcaaatcccggacccgaattcgaacaagaagtcgaaaaattaaaacttttgtttttcatttttagtctaaaaaaggtttaaatgattttgtttggcatattttattctgaagtgtaaaaaataaataattttatgtatggggcttaaactacacaagagccctaccaagcgatgaatagaacgcaccacaaccgccgcagcaacagccgcaccaatggtgacgaaaagacggcgacggttcaaattttcccattgcatcagaagcagactcaaattcttcaacaacataatataaaaaatattacgcaagaaattatttttacatcctttttaaaaatgctacataaatttttattgtaaatagtcacaaaaaaacttttttcactgccaattccgaccagttgagagaaataaaaggcgatagttaagcattgagatataaaaaaatcgtctagaataattaccccaacaatttgtcgg

SEQ ID NO: 19603 - DNA, 2175 bp, Heterodera glycines
  misc_feature (2100)..(2100): n is a, c, g, or t
  misc_feature (2114)..(2114): n is a, c, g, or t
  misc_feature (2119)..(2119): n is a, c, g, or t
ctttttttgtcttcataaaaactaagaaaataataaatttaaaaattaattaaaataattaaatctttccatttgcttggattgatcactattgaatgagttcagccgacggcttcttcatctccatgattaatttgttggcttatggtcccattgtcccttttgtcttcgctttgctcattggcattccgtccgccatactgtactgcttggaagtgtgggtcatcatcgccaactttgccgattttaactcggcattttttgttcttgtcgttgtccgcgcaattttggtattttttcataatttaattaattaaaatatttttccagagtttggccaattggatttgccaattttttgagaatcgtttcggcaaaattggcttatttctggcctttttccatcaattgcccgaatgtgctttgtctttcctttattttgctgtcaattttgcatttcatgtggaaaatttgttgacagtatttctgcttttgaatcggttcagctccattttgttgcccttcacttacaataaggtgccaattcagagggggcgcagtcgttatttaaaaaacctccaaatgatttgatgaaaaattatttataacttagctcttaagcaaccaaatttttaattcttcatatcatttgattcgattgctctaagtattctctaccagaatacaaaaaatttcgttaagtttcaaaaaagttatggctagaggaactcaaaaaacccttgttttttgagcatctgtggccctaactgttttgaaacttaacgaaattttttgaaattttgtacactgatagagaacacttttggctatcgaatgttctcaagaattataaatttatattgcttttgagctaaattataaataatttttcaccaaatcatattgatggttttttaaataacaacatagccccattcagagggcattaaatgcaaaaagacttaaatatagtttatttttaattaatttccaattttttttgtttcagttgtggcgttgtgcattggtccccgctttgattgtctctttcgtcctcccacttccgttcactgtgccaattttcagcttacaaatgttcattcacatccaaaatgacaatgtcagcttcacaattgaccattacaagaatgaaaatgtgcgttatcaaataaatatataaaatggaataatttttttttaaattaattttttgaatggttttggtatatttatagagacacctacaatatttggcccatccatctttatttaaaccttgtacaaattctgtaaattccttcttttcaaaaattcttggaatcacaaaaatttaatgatcaaataattgattttgtcaattatcgccattctatcgattggttttccctaattaggcggtgaaaagcagcaaaatctccgcttggtctgccattttctttggcatcatttgtcttctgttgaatttggcctctcttgttgcgtacaaatttcgccgccccaaaagtgttgttggccaagtgcaaagcaattacagcactaataattcaatggtcgagcggaaaatgaccatttatacggtggtctcttttttcggacaattaattatggccattttcatggtaataataataaattaattaattactgttatttgccatgattatgacagataattgtttacgtcacgtccactcaatttgttgatgaacccaacaaatgcaccaacaatggccaaccggcacagtttggcctcagcgcagagcaaacgcagacgcttttcctggccaattacaaccaatacccgtgggtgaacgacctgagcaccatcgccatccccgcgtggttggtgcactcacagatgaacaaacattaatttcaacaaattaaatgattatttaggctcttattgtgggcttcaacaaaaatgcgccaattcatttccaaaaaatttcaataaaatgccattggacgaggaaattttgttgttggagaagaatgaaagagatctgaagcaacactaacaaccattcagaaaaatggacaaatcatgccaaaaggtgcactgattagtttatgattggttctctgtgcaacttctanacattttgtaattncgtangtttttttcaaataatacacaaaaatatttggcattttttaaaatacagtagctga

SEQ ID NO: 19604 - DNA, 919 bp, Heterodera glycines
gtgcttaaaattgcgtattaattgttgtttttcataattatcagtgaaaagatttgcttttctcacaaaaaaaaaatcaaaatgtttaagttaaataaaataatgctaaaaatgaaacaacaaaattaataaaattaatcaccgtaattatttgtcaaaacaaattatcgttttccattgcttttaagcgttttctcaaattttgccaatggacaaaaaattgcactttcaagtaaaaaataaaagcaaaatttacaatttgcttaaaaatttgttcttctgataagataaggtcatgactttttggaaagttaacattaaaaatttgcttgatttagagcaaagttataagcaaatggtttgcgaattttcgaattttgctacaagagcctgcaggttcattagcagagttttcccatgcgattcgaaaatcatatcaaggaaatttattgtatttttgagtacagtccaacggaggttgttttttttaataatttggacgtcgaattataaatggcaacgaaaactttaaaaaaatgcacaaaaaaaaacagaaaagtagcaaaatatacataaaattatataaattttcttaattcagagtaaaattcataattataaattcattaaatcatatggagacaaatagatgaattaacttgggagaaaaaaactcattaaattcgataattttagtggaaaaaatcgtgaaaatttctttccaaaaatctaatagaaagttattttctggaaaatttccgccttacgaggctaaaaataagtggacgttctaagtgaagcaattatccagacatttggatgatgaacacttgacagtggctatttggacagtgaatgaattgtttttaatataaaaagatggtttcatgcatctgaaagaatatagttttaatgttat

SEQ ID NO: 19605 - DNA, 2976 bp, Heterodera glycines
ttattttgatggctttttgactaacgcccattttgatggttttttgactaacgccctaaaatcgatatttttcattttgatggttttttgactaacgcccattttgatgctttttgactaacgacatagcgccgctcgtcgctccgcttcgtaggcttcgcgagggcgcgcgtactttaatccgtacgcttcgcgaaggcgcgtgcagtttaatccgtaggcttagcgaggccgcgcgcagtttaatccctaggctcgcgagggcgcgcgcagtttaatccgtacgcttcgcgagggcgcgtgcagtttaatccgtaggcttagcgaggccgcgcgcagtttaatccctaggcttcgcgagggcgcgtgcagtttaatccgtaggcttagcgagggcactggaaaaggaaaagggaaagaaaaatggaatggaaaggaaaggaaaccgaaagaaaagggaaaaggaaagggaaaagaaaaggaatgggaacaggaaagggataagggtggaaagggaaaggtaaaggaaaggaaagaaccggaacatgcatggcacccgtgagcagttggaatcggcatgagtggcacccgtgagcagttggaacccgagggcttggcgaatggcatgggtggcacccgtcagcagttggaatcggcatgagtggcacccgtgagcagttggaacccgagggcttggcgaatgggcatgggtggcacccgtcagcagttggaatcggcatgagtggcacccgtgagcagttggaacccgagggcttggcgaatgggcatgggtggcacccgtcagcagttggaatcggcatgagtggcacccgtgagcagttggaacccgagggcttggcgaatgggcatgggtggcacccgtcagcagttggaatcggcatgagtggcacccgtgagcagttggaacccgagggcttggcgaatgggcatgggtggcacccgtcagcagttggaatcggcatgagtggcacccgtgagcagttggaacccgagggcttggcgaatgggcatggctggcacccgtaagcagttggaatcggcatgagtggcacccgtgagcagttggaacccgagggcttggcgaatgggcatggctggcacccgtcagcagttggaatcggcatgagtggcacccgtgagcagttggaacccgagggcttggcgaatgggcatgggtggcacccgtcagcagttggaatcggcatgagtggcacccgtgagcagttggaacccgagggcttggcgaatgggcatgggtggcacccgtcagcagttggaacccgagggcttggcgcgaatgggcatgggtggcacccgtcagcagttggaaccagagggcttggcgaatgggcatgcgtggcaccctggcatgcatggcatcattgttcaacatttttagaaattttttaacaaaaggaaatataatataaatttactttttattcgaacatttttggccataaattttttgaaagttaacaaaattttttggaaaatttagaggctagaccgactactgtatactaaatttgtttgctttttactaatgatcgttttggaatgttcaaaatttcgtcaatttttcgatcagtgagctttggtaataagactgaatgtttataaaagcaattataattttgtgtaaacagtagaacattttaaacaaattaatttgtaagaaaaaaaattacaaaaaaaaatacataaaaatatttggattttttcaatttccgactccattttaccgtataagcgggctaatgactgaccgactattgtatactaaatttgtttgcttttactttggtttctgatttgtatctttgtaatgatcgttttggaatgttcaaaatttcgctcatttttcgatcagtgagctttggattttggcttttcaattgataatattgtttcatcttttccattctttcaacatttgtgtaaacttttaacactgtaaaaaaaattaaattaaattaattaaattaaattctttaactatttaaccttttgaattcttttgaataatgccaaatttcttggcccataattctattgtcttataactcaaaccaaataattggctaatttttgcatgaaattcttcccattcctttcgtgaatgtttcccaatttgcataaattcattttttaatttaaaatatttttccacaatttcttttttttgctcatcatttttttgattttgcaccaattttccactttttaattgtttcttccatttataaatggtgcttatttcaatgcccaaatgttttgctattatttttttgcatttttctctttttccctccaatttttcatttaatttcatttttaattttgcatatatttgatcaaattgctttaacattattcttttttcttcaactgaataatttttgttcttcatcattccaaattctcttttcatttgtaaattttcctttgatttacacctaatttttttgcaatttttctttcaattttttgccattctttctttgaatatttctttccaatttgcttaattttctcttttattttatggaattttttaacaatttctcttttttgtttttcatttgaaattcgaatttgatcacaattttgtccaatattttctggcatttgttccatttgatcacattcgcttcccgattcttctttcacctccaaattttgatcaaatatttgatcaaattgtcctgccaatatttttgactcactttttttgccattttttgtcctatttttgtcgtcattttgtctttgtccaattgttccattttgatcaatttgatccattccattttcctccaaatttttctcccatccatcgccaaatatttgatcaaatcctttcgattgttttattttcatagaaacagtctgatcaattgtatttttgatgatgaataggcataatagtaataatatgtcaattttcatatt

SEQ ID NO: 19606 - DNA, 3330 bp, Heterodera glycines
gttgaattgagtttatttttgttagaaaatgtccaaattaaattattaaaaaattctattaatcccccctgccacataaatggagactggtatattatttttcaacctcctcagaaaggggtatataattggagaccggcagattaatggagactggcatataaaaagagtaaatacggtaaatgggtttgattgcttaatttgccattaactttgtttaataaaaatttgttttttcaaaaatcattaaatttcaaaagggaaaaatttgtcgtgacaggcggcgggaggaatgaacttcgtcttaattaaaataaattattaaaattctattttaataggctccccattccaagtgtattgtggtagatatatttgtactctgataagcgtactcatattgagaaaaaattttcaccccctagaaattcttcggaaatttttcttttagtcctccttttttgggtattccggtcagcctgatgctcatattccaatgctaaggataaaaatcggcatatccctagctatatagggtagctgcagatcgattaatctacggctcgaaatctgcattcccaactcggaatacggctggggatagttcgatccccaaatgatacggataagccgctacttttccctttgttagtgtattctttgtctagtggtttgtgctttggacgaaaaagcgtctgtgggttcgggtcctttaggggctaatgtattttgttagttttttaacaatattatgcacctctatgaattgaaaagattttctcaaaaatgaattccctaaaatataaattttttttatcttgaaaaacttttgtttaaaatttgcttattcaaaaaaatttaataaatcaccattgtcgaaaactaacagcaccggttttgaagtttcaataaaaaattttaaattttaaacatactccaaaatttatttggacatcaaaataatactttagaaattaaattatattatttgaaattaattttgaagaatttataaataaatttttggtttttagagggcacttttaactaaatattctcctcgggaggaggctaaggattttcatctgcagataccctagccgataccctatccttagcattgtgaatatgcaatgaggatagagttagagatggggattaatttgctagtttaaaaaaataataatttttacaacctgcccaccctttcatttttaaatctttatcattacctcattacacttttaaatcttctcttttctcaaatcataaagtattttttctaggtttggagctcgtcaccaaggattccttttttaggcataaaaaatagcgaaactggcacctaatttgtaagtagaaaaattgcaaaataggcattaaataggcacatccttcgaatgatacctaatttgtttgggtttgatccttttaaagggttaggagtgcccaattttgttcatttttccgcatttttaaacgggttaaaaaaccggtttaaatattttcccattcttttttttctatcgttttcagttggatttttttcaattattttacaccacaaagttttttatttttcttaaattttgcttaatatttcggacttttttcaatatttgggtcaatatttcggcatttttcataaatatttatttaaatatttcatgattttttaatagatatatataattattattttctttgatttttctttctcccttccttttctcatcacttgttctcctgcaacaaccgtatcatccgtccatatttcaatttcggtccaagtccggcgcttgttccgcatgctcttgcgcatttcgcgccgtgtctttgccctcgtagtttgttgcttttcgcaccgttgctcagtgaaagtattggaatttttaaattgatgtcatgaaaccgaaatttttgccattttcggggttatcccagatttttgtaagttgcaagtccacttcgacccaaaaagtttttaaaaaatgcaccgaaaaaattgttaaaaatatagttttttgagcccgatcgcactttacttttgctaatttcctctccaaaattgttaaatgatcatgggaaggcgaaaaatgatgtaaaagtaatcgatttaatgcaatttcgcaatgttctggttttcgacccccaaagtctaattttttgcattatgttctgttttagaaaaaaaattcaatcgaatttctgtctggactcaaaatctccttgatgtccctaaaataccccgaacttttccaacccagcagcggtttggggttcagggacggttttcagggggggggggcctcccagagacctatctcatggcttatccatgtctaaagttgcagccgctccctttttggtccaatttgttttgaagaacattgcttctttcggccgcaattgattcttctccacatccgaatggtcgtgaaaaccgcgctcgaaacgacaccagattcggcaacaacattacagcatggaatgggcatataacattaatatgacacaaaatgagacaatataattgtcttaaaaagactagaaatcaaaactgaaatcattaagggttcacttcccagtttttggagtctcctgaacaaccaaagaaaagaagcatcgaaatgtcatttatttgttatacattaagagcaagtcactaccattttttgcgggccatgaagtaaataggcaaagtaccgtcggcattcagcttgttcggcatccggttgagcccattctgaaaatggtcggggaaaaagttatgatgtcccagaaatggaaagaacaaaagtcgtcgtgacataacgtctccgcaaaaaacaaaaatttcattttcaggctaacgagaaaaggtcttttcttaagaaatttcaaggaaacgaaacaaaaatttcttttgtttaatttttttgcgaactgaaaacgcatggaattgcgacaaaatagatacaaatcggttcctctcagttagtgaatagtggatccgaaagaattttggacaaaaagaaattgacaagaattatgggtgctcaaaacctccgaaaatgactttgatagaaaaaaaccaaattagatgagccaaaatggtaaaattgccgaattcagtatcaactcaaaatcacataaaaaaaactttggggttttcttatgcgctgaaaagatggaaaaatttaaatttcggtgctgaaaagcatctaaaccggtttttgaaccggttaaaaactcaaaaaattgattgaataggggggctcctgacgctttaaaacggtcaaattcggacaaatttgggatcattcgaaagcgtgactggaccatccgaca

SEQ ID NO: 19607 - DNA, 1181 bp, Heterodera glycines
gaatgggtgacagctgctaaaagaatgccaggaggcttttaaaatttaaaattggtaattttggacgaggatttaatgttgacatttcgaccatttaatttgttggtattaccgtttaatatgaaaatatgtgtaaaaatgtgttgaaaacaaaaaaaaaagggggatttctagggaagaatagggacattaaacagaagagatgtctaagtgcatatctataatataatgatcacaaatcacaatattaaaaaacaaatgtgtctcattttctattactattttcatattgatcgataaaataaaaatggttcgctgtttacaacagtttttgagggtattaggtgctggaatttagagagatgggagtctcttaattttcttaactgctggcgttgatttttttgggtggcaccgattttttcggctgtcacgaagaatattgattggcagaaaaattataaaaaattattttcttgctgcgggggatttatttggacagctcattttcgcacatacaagttcaaacgcggatacacggccatacaggcgcatgcgcttaatgcacacgcgcacatgcataacgcgcgcactcatacgcttaacgcacgctcgatcaaacgctcgttcacacactcactctcactctcgctcacactctcactcactctcactctcattcacactcactcactctcgctctcactcactcactctcactctcactcacactctcactcactctcactctcacattcattcacactatcactcactctcactctcactctcactctcactcacactctcactcactctcactcacactctcactcactctcactctagctctcactcactctcactctcacattcattcacactatcactcactcacactctagctctagctctcactcactcgctcactcactctcactatcactcactctcactctctcagtcactcactctcactatcactcacactcactcgctcactctcactctcactcacactctcactcactctcactcactctcactatcactcacactcactcgctcactctcactctcactcacactctcactcactctcgctcactcactctcactatcactcactctcactatcactcgcacattcacatgtttatttttttcactctgatattttt

SEQ ID NO: 19608 - DNA, 967 bp, Heterodera glycines
ctcgggataattggtcctatttccggtaaattattaacaaattttgacatttgctcatcataaaattcactctttctatttaacattttcctaacgtcacattcctaaaaatttggttattttatttctatttttaataacacttacccaaacttcttctacagtataccccatctttttccctacacttcttaatctctccattttattttgtgttctttcataattttgctctgccgtaaatccattcgcttgaatcatataccccttataacaattttggcacccatgaaaagcgcatccctaaaaattttttaatatttatttcatttccattattacctgaaattcaattattctcttttgcgccccaattatacaatcaatttttaattttttgtcgcccaaaagcgatatttctcccccatttccggcatgcctcgctttaaccccgtcccgatgcataatccattcaaaatattttatcgctatgttgctctgactatctttcggctcaaagccactctcaggaattataggtaatgtttcattgttttttaaaaatttggcccgaaaaatgctaaaaagattaatatttattttcatttattttggtccctacttcatgcatgaagacgcaattgtcgtcgatattctcaaaacatcaatcccatttggagtttccttatcttgtgttatatctataaatatttttctcatttttataagcgctttcatcaaaatatccgtgtcattagaacaatattcatccaatttttcttctaaaatattaaacagttcaattaaaaatttttaaactaacctaaaataaacccgttattataattcgcataataccattttttgaatttttcatattcatcttcacttaattcatcggggaaataatcctcaaagggcgggagggtagtcaatattttgcctaaaaggatatttttatttgttt

SEQ ID NO: 19609 - DNA, 2059 bp, Heterodera glycines
  misc_feature (1978)..(1978): n is a, c, g, or t
  misc_feature (2040)..(2040): n is a, c, g, or t
gcgttactttaccaaagtgtttgcacaacagaagaaggaaggtggagatggttccggatctgcggaggagtcgatgactgtcacggcggagccttctgacgacaaaaagtcccttccaacagaccttgccactgcggagcatcctccgcccgtttctgttcctggaatcactgcgcctcaacaccctgtacgaccaatatacaactcaaaattggcaactcagaagaaacgagcggcgatagagcgcgaccgactgaataaattggccgaagttcaacgaatgaagacggaactgtacaccaaacttgttgaacaacagaaaagtttgttgaagaagctgcagcagactgaggacaaggaagcgaagaagaaaatagtgaaatatttgaagacattcgagcttaaagtggatggagtgaaaaccgagctggaacaattagcactgaaaatgcgcgaaatgcaaatgcgacaaccgcctaccaagcgaacgcgtactggtctttcgatatccgaacaacaactgttagacaatggggcagaactgggctcgcaattggaaccaagtggaactagtcttttccaagataataaccaacttatttttaaattaagacaaaattcaccagcaatcgcccagtaaatacagcatttccaacaagaagttattgaagtgagttaacccattatttctgttttttcttttccatttttagactttgtcgtgttgtttacgtctcggcttgtccccaggaatttagtgaaaaattaattcttcatatggaacgatttggagaacttttcgattacgatatcaatgcaacgcctcaaattttcacatacaaggagccacttgatgcgcaaagagtattttctgaatttagtccatttaacctttgcgatccctgttttcaaaattgttattatttgaggctgtgaatgaagcggtgggcagttttgaactggcaaaattgaaagtggaatgggcaccagtggcgaagggagtgaaggatgacaaggacatagtgccagacggggagaggaaaccatcggtgttgcatttgttttctttgcctaactaaattatagtaacctaaattggaaggattatataatcataaattttagatttcaaacaaaaaagtattttacggtcttgtaaaattaatttttaattttttttaaatttaggagcaggtcgctgcaaaggatttgatcgctttgctggaatacgatgaggaagaggaagatgacaagaaggagggagacgaggaacagttgtcggacaaggagggaaatgactgattcatccagaccaaaccgactttaacatccaatgatgggtagtgtcgttcagttcaagctatcatgacattaaattcttccaaatcacctctgtattccgtagttcagtgacgtacggtcggtcttacacgtaaacataaaattagtttttattttttcccaatgacttttacgtctctgctttcatagtcgttaaacatgcaaatcctatgtaaaatcggtagaaacttcgatctgtgtgatcatttcatttccagttgttttgacaatataaagtcccactttagcattttccatggtttgcacccttttatttgtcttgtttcccccacccaacatttttcatacaaatgggactgccagtcccttttcatttacatttttggttaatctaagcctatcatgaaaaagatattcaaagattgaatcatcttaaagaatgaagccaaagaaaagacaaactgacaatgagactcaatgttcaattgtgattgtttttttaataaaatgtcagtaaaagtgttatttaaaaattcatgtaatagtattacttttgtataataaacagggctgccaaaaatatgcacaaaaaagttgaaaattaggggtgcaaatttaattgaaaaatttaattcctcataaattttatcgattgtttttgcaattgcaaatattntctcagatttttggcagcaaagctcaactcgcacatccattcagattttgatttaattttangcataatcaaattttccta

SEQ ID NO: 19610 - DNA, 1210 bp, Heterodera glycines
  misc_feature (863)..(863): n is a, c, g, or t
agacttttaagttcaaatcccctcccatccattcttttttgtgctatttttaaaattcacaaaaaatttgatttcgttttctcaattgtcgcgccattgcgctcggaaatccgtgggttggtaattgacgcggttggatttccgtccatttccctgcgttcggtcggggcttcgttccgctcactaatacgcttgtaagtgagggattaaaagtgacaagcggtggtgacatcctcttctctcccgccccctccctttcatcgcctcccaacggctaaagttgtcggcaaaagtcaccgatggaaagtgccaacacagcatcctccccgaacacaaaaagtgagggatgccaatgccatccgttgcctcttcatccggatgaatggacgaacgaattcgttgggatgacttccacacagtcaaagcccaatttaatttgtgggccatccctccgcggccaaatgtgaggcacagcacaacatttttgggctcttttgcttaggccgacgctgaaaggacggatggcacacgaaatgaagaataatggagcatccgaattattattaattttctgttggggaggaaaaatgtaattggacatgaacatttttatttctcaacggttaaattgcacatttggggccatcaaaaggacagaaaagggacagagggcaaagggagaggagagagtctcctcccccccccccaattggatcggatggaaaattaaaattcattcgtcaaatccctttcccttcctttacttttcaatgatcatcgtcatttctagcttttttaacagtaaatgttcaaatttcatgtccgatttgttatcttttgtcatttctctttgtgtttgattntaaacattttaatttcgaatgaatgccaatgatcagtttcaaatgcttttactttcgtccctcttttctttgtggcgttgtttctccctttaccattcatttttcccctttttattgcgcgaacgtggacttggggagggaaggcgtgccaatgcaatgacaaaatgccgtcaaattggtgccgttttgcctcccctgtccctccgtccttccgttgactttcttcccccaactccaaaacatcattcatcgattctgttgtgctcctccgctcattcgttcgccaattaattgtccaccaattttgcatttgccttccccgccccagcgaaaatgtgccaccaaat

SEQ ID NO: 19611 - DNA, 2649 bp, Heterodera glycines
agcaatggaaatgggaaaatggggaaaattaaacaagtaaacaataaatacaaaaagagtccaaaaactgcgcaagaatgcaaaatttgtgaaagggctacacttttcaagtattacaaaatacagagctgtgatggtaagccaaaaacataaacaaaatgaaaagtttattgccctaatagaacaaattacataattatttttaaagcaattaattagagaaattaaattattatttttttagcttgtaagcaattttttcgtcgtacaatcgttgctcagagaacattcatttgtccgaaatcaaatttatgccccataaataaaggtagctttttcacatatgtaaatataattttaattaaaaataaaaagtttaataaaaattaaaattcgaaataagaaataaagacctgtcggccggcagtgctgaggcgatttttgaggatttaaaaaaccgaataaaacaacaattttcccaaaaaacagcaaaaatcaacatctcaaaaaaaccaactttgaccccttgaaagaagtaaaatgctgataaatcagcagagttggctaccctggattaattaaggattttttaaaatagaaatttttttcatttttgatcatttaatgacggcaatttgctggtctttaggcgataaaattcataaaatgcgaatttaatttcttatgttgattgcattttataaaaattttcacgttaattgaaatatataaggattcattacatattccacttttatgcaaaattaccagcctaatgtgaaaaaagtctagctaaaaatatttttgataaagatgctttttgataaaactggccaatattattttttgcctaactttgaactcatgaacgtgccctcattttgtattatgctgatggaaatcctaattgacccccgaaagtcggcataattctaaactaccaattaattcattgctttgctgatttgtctgtgcttcctcaccaccattttggtccattgcttttcctttgccttggtcattcgattcatttgcaaagtctcttagaaagatggcaatttgcatttcgtccgtattaaataattgctcattaatttgtttgttgacgttgcaattttccaaacttttttctgatttctttaattttgttgcattattataaaaaacatagagaaaaggaagaaataatataaaattcattttagcaacattcataaaaaagctctttgaattaaatatttttttaaaatatcaattattatattgattcataaaatatttttatatgcataggaaatgttttaaaagaaaatatacatgcataatatttatatttgctagaaaataaccatggtgagccgaagtgacaaaagtatattggtaggtctaaatgttcttaattagcctgcaaaattaaaattatcatgcacatccaaacaactctggttttccttctcctttgaccgcataaagcatcaaaaggccaagatcctcctttgaatttttcacttttcgtgtcgccattatttttgctttattaaagaaatatgatcaattttttaaattattttaaaatgaacttactagtaatgcaaatttcatcggtttttcgaccataatgtgtgatttttccaaaaaaaaatccggtgtatagtctctggcagagacatcaaaacaatgatcctaaagtttacatctcacgacctcaatcgtaactcagaaataatgcacatatacaagcgcattcaatctttgattactttccatcgtaggttatgtttctaatccagcttcatcaaaatccacctttggcaaggtaatttaagataaaacctaaacagaaaaacaattaaaagtttattagtcgaatcgaagatgaagatgagtacaaacgaaatcagatgagacaccagcatgggctacgactctccacgcaatttcatttcgtctgacaacaaaaggaattaatgtaggggcgcaaatgttcggggcgcaaatgtttggggcgcaaatgttcggggctcaaatgtaggggcgcaaatgttgcagcacctttttggccacaacttttttatgtctcagctaagttttttaaaacattccaggctaataagcaccatgaagccattcaaaatcataccaaagattatttaatttggatgataaataaaaataatatagcgttttgagccaaaatggcttgcgtcaaagtgggcggttccctacaaaaaaatttcattcaaatttttcagtaatttgtgtatagagcctgcaatttagtccttaatttggcaaacgaataagttcttctcaaatttcccttgggaggaataggaatgccttgtcttgactgttatatttatcaaaaatgccaaaatatttaaatacaaattgaaaaagcattcaccaaagcaaaggtgttgctgcagaccgatcaacaaccttactcactacgacatgtccaagatgcctgaaaagacgaatttggacaaattggtcattcattccaacttggatccgaaaaacttcataaaatgacttaaaaataaagcaaaatatcaaaataaaaatagataaaataaataaataatttataaatttaaaactaaaaacataaatgaattttttaccataatatggcctggatct

SEQ ID NO: 19612 - DNA, 1020 bp, Heterodera glycines
gaatatctattcttctgagacagcattttcaaccgaccttttgtagggctcaaccgcagatagtaatggcgtttttggggaaaccccacatgtacaacggtgtagaaaaaaagagatagccatttttctgagaatatctattcttctgagacagcaattttcaaaccgaccttttgtagggctcaaccgcagatagtaatgcgtttttggggaaaccccacatgtacaacggtgtagaaaaaaagagatagccatttttctgagaatatctattcttctgagacagcaattttcaaaccgaccttttgtagggctcaaccgcagatagtaatgcgtttttggggaaaacccacatgtacaacggtgtagaaaaaaagagatagccatttttctgagaatatctattcttctgagaaagcaattttcaacccgacattttgtagggctcaaccgcagatagtaatgcgtttttggggaaaccccacatgtacaacggtgtagaaaaaaagagatagccatttttctgagaatatctattcttctgagacagcaattttcaaaccgaccttttgtagggctcaaccgcagatagtaatgcgtttttggggaaaccccacatgtacaacggtgtagaaaaaagagatagccatttttctgagaatatctattcttctgagacagcaattttcaaaccgaccttttgtagggctcaaccgcagatagtaatgcgtttttggggaaaacccacatgtacaacggtgtagaaaaaaagagatagccattttctgagaatatctattcttctgagacagcaattttcaaaccgaccttttgtagggctcaaccgcagatagtaatgcgtttttggggaaaccccacatgtacaacggtgtaaaaaaaagagatagccatttttctgagaatatctattcttctgagacagcaattttcaaaccgaccttttgtagggctcaaccgcagatagtaatgcgttttttggggaaacccacatgtacaacg

SEQ ID NO: 19613 - DNA, 1210 bp, Heterodera glycines
  misc_feature (1100)..(1100): n is a, c, g, or t
  misc_feature (1135)..(1135): n is a, c, g, or t
ttgcggtcaatccccagggagaaaaaagagatagccattttttgggcagaatttttttcgttagcatttcaaatatcgtgtgagtgtttggtagagccagactagagaaggcaaatgttggtaccaagtttgcggtcaaatccccaggagaaaaaagagatagccattttttgggcaagaatttttttcgttagcatttcaaatatcgtgtgagtgtttggtagagccagactagagaaggaaaatgttggtaccaagtttgcggtcaaatccccaggagaaaaaagagatagccattttttcggcaagaatttttttcgttagcatttcaaatatcgtgtgagtgtttggtagagccagactagagaaggcaaatgttggtaccaagtttgcggtcaaatccccaggagaaaaaagagatagccattttttcggcaagaatttttttcgttagcatttcaaatatcgtgtgagtgtttggtagagccagactagagaaggcaaatgttggtaccaagtttgcggtcaaatccccaggagaaaaaagagatagccattttttgggcaagaatttttttcgttagcatttcaaatatcgtgtgagtgtttggtagagccagactagagaaggcaaatgttggtaccaagtttgcggtcaaatccccaagagaaaaaagagatagccattttttcggcaagaatttttttcgttagcatttcaaatatcgtgtgagtgtttggtagagccagactagagaaggcaaatgttggtaccaagtttgcggtcaaatccccaggagaaaaaagagatagccattttttcggcaagaatttttttcgttagcatttcaaatatcgtgtgagtgtttggtagagccagactagagaaggcaaatgttggtaccaagtttgcggtcaaatccccaggagaaaaaagagatagccattttttgggcaagaatttttttcgttagcatttcaaatatcgtgtgagtgtttggtagagccagactagagaaggaaaatgttggtaccaagtttgcggtcaaatccccaagagaaaaaagagatagccattttttcggccagaatttttttcngtagcatttcaatatcgtgtgagtgtttggtagangcagactagagaagggcaatgttggtaccaagtttgcggtcaaatccccaagagaaaaaagagatagccattttt

SEQ ID NO: 19614 - DNA, 1798 bp, Heterodera glycines
tattattttttgtagttttggtaaatcttagaagcactttctattaaaaacatcaaacatgttgagtaattagtcccattaacttatttttataattactctacttattcaattaatttaatttaattaaaaaattaattttcatctttaaaacgcacatttcagtccgataaattctttttgccctcacaattccctccgctttcgacttgtggcaagttttcataaatcctgagcaatggccagcagtacacgaaatttgctctgtgcacatcacctgccgttaccttttttattttggtgactcatcttgtcatagatacggtaattttgaacggtccttttttaaatgatattatttttattgaaaattattcaaattcactttttattaaatttacgtaaaactaaatcagacgaaaattttgtatcttgattaacacccatttcacccaaaaattggcaaaacttcgaggatttttttgagtaatttgatagcttaagaattcaaaaatatttaattcgattccttaaattttattaatttgtaacataattttctcttttcaaaggtgtagcactataaaaactacaaaaaaggtactgaacactcaaaaaatgctcaaaattgtgtaaaaattcataattgactttaaaaaaaccaaaacaatgactgatgatcagcgtaaagcacaattccattacattttcaaaatttatatatgcaagttcgaattttttaaattttatttatactataagtaaattacactttttaaatattttttgcattttgactgcgcgagccatagtaaaattgagtctgttaatattttaccaaaattaaacttgttttgtttgcaatatatatatatatatatataacatttttaggttgctttctttacttattttataatttaacgacttatttattcattttaatttttttagtttaatgttgaataaaataaaattatattaaataataatattcattagtttgtataaaaataaaccttaaaattattagttaaggccttttggaaaaaatgaaattaatagaaaataaagagaaaattaaaatatgcttttttcatttgataaaatttttatgtaattattaaaatttattttcataaatttactttgctaactcattgttagtattattttagtatatgacagtatctcttcacaaccagatagctaatctaggtagcgaagctcaagaagcgcgaagcgctttccccagcgccaccttcgcatgcaacacccgctagttactactatatattaatttcttatctattgtaactagagaccggacaagatggtcggtcgaacggtatcggttaaaaaccgaaaaaaaaccgaaaaaaaccgaaaaacttaaaaaattctcggtcgaacggtttcggttaaaaacccgaaaaaaaccgaaatcgaaaaaaccgaagaaaaattttcggtataccgtttcggtttcggtttttttgaattttttaatcttttcccaaaaaaaaacaaaaaccatttttatcaatagaaaaagcgaaagatcacctctgagtaaaatattttgttaaaaaaatggccaactgatttgtcaaaaaagtcggtcgattgtttcggttttttaattatttcggtcgaacggtttcggttaaaaaaacgaaaaaaaccgaaaccgaaaaaaaccgaaaaactcaaaaatttctcggtcgggttttttcggttaaaaaccgaaaccgaaaatcgaaaaataccgaaaaaacgaccggtccgatctctaatt

SEQ ID NO: 19615 - DNA, 1458 bp, Heterodera glycines
aattgtttgagtaccccaaacggacacttgaaaaaatcgattttttttgttttcggggcagtccccccgaaccgatgcgccccgatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtactccaaacggacacttgaaaaaatcgatttttttataaaatgacaattgtgtaattgattttaaatttttttagaaattctgagtttttaactgtttatttattttttgaaaaattaattcataaatattttttcagaaactgctctgaaacaaaccaaattttatttacatgttaagcaatgctctctgatgcttgtactatcaagaagtgaggtgaataaaattttaaaaattttaaattgttttttaaatatgcgaaaaagtttaggcttaaattttaaaaagtttcattgaatctagcgcactctaaaatgaatataaactcaccaaattttacaggcgtactcctctgtaaaaggactaacttaacctgaaaaaatctggcccataattggttttcaaaatttttagaaattcagagtttttcattaattatttatttttttgcaaaattaattcataagtatttttacagaaactgctctaaaacaaaccaaaatttatttacaagttgaataatgcactctgactcttatattatcaaaaaggagatgaataaatattttaaatttttttaattcctttttaaacaggccaaaaactttaggcttaactatttactgaaatttcaatcactcatagttttacgagtagtgatcagaaaaatcccagattttacagggtaacagctgagaacaatacctaatttatactttttcccccgtttactaggccttgttaaaaatattttagattttctgattttctgtattttttccaatttttt

SEQ ID NO: 19616 - DNA, 889 bp, Heterodera glycines
tttcttttctattgtattccatggaccgattttgagcataaatctggagctgacaacaaattttgtgtttatttttaaatgtctctcttaatgtgtcgtcgacccgcttccacagacatttcgtcgttctttacatcggtggtcgacaaacatatgtcaacgagttcaaacgatacccttaattagaataaataatgtgtcaaaaaagatgaccaaaagaattttttttttggtccgcaactttttcaaaaaatgatcaaaattttttttgttgaaattttgcaaggaaataaagaatcaaaattgttcaatttggttgactttgacaaaagctgtgacaatttttttttgttgtagaaaaatagagaccgaggccccgccgggactctcgtgtcccgttttttttttggaccaaagagagactgggattcccgggatcccgtctcggtccattttccaaatccaagtcccgatcatttctaaatcccgatctctactcgaaaaaccacagcaccgacccgaacaaaaaaaaaaaaggttttccattttattaattatatatgtaaataatccgcgcaccattttccaatgcgcatttgtaatgcaaaaaatgacgacgttcaacatcactcacagttttgctgcttcctgctttgtaaatatacaataattaacatacataagaaaaaatgaatgtaattatttaattatttaccaccactaattgatggagttgccgacactaatggaggatcatcattgtgagaataagtgattggaattgtcgcaccaacgccggaacaaatcaagcatttctgacaaaattataataattagggttcaaaaatatggaaatccaggctctatggcactttatgagtccatcgat

SEQ ID NO: 19617 - DNA, 2120 bp, Heterodera glycines
cgaaagcacaaagtctaattaatgtaataatacgagaaaacaagagaattctaacattccaagaaagttacaaacgaaaataatcagcaattacttaattaatcaaatcttttttggtaattgcctgaacgctgcgattttatatattttaacttcgttagactttgtgctttcgaatgataccaaaaagatagggtttgttcgaacatgaacaaagttattgtataaaaacccggaattgtcaattgattggactcacaaaagtcgattggactcataaagtgcattagagccaaaatccatattttatctatatttcgctatttaggcccataattttcatatttgtctatatttcgcattatatccttattttatgtgcatgttttggcagttttaacaaaaaaacgtgagggataatataagtttgcttctgtttacctttaaattgattttttttttctttaattcatttttcatattttcatttaatattttgtgtctctgtctgaccctttttcctttctttctctttgtattgttactgtgcagctagctgtgcatctctcagcattttttctttttcttgcccttccctcttgaattatctctctccctctctctttgtttttctctttcctttgcccttcctttatattatctctctctctctgtttttctctttctctattgctcattgttagtcacagagagagagagagagagagagagagagagtgtctttgtttctctgtccacaccccactctcctaattgcctccactctctcatccctaaattgattgtctttggtgtcagcaccgccaattcagagcgcgtcgtttagccaatgtgaacatacgacttcagccatttgagtttctataggtgggtacacaacacaacccccaatttcccatttatccccagcccatttatgtatgtacaaatgtataaaacaaaaattaaattaaataatgcccataaatttggcatgatttcgccgaaaaactctcagaaaaagtcgcaaaacaaaaattgatgataattaaattataaagagatttaaaatagaaaaaggttacaaaattgtatatagaaagctttaaacgcgatttaaaaattgtgcaatttaaaatgaaaaaaagatcacaatcaaattcggtactcaattcaaaatgccgcgcttgcttatacttagttattgtactaacaaaatgtggtatttttgagtacttactacacatataatcgcaccttttagtcccgtgaattattaaaataattgtttaagggattttttgctgcttttttttcatttccaacaaatccgtgggtttcaaaatatggaagaaactgaaattcaatcaccaccacaattgacgacacacaacaacaacaataataatgctattattgttaatgataatgttaatgatgatgatggttttgacaaaattgacacaacccaacaacaaacaccgcccccaacccaacaacatgggtcaccaccaccgacaacacaaatcatcacatcacagcgacagaaacccaaattgttgcacgacggtatgctctatgttcggcacaaactcagtaccagcaaagagatcaaattttggcgttgcgagttcttcaattcacgcatcgtcaagtgccggggtccaacaaaaattaattttccgtttcttcaaatttttggcaatggtaaaatgatgtgtttctgtgaaaacgaaaaaaagtgctgatcacgaatctgaactcattgatccagaagttcggcagtttagcatattgacagaaaaatttcatgttgatttaaattgcggaaaacaacccgcagccaaacggaattgaactctagagacctcgcctcataagacccctaaaggagcaataataaattaaaatttaatttcctcatacatttaatagcttattctaaagcatttgtttctataccattcagaacacggaatttacaaacaaaaaattcttagaaaattaaaaatttatgggaaaaataaattacttgatgaaaatcatagactcatgtaatttgcaaaatctaagctctaggagacgtgataagcgcattttttatcttacagaaaccacaa

SEQ ID NO: 19618 - DNA, 1369 bp, Heterodera glycines
ttaatttttctcttcatcattttttggtttaaaaactcccccaatacttttttatactttgaaagacttttttattacttcagaattttttgaaatttcctaaaatccgcaatcctgcgcaggatcctgcagattttaaatgcaggatttgcaggattaatcctgccggatcctgtcctgtaaaaaattttgaattccaatcctgcaacaggatccgcaaatttgaaatttccggtctctagtagagatagagatagagaaagaaagaaagaaaaagaaggtgtgtgagagggaaagaggaaaagaaacaaatagagagtgagtgagtgagagagagagagaaagaaagagtgagagaaagaaagggagagggagggagagatagagagaaagaaagaaaggcagagagagaaagaaagagagagtgaatgagagggaaagagagagtgagtgattgagggaaagaggaaaaaaagaaaaaaagagggagtgagtgagaaagagaaagaaagaaagtcagagagagcgagagagagatagaggagagggagggacagatagagaaagaaagagagaaagagaaggtgagttagagggaaagaggaaaagaaacaaatagagactgaactttaagccaaaaatacattttaaaataaccgtatttaattaaataatgttttatgattatttttaatatattaaatttttctttataaatcaatcacacttacatctaagaaactgaacgacagcaatttaccaccgaccaaagcgatgtgattcacagttttgccgactagataattttttcattattttatgattagaacgaaggtatttccaaaaaaaaattgctgaaaaaaatcaaatttccccaaatttttggacagaatttattttttaatttggctaatcccataaagctgtaaatgcccttctaattcattattcattcattgttggcaccactcacaaaggtgatgaaattcgaggccctgcttgaaaaagttgatgagaatcctggatttgctgttcagctgcttggccaatgagacattcacaaaaacaaaaaatgtgtcaaatttgatgttttgattgattttcaggtatttgatgcgcttccatttaatttgttttggacgctgcttcagcccctctttatcatatactaaacgaacagtaatgtaattttttgaaaaaaatttttttcttaattaaattcttaaaattttcttcggcgtttgcttatcgcaccggtggaccacaaaatttcagtaaaattttttttttaattcagcccaaaaagcacaaaaacccaaaatttggtcaagaaagagaaaataaattataaaaatttggccaagaaaaa

SEQ ID NO: 19619 - DNA, 1372 bp, Heterodera glycines
  misc_feature (1365)..(1365): n is a, c, g, or t
aatcatatattttgaacagatttttttcaaaaaatgtttaagataccgcttgaacatcgtcaatagtccatgcacacatcccccagtattaacaatatattgtccaaaaatatgggcacagttttatgtattcgccatatgatcgaccatagaaaccgtcctgggccatcagaattttcagtgataacgctcttcttgataatatgttcaatgagttttcttggacaggtccttgacgggtcacctcaaatgtaaattatttttgttaatccaaagacgggttgtgttgttgtccttatttggaggtgtcgaatcgtaaccctcttttttcatataaatttaattatgaaccgtttcttacaaaatgtccttatgtttcgtcccatgaattccttattttatcttcgattctgccctttgcttttaattatattgacctttttttttaaagattttgtccttatttgggggatatcgaatcgtaatcctcttttttcataaatttttttcccccattattttagcttatttaatattgttttgatttctacatcattttacaaaatatttaacggctaaatttcaaaaaaaaattttttttttttattgtttcaaaaaagttatggcctagaagaacattaatagcattaaccaatcggctcagcccaaccccaaatcaccatttttaatttaatttgaacagtttcttacaaaatgtcatttttttgagcaaaaaaatcttattttcgtttatcagttctttatttatctaaaattggaccctttgcttttcattattttttagagtgcggaaaattttatcgtactatggatgcgttctccacgaatatgtgttcacagaaaaactctttgccaagcccaccagcatcaacgttgaactccatttgtgcaataacataatcttaaaatttacaaatatttttaatttaaataaagaataataatatttgttttttaataaggcttcatgttttattttatttttttaaataaagtgaaaaacccattatataaataatataactacgatttgtcacgaaagaatttttgttttgttttgtttaaatacccttaaattttggtggtggcgtgatgctgacaggggcatccggtgaaaaattttaaaaaaattatgaaattttttttaaatatatgacatcccaataaaaaacggaatttcatgcatagaaataatgtgagagacttacttacaatataaaattaaataatatttgacaacacttaacaatcattgagacatttcggtgagccgttcaacaatttgacaataatttttcctctcggctttagatcttcgttacgaatgaggattagatcaccganaatttaa

SEQ ID NO: 19620 - DNA, 1107 bp, Heterodera glycines
aggaacaaaagtgaaaattttttaattttgactttttgttcgaattaaggtccgggattcgaaaatggtcaaaatgaatgttggattcgggttccccgacccaaaaaaccccaataaacatcttttcgcgactttttctaacaaaaagggcccccaccatctatagcagggttaccattgaaaatttcccgaaataagaacatcgctggtcaaaaataagattttagggtcaaaaataaggacatttttaaaacacgcttccaaaatttaaatcgcattttattcaacaaaatcaagcattagcaacatatttctcgccgccaactatttttctgagcaattccggcttagaaatgagaaatttatacatcccgaaaatggattttaataattttgtggaaaaaataagcaacttgtaaattattttaagttcattcgggatcaaaaaatcagtttttaacaatttttttgcggcgtgctttttccaaaaaattttgaggaatgggcgatgggatggggtccggcggtgccgataggcgccaccggaaaaaaatttgtaatttctttctgatttgttaacatattttcatcaaaaaatcatcaatttttgcggtttttacattcaaaaggctttttttgcggcatttttttaaaaactttcttttttaggcggggggaagtccggcggtgccggtaggggccgccgggaaaaattttgtaatttagcgcgacttagtaacaaattttcaccaaaaagaccaatttttacatggcaaatcttaggtcatctcttgaaatcttaggggaattttgtggcactgcggcgccgatagtcgccaatgggaaaattttgccaggcttttcactgtttctacttcaaacaaatttctcgtatttttttcgcgatttttgagtcaatttaaagaaataaaaagaattttggagctctggcggtgccgataggcgccgccgggaaaaaatttgaaattttagtgcattttgttaatagatttagtccaaaaaagaccaaatttttgattgtaaatgttagaattatgatgaattcccatcgataaaggaataatttgaaaaatttaaaaaataaaa

SEQ ID NO: 19621 - DNA, 875 bp, Heterodera glycines
aaaaattttccccggggttaaaaaattttaggaaaaatagtaagcttttgtagtgttccgatacgtatctctgcaaaattggagagcccctgatcaattacaaattatttatgggacgatcaaatttttttgaaatttttttaagtgaaaaagtggtggggtctgcaaaaaattttcaccgggtttaaaaaatctaggaaaattagtaagcatttgtagtgttccgatacgtatccctgcaaaatttggtgagccgctgatcaattacaaattatttatggacgatcaaatttttagaaatttttatttatttttgcaaaattaattcataaatttttttcagaaactgctctgaaacgcaccaaaatttatttacaagtcgaataaggcactctgactcttatattatcaaaaagggagatgaataaatatttaaaaaatttctaattcctatttaaacaggccgaaaaagtttaggcttaactttttcagcgggtttaaaaaatctagaaaaattagtaaaatctaggaaaattagtaagcttttgtagtgttccgatacgtatctctgcaaaatttggtgagcccctgatcaattacaaattatttatggacgatcaaattttttgaaatttttttaagtgaaaaagtgttgggtgtctgcaaaaaattttcaccgggtttaaaaaatctaggaaaattagtaagcatttgtagtgttccgatacgtatctctgcaaaatttggtgagccgctgatcaattacaaattatttatggacgatcaaatttttagaaatttttatttatttttgcaaaattaattcataaatttttttcagaaactgctctgaaacgcaccaaaatttattacaa

SEQ ID NO: 19622 - DNA, 1194 bp, Heterodera glycines
  misc_feature (8)..(8): n is a, c, g, or t
ttaatttntggttaaatttcatagaagtgacaagttcccacccctggtaaccaaaaattctcaacacattcattatcagcctctcaatatctctgaaatcactttcttcattttaattaagacaagttttcattaacactcgaaaaattttgggaaataacctaaaaattaattgtttaaaaatcagacatttatttttctgcattgctttttttgtttgtaaaataggaattcaaaataatttaaaaacgatttaattcaatacaatattatttattagattaattaaatttatttcttaaaaatatcatgaaaaaatttattagataagaaaaaaaaattaaaccatcctcagaaacacaaaaaataattttttcaaaatttaaatttaaattttaaacatttttataagaaattttcaagacaaaaagcaatgtttaaatttaataaaaggttttttgtcaaaaatattattgtttatttttttgaagttcaaatgtataaaaagaacataatatttgaaaataaatagatttaaaaatattttttcttatttaataatctaaaattacctaattatcaaaaattgttaaaaaaaatgtttttcaatatcaaaaaagtaattggtaaaaaatttgtaatgactaatacaatttcacatgctactcttaaatagaattattaatctgctaaacgagttaattggtgcagaaaaccaaataaaattttgtttcctttaattagtccacaaggcgatataataataattgtcattatcaattggtgaaatggatccaaagatcaaccgaatttctttttttacacaaaactgcgcgtaatcttgtaccagccgatcacatttctcgatcggctgtcacgcgaatcttcaaatttgactgagcgaaaaattgcgcaatcgtcagcccaaatgggaagaaaaaatgatagtaaaattaatatggaaaattaaaaatgaagttaaattaaaaaatatttatttacttaggatcaaatttatgcaaaaaaatatttttcaaataatgtattggaaattaaaagtggaaatttatttataaattctggttaaatattttgggaaaaaattggtttttattaaaaggaaaggaaataaaaaaaaggaaaattgaaaagggaaacaaagaaaaacaaaacctccaaattcttcaaattttt

SEQ ID NO: 19623 - DNA, 1915 bp, Heterodera glycines
ttttcaaatatcaaaaagataaattggtaaaaaatttaatgactaatacaatttcacatgctcctcttaaatagaattattaatctgctaaacgagttaattggtgcagaaaccaaataaaattttgtttcctttaattagtccacaaggcgatataataataattgtcattatcaattggtgaaatggatccaaagatcaaccgaatttctttttttacacaaaactgcgcgtaatcttgtaccagccgatcacatttctcgatcggctgtcacgcgaatcttcaaatttgactgagcgaaaaattgcgcaatcgtcagcccaaatgggaagaaaaaatgatagtaaaattaatatggaaaattaaaaatgaagttaaattaaaaaatatttatttacttaggatcaaatttatgcaaaaaaatatttttcaaattaatgtattgaaatttaaaagtggaaatttattttataaatgtctgtttaaatattttggtaaataattgttttttattaaaatgaaaatgaaataaataaaaagcaaaattgaaaatggtaaacaaagagaaacaaaaacctaccaaattcatcaaatttttcaattatgctttttctgttgacaaaaaatgagcaaacaaaaatttgtttattcataattttgataaaagtgagcacgacaatggcatgaaagctgcacaatttttttaaaattttgttttattattaattattattattcaaaaaaatatatttcacattgacgaaaaatgcacattcgaaatgaaatgaaaaaaatttgaaatttttttgctgttttttttcttcttaaaatgctttgagaatagtgatataaataaaaaattggatttcatttaacttaaaaaatttcaaaaaatttgtaatgtgtcaaaactaatgtacaattttttaaaaatacttagaatgaaaaaagatatcaagttttaattattacatttttaccgaaaattgccaattttggcaaaatttgcacaaaaaaaaactttgatttaaaattaaatttgccagttaaagtttatcgaaaaatcatttcaacaaattgaataccatagaaacataacaaacatagaatttcatgtggaaagcagaaaaatcccattttttcatttaataagaaaattttttaaatttttcccgtgaatttatgaattgcctgaccattaattaatttcacatttccgttcgtatattgttgtctttaaggaagctgtcaagagtggaaaataccttaaaaaagaaaatattttgaaaattttaatgaaattgaaaaaaagtactttttctttctgcgcaggagtaatttcttttgagaaaatgatgctcgtttcaatagtcattttttctggatgtattccccagttttttaagactaaaatttttatattaaaaatttaaaataagttattaggcatataattaaattatgtattcttagcaaataacgaattttattaggattatactttttggatctgttttatctttagcgcattgttttgttgaaaaaagattaaaaaattaggttgacaattttaattagaatctttttttatagaaattaaaagaaagcattcggttaaaaataattatacaaaaaaaaagatctgcaaaaaatcgtagtgaatttgtaataaaatgaataattttgcttaaaaaatatctgtaaaagcgtcaaattttaataaactaaatattaattttaaagatttgaccctgcgtggattcttcattctcattgagcaaatttgcaatatgttgtggcacatgatgaccagcaaatgccgagagaactgaaccgaccgaatgttgctcaatgaaattggccatcatttcttgcgcatccatccactcagaatgacccagcatgagtcatcct

SEQ ID NO: 19624 - DNA, 937 bp, Heterodera glycines
tcaatccgtccaacgccccccccccgggcaaatggcattcattcattcgtctttctgtcttcgtccgtcgttgtcgcacatttattatatgttgtgggtgtggacaacaaagaggacatcttgtgatgctatttggaatgggccaagaaacgaaagaaaatgcgtcgtcagattttgtatttatttgattcactatttttggatgtgatacgtttaattgaaaaatacaaaaagtttattcgattatcacagagacaaacttatgggaattatcaacactaataacaaaactatacgtaattaaattagagaatttggtccacaaaataaatgaattaggctaaataagttaacaaaaatgacatttcagcggaatgttgcacctctgcgagaattaaagtgaaacagcaaaatttgagagaatcggccaataaacaatcagcggaatacaaataaaaatatgtatataataataaattgtttattacacagatgtaaaaatgggattaaggctaattgaaaggctattcagttcattttgttcgtctgataaagaaaattgcagaaataacccagcgatttgttagtgatttgatttgtgtgactattgcgcggagatgaaagaacagcagcaaaaaaggtgtggggggggatcagtcagcagttgcggtcggtcggtcattgcttcttttccattgcattatttcattcatttgttttttaattggtcgtctgtttctctctctgtcgctctctccgtttcccttacgattcgctcagtgtctcttcgccgtccgttgccagcggtttcagcgcgataatggccaacttcacggccttggcacattcccccgcccttggcagaatgaaataatgcacgcggtttatgtgcgattcgcccgtgggcaattcgtagccgaatttgaacgtcaaaaac

SEQ ID NO: 19625 - DNA, 1495 bp, Heterodera glycines
gtcctcccactgcagtactgttgccccttctccaccatttccgtcgtccgcccaccgtttgcgcaattcgtccgtcgacccatgcgaagtgccatcttcgtcgtcgtcatcgttgttgatgctgaacaccgactgcacgttgcggtagcgcttgccgaaccgatcggtgctgctcacgtgcttcacattctcttcgatgtccgtcccctttcgcgggccgaccgtttcccgcggcgccattgattcttttctcttcggcagcgattttttcaaccgtttgagaaacgtctaaaaggggacgtgcgtctgacaaagagcaatccgcaattggaacttttatttggcatttttgcggaccgaccatcgctttgccgttttctccctcctttgggcccccttctttgcattccgtgcagtcgttcctcctgtagtggttgctcagtttggtcaagttccctccatcctttagcatttggtgcagcgtccgatatcctccgtccacgaaggaaatgtgctcaaaattctgttgcagaaacttggcgatcaccatgttcatcaaatggtcgccgtcgtcggtggttccaaagcccaaaaagcaaatgtgttcattcggataattgtcctgcttgaacttcatcagcgaatccatcgcatagccaaacttttctgggtcatcgacaagctgaaaaagaaaaaacagacaatttcatccgatttttcagcttacagaccgtttcagcactcaaattgtatgagccggggatggagccggcgttgaagtgcttttggttgcgtgtgtcaattacaaaatagccaaagctcgtgctgttcagcgtcgtcacgtcaatggcacgtctgtacagctcgtggacggagatgggcaagcaaatgagccgattcagaggaatttcggcgtattcgtcgatgagatttgagccgaaaagcatacaatgaaagtcctaccggaaaattattacgaaaatattaatgaatttttttaatgaattaacttctctgatggaaattggcgttaatttgaggtgcacaaagcaaatttccaatagatcgttgacatcttcgcgtactgatcaacgaaatgcgatcaaaaagaaagaaagaaaagttatcaaaatttgcccacccattcggccgggaacgcttttcagcagggcgatgatgtcatcacgcgctttcatttgcaaaagctcctcacggaccccccgggtgaaagccaaggcaatgaaaaatatcagaaaaggatcgccctaaaatgagaaaatcaaatgtaagcgaagtcgacacccatccacgtacattttcaaaataattttgccaaatggtccagcaaagttcggcttccatgtctttgctcagcaatgagcagaaccagtcccggttgaactgttcgggctggatttagaacgagtccaagaaggagcagagcctcgggtcgtgggggggaacagaagacggtacaggtcgaacatttggagga

SEQ ID NO: 19626 - DNA, 1154 bp, Heterodera glycines
ctaactactctttttgatcaaaaaattcaatatatttattttattaaaaggattggttgatctctagacgttctgtcatttgattaaatttgatatttaaccaaaattttgtgatgaaaaactttttggaattaaaaaaatttgaaaaaacttcggcttcgaaaacttcgggtttttgggcttcgagcttcggacttcgccttcgaataaaaattgggcttcgccttcggcttcggcttcgagtgctaagccgagcttcgcccacctctgatccccatcccatctgctgcattctgttgcacctccttttgtgccgctctgctttttcacacctcttccaccgtggttgtacctcttcaacccgtggttatacctcttataatcacagttgtacctcttctaataacactgtacatcttccactagtggttgtgctttacaacccaatagtttatctaggtagcgaagctcaaaaagcgcgcagcgagcattgttttgttgctttttctttactttttttgcggtgcatttttggagggtccaaatcttacaaaataaaaatgttcttattcgggcgattgttcttattttgttcttatttcttaaaattctccagaaaatttgtaattttatggcataatttatttgattttcaaaaaatttttcccggcggcgcctatcggcaccgccggatctctccccttgcacgtacaccaaatttttaggaaaaagcgcgccgcaaaaaatagtgtttttagaagcaacaaattcttcgcttggccttaattgcataattgaactttttggtgaaaatctgttaacaaatcagaacgaaattacaaaaaaatttccggcggcgctatcggcaccgccagaccctctccccccgcctatttctcagagttttttggaaaaatgcgcaggaaaaaaatgtaaaaatctggttttttgatcatggatgctctgaaatttacaatttgcttatttcatcttcaaaattgctaaaaccaataatgagagacgaaagatataacatttaaaacattttagtcgaatagattgtaaaaataactgatttgaagcaattttgcaaaatgttcttatttttgaccctaaaatcttattttttggccctgacgttcttattttgaaaa

SEQ ID NO: 19627 - DNA, 1958 bp, Heterodera glycines
  misc_feature (339)..(339): n is a, c, g, or t
  misc_feature (502)..(502): n is a, c, g, or t
  misc_feature (1896)..(1896): n is a, c, g, or t
  misc_feature (1900)..(1900): n is a, c, g, or t
aaaaacaaaacaatattttttttttctttttttttttttttttttttttttttttttaattttttttttgttaaaatagaaaaaatttgggattttttttttttttcccccaaaaaatttaaattttttgggttttggaaaaaaaagtgggccaactcttaaaaaaattaaatttaaagggtaaaaaaaaattttttttatttaaaaaccccaaattaatttaaatataagaaattaaattattggaagaaaaaataaactttataattttttatcaaaaaataatttaaaaacaaagaaaaattttcctaatttttcttatcggcgaaatataaaaangttcatccttgatcttcaaaattacttcagaaagttatgtcttttttttgaacattttttgatccgaactttctgaaaactcaatgaaattttctgaaattttttagctaatagagcaagccaagagctatcgcatgaaaagatcttttaatttggttgtgtntaagaaagttatgacgggttttttggcagttttacgaaacgcccatgttggcagtttttacgaaacgactagcacccaaaattaccaatttagtgggtttttgcctaactcttttaatcgggttgtataaattgataataatttttattagaatagacaccaataattaattagttaatttatttatttattttcaactatgcattaatatttatgtttcattgtataaaaattgcttcatttttttacaattttctgtaatttaaaattttgttctttggtatgtttcttctctaaaatgctcaatctcaaaatctgatcagatcgtgcgagtcgatccaaaaaaaaactcatcttccaccgaattatcatttcaatcttcagtctaaaattgttatttttttcctgaattctccatgctctgaatatgggtgggtatatccccaaaaaacgtcaaccagccgaaacaccgctggaaaaaacgtcgccgagacaaaacgtcgccaggacataacgtcgccgcaaaaaaaataaataggattttcaaaaattttataattttttttctgaaaactaaatgttactaaaaacaaaattttcagagtttctagaaaaaacttatgctaagtaactaaaaaaatgagtggaccccaaaatttcgctgccgaaaattttttaaaattttaaaattcgaaaatttaaaaaaaattgaaagcgattttttgttaatggaactcgtacacaagcaactcttccaataaaaatttcaattaacaaagcgtaagctttttctcagacttgaataatttttaagcttgagaattttttaaaatttaaaaaaaatttgcggcgacgttttgtcggcaacgtttcggcggcgacgttttttcttgctccgtctgattagtacgaaaaactttgcgaacaaaagttgggacttttatttacatattcttacatatcccggggttttacacatatttggtatatattttggattttttaacacttttttatagatttttaaagcaagtttttataaatgcgccaaaacccaagaaaattttgctaattttttcgtacatattttaatttttttacattttgagatttatagaaatctcttgtgaaataattaaagttttttttaacaagtacccctaaaaatggtatttcaaaaaaagagatatcaaaaattaatttttaaatatattaaaaggtgattctgctgagcctattagatcatcttttatggcattttgtgcctatttcaccctttacaaacaatttttttgcaaaaaagaaccatttgaaaaatttattaaaatatttggtacattttgtttttgaatatatttcttacatatccgaaatgtttcttgcatatatatgtncatncatttcttaagaaaaaaggaaaatttttgacaaatttttggcactttttaacatctat

SEQ ID NO: 19628 - DNA, 1371 bp, Heterodera glycines
aaattgcaaaaattagatggggtgcgtccctttgtaagaattctctcgtcgtctaacccgccccttctcatgcactatttcagggtctaaaaaatgaaaaaaaacaaatgatttttttgttaaaaatcatagaaacttttcagcttttaaattttaaacccgcacgattccgcgattcaaaaccgtgaaaaaaagcgagaaaactattgcattaaatttaagaacgaaaattttgacttgaaaatttcaaacatttgcctccaccttcttttaagtcccacccgagggcgagacagttccaaaatttgggtgccacataaatgtggatgtaatagtaccttaattggactatcactagtcaatttaggtgggggattttgggctctaatggaactgaaaattgcaaaaattagatggggtgcgtccctttgtaaggaattccctcgtcgtctaacccgccccttttcatgcactatttcagggtctaaaaaatgaaaaaaaaacaaatgattttttttgttaaaaatcatagaaacttttcggcttttaaattttaaacccgcacgattccgcgattcaaaaccgtgaaaaaaagcgagaaaactattgcattaaatttaagaacgaaaattttgacttgaaaatttcaaacatttgcctccaccttcttttaagtcccacccgagggcgagacagttccaaaatttgggtgccacataaatgtggatgtaatagtaccttaattggactatcactagtcaatttaggtgggggattttgggctctaatggaactgaaaattgcaaaaattagatggggtgcgtccctttgtaaggaattccctcgtcgtctaacccgccccttttcatgcactatttcagggtctaaaaaatgaaaaaaaaacaaatgatttttttgttaaaaatcatagaaacttttcagcttttaaattttaaacccgcacgattccgcgagcgattcgaaaacgaacgaaaattttgacttgaaaatttcaaacatttgcctccaccttcttttaagtcccacccgaaggcgaaaaaggtcccaaatttgggtggccacataaatggggatggaataataccttaattggactatacccaatcaatttaagtgggggattttgggctctaatggaactgaaaattggcaaaaataaatggggggcgtccctttggaaggaattccctcttcgctaaaccccccccttttctggacttttttcggggccaaaaaatgaaaaaaaaaccatggaatttttttggtaaaaaacaaaaaatttttccggttttaaatttaaacccgcccaatcccccgattcaaaacggggaaaaaaaaccaaaaaactat

SEQ ID NO: 19629 - DNA, 1517 bp, Heterodera glycines
ttttccatttatgctggattttgagaacagaaaaagttgagatttcgggattttggaacccgctcggtctcgatcaactcaggggagttcataaaaaattgtttaattgtttgctgtggaaacaaaatttgtacaaggatgaacgcattgtcggcggcggggtggcaggacgtgattgatggtgctgctgctgctggcttagattgttggaacctgggcgaaatttaatttaatttttttgtcttacagtacaaagtttactgtaatccatttccattaccaccgtagtttatcaagcatataacataaagtggttcatgactcggaataaaatcattaatataaaaatctaccaaaaactgtaatttaaaagaatatttttcctacagtatccttccatatgtcgtacaatggatggcttttatgtcctaccgtaatccagcattggaccagcgccggtgctgagttggatgatcggcaacattccgccaagcagagcagacggagaactcctttaaaaataaatttaaaaaatttttttaatttaaattcgaaaaaattttactgtgcgccgccagtcacaatgcgaattcgttgtcgcatatatttcatgagggcaagtttgatcaacgacaaaaagctgaaaaaagacaaaaaaaaaataaagaaattttttcattcggcgtattccatatattttccagaatatatttcaattttaattttttcccctttattttttacttaaaaatttgggttttttatagagtgccacgggaccgggacctggtagcggacaactgagtccaactgagtaccaaggtcccggttttgaccgggaccgggactagtcccggttttttcgcggttttcccagccaacaaattcccggtttttcaacccgaaaaggtcccggtccagggtttgcccaaaattcccgatcccgtggcactctagttttttatattaacaataaaatcctagttttattttattgttttataataccgaaacgtcttacacaatcatgaagcagacagccaaccaaatgtccaaagctgcaaaaatttaagtaaattttttgaaatttttaaattttatatacaaccaagaaaatttacctttcaaataactgactcttggcatcacctgaaaaaacattaaattctaaaaacacaacaaaatgcaattgccctgacgaacttcattgtaggagaaaagcagaaaagtgatggtcaaaatgctgtaaattagctgataaaattaaaaaattggcctcaaggctggcatacatggagatcatgtctgaaatacggtagttttttttttgttggatacggtataattcaattttatttgtatgcatttattatagcccgggcgggaacgggacctccgccgggactttcctgggatcccaatcctggcttttttggaaaaagtgccgaaatcggaatctcgacaaaaaccaatatttgaatccctttaatcttcttatcctggcgcctggtgccaat

SEQ ID NO: 19630 - DNA, 1178 bp, Heterodera glycines
atttaaattattttttaatgtaaaaaaaatttaaaaaaattatttaaacaatttttaccggtcgcatatgattccaactgggaagtgacaaatgcttctttgattcggaagtcgggcagccgaattttgtgcagtttcagtgcctcgcgttggcccttggaccagccgtaggacacctggtccgaggtgtacccatctggcaaaataatgcaattttttaaaatagttttcgaggttccgacaaaattagggttttccccgacattcagggagagaaaagtcgtggatcggggaggaaattctgtgaaaaaatttgtcggagaaggttagagaaattaaaaaaaatttcggtgagcaacccctaacaccatgaaaaaagccttcattaaaacaattaattttgtaaaattgtatacccccattaaaaaaatcaggcaaaaaattttacagctttcaatgccaagcttgcaggtctgcgaatcgaatggaaactgtaaagagaatgaaaaaaatattgaaaattaaactcattaaattctaattgggtcttgccaaagttaaatccatggggcacctaaaaaaggagaaaattttaaaaaatttaaaaaattcattgctttactcggccacaacggaaaggcgacgactgtaaagaatttggccattggactgtagtctgaaaattggacaaatgaaggaatgtaaaaattttaaaaaatttaaattgaaataatttttgtattgactttttaaacttctgaagaaaatttgtgtaaaagggcgccgccggagaaatttcaactttttaattatattacaaaaaattgcccaaaatttttatgacgaaaaattattagtttgccgtaatttctttcaagaaatcgtttcaataataaccaaataagtttcagttactgtaccaaaattatcgaaagatcgtcaaaatcagtaattttgctctcaaaaataccgtaaaaactcatagaaatttcttgagtggatactctcgggttttcagctttcgccaatcataatctttttttaaatctccttatctctctcgtaaaccaaattccgttcctcccggttccaatttttgtaattttgaattttgctctcgcccacatgagcagtgatcggtgtgagatggactgttcgcgcggatttttagtcgcaat

SEQ ID NO: 19631 - DNA, 1627 bp, Heterodera glycines
aaaaaaaaaacaaaaaccccgcgcggcggggggtttttttttttttttttttttaaaaaaaaaaaaaaaacccaccacccgccgggggggtttttttgttttttttttttaataaaaaaaaaaaaaacccccccccggggcggggggttttttttttttttaaaaaaaaaaaacccccacccgggggggggggtttttttttttttttttaaaaaaaaaaacccccccgggggtggggttttttttttttttaaaaaaaaaaaaccccccccggggggggggttttttttttttttttttaaaaaaaaaaaaccccccccgggggggggatttttttttgggtttttaaaaaaaacaaccaacccaaggcctgggagttttttttttttttcagaaaaaaaaataggtccacccaggggtaggaagtttttttgatattcagaaaaaacagctccagccagggctaggagttttattggattttcagaaaaaataggcccagccagggctaggagtttttttcgattttcagaaaaaacaggtccagccagggctaggagtttttttggtttttcagaaaaaacagtccacccagggctaggagtttttttgggttttcagaaaaaacagtcaagccagggctaggagttttattggattttcagaaaaaaaaataggtccagccagggctaggagttttcttggatattcagaaaaaacaggtccagccagggctaggagttttattggattttcagaaaaaataggcccagccagggctaggagttttcttcgattttcagaaaaaacaggtccagccagggctaggagttttcttggattttcagaaaaaacagtccagccagggctaggagttttcttgggttttcagaaaaaacagtcaagccagggctaggagttttattggattttcagaaaaaaaaataggtccagccagggctaggagttttcttggatattcagaaaaaacagtcaagccagggctaggagttttcttggattttcagaaaaaaataggtccagccagggctaggagttttcttcgattttcagaaaaaaacaggtccagccagggctaggagttttcttggattttcagaaaaaacaggtccagccagggctaggagttttattggattttcagaaaaaataggcccagccagggctaggagttttcttggattttcagaaaaaacaggtccagccagggctaggagttttcttggattttcagaaaaaacagtccagccagggctaggagttttcttgggttttcagaaaaaacagtcaagccatgggtaggagttttattggattttaggaaaaaaataggtccagccagggctaggagttttcttggatattcataaaaaacagtccagacaaggctatgagttttattggattttcataaaaaaaagaccagccaggcctaggagttttcttgggttttctgaaaaaaaaaaaagccacggcgagaagtttttttgttttttatgaaaaaaaaaaacccccccgccggggaggggtgtttttgttttttttttaaaaaaaaaaaacaaccccgcgggaggaggtttttttttttttttataaaaaaaaaaaa

SEQ ID NO: 19632 - DNA, 2251 bp, Heterodera glycines
  misc_feature (46)..(46): n is a, c, g, or t
  misc_feature (65)..(65): n is a, c, g, or t
aaagtaaaatctgattacatattcgtgatcagcggcccaaataacncctaaagacatgtttttgnaagatttttgacgaaaaattttttcaactcaaaaatcctatgctcaccctttggtcccgaatccaaaaatcacttttatttttataacaattcttaaaaaagtgataaaaatgccaaaaaaaatttataaaatagagcaaaaaattgcggatttttgtagtattttactcttctctaatgacttttcagaaccgagttctgaatttttttctgaaaaatcgaaaatttccagaatttctggaataactttttttgtttttgtggtataaatttcaaataaatctcataaaattctcccgattttttgctattttttatgctttaaatgagctgaattggaccattttgaggcgagttatgaatttttataatttaggttgaattttcaagggccaaaaattattgatttttcaaaatttttttacctccctccaaaaaatccaaaacgcaatataaagtgcatattcgtgttcagcacctcaaactaccccagaaaagtattttttggcaattttaggagcaaaaaagtttctcatgaaatgcaaatccatggggtcccccctttggttttgcatttaaaaattcatttttgttttataactttttttatattaaagataaaaagaccaaataaagcacataagatagagcttaaaattctctacaaaaatggtctaagacgatttttcgctaaaatcaactcatgacgagttatgagcccgggactgaaatgtcccggtcaggccaaaaaatttttctatttccgggaaaaaatcgaaattttttcaaaaatgccaccaatcgatagagctcgaaaaactatgttttgaaagtgcccttagtttccctgggaaaaatcggcaaaaaaagataaaattcaaaaacgaaaaattttcgagggggcctagctcgaaaaattttgaaaattttcaaaatctgaaaacgccatcggatgcagctttaaaaactacacaaatgctcaagcggcgccaacccgctccgcttaacccccagcgagttattcgcgaaattcgaaaaatgccaaaaatggttttcaaattttgccaaagtgtacaggctaggcttttgcagctaggcatgccaaataagcgccagattatccctaacactccaacttaaaatcctcccaccaagcgtttttcgctcccgcttcttcccgcaatgatacaggccggcaaaaacggacaaaaaaatttttgggccgtttcagcgccgctggcgctcagttggccaccggatcgaaaaacccgtatttttcccagatgcgccgtcaaaagttggttgagtgatgtcacactcccgagcccctcccggcgcccgttcccgagattttggttttagagacgagtcctgagattattctatatagagtagaaactagcgtgttgtggcgcagtaattgctcggtgtagacagtatacttgtgagagatgaaaagaatatgcattaacatgagcgcttcgcgcaaaggacttcgttgctagtgcttgcgcggcttctttgtctaatagattcggtaaggcataatgcgttcattcggccgcttcccggcctcattttattattcttaattaattaaatttaactaatttattttcattaaaacattaaaatattatgctgttttaaaattcatttaattaaatataaagaaataataacaaacatatgaaaaatcatccaaaatagataaaagttaattaaaaatgcattcacttttaaatttttctttatttattttatagaaaaattattttcatttttttaaaattgaattataaaaaataacaaaaataattttgacttaataattagcattaaaatatagcaaaaaataaatcaaaaaatgatttacatcgtccgggttcgaacctgaccaactcaaaatgatgcctcagaatccccaatcacgcagggattctgaagtcttatcgatttctaaagtgaaatctgattacatattcgtgatcagcggcccaaataacccctaaaatcattttttggaagatttttggtgaaaaaaattttccactcaaaaatcctggtcggtcacacctctttgatcccaaattccaaaatcacttttatttctataacttttttaaaaaaagtgataaaaagctaaaataaaatttataaaatagagcaaaaaattgcggattttt

SEQ ID NO: 19633 - DNA, 1304 bp, Heterodera glycines
  misc_feature (1196)..(1196): n is a, c, g, or t
  misc_feature (1213)..(1213): n is a, c, g, or t
  misc_feature (1241)..(1241): n is a, c, g, or t
  misc_feature (1261)..(1261): n is a, c, g, or t
  misc_feature (1279)..(1280): n is a, c, g, or t
  misc_feature (1297)..(1297): n is a, c, g, or t
ttcaagtaaggaagccttgaaattctgtaactttttgacgtatacgagtgcttactttactattttttttcacattataatataaaatagaaaattttataaattatacacaaagcaataaaaaaaacgtaaaatgaagcaggatgtaaatgtaaaaaagccacatcattttcgcatattatacgtcatttaacattcatattgcatagcgcaatttcatttccattggataagcatatcaattaaaaaattcatagccaggctaacatttgccatcttcgcgcattaaaaattaaatcaaaatgctcaggcataatgccaaactaatttttccatggtttagaaatggcgacttttgcctttcattgaccgaaacgttttcgagattcgttaactaagatggggtcaaaaccgcaaaaacgcgagaaaataaatgagataaaatttttggaatttgataaacttagcctctggatggaaaagtcacagagttaacttctaaataaattcttgccataatttgaagaatagggaaattagttttttttaaatattaaaattgcactaattttttaataaaaattgcaaaactaaagttttttttcttattatcggccttttttctaatcattaattggtcttagatgaaatttttgttaacatttttgctttcatgtatcattcttcttcatccgcaagtgaacgggaatccattcaatgaagttgtttgggctaacaactgccgaaaacacatcaacgaaatggaaatttcggccaaatatggtgggaaatactttaaaaaaaacataaaaaataaaattatttaaaatttaaatttgtcaaaatattaatgcttttaatgagagcacataactttgaaaaattattctaaacatattcctgaatttgaaagactgtgggttttaattcagaatgacggttagaataattccattaatacataaaaatatttttaataaatttaaaattacatacaatttcgtttttcaatgttttatttaatttagaatccaattctaatccgatcactagataaaacagaggttgggacctgttgagttcgctttttctcggactttgcaccgtaaaatgaccttaagaattttacattaagaaataaaaattagtccattctataaattttaaaaaagttctttagttgactattttattanattaaaaatctcttganaatatttgtatcatttgataattattanaaaattcgtttaaatgtttncataaattgtggcgacgnntttaaaatttgtcaaanaatttta

SEQ ID NO: 19634 - DNA, 1278 bp, Heterodera glycines
  misc_feature (64)..(64): n is a, c, g, or t
  misc_feature (88)..(88): n is a, c, g, or t
attataaaatgaaattacaacgtggttgatcacttcaaaagtgcaaaaatcaaaaatctgattnttcttttttttttaaagaattttntaattataaacaagataaaagtgataaaatttacctaatattaaaaaaatcattagccagatgaagcataaatggcgtattttccatttaaaaaaatatatatttgagttcatttttaattttattcatttctaattgaactttaaaatattaaaaaatttaaaagtgatctggtaatgattttatttaatattaagaaatattaattatttttttcgaaatacaacaaaatttaaattacttttggacaattaatttatacatatgttgtccacaaagtaagcggattttcccttttgtggaccttttctttatgaaatcagatttttggttttttgcacttttttgtgaagcgtccgaatttgcactttttgtgaagtgacctagcactaattataaccattaagaaaacggtgcaaatctgagcagagctttgcataatttgacaaatgaaattggccaaaatggaaagtgcgaattgtcatacgcaattcacaaaaattatattaccgaagctaacaaaaagaacaacaaattcgacgcctcaaattcgcactttatgtatgaattggacaaaatcaacaaaatttcaattgaccaatcaacgaacacattgccaactgcattgatatggattaatcaattgcgcaccgatttcgccacgttggtgccagaaattgggctggtggacatttggcaaaacgttgacagttacacggaaacccgcgagttggtggtgaaattatgtgaaaaaattgctacaattcaaacagatgtgtcttacaatggcagtaatttggttaatcagatcatcagtgaagcaaaagataaattggaggacttcaaagaaaaaagcggtgggtcaaattgagtcgggcgcaaatttgtcactggttgtggtgttcgagatacggtattgaaccttaacgaattttgcagactaatagagaacactactaatatccaatgataacaagaattaaaatcttagttagatttgagcaaagttatgtgtaaaaacctatgattatagcacaccgcgcttcgtctcgggaaatattgcccgccatcaaaacgattaattagggaagggtacaggatggtgacaattagatgggaaataggacggggcgagagttcgtcatgaaaatgaggaaataaaatttttctcgttagtatctcgacctgca

SEQ ID NO: 19635 - DNA, 2040 bp, Heterodera glycines
  misc_feature (101)..(101): n is a, c, g, or t
ttttaaaagattgaaaaagtgtctgaagagcaaaaatgaagcactcaaattaatgacaaaggaagtttttgaacaattccgtcaaaaaattgaaatgaatntaagtctttctgacttaattcttcggaaatgggcattaattgccaatagtaaacttggcgaaaatcaaataatcgggttccaagcttcaaatacatggactaacaggttcaaaaaaaggcaccggattgtatcgagaaaggtctgcaaaataaaattattaaaaaattaaataaaaattaagatcacaaaatttatttcaaaaaaacattttgtgaattatgaaaatgtaaagaaggaagcctctgaatttgttgaaaatattcggaaaattatcaaagatgagaaattttctgaaagagatctgcttaacgcggaccaatccggcttcgaacttgaaatgcatgccaagcgtaccttggcaccacttggaacaaaattagtcgaatgtgtagtgcaatcggtggaaagtactacacacagctataccataatgccattaataacggcgagcggaatattgctgtcaccactatttatagtcattgcagaacgatcgggaaaattcccgaaaaaaggaatattccaagtttttaaaaaatatattaccaaaatattggcaattttaaggcaaaaaacatttattcggttgctaataccagtcatattatgaccaaaacattgatggtcgaatgggttgaaaatgttctatacccaactttgcgctcaaaccaaaaaactatgcttttggttgatagttggccaggatggaatgaattcgagaccaaagaaggggtagaattaagcgtaaaacaaatacccaaacatggaaccggaatttgccaaccacttgatgtctacatttttcggtagattttttgtgtaaatattttaaaaagtttaaatttagtatgtggaaagaatttacaaggaaagtcactcaatttgttattgtttgtgaaattgatttaaatttgcacactcgggacaatatcattaaattgcaatcactgatacacaaccagctccaagcaagccggtttaatgcttggataaatttcgcgtggcgaaaagctggattttatgggaatgactccttcccaatttttacgcacccagttaaatattgttttgatgcaaaaaagcagccacatcaatgccaaaagaatgaatgtgccaatgttgttttaatccggtgcgctcattgcgaaatcttcctatgttttgaacatttttttgtcaattaccatatgtgtactgattaaatgattttgatttagagaaaattaaaataaaatttattaaaaacaataaaaaaaaatgtttgcgtaggggggactcgaactttccattacaaaaatgaaatcgtgacacacaaccaccctgacaaccggtcgcttgttgcttctccttttaaatttaatataatataattattaaatatttaaagcctcatatctcggcacagaagcttattccgcagctagaaaaaaaatttggcaatacaacccaggggtggtctacccacctacaaagtttcatttggaagttccaccatcacccgaacactctcctttgttagtgaagaaaatactcagtgtcgaatttatccagtgtcgaaattacatagcgccccgccagatccccctgttcccaattttttttttgaaaaaagcgcgccaaaaaagtagatatgcagcgaaatgaggaaaatagtctgcgaatagcaaaaaaaaataggggaaaaaatccatccaggtgaaattgaaaatcggaataattgtaattggaaagaggtttggactagagttgtacgggacagggaattttggcaaaaccgggaccgggacttttgggttgaaaaccgggactttttggctgggaaaaccgggaaaaaaccgggccttttcccggtaccggtcaaaactgggtccaaaccgggacttcggtactcagttgtacgtgtttttcagtaccaggtcccggtcccgtacaactcta

SEQ ID NO: 19636 - DNA, 1576 bp, Heterodera glycines
ccaccccttagtcaaatagacatttaatgcttggctaacagtttcattgtttttcgtcgagggccaaacatttctgcagtattcaacatgctagtattccattttctagatatatacagccaccatttaaaaaagttttaaattcaaagacataatgtgaatatatgctctttaaagggaaatttatagcggattaactaaatttctgaaatttcaatttatgttctattttattactcattttcattgtctttttcagacttttctctgcacaagaaattaaatagttctctatttatttaaatgctaactttgcataaataatttgataaaaataaaattttaccgaaaattttttctctcagttgaccaaaataataaatgcctaaaagccgtactatttttgcttcccacaataacccgaccaatatgaaacaaatttataaaattggccaatataattgagaaattttaaaatatcgctaaagtttattaatgaatatcataggccattgatgccctattttcagaattagaaacaaaacacagtgtctttattttgacttccgcatttattttcgttatgcacatccaactgaaagatacggacttttactcactgtagttcctgggtaatttataatttccacccttagtcaaatagacatttaatgcttggctaaaagtttcattgtttttcgtcgagggcctaacatttctgcagtattcaacatgctagtattccattttctagatatatacagccaccatttaaaaaagttttaaattcaaagacataatgtgaatatatgctctttaaagggaaatttatagcggattaactaaatttctgaaatttcaatttatgttctattttattactcattttcattgtctttttcagacttttctctgcacaagaaattaaatagttctctatttatttaaatgctaactttgcataaataatttgataaaaataaaattttaccgaaaattttttctctcagttgaccaaaataataaatgcctaaaagccgtactatttttgcttcccacaataacccgaccaatatgaaacaaatttataaaattggccaatataattgagaaattttaaaatatcgctaaagtttattaatgaatatcataggccattgatgccctattttcagaattagaaacaaaacacagtgtctttattttgacttccgcatttattttcgttatgcacatccaactgaaagatacggacttttactcactgtagttcctgggtaatttataatttccacccttagtcaaatagacatttaatgcttggctaaaagtttcattgtttttcgtcgagggcctaatatttctgcagtattcaacatgctagtattccattttctagatatatacagccaccatttaaaaaagttttaaattcaaagacataatgtgaatatatgctctttaaagggaaatttatagcggattaactaaatttctgaaatttcaatttatgttctattttattactcattttaatagtctttttcagacttttctctgcacaagaaattaaata

SEQ ID NO: 19637 - DNA, 2477 bp, Heterodera glycines
aaaaatccaggggggatttaattttatttatttaatttttaatgtaaaatatttttttaataataaatatttttataaaaataataataataaggtcatcgttctgtgttcgctaaacacccaattttgttcaccgaatctggcattttctattttgaaatcagaattaaaagctgtaaaaggtgaaattacaaaaaaaaattaagttcgatttgatttatattttaatttagtctttgctcaattggatttgccaccaaagcgatgccattgggcgaaaatgttggccaaaattcggacagttgtgcataccaaagcgatggccaattttggaccaatgggtcaaagaattttggaatgccgaacttttctcgtggcgatttcgtcggttgtggcattaatttggccactcggcggattatcttcacaaagaatggccaacctttgggtcttttattttattttaaattatttttatttgaattatttttcagatacttccgatttgttcctttcgcctccttttggttttccattgtttccgttcatttctttgaatgattctggcgatttgattgagacaaattttggaccacaattcaaattcgaccccgcaaaagtaaagagaacaaaattatttaatcaaattcagtgcagtttttctcggcagctattttttttatcaaaatttatgaaattgcacgccgaaaaaagttattgccgagtattgttgtgtaaactacaacagagccctaaattgtttggcctgaacaaaatggacattagtgccgatggtagcccctaattgcattatcgtaaaaacatgttataggaatcgctgatcacgaatttacatccatttagaccaatcccggacctgaattcaaacaaaaagtcgaaagcacattttccaacacatttatacaactaatcactccgaatgcataagtgtgtttcgtgaagactgtgcctataacatgttttacgacttaaacgggggctaccaacagcactattatcacctgaccattttttcaatttttaattctagcttcttttaaccaatttaagaacaaaatcaatcattttttcaaggactccaaaaacccaaagaaaatttttaaatttttttgtaaaaatttcttcatttttaaaggccgaagctgagaatcgaaagctgaaaaatgaaattgagaaaatacaggaaaaatttgacaagaaggaggagcaattggagaaggatttgggggaattgcagaaaaagttggtcgaaatggagcaacaacagaacgaacaacagaagagcaatgaacagatgaaaaaggtgggaaaagaaatatttacggcacattttgaacgatttcggcagaaggcattccaagaagagcttgagaaaaaggtcacggaacgaattgtggcagtgcagtcgaaggttgacaaaatggaaatggcacatcaacagcaaaagggtaagggaaatgagcaacgattactgtacctaccgtaacattgttttattactgtcaattattaattgaatttgttccaatttaagttgtcactgaaaaggcaatttttgagcgaatcggcgaattggagggacaacaaaaacaccaaaaacagcaaggggaaagggagacaaacggcgagaatatattttcaatatattattagttttaattatatttttaaatctaaatgcttttcatcttttaagaaatacggtatacgacttttgaaaatatcaatttgaataaaaaattaattgttttctatttttagcattcttacaatcgcaaaatgatcagaagaacattttggaaagaatcagtgaattggagaaagaacagaacagctgcagaaggaaaacatcggtaaaatatcaaaaataaattttaatggaataatttatttaatttcaaaaacatttaatgaattattctaattttttttttgaattatacgaccttttcatgatacaatttgataacttaacaacaattttaaaaaattaattgaaaattgcttcaaatttcagtttcggaagatcatttgaaagcaattttggagagaattggtcaattggagaagcagcaacaacagcagacaaaaggcgaggagaaattaaaatgaaaaaatatttaatcgaattaaatattttcatttatatttgtaaataaattcgatttttaagctactgcggggcaattgtcaaagattttggaaaaaattggtgaaatggaaaaacagaacgaaaacacggacaaaggcgagggaattttagcgaagaataaattatcaaaaattctttttttttgaataagtttcttatatgaattaagaatttcatttaaataaattataacatttttaatttttgaaaattaattttaggaactttggagcaattttcaaagatggaaaatgatcagaagaacaatgggaaagaatcagtgaatggagaagcagacacagaa

SEQ ID NO: 19638 - DNA, 2034 bp, Heterodera glycines
  misc_feature (52)..(52): n is a, c, g, or t
aggcggagcgcaaataccgtatcaactcggagattactgtttcttacggtcncaaagaccacccaccgcaggcaaatggacagctcacgcgaagaaagcttccggagattcctcctcggacctttttgtcttctcagagtctttctccccattcaactggctatattaacttatccacaaacgcattgtctgtcttagacggacgcagggagccgaggacaaatcaaaatcatcagcaggtaacgaaaagcaaagctaattggaaatgggaagggaaaagacttaatgagacggaaacggtaaggaaaagagcaaggaatttgaaaaattaagaatactttttcaataatctgtatattttgaattggtttaagctgatctcaatgcactcaaacgtttgaataaatttataagaattggagaagtaaacaaacagaagtgaacgaacgcaatttatataaataataaatttatgcatttgattatttgtatgaaatgtctctaatttcctcaccatttttcatttttattaattcttctcatcttaaccgaatatcatatcttacttattgtatataaatgatctgtgttaatgagtagggcttcgttttttaggcacaaaaataggcaaataaaattttttattaacattttttaggtagcaaaacacataaaaaattaatcaaaaaaagctaatttggttatatttcaattgttttaaagtttttttttcgaataaggacaatatttatatcgtataagcttcaaaccaagtggaaaacgcattttcgagcttattcgagcgtatcaagtgcacagaaattttaggcatttgcctaaaaaacgaagccctattaattgagtaagaattatttcgtgtacattgtcaaaaatttatgtaaagttaaactaaaaatgaatatatatattcacaatttgtggatttgtatttttattatttggccattttatcatatcgaaaaatgaatagaattattttatcatttaatcattgccatttacaaaaaaaagaattgatttattcgccatttttatcagatgaccgccataacaaattctgaattttatcaaattattgtaaagcatcaaaaaaacggtcaccttcgaagctgattttgccgtctccgtcggtgtccgcttctgtgaataactgaaattgtgccatttgagtgcccttctttttgttggcccatccctcccaatttgcctgttcaatgactttgatcggaaaagcgctgcccaatcgcaattccatcaccaattttttcatctcttccgggtaaatgaacccatcgttatcctaaatgatggacttaaatgatcaacattggttcttcaatgtgtcggcttgccctgtcaaacattcggaattggttcagcaattctttgcgcatctccgcccgtccgtttccttcgcccgccctttccgcctcattcttctgctgctgcctgtccaagtccttctcctgcagccgcatcatttgcacaaattcttcgaaggtcactacgccgttttcttaacagaaacaccaatccattgtccatttgtcataccattttcccttgccaatcccactcactcactgtcttttgtccatttgtcctatgccatttgtcccatgccaatcccactcactcactgtcttttgtccatttgtcctatgccatttgtcccatgccaatcccactcactcactgtcttttgtccatttgtcccttgccaatcccactcattcactgtctttgtccatttgtcccttgccaatcccactcattcactgtctttgtccatttgtcctatgccatttgtcccttgccaatcccactcattcactgtctttgtccatttgtcccttgccaatcccactcactcactgtctttgtccatttgtcctatgccatttgtcccttgccaatcccactcactcactgtctttgtccatttgtcccttgccaatcccactcattcactgtctttgtccatttgtcctttgcccatcccactcactcact

SEQ ID NO: 19639 - DNA, 1038 bp, Heterodera glycines
tgtctttgtccaaatgtcctatgccatttgtcccttgccaatcgcactcactcaatgtctttgtccatttgtcccttgccaattgcactcactcactgtctttgtccatatgtcctatgccatttgtcccttgccaatcgcactcactcactgtctttgtccatttgtcccttgccaattgcactcactcactgtctttgtccatttgtcctatgccatttgtcccttgccaatcccacccactcactgtctttgtccatttgtcctatgccatttgtcccttgccaatcccactcattcactgtctttgtccatttgtcccttgccaatcccactcactcactgtctttgtccatttgtcctatgccatttgtcccttgccaatcccactcactcactgtctttgtccatttgtcccttgccaatcccactcactcactgtctttgtccatttgtcctatgccatttgtcccttgccaatcccactcactcactgtctttgtctccatttgtcccttgccaatcccactcactcactgtctttgtccatttgtcccttgccaatcccacttactcactttcattgtccatttgtcctatgccaatcccactcactcactgtctttgtccatttgtcctatgccaatcccactcactcactgtctttgtccatttgtcccttgccaatcccacttactcactttcattgtccatttgtcccttgccaatcccacttactcactgtctttgtccatttgtcccttgccaatcccactcactcactgtctttgtccatttgtcccttgccaatcccactcactcactgtctttgtccatttgtcccttgccaatcccactcattcactgtctttgtccatttgtcccttgccaatcccactcactcactgtctttgtccatttgtcctatgccatttgtcccttgccaatcccactcactcactgtctttgtccatttgtcccttgccaatcccactcacacactgtctttgtccatttgtcccttgccaatcccactca

SEQ ID NO: 19640 - DNA, 2362 bp, Heterodera glycines
atttaacatttgcaaatggcatttttactttttttttcttcttcgatcccagtcctaatgccaaacttcaagtgccgaacatctgaatacttttttggggaagagcaaaaataattggaatttcgagcatcgaaaagctcaactgattcgattagtcaattaaattattatatcatatttttcaatttcatttatttttgagtgcctaaaatatgtgcaataaagtttagcatttcaattttgtatgggtcttttccgcactatgacacttatacgccttttctggcacataattcgaaaagccagccattcatatttgtttaattattacgcaaatttataaaaggcattagtcgttgtatttttgcaaaagtgtttacattcaaaataagaaagcaattaattagactcaaaagaggaaggcaattaaattaattcaccgctcggctcaatttatggcccgcttcttatgtttatgctaaatttaaatgattgttatcagtgaccacttcacaatttatcactttttgcactgagtaaaagaaaatatatattttaaattccctaaattttcctttattttttgatcttttgtcttttttctcagctaaaaaacgtaatttccaggcaaatacaaccaaccactttttcacgtcatgaacttaattgtgttgtgttgcgtttgtcggtgatgtgtcgttcatcaaattaatgaattgaaggattatctcgggattgaatttgttaattgtccaattaagcaacataatttggctgcattttcttctcgtccatccaaatccgtcccaactctttgcacgggtacgccccctcccctcccccaacctctcaaaatgatcatcaacagatttgtaaattttgaacagctgctcgtccgtctccgtctgacttccccttttcgcttttcctatgctcttctcctgctgtttctgctgatttgcctccctaactcatcttcttccccaatgatcaaccttctgttgctggacatcgcttggctgtgcttttccttttactcactaattcatattccgccaccctcaaatccttgtcccattttgcgtaattacttcaattttacatttggtgaccaaaaataaggcacgagtatgtttatgaattcaatttattttttaaattctatgtatctgatacaatttaaaatagggacaaaactcaaaagttgaaaattttcccccgtgcgtttgacggcggcggttttagtgattaataaaaaagatggattactccaaagatgtctcctctgtcactcattacgattttaagagccacaaaaatgaaaaatatgggccagcagcagatgtgcatcagaagaataggctttgtgggttggttgacagagattgatcggctgatcagatggagaattccactgatcggcggaactgatcggaataatttaatcccaaattataattattataaattcggaattcattttgacccttcaccattatcaattatattattatttcaacaatttattattttttactgagcaagtgaatgtcagagaaacagaaataattatcgattcaaattcgcggaaaatcaaaacgatttaattgaaaatagattttatttttatttttttctctgccgatgatcggaccacaagtgattagtcgcctttgtttacgcaacattattcactcttccgtcattgctttgtgcgtcattgttaaccttatgcaagtcagctcatctcataattttaaatggagacacagaaaaaaggggaattttaattggtctaattaaaaaaattcaaatttctaacttttttgggcaaattgttattttcacggaaatttgttaccataataaaaatactagtattcaattttataattataattaattattttaaaaatacattttaaaaatggaagtgataaggaccagcagcttcatattctgtgttctgttcagtccgttttctgttctgtgccctacgtctctcttcgggacggttctccgcttttcggcatttattcccaggcaccgaccggcaaaaccgtcacccaattccttggcgttccgtttgctgagccgccaatcggtaattaaatctcattaatttttgtaggttttttctgctttaaggcaaactccgatttcggcgtcctgtgcctaaaaaaccgtggcgtgatcaatggaatgccaccgctttccgcgactcgtgcgttcagtcgccggacacttattttggcgacttttacggtgccacaatgtggtaaattgtagcacttgtttatttttggatagtttggcaattaattcaaaaaaacgaaatattttatttgtttattttaggaat

SEQ ID NO: 19641 - DNA, 766 bp, Heterodera glycines
gagagcccttctgatgctctattattttacataatttcaaaaaatttgatcaattcggaacaaagttatggccaaaagttcacatgtggcctggttttttgaattcttctagtcataatttttttgagcattaactaaattttttgaaacttagcaggctaatagagaacacttagagctttcgaatgataccaataatgttagatttggtttacaaagaaaaaagttatagtccaaaaacagggctggcccgaaacgagcggcgccgaaacgagggtgtccctttctaaggcatttttctgaccgttcaccaagcaagttatttcttatttcaaggaatccctaaattattctgtttattaaaagagttcattatgcaactcagtgggtttgcagcgatggtaaggcgtttcagaaaaatctatattagatttttctaccagtgacataataaaaactgttggtaggtaaaaaggttcttatcccttttgttaccccccctgaaattttttttaataattttttctagggcatttttatgcgctgaacagaatatgacgttcatttttagctatcatgagttttgcgtgaattacgtaaattttaaaaaggttcgtttaatcccataactctaggcagataatttgtagttttacccttagaatttttatatttatttattttctcagttcgacattgtatacgaagccaatttgcacgtagatgatatttataggcataatcaagaattcctaatgtgccattt

SEQ ID NO: 19642 - DNA, 1388 bp, Heterodera glycines
  misc_feature (1301)..(1301): n is a, c, g, or t
tttgggttttaggatgcttaacatgaaagaaaaaagttggaatattttttaaaattaaaattttaattaaaataatggtaaagaaaatgtgaggaatattctatcaaagtggggaattgaacccaggcgaaaaattatgaaaggtagaaagtttaaccactacaccacatgtgcatgtgtgtaatcccatgactaaatgaaataaaatttaattttttctcaaaaatttctccttcttcaccaatttcctactcttttctcgaccagacccccattcttaccaatgcaaatttttaccggcggtaccggtactagacaaaccggtaacggtaatttcatttttgaaaaaaccggtaccggtaccggtaccaaaaaaaccggtaattaccggccagtaccggtaccggtaccgctcaaccctaattgcaatgtcatttttagaatgtggctacaaaaattgtgcgagattcgttgagcttttatagacaatctatcaaacaaatgcctatttttaatgcctacgcgctagagctacaaaatttcttctcaaatgtttttctgctgctttcaatgtgcatacatttatgtttgaaaatgctccaaagatgacggacccatttaccattcaagcatcctaaattaaaattttcataattttttttcattacaaaatatttactttcacccctttggcttaaagtttgatcggcctttttatagcattgaagaaacaatttttcgcattggcaaattaattcaaatttaaatattttgttggccgaatttcagaacacccgtttcattgcaatgtcatttttagaatgtggcgacaaaaattgtgcgagattcgttgagcttttatagacaatctatcaaacaagtgcctattttaaatgcctacgcgctagagctgcaaaatttcttctcaaatgtttttctgctgctttcaatgtgcatacatttatgtttgaaaatgctccaaagatgacggacccatttaccattcaagcatcctaaattaaaattttcataattttttttcattacaaaatatttactttcacccctttggcttaaagtttgatcggcatttttatagcattgaagaaacaatttttcgcattggcaaattaattcaaatttaaatattttgttggccgaatttcagaacacccgtttcattgcaatgtcatttttagaatgtggctacaaaaattgtgcgagattcgttgagcttttatagacaatctatcaaacaagtgcctatttttaatgcctacgcgctagagctgcaaaatttncttctcaatgtttttctgctgctttcatgtgcataaattatgtttgaaatgctccaagatgacggacccattaccattcagcatcct

SEQ ID NO: 19643 - DNA, 1479 bp, Heterodera glycines
atttttcaataacgcccggcctttccttcgcctcctctttgtcgctccgcttcaagacaacaagaattaaagtttggggttgaaattggtgcaaaaaggcaggtttctgcgaccaccgaaatttttcttttttttaatgattatttattgaaaaggacccattatttgggaccaaaaccctgttaaccgtacatgtttgatagaatataatcccaattttaacatttttcactataaacggatttttaggattcgcggaattgactgggcctgggaaaagcccgttgagcgcccagcccatccggcctctgttgttcagcaattttactcagaaaagcaaaccctgatcaatgccttgcaccgtttggacaacttttcgtctttgattttcctgcgaaaatcattcaacacagtgccaatgcgagttttctgaagaaaaaaatcagagaatttttgaaaggaaattcggtgcttattcagcagagatttggataggacataaatcccaattttcaaaggatggtgacgttggacctcagaaccagcaaaaatcaggaattaaaccaggaagaactaggcccaaattacccaaatttcaaaaaaaaatccaaaattttacactgagcaggtcgatgttcacccgctgttctccagggcagtgaccaattcaacggcgtcgtccatcttaaaacaaagacccaagaaatgtaatggcatcaaaagttagaaagaaaacaaaccgatttcgaaccatcggtcattttggtcaatttgcgtgagatttccacgatgtcttcctcatgcacattcattgtggacaaatggaaggcccaaaaatgtaggaaaaaggtaaagaacaaagaggagacagaggaatgcgtaaatttgacaagttactctgttaaaaaacagtactctttcggcatcttggcctcataattggcattttttgagtgcaaaacaattttttctttgctcggccactgcaaatgccatttcctatctcgacattttttaactgacgccatagtttttgaggaatgtccatttgcataaaaagcgagttatggctgatcaaaataaaaatgcaaaaaaaaggcatttaccaatgtaaattttgaattagcgcgcaaaaaattacgccattttcaactatggcgttattttatgcgctaattcaaaattcgctcgtaatcctttttgtattttttattttgatcaaccataactcgcttcattcccaactaaaccgaacaaatttgatgtaaaaaaaaagtatttaaaaaggagaatctttttctaagcgagtgctacgcagtttgacgcacaagagaacatttttgagtctttcaaatttttattacgttttaactaagtcttaggccgcagtttttgaacaaaatgctaaaactaatcatttttctattgattctaaaggtccaaagtgattttgtatccttataagcaaaattattagaa

SEQ ID NO: 19644 - DNA, 1493 bp, Heterodera glycines
cttggaccaaattcccccccccccccccctctcctcccacctgtgcccaatttttgtggtcgcgacagtttttctgtttttgccggcaaaagccttcgtcaccgaacgacaggaccgaagcgtagccacactcctcttcctcctgctgctgttgttgttgtgaggaagcggcgaacattgcacggaattcgagcgaattgcctttgtaccagcccaggggacagccacaaacctggcgaattatgagggggagagagagagaaataggtgacaaaaacggatgaattcttccctttaccaactccttaaaataattaccccagcccctatttgggacatttggattcaaaaaacaaaatattttatagcattagaattccgttgcttttttgttgtccacttccatacctccaacccgtactcgtcccggtagtgttccgcgcacgcgtagcgcaaccgtttgcaaaaggtgccgtcaattttgttatacgcctcgcagtacaaattgtactggttggtcggtatctaaaagaaaaaaaaatcaaaaccgtatcaggcaaagagacttattacggggacgggacgaaatctcgccgccggaatctcgccgcagaaatttcaaaaaaaaaaaaaaattcaaagttagaaatttttcaaggaaaaaattttagaaaaatttttttataagaaaattccaaaaaaaaactatgctaactttttttgaaaatttttcaaaaaaaacagtaaattttcataaaatttcaaaaaaaaattgctgaaaaatttttcaacaatttttttctttaaattttcttataaaaaaaaattttaagaattttttccttgaaaaatttctaagtttgcaaattttttttttgaaatttctgcggcgagatttcggccggcgagatttcggcggcgatattttgtctcggcgagattttggggtgcacccccatcctcccatggatacgggcctgaatctaatagtttaaaaaataaaatttttcgggctatgggcttggccctgggtgtttttcttgaaagatttccaagtttacaaaaaaattttaatttcttgtggggcgggaacatagtgttgtatctctaatttttctcattcaataatcaactttttttacattaatactttttgccccctctcgcctcagaatggactcgctggaagcggagaagcgtcgcttgcagggtcgcctcgacgagttggaggggggcggaacggcggcgaccgttgcgacgacgacgacaacagtcgccgacggcggcggcggtgtgccgacgaatgccgcctaagcaccataaaagcacaacataaattcaaattctatttttgaaacgcgtaaaacggaagaaagtcgtttcgtcgtcttcaattcttttcgtccatttttctccacaaaaagaaattttcggcgtttttttctctgttttttttgtttgtattacataaaatacacatttaaatattctct

SEQ ID NO: 19645 - DNA, 1311 bp, Heterodera glycines
aaaaaaataaaaaatatagtttggcaagaaattttaaaataaacgtatatatttataaaaattaaattttggaacagaattacaataaaataattcagttaaggttaattaaattgtatggtaataaattagaatggaacattgattaaagctgaataagagatttaaaaatgcataaatatttcattattatatgttttgttttggaaatttaatataaaaatattgtttttctttttttcattaataaagaaaaattatttgtttgccttttcaagaataattgaatgtataacataaaaataacacacatataagcaattttaacaaaaatatgaatgaaaattaaagcaaaaatatattaaaaacaaacaaaatatatattggaaaaaattggagctaattaaggtaagttaatcgttgcattaacaaggggggtgcaacgtattttaaaaaggttttgtgaacagattgttggccgataaataggttgtggtttttgatcattaattgttagcatccagtgctttgttggccggtaaatgtgttgttagaaaagttgtcgcggtgttttcttcaaaagtaaataaaaacaatttttacattaatacatattatgttaaataaataaagttcattcattcttttctttaaaaaataattcaaatggatctttcatttaattccgagaaagctcctccaaagcgtgccaaacgttcaccaattcagcgattaaaagctggagaaacgatgatgtgcgtataaaaaatataattaattaataaaataatatggttaagtgatataaaattggttttgattatggccgattctatgcggattgttggagaaaaaagcaaagtttggacgattattggtagcgatggagatgattacatcaacataacaatgtgggacaaaaacattgaaaggctgtctcgagaaatcgggaattcttttcaggcaatttttttatataaccaaaaaataaattgtttttaggaaaaaacttacattctcaaaacttgggctgtttttaaagttgccgaaccatttaattatggtagcgttgagttggaattgcgtgcccaagaaggctcaactgtaacaattgttaccaaaactgattatgttataaacggcatcaccaaagaaatgtactttgattttttgggatcaaaactggcactcaacgaaacaaatttcatgccatcaaaaattgaaaatttacggaaagggggagaaattcattgtaaaataacacaaaaaatacaataaaattaataaaattttagcgaagtcgaagcaaaa

SEQ ID NO: 19646 - DNA, 961 bp, Heterodera glycines
aaacgcttcgtgtctattttaaatcaaatatatagattcaaatttacaaaaatcaaagcaaaagttgttataaaaaccactctttaaaagaaactaaattattattttactggttaactaaattagcagcaattataaacttataatcatttaacaaatatattcctgcttacctaagtatgataaatatacaactaatttgaataaataaaatttttcatgcatttaaatgaagaaaaaatcaataaataaatatataacaaataatttatttgtttaatttttttttaaattcttgaaaaaatgcaattacaaaataaaacggctaaggaaataataaacaaaaatttgcctccgaaagcttaagaatgacctacaatactcatcgtttttaaatacatatcgtgctattattataataatttaaaatatttaatttttaaccttaaaattctttttgtaattttttataaaatgatttatttaatattaaaatctcaattcattttcgtcaaataacttaataaattttatcaatttgaattttaaggtttaaatacaaataaatatgaaaaattatgatcagtatatataacaattgaagactagacttttatacctactaaaatatagtaataaaaaacaattttttaataattaaaatatataaatatttgagagtagtacagacgattgaattaaacaataaaaattgatggtttttaataaaaattcctttaatcattttaattctaacacttgttaatagtttaaatgataatattgttttaaaaagtttgaagcaaatgaaaagttagtcgacagccatgttataataataatatcttaaaattaaaatcgcgtgatcagttttcttccattttaacctatttatttaaccataaaaatttaaattaaaaagacaaaacctaagtttcatttataacccaatatttggata

SEQ ID NO: 19647 - DNA, 1085 bp, Heterodera glycines
tagaaaagttcccaaaaaaggaaaatcctatttttttggattacagaagcaatttaaaaattcattaaaaaataaaaggttcattacgcaccgccctccctctcatgatcgagagtatttgtattatagaaaattacccaaaaaagagaaagccatttttttgggatacagatgcaatttaaaaattcattaaaaaataaaagggccattacgcaccgccctccctctcatgatcgagagtatttgtattatagaaaattatccaaaaaagagatagccatttttttgggatacagatgcaatttaaaaattcattaaaaaataaaagggccattacgcaccgtcctccctctcatgatcgagagtatttgtattatagaaaattatccaaaaaagagaaagccatttttttgggatacagatgcaatttaaaaattcattaaaaaataaaagggccattacgcaccgccctccctctcatgatcgagagtatttgtattatagaaaattacccaaaaaagagaaagccatttttttgggatacagatgcaatttaaaaattcattaaaaaataaaagggccattacgcaccgccctccctctcatgatcgagagtatttgtattatagaaaattatccaaaaaagagatagccatttttttgggatacagatgcaatttaaaaattcattaaaaaataaaagggccattacgcaccgtcctccctctcatgatcgagagtatttatttgtattatagaaaattacccaaaaaagagaaatccatttttttgggatacagatgcaatttaaaaattcattaaaaaataaaagggccattacgcaccgccctccctctcatgatcgagagtatttgtattatagaaaattacccaaaaaagagaaagccatttttttgggatacagatgcaatttaaaaattcattaaaaaaataaaagggccattacgcaccgccctccctctcatgatcgagagtatttgtattatagaaaattatccaaaaaagagaaagccatttttttgggatacagatgcaatttaaaaattcattaaaaaataaaaggg

SEQ ID NO: 19648 - DNA, 2716 bp, Heterodera glycines
tttaatttctgttttatttttatcgtttattcttatcattcaaataaataaagcttcatttccttgaaaatagcttttattttcaatcttgatagacttttaaatatttgcgacaataataaaaataatcattatttttcttgtgttgaatgatgtgtgtctcaatcaatcacgtatagctgtttaaattttataaacatttaaaatttcaagtattaaaattcaattaagctaaacctaattaatatctttcaataggcctaagaattcaaatttaaaaaaaaatcattgggtttcaaaaagtttctggttaaataaattttgtgtccacacttatttatggtacgattgtagttggtataaaaactattttttaagtctaaatgcattattaagtttttaactataagaataaataactaattataagcttgcgccgcaagtttttaatagattcattaattgttattatcgatttacctcgaatgcaaaatttgaaattcatttttattaaattcaagcgacaaaaatcgctcttcaacctgcttttcttggccgattttccattaaattttaataaaaatgtttcatttttatccttgaacagcgaaaattatttaattcatacaaattaaaaaattcttttgatggttcatttgtatattttttataatattttattgatttaaaaaaatgcatttagagtcgtttttatatatccgcaatttatttaaataaaaaaattattttatataatcgattattttcaagtaagatttgcaatattttttatattttgtttactgtaatttgtaatgtagaatcagaatgcttgcgaattttttaaaattatcttgccgacatgacagcattgcttagtgttaattttctgcttttaaattcagttttatattttgtatttgaattattactatgtctaattttaagcttatgcctgcaggttatcacatcaaagcggcgtttgtcctatttcataaatatttgtgaattatttaaatactagggtgtcccaaaagttttttctgattttttataacaatatcggtacccctgtaaataactaaatgttgaatataaaaaaaatagcgcaaagaaaaactcgcttgaccgatttttgaaccggtctaaaacccggttcaaattcaattctatgaaaaatgctgaaacatgtcaagcgattttttccttgcgctattttttatactcaacatttagttatttacaggggtgccgatattgctataaaaaatcggaaaaaacgtggaacaccatagtatattaatttttttgttatattttgaacttattgattaaaatttaaaaaaattaaactttttttttgtaagttatacttcattcttaatcggtttaatatatttttatataaaaaattaatactattctcacaaaaataaaagatttaatttaatattttataataggcacctctggtctgatgttacccattcttcccgagtcaattcattggtcagatcaaatagcacaactgagtcagcaaaagataatgaatttttttatagattcatattatgtttctggtaaatttaatttatttttaaattctgtctcatgaactatattttaattgatagttcattggacgtatttaacattttgacaaagacagataaattattttcttgtctattttttccgctccgttttctgccagccacataacgaattttcatcaatctttcgtatttaactattttaatttatgtgcctctttggttagcaattttttatatcaacttgaatctttttttcatcgcttgtttttaaattttgagtacagatttggtggcgttcagcaggtgggaaaggtggattttttaaaaacttttaattaaatgaatgaaattttgaatttttgctggcttccatatgtcaataattttttctgttccaacgcatttttataagaaattatttgagctctaatcgaagaattattttacaaatagcaaaatcctttaaaaaattatggctttaaaaaaaaaagatgcatttttatttaatgttttactgcagcacaatttctaatataatgtattaaaaatttttttttaaataaagttgatttaaaaggaatatttcatttaatttacaaaaagtttattttaatgtttcaaggcaatgtttttattttgggttatatcattaataagttccatttttcaagttgtggcgcaaagtagccatgctcatttgtcagcagaagaaatcatgatgaatttgggtttattttttagtaacctcatatatgaaataaattagcgtgtttatatgggtaaaaccaaaaaaaaaaggactaaaagtctaatatatggataaaaatgtcgataacaacaaaatttcccaaaatagtgccaaaatttctaaaacaattaaatttttactctttgcaaaaaacattaacttctcgacaaataaacatatatattaaaataattcaattataaactttctgtgttcgaatatgaaaattgattgttggaagaaatggagtgaaatgaaaatgactgctcatgtcagcgatgctcaccaatatagtacaaccaactaaattggtgttcggcatttctcactggttaattggcgtcactttccaaagcgacgccacagaacatataaagaacagcggagtcagagaatgagagaaaaattagtg

SEQ ID NO: 19649 - DNA, 2807 bp, Heterodera glycines
  misc_feature (109)..(109): n is a, c, g, or t
  misc_feature (173)..(173): n is a, c, g, or t
gggttcattaatgcagggatgtcaaatttatatttattaaagaaatcacaaaaataaattaccaaatttacttaaagggaaaggtttttattttttatagttaaatctntagctccaaggttaaaatccccaaggtatacaacagttttctgaaatgtaaaggtcaaggaatntaaaaagatttttggtattttttaaattagtagaaggaggtcgataaataagaatcaaatttagtgaattgtaattttgaaattgcaatattagtatttcacacccaaattttgtttcagaaaactttacaaaaaactgtatatcttttttagcgagaaaagctatgccgcctccacgcttattcaatctgttagtgtaagaaatggtatgattttgaagaaaatttgaatgaaaaggaaattggttttcattcttaccccaggtttcagtaaaacagataaaatctaaatttaaggattcaaaaattgtttctatttgttcacatttgttatagatagaccttatattactaaagcaccttgtatacatttattaaacttatgaggacttttgaaaaatcttgcggtactagaatttacgtttgtaaaattttttgaaatttcagtgtgggtggttcccgcaagattttatgaattggatttatggcaaaaacaggaataattaccagggtcatcacgaaaaacagagacatcgtttcggtgaatgacatgtccagcataaacaatgaaattgagattaggaaattgggcgcgggctgtcttgcaacaattgatcaaattatgccgctccttgagttgttcaggggagagagatggacggacagagacagcttgaaatttggagtttttaagacgggttttattgcggagaaatgtttgtgtaatctttcgggttgacatttccactttgagaagtcggggcctccttcctttctttggcccatccggtaaatcttggtcggcattgcctcatttcgcaaacgtccagaatgtctaacacctgctgttggtcagcaatcgcgcgccgtgtagaggaaaggccactgtccgattccggaacgcccatcagaacgaccgaatgttctcgtcggtcctcctccagtaccgcgcgagtgtcctgggtcgacgtctcatgaaccatgtccaccgcgagcttgagaagtgcgtccagttggagaatgactgcacggactggctctgacacttcagtgcaggttagcagtgctgtgatgtccaaatgcgccgtgccgtcaagaaactgttgtcgttttgttggaattgttgagagaggcgatgttgtcaagtgtgccgcagtacgttttgctgataatttttgctggagtgaaccatggatttttaaaagattgggaggaaaagtcggcattattcccaattaatgaatttcatattttgaagccttaggaatgtaattttaagactttttcgctaatttttatttggcgggatttcgactcattttggctttggcgcgatttcgacgcagcgggattttgacagcgcgccaacaaaattatttcgggatacttgatttttgacctctcttttctcaatggggagaaatcgtagagacatgggaccttttcatcttgtagctaatttggtgggctacatgacatttcgccaactgacatttcgccaactcagccaaaaacattcatttcgccaactcagccaaaatcagacattttgccaactgacatctcaccaagtttacatctcgccaactgacatctcgccaacatgacgtttcgccaactcagccaaaatctgacgtttcgccaactaatttcgccaactagtcgaaaatttaattttaactatataatgatattaaatttattataaaagtgcttcaagcaaagaaatcttcataaaatatataaaatatcaataaaaaaacaataatatgaaaatgtttaaaatcaattttcatcggcctcagtttcttcaccactctctgaatttccacggacgtgaagtccctccgcaaagccttgaatcacgatcccgagcaggtgcaaggcgtttgtcaatccttcttccgattcaaagtcggcctcgtcaaggatccgcaccacattttgttctttgatgacgtaccgttgtcgtcgtttagtgcttttctggagctgttctgcgcgtccgatgtccaactgtttgttgatgtccttcgtgaatgcagcaatgaagtcactcaatgatggatgatggttgagctcacgttgaaaataccaaaaaataatgttttccgatgaaattttttactgcaaattgtccatgcgcggcttccatgccgttgttcgttcgctcaattgccatttgagccctggtgtatacattccaaaacgagatcgggaaacgtggaggacagacgatgtcttgttcccagcgtggaataagctgcaagctgctttcttctgacaatggaatggttggagttgaaggttgtggcgaatgcagtccgaattgtattggtccactgcctgttattatggatgcctgggacacactgaacgctaaaattgaaaaaaatttcataaattttatgacagaataggtgcatttacgagttgtgcttagagtgcgacgcagaagaaagtgtccgacatcagcatgcggttcaaatgcctccgccccgcgatcaatctcgaattgagtggtgccaatgtaggttttggcaaaatacgccagccatccttgaactccaagcggtgccgcgctgacaatagttgaaaaagcgcgccaaacgtaaagtggcggaatgagtgccaa

SEQ ID NO: 19650 - DNA, 1889 bp, Heterodera glycines
tttattatttttttgacccgaaaatttacatttaattcatttattttactaataattgtatgagatttttttaaaagtaatatttataataaaaattttttttttttattttattttaagtgctgacaatttaatataatatattcttttagtcccgataagtaatttaattctttttaaaatttttgcaattaatttaatattttcttattctcgtgcgattcttcgaatcgtttacattaatacgttactaataaagagaattcattacaaataaatattttccaataataataattattacttttttacagaaaaaatataatatttgtaaaaaagggaaagggtgtatttgaattttattttttttattatatcaattattaataaacagaaattaatagtcagtacttttatattaatcatttaaattgaagaaatgtaatccttcacattatttttaatatagttttaaaaatttatattaatatcgttttttaattatttaaattaattactttaagtaacgagcatatcattactacattaaatttgacaatcattgttttctttattgttattgttaatcgttattttaattatctatataaatttataaatgaattttctcatttttattatttacaaataataaaattagattgtcggccgagcttggatcttcaaaatccaccatcgatcgccaccttcatgaactcgagctggtgaacaggcgttgtcgacaagttccgtacgaattgactatagttcaaaactgaaaagtattttaatcctgaactatcttaaaaattatgatacacttaatgaatatatttagtttgagattgaacttgttgaataaaatggtaaaattaaaaaggtttttgattgatacaaaaatacaatttaacattttgaaaaggttttcgataataattaaaattttagtttgcaaataatcgtggttgaattatcattataataaaaagacaatctatttgtcacatgcaaaaaacgattggaaattcgaatattaaacaattattctatgcaattttttcaattaaaaattatttaagggattcttaatatctattagtttttagaatattaattaaaatagtttggtgcgattatttttgtttaggttattttctatagaaacttcatgtattaatatttatttttatccttacttcacaattatttgaaattcaatactaccaaataacttaattaatttgtttgtttttttaaattttttgctgtttcttttaaagtattaattgacctttaaatttaaatgatacacgcttgtacaattttttctgcgatgctaatacgaaattctgttattaaattagcgaataatttttacttgcgcatagatcttttattatttaattatttaaaaatgattaattgtttaaattctcaattctaaccttttaaactttgttgcactcaattatattaatatagattagtaatattttttaaaaaatatttttaattaatgagcaaagttcattttttgatattctttttttgtttattgttcaaatttttttatttgtaaattgttttggaacaaaaataattttattattctattaaaggtaaaaatgtagaataaaattaatcacgctattttttaatttcttatttatttattcaaaaataaaaataaccaaaagaagggcatgtgccacttatacttttggcggaaatgaggtgaaatgaaaggtagtgataaaagataattgaaattttgaatgaaaaagcagaaattaaaaaagtcaaacctcccaacaaaggaaaaattgttttttttttttttaggggttgaaaaaaaaggaaaaaaaaatttttttttttttttttttttt

SEQ ID NO: 19651 - DNA, 2135 bp, Heterodera glycines
  misc_feature (80)..(80): n is a, c, g, or t
  misc_feature (2103)..(2104): n is a, c, g, or t
  misc_feature (2126)..(2127): n is a, c, g, or t
ccccccccccccctctgttttttgttgtttaaaaggcacctcccgctgaaaacgctcttcgccacatcgctgtgattgcncatccgccagcagagaagagaaaagcgcaggatcggtctcaatttgcccttctccgtcatgcatttcctccgctccgtcctcctccgcttcattcgcatatccctcataaaaatcctataagcattgctccatccatttattaaattattcatcgcaacattttgaattacctcaaagtgtttatcaaagggacgaaaattcgcaacacttttacgattactggtccgctgcgcctcctccaaatgtttgttgtgtaaagaataattcactgcacttttgcggtcaatgaacggctttttgtgtttgcccttaattaaggaaaagtgcaaatttcatgaagcgactatgcaaaacaaaaataataccattttagcagtgtaatgtcagaaacactgaaaagaaattggaaaattataatagtaagaaaaagtagaataagaatttcaattgggaaaacaaccaaaagcaagtgacaataatatggacaaatatgaacttgaaatttatttgggaaaccaatcaatataaacattaatacatagaatccacatataaaatataacgaagaaaattaaaacgtaattcactgcgctgatcgtgcataaagcgctaaaaaattcataaaatttagaaattcgatttttgattgctttctttcatgttacctttttttaacaattcctgctgatggtatcaattaaagccttttattttctgtttacgaatttcaaactttactgtgaaactaagtgaaataaaagaaacaaatattttaatgagctaaaaagatgaattagtaaaaaacgaaataaagtgagaatatgaaaatattgcaaaatggtcaaaacatctcattaagcgaaacaaaatgggccaattggtgctttgtcaagtgagtaaagcgatcgatcagaggaaaaattacgatcagttaggagaaaaacggcagaaatacacaaaacatggcacttcagaaacgttattttgcccatccgtcgtctatcagcgacgacctgtagaaaagaaaaaggacgacggcacgtcaggcgttcgggacgtaggggaagacgaaatgcgacgggaatgacgagagggtgccgaaaagaagttctgctgttgaagccgcggattgtcatgagagcgaggctaaaaaaaacgaaatgatggacgacgacattaattaaaggcaatccaattaaggggagaaagagaggaaagagttaaatgatttttcaaagggttttttattttatcaagactcattaatgccttatgagagaatctcgatttaaacatattcgttctcaaccgtgctgtaatggtgagatgaccgcagcgatcttccacgactgtgctcctcctctttttcattgttgtaccaacgctgctcgaactgcttgaatgtgttgttgccgttgctgtgctgattgtccttgttgtaccaacggtgctcgaactgcttgaagttgttgttgttgttgttgttggcgtgttgatcaacttcagcagatgctgaaattcgccgttgttgttgctgccattgccttccatgccatggcaaatccgtgccaacattcctacctcccccgctgcccccatctccgattggctccatgctgtccatgacttgacgtcgtgcccgtgccaccatcggctcctcgtcgctgctgtccccaccagcaccaccaccaacaaatgcgttaaatgtctgtactcgacgagttgaccaagccgactcaatggtcgaaatggtactgtcgttgttaccgaaggtggtgctgctgatgcaatttgaattcggtgcccaatttgaagagtatggacgatgcgacgatgggaacaccgaagggctggagaaataggacacaacgccagcagaatttgatgctgcaccaaagtcacttgctgacaaattggacggagtgattgcccgcggctggaaaagtaaattttaaaataaaaaacaatattttctttgtaagaattactttttgtattcctcaagttatacgaaaaagaatnntcgaatcacccactaatgaaanntttaattt

SEQ ID NO: 19652 - DNA, 1050 bp, Heterodera glycines
gtccatgtccaacaactgctgtggctgtgttttgctgtgctccgccggtgccaaagtccgtcgccacgacccgtcgaaggcgccggcggttcgttccaatcgcatcgaactgcgctgttccgcatctatcgctgtgtccagccgatttgcacgggagaaagcggtggatgacgaagagttgtcgacaaatccgctcgtccgtgtgatgaagcgttccgttttgcgaacccattcgtcgtcattgctaatgctgtttctgttgcggccgggggcgacggactttcgctgctgctggtggcgaatggtcgacgaaaaaggcgaagaaaaatgtgatggcgctcgtgcagtcaatgaaagcagcggagtctgcaaaaagaattaataaaaaaaataactaggaattttataagaaaatttcaaaaagaaattaaattagttcagtgaattttaggaaattttttttagaaaaacaaagtaactcatcataaaattttgaatggctgaaaaaattttcataaatttttgggggggagggggggaggaacgtagtgccccctcttttctcaatttgaataaattcagtccattgtaccgctctcgcatagggacgacgtggtcccagcccatatttggcggtgcgtccattattggcgctgaaactgctcatcctcggcgacatcgttgttgtcggcgttgttcggttgcgtttctcctccactccattcgctgccatttcccaccgtccctccccaatgctgttgtccgttctgaacagtgtcatccaactgcgcttcttcaaatgctttcgctttatctttggctgcggtgcctctgattcattttggtcgcacaatgatttggcttttgaacgtcccaaacattccattttttgagcaatgaacagttttgtcggagatggaaactcctaaatttatgagttttattaaaaaaataatcgttgatgaactaagccatgcaataatggccatagaacagaataacgagaaggaaaaccaatatcatatcccataaaacccggtggaattctgt

SEQ ID NO: 19653 - DNA, 2793 bp, Heterodera glycines
  misc_feature (2707)..(2707): n is a, c, g, or t
  misc_feature (2741)..(2741): n is a, c, g, or t
acaaagaaggcgagtggatcggtggcaaatgatcagacccatgaacgaatgtgcttttccccacttaagggtggtgccgcaacaaaaagtacatacaaatagtcaaaaaaggtgccattgcaatgccaatttaaatattgccatcaaattcgccatcgttcccttaggctatcggtgtttggtgtgcaacaaagtgtacggtcgctacaactcggtcagttaccacgtgaccatttaccatcggaacccgcccatccgttgcgaggaggagggatgtcagttcaccaccaggcaagccaagcccagcggaatactgccaaaagagtgtctttccgtttagagaagcgcggtacattcactttcacaaatattaccgtcaccaaatcgcactgccggaatccatcgacttgggcaagtttaacaaccaatgggagacggacgaacaaattttaagacagaataggaaaaggggtcaaaattaagtgaacaaaacccaaaaagagtcgaatagagcgggcgaactctgttcaaagacattatatgtacacatataccgtattacttaaattttttccaatttacatttcggaggggggggcaattggatggcactccgttttgatatgttcgtcaattggtagaatattttgccaatttctgatttgaattgactccgccttctgctgttcagcttctcgcaaatgccctctgttaggctgtaaacacgtgtccaaaagcccggccatgttggacaaacacatccaccgacacgtggccgactgtttgaaggacggcgcgctttatgtgtgcacaatgccagcaaaaggaggcgaatcggaggcggaagtgcaggcggatgaggagcaggaacagtgccaattcagagcgaattcgcacgaagtgagaagcaaaaaaggaaagggggggggggcaaagggacaacaactaatgagtgatcggaaaaagtgatcaggtaggggggaagctttccacgtgttggcactgtgaggcatggcttatctcggccaattcaaattatccgtccaaaacctttcgcttttccctcatcagacaatgtatgagcatcttttgtccgttcattcgagcggcggccgcggcattaaaatagacgaatatcaaacgacagaaaaggagaaaaagggacagcaacagacgacgataatgcgaaaccatcagcaaacaccgccgatgagcgcatccgcaccagcgacaccgccaacaccgaacaacgcaagggcattccattgtgaggaatgcaatttcaagtgagtgatcagtggcggaggggaaggaagggcgatcactgactgatcaatcagagtgatcacagaggaaccgaacaaaaatgtagtgatcagaataaaagaaaatgactcctcgggaaattaagacaattttactttaggggacgcacattggtggcattggagcagcacaaagtgcaaaaacactctcaacgggcacggaccggcactttcccaaacataacgccaaaaatgtcgggtctgactgcgcattttgaaccgatgatccctcaacagaacggaggaaggtaagcggagtcggagagcggatgaaccatcattaaattgaatagaacgggataaattacggtgaaaagggggtcgtaataacttcccggactgaaaatgtagggactgaaactgactttcgctgccttatctttcatccaatgatctcaaagccatcagtgccttttcccctcaatgcttttcctctgtccccttccatttgcaatggtttgtttgttcagaccgctcaacggtctgtctcttctatctggcgttttgtccgccgcttctctgcccgactcgccgctttcgccgtcctccgtcggcggcggactatttccgcccgcctttccgtcgtcccttcttttcggcactgtgccgtctccgttcttcgctcagtcggccattgttgctgatcagcaacagcaactgatcgcccagctgatcgccgcccagcaaaagttggcctccgcgctgctcggctcaccgcccgccgcgcagcaaaacgcgacgcaaacggcgacaatggccgaagtcggcgactccaatcagcagaaaatgttctgaagggaagagaaggaagcgataaaaagccaaaagcgatcggaacagaacgcaaggaacgccggaccaatcagtggccaatttgctaattataagcatttgcaaatggcaacaaaaaggccaaccgaacaacacttttatttgtttgttaatttgttccgtccctcttctctctcccttccgttgtccctctctcctgcctctctctttctctgccagtcccccttttcccccatttcattttgttgcttttttctctgttttccctcttctgctcacctttccctcatttcctttcaattgcccttttccggtaagctttactccttctcaactcatcctttatttcctattatttttcttcttcccttatcctcaactttccatttattattttcactggaaaaggcgtaattattttttactatttttaaatttgttattttttggactatcgtcgaaagatgaaacgtaaaaaagcatccaactgaactattgtcatatttaatatcaaaatggggaaaaataatacaacatgaatacaaaacatattattgaacagagaatgaaaatggcatgatgctaattanagatgaaaatattatttataaattatgtgaaatncaaaagaattaggggggggtggcaaatgattgaggagggggggggggggggg

SEQ ID NO: 19654 - DNA, 3029 bp, Heterodera glycines
  misc_feature (2957)..(2957): n is a, c, g, or t
ccgtcccccgcttctcccccccccccctctcctccccgccccattgtttgtcctccgatcgccccttttctccattcttcgccctcgggcgatgcgtcgcccatccgatgatcattattattattattacagtttatgtttaaatttccgataattcatctacagaaatgactttgttggtagctttttcagaatgcttcgtttgctttttaccttttccacaattttcacgggtttcggtctcgcctcgcccattaaaaatcgttcatcggcaacagaaacagtcgatgatcaaccgcaaaacgtaatttattatttttaaatgttaaaattaaattgaatttaatcgcaaaattttttactttagcaaatcggcacacaattcgttgaagtccgtcggttattagatgaaataaaaatagcttcaataaaacaacatggtcgcttctctgatcaggcaataagcaaaaagaaaaaaaatttgcttttttacttacaaaaataggacccaacccgagaaagggcacggcaacgaattcgggacaaagtggcgattaatgacggcaccgaggcgaccgtcaaccgagccgtggcggacgaccttttcgagaacgacattttgctgacattgccacaggccaagcaaatattggaggaaatcaaagaaggtgccgcgggcggaatgccatcgaatgaatgaataaaaagttcattcagtttcgccatcgaacaaacgacgcggaagacgacaggcgaacccaacgccgagctcaatttggggcaatgtgaacattccctacttgttccaagtctcgcaaaccgattgtgagattaagcacagagaatgggactgaatttgcaatttcagcaaattggcaaaataacatcagaaaagggcaccggcacattgagtgggcattggccataagccaaccctctgactcttttcattttgaagaagcctcacgtgtgtccgttttgtgttccaccaaaatgaccacgcgttgaaaggcaaagattacctgcaatactttcgtggctccggctgttggtcccaagtgggcaaaaccggcgggcgacagcccatttcgatcggatacggttgcgaatccgtaaactcatcgggttttggcatcttcgtcaatccctccccctctctccccctaaagctcggcatcgtcgctcacgaaactttgcatgcactcggactttggcacgaacagtcgcggctggacagggacagtttcgtcaggataaattacgactccattttgccggtaccttcgccattttgttgtcaatttattcatacgtctgtttttgtcagggcaccgaatcgaattttgaaaaacgaacaccggacacaagtgacaacctgggccaaccttacgtagaaggggcgaagttgaccatttgagacggcctttgtttaggatttggggtccgccatgcattacggcaacagggcattcgcatcggactttcgaaggtgcggcacccttcagacggcacatttggcctcttttgcttcagtttcaccattctgacggtggatcggatgtatcagcagacaataggacaacgcggcggactttccttcaaagacgccaaaatgatcaacacgcgctactgctcaggtggacagtggcgcattggcaccaaaatgggcaatacaaattgcagaaatatgcaagactaagttggactgtgacaacggcggatacaccgacccaacggattgcgaacggtgccgctgccccgacgtacgaatcattggcataaaattaaaaatggcatttgtttgttggcttagggatacgccggcgattactgccaacgcattcccagcagcagtaattaataaaataattaactacaccctagcatttgtctcgttccccaagattcccaaacttgtctaacgaccggcgaattcacccgccggccgatggccgggcagcctcaaaacaagttcactggtgccgcgtgcttcatgttattggcgaatccatgtaaatgaatgcgttcactaattaacccaaacgattaaataattaattatttagcctttgcatcggacacatagagttgtgataaacatcgaaaagttggacatgccctgcaaagattcgtgtgcctcctttttggagctcaaatacaaaaaggacaaaatagccacaggcaaatgacgtcaaaaagctttcatttcactttttattttgccatttttttgctatttaggtgccagactttgctgcggaaatgcgaccacaatttacgcggacattggcaccgatgtgctggtgattttgatgtcggacaacaatttggaagcgaagtacaccgggttcgagctgagttacaaatcgggcaagtgattagcgggagaccaaaagagaccataattagcaaattcacagagggcacagatccgacagtaatttcaccaatggtaacagcgaagccgacaattgctataacgaaaaggccgccgaaaacattgaccaacattacgccaaagataacaatagaaacaacgccaaggataacgacaacgacggacacaatgccaaggataacgacggaaacttcgccaaggacaactacggaaacatcgctaaaaacaacgacaacttcggaaccaacgaccgaaacgacggcggaaccaactaccccaaaagaagaagaggcaagttacttggatcagcagattgaaaagaaacacttaaaacggatgagcaggggatttggagcaaatggggcggatggagcggatgttcggcttcgtgcggtgcgtgcggtcacaggagaagagtccgcacgtgtttcaaaggcaaatgcaagtgcgttttgggcacaaaggcaatgcatggccaaacgctgttgttcaggggggagtccggccaaatggagcgttgcgccttcggaatttgccctttggccaaacaaagaacaanccgttgtcaaggtcgactggtaatgccattcaatgggatggaaagcctcgagttcggcacggtgattaatta

SEQ ID NO: 19655 - DNA, 2168 bp, Heterodera glycines
aattatatatttcttttccaaccaaaacgaagcccatttttggtgataatgatctgccgagtggcagaagtaacgccaattcctacggtatcgccaacaccgtaggaatattcggtattttttccttttccttcagcgttaatccaaatttcgccattgcttacatacgcaaaagcgccatttcccattcttcctttcaattctttctgttttttgagtacgaatccgatgctgatgacccaactgaaaaattaataataaagaaataacaataacaaataaataaaattttaatatttatgattaattttatattcaaaaataaaaaaaattcttactctttcctatttttaactgaaatttcgtagtaaaaaatctcggacgaattattattattcagcaaaatcggatgtttagcaaaaacagacgaacaacaaccttttgaggagaaaagtaaattatgaaaaaataccagcagaaaaatttctcttataatggacaatgagacttttgttgccaatgatttggagattctcatgacaaacattggcatcccaataattttgtcgcaaatttaaaagtgccttaaaataattaaaataaaattgctaacatatattttacccctaattcacctttctcttctgcttctgttctttatcaaattgactgactttttccaatcgagtcctttgatcaatttgcatttttgtgaattggtcagttttagctaaataattgttcaaatttaaaatggacaaataattaaacaaaatttcttgattcatcctacgaaaaatagtttttaataatttattcttatctaaaattcactcgcctttgctcgtgttttcgatctgctgctgtttttgctgcttttccatttcactgattttttccaaaattttcttctgatcattttgcaattgcgagaatccttaaatttttgaaaattggtcctcacagcttaaattaaatcaattttgaaatttaaatgtcaaattttattttcatattaatttgtcctcgccttttgactgttctttttgctgcttttccaattcactgattttttccaaaataattgccaaaatttcttctgatcattttgcaattgcgagaatccttcctcaacactagcttaaaatataaacccaattattacttaaaatggacgttaaaaatattttatccattaaaaaatgttttaatgccgaccaaaatggactgagaacgttatgacaactttttggctagcatattttttacttcgtaaatttgtacccagtaatttttgtggattgtgatcgcgactttgcatccatttatacaatttttaattcctaacccgaattcgaaaccaagattgaaaaatcagttttatcaatttttaaatttttggtttagaatttgggttaaggaattaggattagtcgaaatcgtgatcactgatccgttagtcattccaaaaacacatgggaagcttttatgactaggcttcataaacataattttatagaaaaaatggtcctctcccctttggttttattcaatgggcccaattttttgagtgttgcctaagttttaataatttgattttcgatattcctaataattaaattcacaactatttttatgacagtataattttgatactgtatccctaatttccgcattttccgggagctctcactattacgttttttaccatttttctccttttcctgttcaattttggccactttttctttcaatgccttctgttctcccatcagttcctggtactttaacttttgttccttctaaatttttaagattttttgacaaatttttactcgttattttttaaggtaaatctgacattttcgagttccaatttggccattttcaattccatttccattctggcaaacttttcacgaaattcctatttaaattaacaaaattgcttttgtatattgcataatttaaattatttttctcccaccccattgtttaggtatgtctatttttgtttttcttttgcccaccttaagctgttgttgatcagtgatcgattgttcactgttttttccatcaaataattgtccatcattgcccaaattaatagcattgccattcacttctaaaaatgacttaacttaaattttggacttaaaaaatttatt

SEQ ID NO: 19656 - DNA, 842 bp, Heterodera glycines
aaattcaaatttccttctattttccttttctcataatttacctccattttctgctggtgtgaaatcttctccataatttattgaattggtcgaaattgacatttctgagtttgatatctctaaaagagcttattgttagattttaaattttataaaaatgtttctgttgaataaatgacaaagaataaaaagagaaataaaaataaatgaccattccttcatttttaactaattttcggcaaaatgatgacctaaaacgaaagagcaaaaagaagaaaagaagtttccaacatcatcatttatgaacaattatttaagaattcttttattgccggaaggcaaaaaatggagagaagcaaaatatgtatgagaaggaacgaaggtggaggagggggaggtcaaatagacaggtcaaaaaagaaacggaaatcatgtgaagacctaattttgaagaatggtcaaaagaatcacacaaaaaataaaaatttaccaaaaattgttctactaatcatcaggggtgtgacctgttcttgctttctatgaaatgttctgatttggggtagtggcacaactttgctctgatttcttgaaaaaataagcactggtaagatgggggtttaaatccgaaaatgaaacgaaaatttttagacggacgaaaacgaaacacgaaaacgaaactcaaaaagtgccgaaaatgaaggacgaaacgaaatttcgtgcagccctggtctgggtgacaaaagagaaggaaactcgtgaaggagaaatttttcagaaaaaaaaattttttttttcatttaaggcgttgattcaaatgcatatatggtctagtggctaaacat

SEQ ID NO: 19657 - DNA, 842 bp, Heterodera glycines
taaatgagagagaaatagatggtgggagataagcaaaagagggggggggagaaaaggtggaggatgaaactcaaggaagaaaactaaaggagagagaaagagatggtgagagataagcaaaagaggaggggagagaaaagggggaggatgagagacaaggaagaaaactaaaggagagagaaagagatggtgagagataagcaaaagaggaggggagagaaaagggggggatgagagacaaggaagaaaactaaaggagagagaaagagatggtgagagataagcaaaagaggaggggagagaaaagggggaggatgagagacaaggaagaaaactaaaggagagagaaagagatggtgagagataagcaaaagaggaggggagagaaaagggggaggatgagagacaaggaagaaaactaaaggagagagaaagagatggtgagagataagcaaaagaggaggggagagaaaagggggaggatgagagacaaggaagaaaactaaaggagagagaaagagatggtgagagataagcaaaagaggaggggagagaaaaggggggggatgagagacaaggaagaaaactaaaggagagagaaagagatggtgagagataagcaaaagaggaggggagagaaaagggggaggatgagagacaaggaagaaaactaaaggagagagaaagagatggtgagagataagcaaaagaggaggggagagaaaagggggaggatgagagacaaggaagaaaactaaaggagagagaaagagatgggtgagagataagccaaaagaggagggggagaaaaggggggggattgagagacaaggaaaaaacta

SEQ ID NO: 19658 - DNA, 2126 bp, Heterodera glycines
attaagaattattacgccgtgatgcgcaatgccaatgcaaaaaatcaaatgaaagaggaaaccagcactagtacaaaaaccgaacagaactgaaagtgaaatgatcggaaaatgggggaggaagcgaactgattgataatttgattggcattgagagaggaggcacataccggagaggagtttttgttgggagttatggtccttaaattcacctcttactgatcatgaaaagcaagtaaaaattcgcaaatcatttgtttttattacataatcccgagtttatgctttggcatccaaatggtagccgccgattcggtaccgtgtctccgctaagtggttgatcactggtgttcttgctgctcacagtattttccttttccgtctttccattttcgaacattaactgtatattctgattcattagaaagcggcataaacttttttcgtttaattctgaattatttttcgtgaacatgaaattgaccaaaatggaatttatttgtcgtctgagatgtgtcccaaaaatccactaaattattttcatacataattttattcccaaattattttttcttatttttgtttttttatcaagtttcctcccttccaaaagaatattatttttcctaaaagtttgcctaaaatccacaaatatttttgctcagtactgattatattatatttttgtgtgatcttccttgaaattcaaatttaatttttaatttcatcaaatgacttacatttgtcccccgttcaaaaatttatctctataagttgaatatttttaaatttttttactaatataatagttcaaacattgccttttcattttttctctcattcttttcattttataaataaatcactatatttatataagcgtcgcgtgtaacagttgcgtgatgttccaacatcgctggcatttcccacactttagcccgctgctttttatccattttaggtttaaaaagtgtgataaataagcacacttaaaataatttaaaaactgacgttttcttacggaaggatgcgaatgggtgtaaaaataatgaattcgctcgagtcatttaccgaaattgcagtggctaattttccgggattatgtcgactgggtgaatttgattaaaagactatgaaattaattttatatacagcaaaaaatggcgacatccgttgtctcattattccttgacttgttccgttggttggcactcggatttggcattttgttcaatgccattttaatccaaatggttgttcgtcacactccaaaaccaatgcgaatttacagcaaagtgaacatgttttatcttaatgattttgaactgattaaaacatattcttaagatcctattgcaaacatgtgtgactgacctttcattacttcttatgatgttttttttctttccggtgcattttttatttaaagttgaaaatcaaatttattattttttatttatttaagtgcaattttataacggaaaagggcgaattcgcggcaattttgtacggtttggtcacaataaaaggcgtggagaagggaatttggaatttgttggcatttgtctgctttgtttttcttgtctatgtgtcaatgtttggctatgtgtcccaatttattttccgttatttccttattgtccggtactttaattaaaaataatttatataattaagcaaaattaatcaacgtaattaagcggcaaaaccatttcggctctgaattattttttgctgttttttctgatgcttctgttcccatttgcttattgcgtccatttgttcaattgctattttccgcctgctgaacacggactaatggaggataattatgttgcggaaattctcggcattaatctcgacgaacaaattccgttggcagcttttcctttaatgtactgatataaaatgtacttgagcccagcctgggattttgaaagtatcggcactttggcttagacaattgacgggacctggctgctcggtcaaaaaagccgttttaccgggcgccccgatcccggtcaaaattttagcgcggcgtccggaaatttttttttaaattttactaaatacttgaaagtatatcaaattttcaaaaaagtcttatttttgtctttaactttgaa

SEQ ID NO: 19659 - DNA, 2479 bp, Heterodera glycines
tctatccgtccacctctgttgcatatgccatccatttctctttcatttccttgtgtttttgccgtcatacccctcatcctatccaaagtccatccccattgtgccagtattaaattcactcaatttctccctcgggggctccgagatgtctgcagtgggtcagtcagtctgtgctgttccttgcctttggcaattctttcccaaataaccaattgcactgacccaccaaaatgctctgaggttgttgttgacccaaactattcccggttttaatgcgtaaatattttgttaatgcttttccttcaataaatccttttctcttaaaatggtaatttgaatggcttaaagccttaaacccggggacagaatagtatgtatgttgtaaaggccaatttggacgcacttttactgacgccaacaaaaatgcccccatcagcaggttaatgaaaagggcaccgaggctgcggctgccatagctgtgagccctatgacaattaggccagcaataaggtcaccgcctgcccaacttgttgccgaccgcccattcgtcgcttttctcgtcaatcacagccaaactgtgcttttcctcgccattttcttaggctgaatgaggtgaagaaagagctttggattggagttgggcactttttgttattggaccgcactttcaattttaaaaatttatctgctgggtcaatgctcgaataaacctccttttatcaaattttttgaatgtgacttttgattgttccatgttactactgttgattagccaaaactattgtacttgagagaaatttgctcttaatttttactgtcaaaacaaaaaagaaagagcggcctcacaacggagaaggacctgatctgctggaattgttctccaactccaattagcaaagtgtgtttatacgctttctttgttttgtgactttgctttgatcagttagacatgggcaacccattaacactttctgtactttttttgctgttgctttccttttttctccttcacagtttaccttatttttgctacaatttcttataaatcccacgaaatcataaactaattaacattgtctaatgcctaataaagctcaacgagaaaggcaccgaagcgagtgccgccactgcgataatcggagaagctgaagcgagtggcccaattgaacccgagccggcacttttcattgctaaccgccccttcttagtggcattgacatctgctggcaacaaatttctgttcactggaatgcttcaaagaatgaattaattaataatattaacagccgatcattgatcatcaaaaccaatgctaattaatcaaaattaattttcactaatttactattaattcattaataaaattccatgcaaatatgaagctaattgattattcaccgctccccccccctcccaaaaatttagggttaagccccgaccctcggaaaggaaattccccgacaaaatttgttggggacggctggagaaatttaaaaattatcggggaataaatttttataaaggaaaaaagactcaattttcagaacaatgaggagggaagtgaagcggccgcggccaccgccgtggtgatgatgacacggacggcgctggtcacacggccaaaaatcgaattcgtcgccgacagacacttttattttacgattgtacgcggggagggccaaatgctcttttcggggatattttccggatgaaaaacgaaatattgtggaaaacaatgaagggaaaacagcagacagataatgatcagaaaaaaatgttgcagaatcatattccaaaaagaaaatgaaaaagagaaaagtgaataaaatatttgtttgaatgtgcgcaaaagtcccccccccccattatttgcttcgttctaagaaccaattctcgtgagttaggtattcccttcgaatggatctctttttattaccccccaatcattgcttcgctttctttccatcactttgtaaatccgcttttttaccggcatttaaaaccgctcagagagcgtcgcccccgcgcccgaccccccaaggggggccagccgacggtcctcaacgccgggcgatcaccaaaaatgctttccagcgacgcccccggcgagcttcacgctcaggggacgacgccgcgtttcgtcatcgcgggtgctttggcgagcaaggcggaactcccaccgggaaaccgtactacagaaatgatcctgagaagtacagtctcaagaaaggaagggattggctgggaacaagtggaaaaggaagagagaaattaatgatgggatgaaaatggaggaagagaagagggagcaaacagtgcactttccctctcacttctcccttttctctgcccattaaatgaatgctatttttttcctctttaattccttctgcaagggcaattgacaaatggttcgcctctctctcatccccctccctctctgtctctctctctttcattttttcgccttggtcgctgc

SEQ ID NO: 19660 - DNA, 1760 bp, Heterodera glycines
  misc_feature (1646)..(1646): n is a, c, g, or t
  misc_feature (1679)..(1679): n is a, c, g, or t
tgctgatgatgatgatggttggctgcactcaccacgcccagtgttggcaatttcgtcaatgctttcataccatttgcagcctttaccgttaaattgtaaataggaagagttggaagaatgtgaagcttcacttttggtgtcctcctcctcccgctcctcaatttcagtgaacaatcgaccaaataatcgccctccctttttgtcgtcgacaatttcaagcagttccctcggataataacggtcctcaccacgcgtaaagccttcaatgatgcatggcacataggggtagtgcaatttgacacggtgacgagcgtaaaaatgcgctgccacgttaatgttgaacggcttacgcagacgtccatatgcgggttcaaatgccgcgcctcgttcagtcattccaccaacgaaaaaacacttgcacattccattccgatccttgtatgttgtctggacctttttcccaatcaattgctgcaaaactcggactcggtcctctgggtggttcagtcgatcgcgaagtgactttgtcgggcaggagagaaattgagcacaaaattcgctgacgagaaccatttcagatttttttatgtctgaatgaagaaattcgagcggcttttataccggtgttccaactcaaatggataagctccgcccctttttattttattgcatgcataattaatgaatggaaaataaagtacgaaaataattaaacgttggaaaatgtaacttttaggtagaataatgcataattagtaggtggaagacacaattttgaaaaaattaagaaattgaaaatataatttaactgttcaacattttatttagcattaataatgaatacatgtcagggtttgaacaagttttgagaatatgtataaatttatcgaatgattttccatgggacatgtggtaaacaaagacaatacaatggggggcacatgttgatgtcaatggggactggtaggcttcaatgtttttgtgtaaacctttgggaaatttatttaaaaaggatgatgaaatacttggtggtatgggaagggcaaggctatcaaagtaaatcactggcgcgtccaagtcccgggcataaatggcacaccaatgggagccccctttgtgatgggggtcacggttcacaatgagtgccgcaggatactgtagggtggccggcgaaggcaactggtcactggcgaaacatcctcgaaaaatttgtgacgtccgttggttttctctcaatattttggtgatttgtgtgctgtccattacgtttcaaccaaaaaacagagcacaattggtgtaggaccaaactgacgataagcatcaaatacagagccaacagtgcccagcaaatgatttgttggaagaaattattttcctttgaggagtctttgcacaattgaatcagtggaggcaaaattgaggacacttgttcatctatcagcttctcttgcttagggcgttgaggatgggttgttgtggtggttgctggacttgccagccgggtcgaagttgtactgggaagtcgtgtcaataatttgcgtcttagatactctgggacacgcgttgtactgggttgagggctgctttttggccagcccatttttagtctttttatatattcggaatatgatgctgataacctcggntgtttgactggacacaacatcgaaatttaattnaaagtatgaagaaaataatttccacatttttgtattcatctttatcaaatgatagtggcataaaaaaaaaatgacagcctt

SEQ ID NO: 19661 - DNA, 1250 bp, Heterodera glycines
  misc_feature (1196)..(1196): n is a, c, g, or t
  misc_feature (1223)..(1223): n is a, c, g, or t
cagctggacggtttgggctgatcaaaagttgtgcatggaattgtcccatttctcccgcggctcacgggggcgaccacttttgagtcgtcggtaatgaaactgaaagaagaaaaataatatcgcaatcgaaccaaagttttaaacatgtttccttcatttgataacttcactttttcaatgtcgaaagaatgtcgggactgtcgtgtttgtccgggtccctgacatcgaaaatgtaaatgttgtcggaactgatgttcacaataagttcgtcgcctcttttgttgaaggccaaatgcgtggccaaaaaacggccttcacttccaatgtgtaagttggcttaaagcatattttaaaatcaattttacaaagtgttgccaaccctagagtaaatctgtatccaaacttttatcgaaccagaaattcagaagccacaaatcgaattaaaatataaaaattttgctaattcgcattttattttgggatgggattcggtaatgctttgcggatcaggtcaattgttacccggcaataatcggatgatcggctctttcatattgcgcctgtcaaaaatgggcacgacggcgtcacttagcccggcagcgatcatttcgggcctgacctcgttgatggccaacgatttgagttggtattggctggacatgtccaacaagtcggaggtgcggttgtcacggaggtcgtattgccttgacgataattaaattttggaagtaaaccgagcaggtcacctgaaaaaatcgctgaaaaaagaaccaagaaaaattcagaaattttacacccctgaaaacgaaaattgtgctggtgaaccctgtggacggtcactagcgatagataaatgaactcacctcaaaacgccatcctcggaggttgaccagaaaagacgcggttccgctgcgcaagtggccaacttcttcaccctgccgccgcactcccacctttggatgtgtctgtgcccatcggcggtagcctgaccagaattgaacggtgtcctattgtttggtaattttgtcgagtaagaagcccagggagtgaattttttgatttttcaccccatataaattcactattcgaatatcattattggtcatgccgttaaacttaggcatattgcacctttgtgccatccctacaaccatcgaaaacatgacaatttctctttaccgccggctgatggtccnagtcatgcaaaagcacttgagcatcgncccgacgcggacacgagcagacgatcc

SEQ ID NO: 19662 - DNA, 1254 bp, Heterodera glycines
cgaaatctgtcgatacgaaatgctaactcgtttacccttaaatattctggagcgtacccaaataaaatgagaatttttatcagatcccggtccgttttttcaaaatccaggttttcaaacggtgtctaaatattaatgcaaaagtacgcacatgttggtcgtccgaaccacttgccaagagtgtgccagacacattccaattgatcgtgtttacacatcccccgtgtccatgcaatgtgtaggcgtgtgtcaatgaattaaccagtgcgcttgtcacacattgctctctgaacaaacgctcgggaacgaccaaattatcttctcgttgtctgattaaaccaattaaagtcatttctaaaattcgcttaaaataaaaacagtcctttaaaatactaatttcggctctattgcagttcacacgaccataaaaaattttttgcaactttagtgcaccataactttttcaagaagcatccaaaaaaaacattattatatgagccacattccaaattttcttctgtttagtctttaaaaagtaagtcatttggaaacagcgattatataatattcaacagtcagaaaatatgtacaaatagcaaaaaaggaaaattgaaaatcagaagttgcgaaaaggatgaattttcactctattagagaggggccgaaaaattggggttttcaatcctaatagagattctccatttttgtaggagtcgagtatttaataacttatgttgggtctgtaaacacactgaatatgtaaattactgcatgcaattagctttatgttttattccatcatttacatgtgtacatagcatacgcgttacaacatcaaatacaattatcgattaacacaaaggatcgatcgtaggggataatggtacgtaggggataatggtacagacaattgatcagagatgggatagatcacaaacaaacacagcaaatgttgtacttcgcagagcgcacatcgtccgttcatcgacttcttggcaattcacttgggcttcggaggttgcttaaatgtgaagttgaaagttagagaagtcaaaacccagcccattttcaactcaccgcccaggccgagacttcaattggagttggcgattgtgcaacgcctaaaattgagagttagtgaaaaaagcaaggaaaatcgacgcccttctctcccacctgcgtaggtcgacaaaccgggcatctgcgaatttgacatggttgagccttgcgccgcactctgtcccatcttggagg

SEQ ID NO: 19663 - DNA, 2740 bp, Heterodera glycines
ttatgaattattgagttattccaatttttcgtccgtatttgcaaaattacctcacttaaatttatcaatgccccctttggcattgtgattccgccaataaaaataacaatttttatattttaattgactgttcttttgcaatttactgctcaacaattagaaagttgagaaaagattgtgtatttgtaatggaaaaatccatccgatgtttaaattcccactcagaaaaaattttctcgactaagagtatcaaaattttttgtgggaattttcatggctaattgcttccaaaaacttttcttccttaacttatttaagtttttttgtcataaaggccataatataataatagatacatcaaaaatatttttcatgataaaatatcaagaattacaatggatgaaaattcctgcattttttctattataaataactgcatttttaaagaaaagttgcatcctttatcttagggattaatattgtatcagagtcaaaggcaatcagtcccacaaaatcctatattataataaaattaccactaattttgttgactgttcgtttagcctaatgtaagaagtcacattgcgttcacaaaaataagtcggattttctttgatagccttttcagttgaaaatttatggtcgtcaattcgtgccaaattttttcctattttaaaataatttatatattttgagtcaaattgaggtgtcattagttttttgaccaaaatttttaacacttttcttattaagaaaacatgttatcatagtgcataaagagaatttaaattttttggttttagctttctgaaattaataaattttatacaaacctttcgatgcagtagatttctaataaatattcaattacttcagaaaacaaaatgtcgaagacaaatgcagctcgcagtgttccgacctcccaaccaaaatgttgcccaaagtttcggaaatcctttactcaaaatgatttattttttttgggcacataattcaaaaaaataattaattgaccataattggcttcatatccaacaaattttgtaaattgcttttttaattaattaaacaaataaaattaaaattttcctttaatttcaaaatattgcttcatctttttttaatttgtcataatttgaaggtttaattagcgctgaaaataataaataattttaaaaagttagaaattcgcttacttttattgtattttggcaacaattcttttttccattttatcaatgtcagaaatgcccaatttcttcgcaaattctttctgtttgccttggccatataattttttaaattcatcaaatcgttcaatgaatttgcgctttttctcatcatagaagcgctttttcattttatttttatttagatttaattcatttttccatttttgtattaattgcagatttgttcctaataattttgcaatttttctctcaatttttccataatctttgcttttgtattttatttttccttcaacttttctttaattgcttcaaattttttaattatttctctctttttgtgatcatttatattcagatcacctttaaaaaggttctgatcggtataatttcccatttgatcatttggaccatttcccatttcttcacccatttgatcaactgctgctgattgtgagttctcatttcgctcattttgttcaatttttatcattaattcttctttttcgtttttgtcccatccgtcgccaaatatttcatcaaaattctgtcggattttgccggattcaattacaaaaacattaaaaaatataaaaactattaaatgccataaattcaaatttttctcatttattggcttaataaaaaatcgagatgtcctgattttttatatatgataaaaatgttttttctaattagtataaatcagctacaccatttgtggctgtggcgtgcttttttcaaaaattttggggaacaagctgggcggggagagggggtagggatgtgcgagaaatgattttttggaacaattttttaagagaaattacaatttttgggggcgccagcggtcccgataagcgccgccggggaaattttttttgggatttttaatgattttgttaagaaaatttgtttaaaattccggcacctaaaaatccttatttctcttaaaaaactggctaaaaatcgtaaatttggtcattatttggacaaaatctgttaacaatttgcactcaaatctgcgaaataaattatttaattttaagtaaaatttataatttatttaaatgttcattttcaactaataactcagaaaactattatcaaatacaatgctggtgaataatatgctaacattggcttttttcctttccgttgctttttattttttagtgaatgagcgggcgactgataatttgtattgtaactagagaccggaaatttcaaatttgaggatcccgctgcgggattggaactcaaaattttttgcgggacggggtcccgcgggattaatcccgcaaatcccgaatttaaaatttgcgggatcccgcgcgggattgcgggattttggaaatttcgaaaaaatttaaatttaatttaaaaaaatttcctaaaagcaaaaaatacctgacattttgaaaaagaaattttttagggctgggggtgcatttaaaggggctgatgggtcgactaagattttcaaatggatcagcagacggtaaaaagagatcgggaaccaaaatctcctaatgatccataaatat

SEQ ID NO: 19664 - DNA, 1760 bp, Heterodera glycines
ttcacattaagacctgaatatcaatactgatgagaaatttgtgaagcgaaacaataataaaaaaatgatttttcaggttacaatccttcgcgaaattttggaaaacatatttggtaaaaaaagtttttggttatttattttgactaatatttatttgatcataaataaatatttattaaaaaatttcgaatgtaaaaagaaattattttagcagaattttgaacaaggtttggcatttctttttgtttttagcaataacaaaacctgaaattgtacaatacgcctctataaataaatcagtgaagaatattattacagaaaaattcaaaaatttttttatttattaacgctttttgatagcaaaaccagggttgcaactgaaaatttttaaaatttgaatgcaatttgtaaaagttttcatccaatttttgctattttgatccatttttaatgaaaaaaaagtttttgtggtctgtcagtgccgataagcgcagctggggaaaaaggaataaaaaaaacaccgaaaaatcaaaatattgccataaatttggaagtgttggtagcagtttccataaaaatgaccatttttgtgaattcccaaaaagcagcaaaaatcagcatctcaagaaaaaaaaatcagctttgaccccttaaacagtaacaaagcagaattgggagccctgattatcgataatgaattaccaattaataaataatttttaaaaattttttgaactaaaaaataaaaaggagcacacacaaaatactcttttattttcaataaaatatttttccggataactcagaaaagtgttttaatgttttgtagtttgttttatttagaaaatttgttttagtgataaataaatggccttgggatggcactgaattccgatttccgacatttttagggtcggaattccgatttacaaaaatatttggggcctcggaatgccatccctgccattggataatcaaaaactaataatttgtttataagaaaattaaacaacattaagagaatatcttaagaaaatgaatttattccccttattatgcttaattttaattttaattagtccaattgtatcagaaaagctaaaactccaactgaaatcatttggcgaaatatttggagaaaattgtgaagaaaaagaagatgaaaatttgcaagaaaaaagagaaatgcttaaaaatattataaataaaagaaaaaattatgcaaaaaggaagaaaatacggagcaaaaaaatggagtaaaattgaaagaaaaatcggaagaacattagggtaaaaccacattatatttataggcggattaaaaaaatgggattaaagcaaaaaatacctaaaagatagaaattaaaaaatgatgaacaaaaaattgaaattgataattcaagcaaaaaagaaaaccttaggggtctattttctcaaattttttcaggtcatttaattccaaattcctggcggcgacggttaggcaccaaaaaaaaaagatgaaaaaagacataaaaaggcataaaataaaaaaagcacaaaaattaattcgacaaaagttttattagagtaaaaaacaaataaatgtaatatttcaagattttttcaaaataagaaaataatttttagaattttaaacccgcacgattccgcgattcgaaaaccgtgaaaaaaagcgcgaaaactattgcattaaatttaagaacgaaaattttgacttgaaaatttcaaacattttcctcccaacttcttttaagtcc

SEQ ID NO: 19665 - DNA, 955 bp, Heterodera glycines
aaaaagcgcgaaaacaataggataaaattaagaacgaagattttgacttgaaaatttcaaacattttcctccaccttcttttaagtcccacccgagggcgagacagttccaaaatttgggtgccacataaatgtggatgtaatagtaccttaattggactatcactagtcaaattaggtgggggattttgggctctaatggaactgaaaattgcaaaaattagatggggtgcgtccctttgtaaggaattccctcgtcgtctaacccgccccttttcatgcactatttcagggtctaaaaaatgaaaaaaaacaaatgatttttttttgttaaaaatcatagaaacttttcggcttttaaattttaaacccgcacgattccgcgattcgaaaaccgtgaaaaaagcgcgaaaacaataggataaaatttaagaacgaagattttgacttgaaaatttcaaacattttcctccaccttcttttaagtcccacccgagggcgagacagttccaaaatttgggtgccacataaatgtggatgtaatagtaccttaattggactatcactagtcaaattaggtgggggattttgggctctaatggaactgaaaattgcaaaaattagatggggtgcgtccctttgtaaggaattccctcgtcgtctaacccgccccttttcatgcactattttagggtctaaaaaatgaaaaaaaacaaatgatttttttttgttaaaaatcatagaaacttttcggcttttaaattttaaacccgcacgattccgcgattcgaaaaccgtgaaaaaagcgcgaaaacaataggataaaatttaagaacgaagattttgacttgaaaatttcaaacattttcctccaccttcttttaagtcccacccgagggcgagacagttccaaaatttgatgccacataaatgtggatgtaatagtaccttaattg

SEQ ID NO: 19666 - DNA, 1343 bp, Heterodera glycines
  misc_feature (1169)..(1169): n is a, c, g, or t
  misc_feature (1242)..(1242): n is a, c, g, or t
  misc_feature (1251)..(1252): n is a, c, g, or t
  misc_feature (1284)..(1285): n is a, c, g, or t
attgtcgtaaagctgagttgtccaccaaccgagttgtccttttttaaaattcagcccttttctatttcaaccgcttaaacgataaatttattgaatttattttttgcattttcctttgatgtaaaaattcacattaaaatatttttctgcacacgaagtgacggattaaagttttgggcttaaaatgttcttcttgtcctgaaatattcacacgcaaattgcttagttggggatggaatttcagtgaatgaattcgccctttgacggctaaaaattattcggtaatttcatccaacggaaggtaaaaggaggctcatggaaataaacaataataatgctaataatttctgggaaaatttggccaaaaaatttggccaacagaattttcattttggcaaatggtcgaaaatggcctcctcctcctcctttaatatcaaaaatttgctggccattgcttcagccgaaccaaccaatccgaatccaaacagtcaaaatgccaatttggccattccatgcactaattcgtccgtttcggcaccccaaaataccaaaaatccgagcctagccattacgctatcaaaatgtggccaaaatgggccgccgcttccttctcagccggcactgctctttctgccaccaacaaatcagcaacaaattgtgccccgcggcggtgacactccgccggcgccgacactggcagagctgcaaatgttttttggactgaacggttggggcacaagcattcacagtttgaaatcagtcacttccttcgtttgatgtccccaggggttcaaatctttcatagtgagaaatatggtaatacaaaaagacaaaaaatggtaaaaatattgccaaaacaattaaaaatacattaaaaaaactatttgttcatcattttgagcaaatcgggaagtgttggcatttataaaaaaggatttaccaatttaatttcattttttaaaaagtttttccttttgtcgatgggcactgtaagaaaggctattttaaaaatttggcatttgttaaacagctgatcagaaaaaagagaaatgagcgaactgaataatgccatccattcttaatatagcaattaattggtcatttcgtgtcaatttgttcagtgcggaaacacgagtacagtcgcgcgcggcgtcggacaatcgaccganagccgcgccaggcgtacaccgcaccacagctgaacattttggaggagtcatttcgggtaattatattaattgnggaaaatannatgaaatttctgtgggcaaacacaaaattaannggcgacaataattgagtgtgcaaaagcgagtgcaattggccaacgaattggcactgac

SEQ ID NO: 19667 - DNA, 1155 bp, Heterodera glycines
  misc_feature (59)..(59): n is a, c, g, or t
  misc_feature (79)..(79): n is a, c, g, or t
ctgaacttttggaggagtcatttcgggtaattattctccagggaataaaatgattctgnggggaacaaccctttaaggncgacaaatatttgagtgtgcaaaagcgagtgcaattggccaacgaattggcactgaccgaaacccaagtgaagacatggtttcagaacagaaggtgagttgatgagtgtgccaaaagcggacaaaatgatgccttattttgagaatcaaaaggaatttggaaaaaaaagggttttgtcgattaattaaggctttaattttgcgttcattttttatttttaaagttaaactttctgtgcattgataaaacggggtcattcggaattcgattcaaaaaaaaaatctcgaggataagaaattttgaactttaaaaaatatatatttggggtacaatgaaaagagggggtcattcaaaaaccatttgaattttggaaatttatagccaatttactaattaataactagggctgggctttttaggcacaaaaaatcgcgaaatagcacctaaataggcactaaaataggcatttaggcattaagcacaaaaactccgaaataggcaaagttaggcattataaaagtcatcgtagacaccccaaaccaagcggaaaatgcttttttcgtgcttatccgttcgtattaagtgcgcaaaaattttaggcatttgcctaaaaatcccagccctattaataattgattgcatctttattttgtcaaaattatgcagaacaaagtggaagaaacagttgactgattcgcttcgacagctgtgccaggaccaaatgtacggaagtgttgccaacggaggcaacggattgggccaaattgggatggacgaagacggcaattaattaacccggaaaattttgctttttcttttacctatcgaaatcctatcattcttctacattaaattcaaatgcgtttgttaataaaaaaaattcaaaaatcagcaacgccgcccagaagtattgaacgttcgcgcattccgattccattccgacattttggaactcggaattccgagtcttgaaatttttgggtgtagcaactgtaacaaattcttactttcattaattcatgacaacttgtttaattggtggtttcttttttttttgattgacaataagctgaaaa

SEQ ID NO: 19668 - DNA, 950 bp, Heterodera glycines
  misc_feature (316)..(316): n is a, c, g, or t
gagatgaaccaataaatagagagtgcagagaaaaaaaatctctcattttggcgtactatttttttgtctctgttattagagaagaactgaattcacttcgtgacgtttaaatttttttccggacgttaaatcttcttcaaattttgcatacctatagaaaaaaaaattctgcatcgattaatgcagaaattattcttgttttgcgctagttcaaaattacaagtttagaaggcccatatattttttctattgcatccaaatactatgaatttgcttagaaaaagctttttctaaatcagtgctttcgaatgatacncagaatgtccaatttggttggcaaaaagcttcaaaaataatttgcaaaaatcgtagttttttattttttggacaaaaataaataaaaataccgtactttctctatttgaatgcccctctctggtagaatgccctctccaataaaatgcccccctcaggagggatcgagtatatccgcagggattctggggctttgacgatgccgaaagcgaaatctgattgcagattcgttatcaaccccctaaaatattcctaaaaagtatttttcagctaaatttgggtgaaaaaatttttcccactcagaaaccatgtggtcccccttttggtcccaaattcccaaatcacttttatttttataatcttttccaaaaaaatagtacaaatatgaaataaatacaattctatagagcaaaaaattgcgggttttttgagtatattaattttcgaaaacatcctttaagaaccgagttctgattttttgtctgaatttcgaatttttccagaatttcttgaaaaaaatttcatttgatgatagaaatttagaataaaattcataaaattctccttatttttctctatttttaaagctttattgtacttaaattgacccactttgaaatgagttatgaattttc

SEQ ID NO: 19669 - DNA, 1773 bp, Heterodera glycines
gcaaaaagatacaggaaaaagaaaattctcgctttgaactttaaaaaattttcttaatttaattaattttaacagagtgcttaaaatagctcatactatcattgacgagaacagtttttatttattatgatggaagtggccattttgaagcaattttaaatccaataccaactgcagactgaaatatatgaaatgaaaaagaaaagagaattaagttatgtgttttatgattaattcttttaaacaattaatttgggaattttttatgtaaaatattaattttcttataatttttttgcaaaattcttaacgaccaaaaatcgatatttttcattttgatggttttttgactaacgcccattttgatggtttgtgaataacgacatagaagcgatcaaatccatttattcatcagctctgctgactgaatctcgtttcgtatcagattcctaacctaataataattataattagaataattaactcattgcaaagtatattacatgcgaattttgttgaataacggtcggtccggctgggagaatatcacaagagttgcatcctcaggtcacctcataaattaggagttattccgcaccaaaggctcgtgatatttgcgcaatatctttcactttttgcctcctgtgtggcgccattcatgtgcgtatatagttatccatatcataatattgagtccatatgattaaaaatcatcagatgttaaaattaatatcaaattagtgatcaccgaccttggaacccccaaattacaaattttggaattttttgagggggagggggcagcataacccggaagtaccagtgcgcctatcgccagcaaaaaatttccaacaaatttttcttttttttgatcaacattaatatttttaaaataaaagcacgctagcatttatttacatactcagagtgaaattagcaacaaaataaaaatacatcgagcaaatgtacgataagtgaacaactcgagaattaagtacttaggcttatgccttatgggacaacaacagagatcgaagaacatcgcatttcgatttaattgccgaatatactcgcgaggcctcccagcacagcaacgccttggaaactttcaggcgtaagcgcaacaaccaaaaggagaatagcgaacagaatcacgagaatcagaatgcagaggcacaagccgatgcacaccttagaaacaccgccttaaataggaaaatgggagggacgagttgagctaattggagaaacaaagtcaaaagtcacccaccaccatccatcgaactgtccgctccaaatcccgaagctgcaggagtggtgcctctgcgtcgcgttattctttttgttaacctgtcgagaaaaccgtaggcttcagacattgtgatgcggtttagttcagttaaataggtatttcactttgctaaaaattttttcaatgtaaaattgtatgaaaaaattggaggtcaggttgaaaaaggaatgaaagaccagcatccgttccgaaaaaaaattaattcacatccgggaatttttggctgggaaaatcgggaaaaacccgggactagtcccggtcccggtcaaaaccgggaccttggtactcagttgtactcggttgtccgcttccaggtcccggtcccgtggcactctagttttgatatagaatgaactcattaagcattgagcataatttggcgaataaaagtatatttacgatttttgatttcaaaaaattccctttgtttttttgataaaattcaaaatctttcacttttt

SEQ ID NO: 19670 - DNA, 1312 bp, Heterodera glycines
acataaacaaaaaagtgaagaaagagagagagagggaatggaagaaaaggggggggaagagcaaaattggtggaagaggaaggggaggggggcaaagccaaagcaaaatggaaatggggaggggagggggcagtgacggggagagccgctggttggtggtggcggtggacggatggccgaccaaaaggggggagggctctctcttcttctgtgtgtgctgtggtggtggcccgtgttttcgcaattttttgttgtcaacaacggcgggggacagtggcagcagcggaaaaatcccccgcccccttcagcactttctttgccattcttttttccacacatacaattttttatcatcccttccccccaccctccctatttttacttccataaaagaagagcatgatgaaaaagtgctatacgtacacatgcacatgcatatgtttgttgttgtgtatgcaaatatgccaaattgtataattacatgtttaattgccttgcctcatttgatgatgaaatttttggcaaattagctgtgtctatttatgacaaataaggaattattcgttaatgtaagcatatagctacaccaaatattttggattttacggttaaaatgatattctcacacatttatcaattacataattcacattcgttgctttattgttttattgatttgtgcactttaatttgtcaattcctttttcccttttgtttatgtacataattcggtttcaaaactttgttttcttaaacaaaataaaaattaccttaaaatggcagttttctaaaaacattacatacatactagtaaactgaaaaaaaaagaatttaagaatttgctcgacattaaatcaaacataaatttgaatttacgcaattacatattcttttccaattttggcgaaatatttttttttgtaaaacagagcttcaaaatttagtttttcttttaaaaatttactgacacattttcttccgatggttttgcccggtcattgatagaaaaccataaagaacattccgctgtgccaattacataaagcttaggtaaccaaaaaccaccaaaaataatgttgcgaattaagccctcaggctacaacacgcaatttgcttccatttcttttccaaaatcaaaatacgattttataacgcaattattttgtttcagaaaagtgtaatgatcaacaatgtttgactatgatcgagatttgaacattgcccagcagttggctgtaaatgttgacgcttttcaatggcagaaaaaggcaatcactcggactctgactgatgatgacgacactttgccctt

SEQ ID NO: 19671 - DNA, 1038 bp, Heterodera glycines
tttattcgttacgccttaagctgatttgaaagcaaacgaacattggcaattgaattgttttttgactttcgacgttcactcggaaaataaaagtaattaaaaactgaattaaatattaaaattattaaattaaaattgtgaataaaaaaagccaaagtaagacaaaaaaatagtcgatttgccatgtgtgtctttttttcttcaattggtgaaattaactttttaatcccacttccatcggttcatttttgcctccagtcagtgcagtgccgtcgccgtcggtgctatattgtctccgtagttcagctttggtcactgatctgtgccgtgccattcgctccattcggttttctcctttttccctctttattttggcctcatttttatggatgatcagaaaagtggcatgactatgttatcacaaaataaagtattaaaacttagtttaccagattagcttatcactccaaatttatcccttccttaatgtctctattaattaatgtcaattaattacctttttacacttcttccgttcccgaaattctgtctaatcaaccaacaaattgatttataccgaggagagttataagcggagcattcatgacacatttttgttcattaacacaaataaacagccaattaagaacagagcgaaggaaaggggagggaagggaaagaaaaggaagacgaagtgattgacagtcattatgtggtgattaggcaaaactgaaggacaacaaaaacaataactttcccccttatttgtccccttaacctctccccttcttcctccccctttcccttcttcctccccctttcccttcttcctccccctttcccttcttcctccccctttcccttcttcctccccctttcccttcttcctccccctttcccttcttcctccccctttcccttcttcctccccctttcccttcttcctccccctttcccttcttcctccccctttcccttcttcctccccctttccctcattacccctctctttactcccctttcgcccttttatgtccc

SEQ ID NO: 19672 - DNA, 2140 bp, Heterodera glycines
  misc_feature (81)..(81): n is a, c, g, or t
  misc_feature (208)..(208): n is a, c, g, or t
agatacacacagagggaaaggagggataaaagaaagctgacagagagataaagacagtttggaagactctttgttgattanggctatttccgtgcaagttacgcacgggattcgatgcagtccggtgtccatttgtccgcttcgtcgagcagcggatcatcgaccgagaccactcggcacgaaaatgtgttctactgaaaattagtgnaataaatcggctttatcattcattggatatccttttatgttgcgctttttcacgtgtttaggctgatgagcgacttttgaagaaattgcctccaaacgtcgaatcggctgcccttttggtccgttcgtcccaattcgatcagtttttctctgatctccagttttcttcaggtggctaatgtcagtgctttggaccgtcctttgagtgcttttgtccgtcttaaatacccaaccgtatgttttgttttactcattagtggccaatttgtcacctctttcagttgcttcatcccgaattgcccgatcacccaattcccgtccgtttcatttatgtgttgctcaacccaatggacaattacccaaatgagacaataaacatcggtcgggcgatgggtgcgcttttgtcggatgaggttgaaaatgaatagggcaattagcaaagaacggacgcgggggaaaatagaaaaattatatttccaaaaataaaaaacactaatcgaatctgtgcaagttaccatttgtccaccaattttcactgatttggcatcgtctgactttgttttttcagcttcattaattaaatataattaattttattttgacccaattaatctcagcattcggctataatttcgtaatttgaatacttttgccaaatttcgtcagattttccaatcggtcgcctttcattgtttggagcgccacactttgtcggatgcggtcgacgaatttctgtcccaaattgttctcattccgccaggcaattgttcgctcgaaacacgatggaagccggcggacagagacgcgggaggggcggtcagaaaaagggcgaaaaactcaaaaaggaaaattggcgcgcgtttagacggtacgccacgtcggaatgctttacgccaattacacccaatcagtggacgaattgccctcctcatttgcaccgtttgtgcccagtgaatacagcaccagcaccaaagaggcggcagccgcctctcggcacttgcaattggcccacctcaacgcggacgcacggccttaccgtaccgggagacttttcgggggactgatggccgacctacggtgggattggggaaaaacaaaaataaatattccaaaatataaatatataattatcccaaaatataattccccccttcttcatcaggcgcaaattgccttggtttccgtcggatttctcggatttcttccgcggccgtctcagccaatccctcgccgccaccatccttctgttcttcgccaatctgtccaatataatcactttcggcgccattatggagcggtctttccaccaccaaattgcttccattgaaaatacgtttgaaaattacagaattaattactcatagttgttctcctaaattaattaatccaactaattaattaactaattaccccaattaatttgttaattaattgtctctctcttttcaaatataatttgtggcgctctgtccggccttctctttggcctattcagtgggcaaccgctgagtttgttttagctaattctgccaatgttctctcccatccttcagatgttctgtccgccaccggtcccactttgatctttgagaaaattctttttgatttttgcacgtaatttttcaattttttttttaatttccgccatttccgcccttccctttcagtaccaaccattgggagtttctgccctttcgcttttacgtcggcctttggatgagcttttatctgatcattttggtagccaccgatgcgtccgcgttggtcgcactgatcactcgcttcactgaggaggcatttgccactctgatctcgatcgtgttcatcatccaagcattcgagaagttgttcgagatcagttacgaggcaccgatcacccgacagccccagggggagggatcaaattgagaaaagaaagaacattgttgaagga

SEQ ID NO: 19673 - DNA, 2629 bp, Heterodera glycines
gatgttattcggaaaatgcgcgtagactgagcgcattttgtaccgaaatcccaaccagttccaccttttgatcatgttttcaatgtgtgagcacactgtgcgaatggctgccacttctttgcggatgccaaaccatttccgcacacggagcagctaaaaacccaccattttagcattttgaaagttggaaaaataaaagtttaaatttgagactattttaaacgaaagcgcaatcatttcaacaacaattagaaatgaaaagagcactctataaatttcagattttgtttgtttgttactcagaataccttcgggttttctcgcataatttcaatgtttaagtggcgaaagtcgcgcttgagcgtaccgcgcggtcccttcacagtcacaacacggttgttgagcgcgaaagtgacattgtctgggaatttgacgatgtcgctggattcaatcagcttcatttttcgttatgtttaaacagaaaattgatctgtaattgaaacttacaaaatctctttttttactcctagaaaaatatataacaaacaatactattatcataggagacttttaacattggcagcaaagatataacttgggtcaacaatcttccagtacctcataccagtctaggaataacttttcttgatttttttaataaattttcactaaacactaatattataggtccaacaagaggaaattcaattcttgatctttgtctttttacaaaccttgatttagtctcttcaattgaactaaaggatagtattgttttttcagaccattcagcattgtattttaatattgatattccttgccaaagacaaaaacccctaaaaattacggtcagaaatttcacccagtctaaaattaaagcattcaatacctatttactctccaatttatcttcatctttaagaacctggcaagagtgtaaagatcgatgcttttatcttgagaatttttatttaaatttattttggcgttttatcttcctttttattttaaaacaaaaattatggattttattgttgaaaaatcatgaaaacaaagtgtgtaggaaaaaaagcagagtgttgtaaatgcaacatgcaattcaatgtttattttctctgcacaatcgattgcccaagaacaaagtctccgcccccactcccccccccccccgcccactttgataaatctcctccattgcccactcacaatcattctcattttcccataaaaattttatgtagactaccgccgatggtacctccctctttaaaagaacatttctcaactttttttcgaaataaatttgtttatatgttttcagggttgggaaatacaattctaacacccatttcgaaccctggacctggattcgaacaaaaattatttaatttccagcaaaatttggaaatatgcaataaaatgattgaaataaagcgaaaatattctcctgaatgaaagacataccatttcttgaattggaaccgttgttttgttgcatctttcgaattttgtagaaacgaatttttattcgagtccgggtccaggcctcgagataggtcaaatggatgtttgaatcgtattctccgatcatgaaaatttaaaaataactacctatattcgaaaaaaaattgtttaagttttcgaaaaagcgatgggtagatcggtagtgttaccttttttgaaatcataaattataatggtaacatatttaacatattaagatttgctaaaaaaatttagttacctaaaatgcctgtgcgacaaattctctcgggtacccgcagaattgcgaccaaaagtttgtgttagtggtttttcaaattcgataatcatccgttttccctttgacagcgtttggaattggttcggcgaggttggccgattacgtgagtgatttaggattttaaagcattcaaattgctttattcaatcttttccatttagggtgtctttaaggccctcctcgagcccttagtggtttccaagtttgaagagctatcgcgcattagagtcgaaaaaattagtaatttttttcacttttttaattaacacagagtcttaaatttagcgatcttttttgggatcctcgttttcgtctcattggctgacgttgctatgaccctgcggaccaacgaacatgttggcgacgttgagcgccgtcttgaaagccgtcttgaagaccgttttgctgaccttcgagcgcttcttgagcgccgccttgacagcattgaccgccatctcggaacttctgacaaagtatattcagcttactggtatactctaaaatccagtcaatgtttttaactttcaaggcgacggatgccaagttgcccggccagtgatcccagtggaactctgacgaaggatctcgggtgttacctttaccgggtattgaattgaccaattgctttgttgttctcatcttttcactaaagtcgtaaaaataaagttttaatgtaaaatgttcactatttccgtgttcaatttctcgtctatttattttttatgtttcaaacattattcgctttttggtttgcctttgttcggttcgaatcgatgagaatcaagaaaaaggtaaataaataaatcgggcaacactgatcgattggtcaaatttttacagagggat

SEQ ID NO: 19674 - DNA, 2920 bp, Heterodera glycines
  misc_feature (2817)..(2817): n is a, c, g, or t
  misc_feature (2884)..(2884): n is a, c, g, or t
gccaagttcaatataaaaaatgcgatttataaaatagcacaaatcaaactctaaaataatttcaaaaatcttaccatttttctgatccttttgtccacgcattcttcggtatcttcatcgtaatattcgctttgtcaaattattttttaaatttccttttaccctttgggtgcgtttgtggcacgtgatgtttggcaaactgcgctaatttgaccatttcctcgtccatctttggtttttcgtaggcattcgcacaattcacataaattgtggccattgtgaacacgcatcccccggcattttttgccaaatcgaccaatgccttcagcaattccgattttccgacaatatattcctttatttcagcatccaaagaaaggtaagaaagtccttcacaagcgaaacgtctgacatcgacctgacaaataaatgtgggaaaatattagacagccgtaaactgccaaaaaattccaaatattatagaaaaaaatccaccgaaaaattttctgccttttcaattaaaaatttatgacacgtgttcgccagtttcatgcgagattcatcgtccattggctgtttactgcaatcatcgccggcagacgaagcgcatttacaaaggcccaccaatgcgcggacacggacatttggatccgaagacaaaaataactttttaagcactggctaaaaggcattgttgaaaacaggagagctttaaatggctaaaataagagagacaaagtcctaatttaacaggcttctccatgcctattgcaccgatggaccccgtcaaattggttagatttttccaaaatgctttaaatactgaccagcccctgcttgatcatgttggtggccctttcgtatttgctcactgaaagcacaattaattcggctgcaacgctttgctgcagaaagtcgtcggaagaggccatctggagcattacttcggtgatttggtcgttggtcaccaaattaacgccaacatcaacgggcccttggagcaaagtgatcagaagagcagccaaattgattctgttctttggatcattaaggtcggacattaaaccaccaaatatttggtccaccctttctttgtaaatcgctctccgttggtcaaaaatcttaaatttatttatttctcatgaaggaattacaccgaccatatcgtcataaagttgagcaaggaaaacagaaacatggtgacgagtttcggaagtgactggatagtcgcattgttctggcaattgtgtggcaatgtgcaagattttgaaaagtcctctgtcctcgacaaaacgccaggacctgaaaaaaaaggaatggttccggtcgaagtttaaatgtggaattctctatcataaaatttattcttctaaacaaaaactaaaacaaaccatccacggggtaatcccccactcatatgcatcaaatttttaagcagaaggtcaatgctgatttctctcgctgttgccgaatattgcgggtccgttagaatttcttccaactcgagaatgagccgcagaattgcgaccttgttccgttcgactacttccgagtccggcttaatctccttggataaatccatcgccgccaatccgttgaacacacgctgaatgactgcgctggcagcctccgcatttgcaatcgatgggcgaagagaaggcagtcgagcgagggtttgtacggaaagcaattccatcatttggacggactggcaaagaacaaataaaatttttcacttcgcacacgaggggcacgtattccctccgaaattttaaccagttcttacgacaaaaatgactcttccccgctagtgcattattttacaaaaataatattaagcaaagatcgagaaaaatgtacataatttaaaaccaagaaaggcataccctttctcgtgacttggccaattcgtccaaaatcctaacagcacacagtgcttcttcgtccgatgcatttcctttgataactcccaacaattgcgccacaatttgtccattttgccaaactcgcattgccccgctatttgagtctcggcataaaacaagcaaattgttcatggcctaaataacagctcaaaactgtaacacatccatcccattcccttcacctttatgtgcttttctttgtcactttgttgctctccaaatgcaatttttagcatttcttccgcacgattttccacactttcgacctgttttaaacgctctgcgttgattttgagaagacgcgagcataattccactaacacactgaagtttattataaaattgcaagaattaatcagccgaaaattacgtgtcccctggtcgtaaacgaatggcctcttttgcatcattaaaagctgagccgattttgtctaatttttctctcgccaaagcgcgtctataataagactttgggtcgcttgggtttaattcaagtgctgaaataataattactgagcgagaatgttcacccataaaacatgccattgttgcagtcggactcggctccctcaaaatcgtccgtcttcagcttggccattgctctgttcttataaatgaccaatcgtaatttatcatcaggttttagctccaatgcttttgtatatacttcaatacatgacgtaaaatcttcgttttggtaaaatttgtttcctttttctttcagtgtttcagcggaatctccgtttaaagcctccatttgtttaagtatctaaaaaatcaaattattttgagtgttcgcaaaatttaaccccttttcctacattatacacatgtaagaatgatcaccaattgttatttctttgttctcgaaaacgaaagagtcttcctcctncaataaaccaatgatcggctatcattcgtgatctcgacccagagaaaaagcatgattaagcttaagntgtttaaaatcattctcccttctctctactctcact

SEQ ID NO: 19675 - DNA, 1880 bp, Heterodera glycines
atttgcgtcggtttgcccattccgtggcttttgcattttggtcttcgcaatggcttcatctccgtccagtccaatgggcttctctgttccatcgccatcctttttctcatgctttttgttctcgtcatcgccgtggtacagtgaaattgattcagcgctttttgaacaaattccgattggttcttactgttttccggcttttaaattccggcaaagtctgagtttggcccatggccaatgccaactttattccattgttcttaagacaatcactcggtggcgcatgaacaaagcattcggcatgatcatgttcttcgcttatctgctgttctgtttgctcagcgttctgctggagaaaagtttgctgtactgtccgctgaaattggtcagaaaagggaattggtgttaaaggaagggacgatcgaacggtggaaaacgaaacgaatttttcgaaccctcattttgtatactgtacaaattcgtttatttctaaaagtctaaagcgattttgtacccctataaccaaaatcattagaaattgcgaatttgtagttttttcatgtgttagagacatgaaaatagggggtgcaggtcgttccacaaaaaagctcagtgatcgataaaattaaataaataaatttaattattcaattcacaaaacacggtgccgtccggttaatactaatgtacggcgggacgcgtcattttcaaattttttcaatttttgacatcacttctcgccaattttctccatttgtagtagacatagcctgacgccattgataccattttgtagagctcatcgagctgtacaaaaaagccgctggtaccggcaagcttagcttgggttggccatcgacagggtcgggggcgagactgagggtcctccggcagatgtgccggacccatgacaggctccaagacgactcaccacgaaaatagggcacttatatgttatctgtgtacagatttcaaaaacaaattttttttatagattttcggggtcgggaaaaccgactctggcatctgttgtgacccaattcgaaccccgaacccggattcgatcaaaaaagtcaaaatccattttttaacaaaattcacattttatacaaaaaatcacttaacattttcatttttttaaaataatgactagggcatgataaaataaataattcgtaacattattaaaattgaataatctaaaatcagtgaaaattatgtttataaaatagagaccgagatttccaaattctccggaccggactggtattttaaaaaatgaccggatcccggatccggtctctcataatccggtcaatccggattttcatattgccggatccggattggtaaaaatttaaaatttcgcatcctaaattgagaaaaaacccgcaaaatgtcatcaattatatgtagaaattcggtgcaccagaaaatgtcgccgttgaaaagacaatttcgccaaaaaaatataatttttcaaattttcaagaaaaaatttaaaaaaaaacaattttaaagtttttttatttttgaaaacctatgttttttgggtaatcctggagtagggttaagccccgagccacccgacccgacccgagacgtttatgggacctattccccgcccccccgaatcattttgctaacaaaaatcatcatttgtggtcaaaaatcagcattttgaaaaattttcttattccaactgaaaaaaattataatgtttttttgcggcgctctttttctaaaagaaaaactttttgggaaaggggcccggcggtgccgacagtcgccgccgggggaaaaatttgaaatttgaacatttaaagttaaaaacattatgccaaagagatatttttcaaaggaaaatgaaaaaaagttat

SEQ ID NO: 19676 - DNA, 918 bp, Heterodera glycines
taatttgcagcagcaatttgagcatcgttgggttaaccatcgcttgttttttgtcgatcctcaagacccacaagttcacacacagggcattgaggcaacttggcgtgcagtgaaaaatggtcttcgtcatctccacggcactaaccccgagcttttacaaatggaaacgtattaatcgatgaagaatttttttccctgtcgatatgcaaaatttggttaaaattgtatgagtagaaaagtggagttgacccatagtgcgactgcatttaaactatatagacgaaatacaaaatttctttagggggggggagggaaaaatagagcaaatacggcagatgatcttttttccattcgcctaaaatgcgatgggatgcacaaaactgactagaacacatttttttattcctcgttacaacgcaactatacaggtgtagataaacatatattacatattaccaccggacaaaacaatacagggaaagagaataggcttaagctttggatgtgatcacttctgcccccgttccacgcacaaaaagcactttttgcaaattgtccgaaatcacctgaacatttttatattgttgcgtttaaaagtcaaagtacacctccaaataatggatgtagtcgtcgacttcgtcctcaaagaaaggcggctttgggagagaaaaaagaaccaattgactgcagcgcgagtgttccaaaataagcttattgagtcggattgccccgtgcattttatggaccttaattagggcgtaatgaggttaaatagaagatttgcattgtactcattcgttcacctttttgcgatccaatgacttcatcctctccgacgacggcctttgcccttccctccggcggttcgtctcccggttcgcattcagtcgaaggaacttgcgactcttcccgactttt

SEQ ID NO: 19677 - DNA, 2226 bp, Heterodera glycines
agaatttacaggaccccggcataagcgaggacctcaaggcgaagagacatgattgtctctataaagaaagacgtacggtaaaggggatacttgaaaatagaccacagaaggtagtgattgagaatcatgtacccggtccaaatgttgcaccatatctgggcctcaataaccaatccaaaccacaggagaccgaagaaccacggaaaataattattcctaggaaaagacttaaagagcaaactcctgatcctgaatcagataatgatacacttgaggagttaagtccggaacctcaaacaacatcaatactcaacccacccattccgatcaaaactattatacacccgacccttttaaatggtctttttaggtacgtgaaagaaaacaaagatttatttaaaattacggcggccggaaaggtacagtcgaacatgaatttgccgattgaaaacagtaattatagagatgttttgttgtatctcgcagggaagaaagatgaaacaccccggggtgcaaaatttctcaaagatcggttactgaaggatccaacagtaaaagacatggttgataaatcaaaggtcatgtggggacgtggaaggaaaaaggcaataaaatctataaaaacacccggcatagcacgagagaagaaacccttcaaaccactaatatgggccagactgtagagaaaatgttatcaaaaatttattttaatttaaaatctccggcaagttttgctggaattcaaaaaattttaaatgaggccaaaaagattgacccggaaattacgaccgatgacattaataaattcctagaaaagcagagaacatacacgattcacaagcccatcaggaaaaaattcccgagactaaagacggtaccgagcggcttccataccgattggcagtgcgatttgtgcatatttgatcagttgaaaaagcataacgacggttacaaatatctgttggtatgcatcgacgtgctgaaataataaatggaaaattattggcgcttatcgactcgatccttctgcgacgcctatacaatttatatttccatgataatgagctgaaattttgagaatttcaaagtgataatgaaatgtaaatagagaatctcacaatttcagctacttaatctctaaataaatactgcagcaatattgtagaaggatcgggttaataatattctctgatttattattttcacgaccatccttgtgaaattctcaaaatttcagctaattatcatctaaatataaactctaactgcgttgcggaaatattgagttgatagcgccaataatctccgacttattattttcacgaccatctttgtgaaattttcacattttcagctcattttcctccaaatgtatctgtataaatttgttcaagtaaattgtaaatcggaaattattagcgtttatcaactccatacttccgcaacactttatacagtttattttgagggggtaatgagctgaaattgtaagaattatacaagctggccaaaccaaaataataaatggaaaattattggcgcttatcgactcgatccttctgcgacgcctatacaatttatatttccatgataatgagctgaaattttgagaatttcaaagtgataatgaaatgtaaatagagaatctcacaatttcagctacttaatctctaaataaatactgcagcaatattgtagaaggatcgggttaataatattctctgatttattattttcacgaccatccttgtgaaattctcaaaatttcagctaattatcatctaaatataaactctaactgcgttgcggaaatattgagttgatagcgccaataatctccgacttattattttcacgaccatctttgtgaaattttcacattttcagctcattttcctccaaatgtatctgtataaatttgctcaagtaaattgtaaatcggaaattattagcgtttatcaactccatacttccgcaacactttatacagtttattttgagggggtaatgagctgaaattgtaagaattatacaagctggccaaaccaaaataataaatggaaaattattggcgcttatcgactcaatccttctgcgacgcctatacaatttatatttccatgataatgagctgaaattttgagaatttcaaagtgataatgaaatgtaaatagagaatctcacaatatcagctacttaatctctaaataaatactgcagcaatat

SEQ ID NO: 19678 - DNA, 822 bp, Heterodera glycines
tccaatcggttcgtttgtctgttaattgatcggttttcttttgccttggcatttcatttgatgagtcataattaatcagctttggcgtcacggcgatcggagcccaacgggcacatttcgaacggacatttaccaggaggacttttggccgcaggggtggggccaattgtcaccccgggggatgagtcagcaagtcacgcttgggaagaagttgcgcaacagatacgtagagcaactgggacaaatcagcggctcttacgacagtcatgagctgtatgtgcgggcaacggatgtcaaccgaacactgatcagtgccatttcggtgggggggggggggaggacaacaaagaaaaatgattggttgtttttgcagaatttcatcggcttttatggcaagggaaaagctggccgtgattacccaaatgaaagcgattggcccgccggctttgttccgatcgcaattcacacggtcgatggaaacaaagatttcatttctccgagtggttcgatgcttttccgtctcccacttcccccccccccccccccccctccgcaggttcgttgtgtccgcgttacgccgaattgtctgatttgattgggaacaccacggaatatcagaacacttatcaccaatattccgtatgagaagggaataacacttcgattgattcaaacattcgaaggttcttttagagtcttctgaaattcttgaacggatgaagccgaaaagaaaggtgacattgtcgacatttggctgtttcaagacactttctttgtcgaggtgaacaatatttgaaatggctttgaattgggaaaaagtgg

SEQ ID NO: 19679 - DNA, 1618 bp, Heterodera glycines
cgatcagcggcggcggcagaaagtgccattttcatatcctcaatgtgagacaattcaattaattattaattagtcacattttgttgccagcttttttttcaaattgcttttcgccgagaaaacgttgcgacaatgaattttggcttatttatctggtgataatttatttgtctgttcattattttgtctgttttcaaattgctgttaaagacgtgttttccccactcctctgttccttcctttgccccattcttcgaagtttcatccatcaaactaaaagcccccgcttcttcattctttcctccgattgatttgcttcttcagagaatcgcttttccgtcgcatattttttctcctctttaatcccatgaacataaaaaatgttcacttcatcacattctttcgataacatttctcgttttatctccgacttcgttccgtccccaaattcgtcttctcttcgaagtgccttttccaaaagtgaaagtgccattgaggcaattcttttctttccaccatttgtccgattttcatttgctttgaccatagactccgacaatcacaagcgatgaacggcactcatcgccgtgctcttcaatcagcaagtcttcctcaaggtcgccgctggcgtatgacagaatcgaacattggcaaagtgccaatgaaacgccaatttggcaaagggaaagaaaattgatgaagacgctaagattcacaataaacaaaactgatgaagaaaacgaagagaagggaagaagcaatgggacacagcgtaagtaaaaataaaacaaaacaaaaggaagaaaaagccatggattttagaagggaaaagctgcttttctcgaaaaaagactagtaagcattgaaaaaggagtcactcataagaatttcattacaattattaccgttgctattcatttagggaaaacaaaatttttgaaaatttgaagatgcgtcatcatccagccattgtttaagcaatcaaagcacaaaagaacaacagcagggagaaaatggcgaaggattgggtggacgaatagttttggtgttcaggaagtacaaaattggtgatccggaaagcacagtgtaaccattaagaaaacacaacacaaaagccttattcctcatcagtttgtctctcgtgcggcattcgcgagtggcgcttccccggcggattcttaattttttttttttcatttttaagtccataaatagcattaaaaaatacctgaacaacatacagctggggaatgacgtaactttgcacagtttcgtttttacttccattcccttgacaattgaattcagatttcatgtcaaatgtaacacaataccttaaatgtttaaaaaattggatctcccatttccaaatacccgtcacgtaaacgctcaggtggcgcgatcacacaagcgcgatagaacaccgacgtttttgggaagcgtgccatcacgagtgaaccgggaccaaataatgcgctggcattgtgccgaggatcggcacgaaaacggggcaatgggataatgtcttggcggggaactttcttcagcagaaaggggagcttttggcgcactagcgaatatttgacagttggcgtgacgggaggcgtccgactgagta

SEQ ID NO: 19680 - DNA, 1501 bp, Heterodera glycines
ggcgaatttgatctcccgcaaattcgctcttccatcaaatgatcgccgattttcgtcggctgtccgctttggtggtgtgttgtttcgtcctgtcgcattgccgatggtccgatcggcgtttttgcgctgcctcgggcgtccttcacgcagggaaggcgccacatccgctttttatcgctttctttcccctattcacgtgcctgccgtcagccggccctcccttcacccttttcgcccttccctttttgtcctttctttccttcatcatttcccgtttgccctatttttctcatcatttcatccatttatcactcctcgttcgcaacttcattcactcctacccgtcatcctcatttgtccgctcaacggacattcgcggctgtcgttcagccgcgacattcccacggctttgaaaacgtcgcttcgaacggaatgcgaccatttgtcgtttcagctccatcaccagcggtgacggctcggggtcctcttgatgtgaacttgacgtttcgttcgctctcatttcctggggcattgaaggcggtaccagctcaattgcttcaatccttgaaattgccggtgctcgccgtgtgcctcgagtagctctgttccgctgcgtccactgatttcccgtcaccaaattgcggatggtaacgatgacgggccccattaagtagacccataccaagggtatcaggacatcgcgcccaaaaatgaatgtgacgtaaatgcagcatgccgttgtccagtaggagacgagcagtcgaagtttgtccatgaaccattcttcggtgaggccaatcactccgctcgggagggctcccagtgtgagcgcacgcgccgttttgtgctccttctccttcgacttccattgatccaaacgcagccattcatccaagtgcgcgaatagcccttcgcctgtttcgttgtcgatcgtccatcgatgaaaaacaagcggcgtgatttccaacaacgatttgtctccagaggcttcgtggatctcagagatgctgctggagtcgattttctggatcgtagcggtgcgtgtgtcgattttgatccaattgctctggctcagttgcagataatggtagcggaaatttccacaatctgcgaatggtgatgacgctgtgaggatgtgaagctccggatccaggaatgcgttgagcgtcttcttgtcaatgcggatttggaccggaatgtagcggtaacagttgttgactgcttgatattccacattttgcattgaaaactcagcgcacgcgaagatttgcatcgtgtcctcgtttagccacctggccataacatccttgcgtcgtaaaagtcgtctggcctgaatggtcggatttcctctctggaacttcttcggcattccttggaaaaaagctgcgcgattgatcggcttgtggcgagttgtcctgcggttaattgtgctgcgagttgttcctcctggatggctctttttcccaatccacgatcgttgacgatcttcaggtactcatcc

SEQ ID NO: 19681 - DNA, 2200 bp, Heterodera glycines
ggccaaggccactgagtcccaaatgattaagtctcttcgatagacacattaatcccaccataattaagtttttattaaaatcttaaatgagtaaaatttacgaaaaattatgaatttacattcagtcccgaaaccccgacccggctggtccgggtctaataactattcttttaaatttttgaaatttctcaccaataatccactatagctctcatttattgagaagactattaaatgcacaattctctattttataaaaatttttatacatttttaatcaattttttattttcgtgaaaataatcaacaaaaaacgaaattaattaagacatttggcagtaccttaaaaattttgaagaatcaaaaggaattactgataaatgtttatttcttgtttcttctgattttttaaatattatttgccttactttcgaattgttttaaaaccaacatattttattgtatagtttaacattcaatgcattatattgcattttttcatcaaaaaaaattactacaaaagcctaatattgtaaataatttaaaaaacgccttaaatcattagaataataaattaaatttaagactataaatttaattaaggggggtccactaaattcagtcataatggtgaacaaaattaaaataatcttttttctttaaatctaataatcttggtatcattctaaagcccttcagaagccctattagacctacaaaaaaccaaaaaaaaaatttgacctgtaaagaagttattaagaaaaaatcacaaaaattttgacttttttgcaattttcagttagaacttttttagtaagcgactaatcgctaagcaattgcttagaaatagcttctaaacatgttcagctttcgaatgataccaagattgttagatttgatcgacaacaaaaaaagttatagtccaaaaacaagggctggcgccgaaacggcggcgccgaaacgatacagaccccagagaaataagttgtacaggaaaacatttgttggaacagagaaagaaaatataaaaatagtgcattcatataattcagaaaagaaacaaaacaaaagagagagtgagggtagaaaagtcttaccaatttgatttctctgtttctcatttaaacccatattttttatcattttcactagacacacttttttcccttcttcgttatccgcagccgctcgttacaccgccgccgccacgtattttactgcgccggaatggcgcaaatttttggctatataattcagcaagaatttcggaataatgatatagcttgaaggaaaatgtgattgctaatcagtgatcgcagatcactaaaatattcccaacaaattgatcaatcggtccattgcaggccaagcacgcgctgtaaaaaggagtagaaatcaacgagttcatcaatctgaaacaatgatgaaaagcagaattttcatggaattaaattggatcggcagatgttagttttaccaattttgcggtcggtgtgccgacaatctcgtgcccctggtccacccgtatctttgccaacacgggattccgttgccaactctcagcttgagtgcgcaataaatggtacagttgtgccgtatatttgagtgtatgtgccggcacaactcggtcctgaatcatttttattgttcggcactctgtcattgaattcgttgtgcattggcccttggggaggggggcgggggaatttgcttggactaatcggggattgatctcattggcactcgcaaagggaatttgttgttcattttggcacacattttttgatttgtccccaaagaagtttttatgcttgcttttttcttgactcgaaaaaatgcttttagtttttctttctgtttattacgacagtaaatgaattgtgatcatgcagaggctgcagaatactcaataaagcagcaaaaaaggaaggatctattcgcagattaatttacgagagcaaattgaaggttttttaattaaaaagggggcaaccaatggcaaattgtataagagataatcaagtaacacatgtatttcacttaatttgttattacttatctatattactttttttgtaatttgcaaaatttttacgattttgaattgcatttcgttaaaatttttcaagaaaaattttaaattagtgcgcaaaaaattacgtcaattacgctatttggcgaaatgatatttttgcctaac

SEQ ID NO: 19682 - DNA, 1302 bp, Heterodera glycines
tgatcatacaaattaatttttaaaattgatataaaattagcaacaacaatgccgaaaatcctttgaaaggcatttaataaaacagaaaaaaggaattgaaaaattttaaaaatttagaaaaagtaatcgaaagcacttcgaacaaaaatgagtgatcatcgaatgattcattcagtcatgaaatgatttgacaaatacaaatcaatcccgatgaaaaatatgtgaaattgatgattgccggtcggaatggattttccgttgagaatgccctccggcgcttccatcggcctattggtaccaccaacagaattgaaattcattttactgttcggtatttgcaaattcaatgtcgcccgcccatacaacgcaaatcgcttgagggcattaaaatattttaaacttaaaataactatacatcgaattaacaaaaataaattcaaatcaatttgttctgttaaaaaatcggttttctaaaataaaggaattttaaaaaaaattttacgaaaaaaaatttaattaattcttctatcaaagataacgttcttttattttgctatattcggacggggcctaatgtgatctcatcctcagggattccaacaatctcaaatggttttgttctggtatttaaaaataccgtatcggataaagtatggtaaaacatagtttttccatccggaaagcctatcctgtatgtgttgcggatccattctttttttttaattttggcaccaaattttaatgccaaaactgccaaattgatcattttgccatcagagtaaaagcttcggatcacactacaattctgtgaaaattcagactgcgatttgagcgcacctgtggtatccaatgtgccaatttggagccgttcggactgccgttggtgcttatattggagggaatgctaattaatagaggaatacggtgcattcccatttttttttagttaaccgaatgaatctttagggatgtaaaaaagatggccaaatctttttagcttttaaaattaataatatatcaattttgtggctaatttgaaaaggtattcttttcagttttaaaaaaattccacaaaattgatcgttagagaagaaattttagccagtctgtagaaattatcatcctttggccttaaaagtctttcatttatacgataatacgatattttgagctcagaacagaagcttttttgagtcagttcattattgtccgataatgtgcgagtgatacccgaaaatataaacacatttaattaaagaaatggaaggcattaaatgaaattggggctttaaaatgctctta

SEQ ID NO: 19683 - DNA, 2166 bp, Heterodera glycines
caatttgccgaataatttaatgtaaaaatgggttttaattagattgatggcatgcaaattattatgccataattaatttcgtgttttcagaatggaattattaaatttaattttttttttccgtccctactttggccgattgcattgccctccggcagtcttcggtgccttcgacattcgaaatttccgtggagcccaaataatgtgcagaaaatcgggcactgtcctccttcaaacgcaccctcagctcagcaatattcataattggagattggggagacacacttaaaaaatattattttgttattaattaatttattttatggaatgtttaatcactttttatgaataaaaaaacattatttttacccgaaaatattttgcctcaaattttgttgtccattttgatttaagctcgacataaattgcattgctgaacaagcttctcgtgatgaaccattcacagaaacattaggagacgatgaaccggaagaatttctttaaaaaattgaaaattaaattaaaatttattttaaattaaaaaaaatttttacgaatttgttctggatttatgcaatttctttcgctgttgcaccgccaaatccaaggaccgcataattcgagcgatgtgaccaagttgggtgacattcattttctggaaataggaataaaatgattaccaattaccataatttttcttattaccgtactttaaaaaaaaaatgttttttttaaataaaatattaatgaatttaaatcaaaatttaatcaaccgcacttccaaatcgcctctgctcagctttgcagcgatcacatccgttgtggatgtgagatttgccaacgcaaatgagcccaaatggtcgagaaggtccaatgagtcgagccaatccgacacaaattcgaattgctctaaaacgagttgttgggatgttttaaaatctcgggaaaaactgaaaatctaaaatcgaattttattcctcagggtttgaacaaattttatacagtctcaaattttaaaaaatgcgatcaaaattttccgattaaattcaaaaatataattaaataatttgttgttgttgttgtaccagcactgcgaatgtgctccggcactgtgttgtcgttgaggaaacggcatatttgcagttgcactcgtcgtggcaccccaatttcgtccatcagtgccgtgttcagtgatcccttcatgaagcggactgtgtcaaagccgtgccgatgaagcagttcggcaagcgcttgcgcactgcaaccattgttgttcaactgttgctgctgctgttgctggtgatgacgatgctcccgacttagtcccaccttgaccaattcgtgttttttaaattttgtaattcccgaatccttccctaaaacctcataattgcggatttttttaaaatttgatttgtccattgaacaaaacaaagcttatgaacgctaaattgatcatttagagaatactaatgacctggattctcaaccatcgaacaatgggttgataggcacaagctgtgacgccattggcgccggcacaactattaggtgactgaaaattggaaaatgggaatttataaaaaaataaataaacaaaaaaataataaattttatagagaaaatatttacagagctgctgttaaacgatgaaatagaattttttgacgaatttttcatcagtaaagaagggttttgattttgctgatcagcatgggcaatcagttgggaatcgtgttgaagggagtgcaacaattcatcaatctgaaaaaatattaaataataatttactaaaaattggataaaaaataaaaatattggaagcataaagatcaaatggtacaagctaaagattgaactttaaaaaataataaatcaatttttaaaattaagaaaattattctatacaaattaaaaaattaaaaactcataaaataattcacttctttccattgttcctcatggtccgccatggactgtttcctttgatggacgatactttcagcttcgctgctgctctgttgccgttgatgatgctgatgctgttgctgtactgcttgaacttcatgtgccaacggcggtgtgccaaaaatgccgccattttgtgccaccggcattgttgataatgggctgctgcttccattagcttctttttctgtccccatg

SEQ ID NO: 19684 - DNA, 2272 bp, Heterodera glycines
tcttacacacaccatcccagaaatgagctcctgtgccagaaaagatttgcatgtgtggctcagtggttttttaagatagtaaagggacaaagggtggtggttcgagtccgttgtgcaacatgaatattttcatttatttatgtccaaaatattaaaaaatgacgatttttgggaattgtttttgaagctttttcccaaccaaattggacaatcttggtatcattcgaaagctcttgatggggagaagctttttctaagcaaatgctaagcaatttgatgagttagaaaaaagatatgatgctttgaaattttgttttttgaataaattctcgaatcgacctattttcaaattaacctgacctatcattagatgcagaatatttttctctatcgatatgcaaaattaaaagaaattctgcctgaggaaaaaaaagttatgctgttcgaagtaaatgttgcttttcctaataataaaaatattagatagtacgccaaaaggagacaaaaaattagagaaaaaaagataatgtttttctctggcattctctatttattggtacacatctcgttttttgggatggtgtgtacagaggtcccagtggcctaaaacgcacgaaaaattgttttttggtggttgttaagctactttttgatagagatcggctacgggtcggacccgtatacggacttttacgggtccgtagtccgtattttttcggaccaatatggactactggtttttagtccgtaagtccgtatggatgcctagtccgtagtcccgtcctgatccgtattttcgcaaaatgccgatctctaattttttgagttattagggccgattttcttggtttttaggtatttttattactaaaagtttaaaatttgaaaaaaaaaattgttatgctgtacaatttatttacaaaatacaaacaaataaacaaaaatatatctctgacaaatgagaatctagctaaaagtttcaaaaatgcactcctaaaaatgaaaattttctcaaaaattcctctacaatttattatttatttgatgaaaatttttggttttccaaattatatatctccataaataaataaataacatatgtctttttcctgtaatttaaagcaatgtttttgggagctcgttcaactcttttcattgatcgtaaagatgccggccaaaaattggctaaggctttagcccatattttgcctcaacgtgataacattgtaagaatgagggctcttctgcagtttagtttccgatatacttttatgtgtacaaaaaaccctgaaatgttggagttcaatctttcaaatgctaccaaggatataggcatatgtattaaccaagtaagaaaaaaactatggcctaagaaaactgaggatggtcattgattggatgcgtaaactgcagtaacgccgaattgggtgccaaaacgatagtattttgtggtttaacaggtggttttggcacttccgcgtggcggagttccagtggcttgtgaagtcgctgatgcctttcaggctcctctcgatcttctgatggtaaatgcaaaaccatcggcactattaccatgatttttacttcataatatatattttaggtaagaaagataggtgctcctggccatgaagaatatggaattggtgctgttgtggaaggaaatccgcccgagctcgttatggtgggcagaagaaattgttgcctaatgtaaagttcaattctaagaatgaggaggctgtcagaattacacgaccatctgaagcatatgtgcaacagcaaatgcagaagcaactcaaagaaatggagagacagcgaaaagtgagtcatttaaaacacgcaaaaatggatttaaccgaaaattactaataaaactctaaatttagtataagtaaccaaaaatcaaatgaaataagaagattcaatacaaaattttgcgaagcaggaaaaagtgttgccgttactttagttcatgaaaaaaaattttatttgcggcgacgtgatgtcggcgttatttaggctagcattttttattactccgactttttttttaaaaatttaaaaaaagatctggtaaaaagaccaaaacgaaatatgggtcaagaagccgaaatcaaaacatccgtaattgatttaatgcactaaaaaggcacaccaaaattctatgcgtcatggatggacaaggggggggggtcaatttcgtaaattgtacggaggtcctaggcaatttagtgaaagttttggccaaaatcgaaaaggcactggtaaagat

SEQ ID NO: 19685 - DNA, 2580 bp, Heterodera glycines
  misc_feature (1529)..(1529): n is a, c, g, or t
gtaaattgaatattttattgcgaatttaaaaggctctgaagatccagaagacgacaatagctcaacgccatttatttcactcggatcagttcaaatcgctcaagaaaacaactcaacagtcaaactccttggatttgcaacctctgatggagaccgacgacaaacgtagacaatctcaaactgagtctgattattatcggacttttcatctggaaacgggaacgaatcggcttggaaacgaagaccaaactaaccagcagagaaggagcccatcgccagcttcgcccttttcgcgatattcgccgggaatggcccgaaaatcatttggaaagctcgggaggacattaaggtaattggaaacccggttgattgtgaattttaccaattacaattaagtgcaaaggcgacaagtataagaggaacagttcaatcgggcgcacaatcggtagcgtttacgtcaacaaaaatagacctgatttttttcaattatttgccaagagatttcgtccgtcttttcgacttgaaggacttaattttcggagccaaaaagtgataaaaaaaacaaaatgtgcttatgtgaatgtcttgtttattgccctctcgccatgctaactaacaataaggtcgctcatgaagtcgtttcgcacactttgtccgctgcggatcacatccaatccggcatacagaatggggcaaagatggtcgcttccgttcctggttcgattatgaatgtcagcacggaactgttgcaggagggacaaaacggagtgaaggaagtcgttgatcagctgaaggcacttggagaggtgacggggagggaaatcaaaggcaaatcggcaaaaaaacatttgtacagcccggtgaacaaagtgatcgttcaccgttgtccataaaacgggagaagagtttggcgacgctcgagacactgtgccaacggacacagcaggcgcgagagcaatccgtccagttggcgtgtgacaccgggtaaagcaacaattagcggacaaatgttcagactgggatgatataagctcatacaaaatacaggggcggcgtcaaccaaaatttttgcgaaatggtttggctatgtaaattgacgatctttttttttgcggcgcgctttttccacaaaaaaaaattgacactcaagggggccggtaggcgccgccgggaaaattttttgaaaatttgggtacaatttgttaacagattttgtcaaaaaatgacaaattttgagattttgtgctattttttaagaataaataggctttttggggccggcggtgccgataggcgccgcctgggagaatttaaagaatttttaatgaatttggttaataaaatagtcaaaattttcagacatttccctcttttcctcttcgccggcgatcccctaaaaaaaattagaaaaaaaaaattaaaaaaaaataatccacttcttttacaccggcccctcctcggtacgaaatggtcccacattttgggccctttgcaggcgaaatggggggggggtcgacctcccccctatnattttgtatgtatgataggcgttaccaaataagaattttttttctatttgtcggaattaaaactcgcaaaaggttctgacgacgtttgttacaagtgtaacggaaccttaaatattaagttgttatgggtttgcccttggctggttgatttattctttaacaattttttttaacttcaataaccaccgggcccttctaattctcctattaatttactccttgcttattgttagtgtcattatctgacttgtcaatgacattttcatgcttacaattagatttgttctgggggcagaagaagcaccggtattatttggtgagcacggcaaaagcgatgaaagtcggcccattgggacgcctcccgagccaccgttttatatggtcgtgcgaatcgacagacgcaaaaagtgcaaacgtaagtcaaattctttgagaaatttagataaaaaagacaaaccaaaaaatgtgaataagcgtttattctttcttctgagatgttcgtcccaaatgccttcccgtgccatttcattgacccttcgccgtcgctttgacggcggaatagtcctcccccccccccccccttttatttatttcctcttcattatgtaccgcccatttcagcgataaatattttattagtttgaaaactcgagcctctaataatcgagttttgagaaagtttaaatttaatggatttctgagtaatattcgtttccttcccccgttttgttctgcgttaaatcattgcgttagcgatccgcctccctccgttcattttccgatcgattcctccgatttccgagtctctttgtgcttgcgtttctcttttggtttctttcgaaggcgtcggttggatctccgaaatccacacgtttcaatttacctattttatttggtatcgagcttttcgataatttcaattcctcttaattaagtatgatttcgttttcagaaaagactgttttggtgcaaaaagcgaatttgactgaaattggtgcgtcaacggagtcgaactttttggccgctgcagaactccttcaggacgaagacc

SEQ ID NO: 19686 - DNA, 1535 bp, Heterodera glycines
  misc_feature (107)..(107): n is a, c, g, or t
  misc_feature (114)..(114): n is a, c, g, or t
gcggtggtggacgaggcggcggcgggcggggagggcaggcgctgcagcagccacaggatgaggacgaggtgggggaaggggagcgacagaggggagggatgggcaanatcgganagtgcacgtcgggtcttacaatttgcgagcgattgcataaggactaggttttaaagtgtctatctatgcgatttaaggcctgagaaaagctgttaacaaattacactcaaattttcaaaaattttcccgatcccaacctcaagagtttctgtgtcccttgttttttgtttttctaatttattttttttggttttattttttatttttttgtttgatcatgaatttgacattatttttaacaatcttcaaaaatcaaaaatatacatgatactatatttttcattttctcagattgtatagtaaaagtgttttaaagattagttcaatcaaaattgaaatagttggacttatggtagctaaggagtacatagctttaccccacctcgccaatcattcatctccttcctccaccgtcgcattgttttgtggcctttgtcgcatcactttgtggccaaataacacggacccccctactaaccccgtcgctgcgcatgcagtggcctcattaacgaatgattggtgcggtagggtaaagctaggtactccttagctaaaataagtccaatattttaattatgattgaactaatctttaaaacacttttactatacaatctgagaaaacgaaaaatatagtatcgtgtatatgttttttgcttttatttctatttcaagcctaatccaaatatgcttacttacctaatttatccaaaagtttccctactcttttggctcccgtaagatgttttttaaattttatttttaaatcaccaaatattatcaattgtgtgatcttacaaaaaacgatcaccatccatcagcggcaaaatgcgcagcgggtggccttgcgcgtgcgctgcgagcggcgcggccgcgtcaccccgatcaggtagtcgatccgcctcgactgacagcccagacatttggggcgcgcatcgtgcccctcgacctgaaaacatgaaccaaattaaatttttatcaaaaaatcaatgttttgtgtgtttacccaacgcctctgactgtcctcatccccccgcacgagtcctgtccacgggtcgatgctgtcttcgacctgccgcgcggcctgatcgcgcgccgcatccgcataacgctgccaccagccgttgtcacagcatgtgtcacagattgtgacacagccgcagttgttgcctcggactgtcaccgcacagtccaacccgtgctcacccatgcacaggaggcactgatcggaaaaatttaattctccgatcagtgcccccggcgcatcccccgaagggcttggcgtccgctgcggcacgggccgctcaaagtgcgtgcggggggtttcccacccctgcatcggattgttgttgttgtgcgccaggaatgcccgcgatgccgtcgtcgagccaaaacgctaaatgaattattagttaatgcata

SEQ ID NO: 19687 - DNA, 3603 bp, Heterodera glycines
  misc_feature (3590)..(3590): n is a, c, g, or t
accaaatgttgggtttttattggattgaaacgagcgcaaaaaggccaatcattttccttccaaatttttagaacacaaaattgcgtccgtcagcaaacagttggacgagaagggcacaaagctcaaggaagcgttggagcagaacgcgtcgttgaaagacagaattggcacactcggtgagtattttgtgcccttaaatttaaggacatgtttcgaggacggatgagaaatttgtacaaaaaacaatttagagcaagaaaaattggaagtctcgcttctcattgaaacattgacaaagagtcgggacagactgcttcaggaaaaggtcggtttccgtcgacaaataataatttacagtttttgctgcccaattcaaattattaaaaccggggaaattgccaaaaaaaagtggcttattgttcgaaaatcgagattttcgaactttacatcataaaatgttaattcaattcgtcgtttttcaccttttttaatctaattggggtcggtgagccttttgctttactactggtattgttgcattcatttaaccattcatgattcgggtttttgaatttggtcacggcccaaattatgtttttcttgacctcaatggttaaaatattcgcacatttttaaatgattgataattgtcaattactttccttaagacggacctccgaaatgagctgcttggcctcgagaagcgcaaagatcagctcgaattgcaagtggccaagttgaacagcgaaaaacaccgccatttgggtacacaatccgctggttttctatcggttttaatttggcctaggatctgttccattttccccaaaaaaaaaacaaatttttcttttcagaagacatcagtgaactgcgccaaaagtgtgacgaattgtggggtgaacggaccgagttgcagagccaaattgacgacttccaaagtgacaaggcgctaattgtggtaggattttcttctctttttttggatggaattttgtggattttttcatgtttttatttttgaccctaacatataaacatgaaacataaaaaagcagtaaatataaaataaatgtctaataaacatttcaatgtccacgcctttcccttacatttccccccccccccatttttcaccatttttggttcaataacctcctttctctgcatattaataaaatgtacagcttctgttaacaaacaacaattttgttgtgtccctaaacctcccctcttcatctctgcccacacttctgtgtctctctggcattccccccccctcccccctctcaattgctgcacaattaaatatttgtttatgagccaaatgaccccttcgcagttcgacatttttgttcgcgcttttcaacacaaaccagcactgattgaaagtgtcatttgattgtttatttgtgtgcgtttgtggtgtgtctttgttgggtggtttctgctcttttttgtggtcacatcgctttgccccaaatttcgtcaaattccgcgcccctttttcattagttgcacacacaccccattttccagctcctttctgtaacaaaatacgcttcttttcctttgttaaatgtgcgcacctcccattcccccctcattttgccattgctttgtttaagcaaccgattcggacggaatggaatggtccaaaagttgttcaacaccagaagaagatgaagacgaagaagaaggtgtttcatgggttttcaatgtgtgaaaattgctcccaaaatttcctaccaaatcagtgcaaagtcccgaaaatatgtggcccaattggtaatatgccgctgccgacattggccagtgtgtgtgccaagtttaatgatggagctactactaatcctttgttggcggataatgttggcactattgaaattgatggtgatggtactgctggtgccaatgttgatgctgtgcgcccgtcaatgtcaaagtcggaaaaaagggcacttcgtagaagcagtaattaattacccaattaattgttgacgcaattcaacaaaattttttttccacagggaaaaaagctttttggaggaagcaaaacaattgtttgtccactcaacaaacaaacaaagaaataaaaaaagaagaaaaaaccgaaccaccgatcgatgtttaatccgaaaatgaatgaataaataaataatattcacttatcctgtttaatataattgccatttaatcaacataatctcgactgccaacatttcattcagttatgtaaaagttttctctaaattttgttgaattgtagttttttagttgttttcttttttgcattattgtattttaacatctttaatcttttttatgtgtcgcacattccatttttgtgcaaaatggggcaccctaattatttgttaaaagttggaaataaacattgttgcttgtcatattcacagatctggttaattctaacaaatgtttaataaatattatctaaaacacaatttaatagggcgctttctcaaaatgactttttttaagacttgtttattcataaaaaataaaaaagtcatcagaagggcgaaaaccacttactctgacgactattccggtaaatgtgtcgtagagtaagtgacaaaatatatggatgatcacaggaattaaaaaaagacaaaaatatgtgaaaataaataataaataaattgaggtcaaagtcaaatgaggtcgaaataccaaatcacttagaaatttgttacattctagctttcccggtcttacatattaccctagtgaactttaagttttattttaaattgatttaaagaatttgtttttattagttctttatctagttgattccacaattttgttaccctcccagcaaagggaatgaattttttgcccagtttgtattttgtgttaaatctataaaaggggatgttaaagcgtgctgatggattaaaaatagaaaatagtttcagatctgttcggccataaacaattttatgcgccatgaacagatcaaacagctttcgccttttctcaagtgttggcagttgcaggtattctaatcgattttggtatggaattggcggaaggctacatttaaaaaatactcttttggtgaaatatttttgacacttttcgatttttttaatatttttttgaagagacggattccaaacctctggagcgtattccaataaaggcctaatataagttttatataacgtaatccaaatcttagacgatttggatttaattattctaaacaaggaacgcatacgtaaatacgcattccttgttatttggttaatatgatcggaaaattgtaatttgttatcaatgtttactcctaaatccctaattgtatccacagcatttattgtatttccatcaaatttatatgtttcttttgggttttttgaacccaaatataatacaaaagttttttgcattgaaacttttatttgccatttatttgcccattcgaataaattatgcaatgctttatgcataatttctgtgtcggttcttgctttataacaaatatataatttaacatcatcagcatataattttattttcactcctgatggcaaagcatcaggaagatcgttaatatacatcanaaaataataaagg

SEQ ID NO: 19688 - DNA, 3328 bp, Heterodera glycines
  misc_feature (141)..(141): n is a, c, g, or t
aaaaaaatctttttttctgtatattatggaataaatcaattcattttcctatcttttttacatatattctttcttcatgaattgtctgggcccgtttttgtattttaattaaagaaatatagaaaaaaaaaaattgtagtntaataaatttctttttgaaaatagggaatttatgggaatttataatataagttttgttaaaatttctctgtccaaaatttataatggtaattttaatgaaaaataatctaactaaagaaattttatttccaatctttctttgaaattttcttatttataccctaattcttaaaaaattcctttttttctgtatatttatgggataatttcaattcatttcttatctctttttttgtaatttttttgttcatttttatcatcggtttcatcttttttaactcatattctttcttttatgattcattatcatccaataaaagtgcaaaaagcaaatgaaggcattaagtaagtatgcattccaatgattaattattttctacaaaaattttcatttcaataaaacggacctaatattcattttttgaaaaaagaaataccaataattaatttttaatatatttaaagccccatttgacgcctttctaaaaaatttttgtccaaaaaaacatttttaaatttttatttacatattttgatacatgtttaggagttttatgcatctttcttacaaatcttacaaattttggtgattttaaaaaaaatttatttatccatactatgatcagaatgccaatttcaaataattgtcccactaaatttggcttttttgcaaattcatttgtgcaaatttttttgttgccaacaatctctgctttttggcacaaatagcttttgtttgttaatgacgacgatttccgcagttttcagtttcagtttcaatttcattttttgcctcaaggccctccaattttgtggaattggccccctttttcggataatctcattttcatttttttttcatccattttctggccacataaaaggcgaaattttgagggaatgaaattcaatttattatgcattatttaaaccaaactaaacccaatttccccattcaattatggttttgtgccgtatcatgctcatcaattactggcacaaaattttgttcctcatttttaaagtacgaaaattttggaaaaaaaaaatttacctaaaacaatgagatattgaaaagggggtacaaaagtttgatatacaacctaaaagcacaatctttataaaataagggaaatattttttatttataaaattaaaaaaaatttaaatgcttttccaaattaaaaaattttcattccccaattttaaaaattcaagtttagaattctaaattaccctaaaaaattttaattttcaagtttttttatacaaaatttcatattttcatttgataaattaaatatttttcaatattccatttaaaaatttgtataaatctatattaaagtttcagtttttcctttttaaaattcatttttcaattttctattattttcatacattttataaatacaaaatgtgccggattagcgttatttgcgcgttcgttcatactacgcaagcaaatgaatgggtaaagccggaaatgggctgaaaaatggcggcacattttgttggctccccgccttggcattgtgtctccacccgatttcaagttttgcctgtgctttaccgttaattaaaatgcatgctaaaagttcaattttcatattcgtaaaatgagacatttgaactattttttctacaaaatatatatggtgaagtgtctagaaattaattgtatatattatttctaattttctgactgtctgtttatgttagtgctctctgagcactctgatcaactttagctccgacccttctcgtaatgtggtccattccctaatgatcatttatcattgtttttttttaattttttttttttttttacttttttttaatcttaatttaagttgggttattagaattttggatatgttttgtcctaatttttttttatttctcaacttattccatctatttttttaaaatttttctaatactagttctgatttaactattaaggttgttggtcatcagtgatattgatattgattgatcgtatgaaattggtgataatatcggctgtttttttactctttttttattatctgacgaatttttttttattatataggagattattgacttattctattagaggtagctaatcatttgatttgaccagttaatttttttgtgcgtgttgttttaattcttttgatgtgattcattcatgaactttaccgatattttttgctgcacagatcgggggggagtgcatttaagcgaatgagagaattgggaaaaaaggggagacaacgggggaatggaggggaaaggctaagaaggaacagaaaaaaaggactaattgtaagctggcgtaaatcccatgcaaaaaccattttcaaatgtgaaaaaagcatttttatagacaaaaaaaaacgtaaaattaaacaattaaaatgctaaatttaatgtgcaaaaaaaaagttaagcaaaggaattctgctgatatgataatatgaattggcctttcactttttctctgtcctcccttttctctcttatcaattgtaaattaaaaaagaattattttaatttcgaattttgaaattcgatggtctttaaaacgttccagaagaatcggctatacgtttttttaatttaatcctcccaaatcccaaaactcgccttgcacattccggacccattgtccaccacgagagcagcaacttcttcgtcgcacatttttatcggctaattaatgaatacgaaatgaaatgaaaggctgaaattgttcaataagttccctagcaattcttgaatcggtttggccgtggtcgtcaagtcgaaagtgagcggtgtcgagcggcgggacggcctttttgttggcctctcccccaccaacgaaagtgatcacccccggggcagtgggcgtggcctatgggcaccggagggaaaagcataaagaaaaggaagagcagagacagcaaaaaagggacgtggagagagcaagcagagacaaccaaagttagaaaaaagtgaaaaaagaaagagagtagagagatagtcaagaagaaacgaaggaaggaaaaagagaaaaaaaagaaaaaagatagataatggaggcctttaaatgaagaatacatacatattcaaattttgaatgttaaatctttaaatgattcatgagccaaggttaattaatcccagattttgtcggccgtgataaaaaagcaatttt

SEQ ID NO: 19689 - DNA, 1607 bp, Heterodera glycines
ttctcgatatgtaagccattttagaccaaaaataaaaaaactcgaaaatttagtttcgactttttgcttgaattcgggttcggggtccgacataggtcaaaattaatgtcagattcggtttctccgacccttaaaacccctaatatgatcttctcgaaaaatttttcttaaaattttgtttttcgaaaaaaggggggggggggaggtaccatccgtagcaatctgtacaaagtgatgagcaacagcaaaagcacagcgacggcaacaacaaccaaaaagattcaacatttgctcattttttattgaaaatatattttgtcggcatcaaacatcacacgccaaaagttcagccccaaaagagtgatgcgattgacaatggcacaatttcgccgttcggcaatggctcggcaccgcgacgaaagcctaaaaaatggccaaatttgcaaaattgtaatatgtaaagcatattttgtagagcgcgaatggacggacggattccggcggggatttttcggtaatagtagggtttgccccccccccttttttatttgtccctatttcgaatcccggacccgaattcgaacaaaagtcgaaaattcaaaattttgaaaattcacttttatgttcgtacctgtataaaataaccatttttttgcggttacaatggtttgtgactaaatttagctttttttggtcaatttaggaacaaaagtgaaaattttcaaaattctgaattttcgacttttgttcgaattcgggtccgggattcgaaatagggcaaaatggatgtcagattcgtgatcagcgaccctgaaacccccgtaaacatgtttccacgacattttagaacaaaaaaattttcttttaaaaaagggggggcaccatcgatagtattaccgcaaccttatttaaacttttttgcatttaaggttcttgatgtaaacaaaacccaacaagaaccaaaggtggggtaattttttagaaactttaattttcgtcttttaaggctcctcctgatgaagtgaaagagacgccacagggagacaactcggaagaagttccaactgaagccattgttgttgatgttgtcgacacaccaaaggaagccgatagtgaaaatggaaaaaaagaaagtgaaactgcggagaaagatcagccatcgtcacagaattctcttggaaacgaccaaaagaatgaaaaagtaagagttgtttctcgatttgattttgttttatgtatttgcttcaattcagacttctccggctcaaggtggtcttccaaaatggatggtgcagaatgccaatgctccgccatccccttctcccgaggttgatgggcataaagagcagcagcagtcgtcagcatcgcctcaaaaagtgcgtggcagaggccgtggacgtcgtccggcagcggagaaaacagcagcacccaacgataaacgcgtccaatcgcctacggtattttgtgaatttccttttttattggtatacaaaaaattactctgttttattttcatttcaggatgataagacttcacaacgtccaagacggtcgacccggactcgtaaaagtacgcaaatcccgatgctggtaataagttataagaa

SEQ ID NO: 19690 - DNA, 2662 bp, Heterodera glycines
atttgaattttttgggcattaggtaagtccgaagtgccatcgattaggaaatttgatttgattataatggggcccgacacttttttggcacgtcggatatgccaaaaatggagataatcatcgtgcttaaaacttggcgttatatctggcccaggcttgaaaaaattagggcgaagacaaaaattttcaaccgttaataaagaaaaagctaaaaaaaaaattagttttatgaaaaacatttaataataaatttaaaaaatcttattttttttaattcattctttgttttttttgtggttcgagcaataaattaaagtttttttattacagaaatatttaaaaaaattttattttttgaataaatttaaattttttgaacattaagtaggtccgaaggtgcgatcgattgggaaatttttgccaaaattttactcgcaaatacccaccttaattgactttttttttttaaataatgagaaatcattttgcacaatttaaactataaacaaaaaacacgatgcgcaaactccaaaattccatgtccgtcctccgttccaattcatcttttggacggtaaaatgagcgattaataatgtcaaaattctcctcattttttacacgtgaatcgggcagccaaatttgagagcagcaaactgagtctcgcggtgattcagtctcacatttaataaattttaaataaattaattgagtcactgtgaggcaggcggttttactgtttaataaagtaattgggataggaattttggactatttatttctgttgatcaatcacttattccatgagtttgaaaaagtttaatcggtcaatgctggtactgaaatgcaatttcatttttaaagtgttaacaattcaaattgctattctattgaataatgatcaaatgatcactgatcagtcattgatcagctgtgtccatatgttcaaaagcgagcactgaaatgcaatctcatttttaaagtgttaacaatgccctgatcagtaactgatcacctttccatatgttcaaaagctggtactgaaaaggggccaatgctggtgctgaactagtttccattttgtgattgttagagaccgacttttgatgcatatgcctttttttctgcgcactagtttcgatgtattaagcataaaaaacacattttccacttggtttgaagcttctacgttgacttttattatgccttttttggcattttcgtgccttttaatgcctttttttcaattttttagtgcctattatagtgcctttttcgagatttttggtgcctttttttcgttcgccagtgattgtgtttcccataacattttggaattgttgactgatcaatggactggtatttgaatggcttcttaaattctgatcacttttgtctcttttgggtctgaaatgtccgtctcccgaccaatttcgccgcttttgatcacttttttccatttaagactttttttctctaaacatagcacaaataaatgaaacttttgctggctggctcctctactgcctctgatcaagtttttggtttggcgttttgtccgtccgtcctttcccccgtcaatttggcctcctcgtcgtccgtccgtctcatttttcattccatcgccggggtgtacaaaattatcaaataaacgatcaaactcactcaacacacacacacaataatttttgttatttttcttgattccgatcagcgcctaattgcccccgccattttgtgcctttaatttttttttttctaaattttcccattttccatcgcgcgatgcgatcgaagaaacgaataaaaaagaatgaagacacaaacaaacaaaaattgtttcgtccatcatcatcatcatcgtcaaatagttttggtgggaaatttcaattttaaatttgttacgcgccaattatcacaataacaaaccaacacataaaataattaattcttcgtaattattagggctggcaaaaaaaggcatcaaaaatcacgaaaagggcaaaaaaaggcatttaaaattttttttttattaaggatttttagggagaaaaacacgtaaaacttaaccaaaaaaatttattttggtcatttaaatgattattaaatattttataatgttttcgaaaaagggaaattttaatataaaactaaaatttttaccaagaaaaaaaattaaattattttttgagaaaatttttaagttcttaggggtgtattttctgaaatttttctggtcagttcttaggtgtgtattttcccaattttattgcattttaatggatttttcggtaaaaagcgccaaaaaggcaccaaaacggcaaaatgccaaaaaaggcatttaaggcacgaaaatcccgaaaaaggcaaaaaaaggcataataaaagtcaacgtagaagcctaaaaccaagtggaaaatgtgttttttatgcttaatatatcgaaactagcgcgcagaaaaaaaaaggcatatgcctcaaaatgcgagctccagtaattatttttgccattttttctgtttcgtcgtcattgaccctaattaggcgcttaaattaaaaatttcttgatataaccagcaaaagttttgtcaaatgagcaaaaagataattttgcgaaaaccctgagacagactcattatttaaaagtcattttttaagccaaaaa

SEQ ID NO: 19691 - DNA, 2303 bp, Heterodera glycines
  misc_feature (20)..(20): n is a, c, g, or t
aaatcgcaaagcaacaaaantcgacatgagaaaaaattgggtcttttaaaaaaaaaacaaaaaaaacaaattttttaatttatagcaaataatttgacgggaacagtgagggcggaagacgacgaattttttagttttgtcacagagagtcccaacgaaattgaatttatggaagccgaaagagtcacgaaagtgccatcgggtaattctgcaacatttatgtaattacaatattcatggtaattttagcaaatttctcgcaacaaatgccgatttcgcctactaaaagaattggcaaaaaatcgcggcaccatcaaaggacaaagggaacggacgaaaagttattcccatttccaaacgaattagtggtcggtgatccgccagttgaaaatggacgcaaaacggcagcggaagaggacaaacggaggggacgtgtcattcttctgccggcaccgccccgggggaggtgggcgaaaagcaatcaattaaataataattgtcattagagaaaaacaattgtgcctttagagaaatattctcgtcgaaaaagcatcaaattttgaaaaatgatgaaaaaactgctggtgaaattgcaacggaaatgtaataatatttcatttcatatgtaaaataattaattttgaaaaccttaaggcaaacaaaacggactgacaattcgtcgacaatttctccaattgatgagaaaaaaggagcaaatgttgtcaaaaatggcacttcagcagagactgaccatatttatcaaaatcagaagcattggacaacgacattacgaaaaaatagcactggtgaaagaaataaatgaaaaatatgaaaagaaaaagtaaaaatggaatttctaataatttaaaggaaaattggtaattaattaattgattcatttcatgggctttgacgtttttcccttcaagggttttctgagtttcgcgtcacagaaatgctaccgcatcgtaatgccataatcgcaacctctgagtctccaattgttgttgatgccactaaaaaagattctctgacaatgccgctaatgattgaacggcttgaatttgttaatattttttaaaattatttaataattaattatatataatattttttaaactaatgactaaaagacactttttaggcgcgaaaactgcgtgaggaacaagtgaagctggaaatgttggaagcgattcgccgcgaacagcttggcaccgatgacccggacccgaattgtattatttgacaaaaagaccatttaaggggtaaatctttagtggagagacgaagacaagcaattgagaaaaagttgacacaactcgcacaatcggaaagaatccaccgagaaatgttggcacacaatcagcaaaggcacgagacggacaaagtgaatttggcatttgataagggaatcaaaatgacagaaggaacaaatttgaggttgcttcttcaattcgctcttcattcttagcgatgccatgcgaaacaatgcgacggttcgtccgttggtttcgcgtggacagcccccgggaatggattcgccaaaattgccaattggccaaacgccactttcccaatgccagctgtgaacagattgaggcattgttaagcaaatgcgtacgataattgcatatgcaatttccatatatttatatactttttctgtaaaataaaacaaaaaaccgaaagaatttgaggggggggggaggacaggagacctttttttgctcgtttaaaatattcgggacaatagtaattaaattaatttcttgtgcttaatgactagggcttccaattatatgcaaatctatatatttttcctggactgttggaggcctgaaacacatgaaaaacatgtttttagcttggtttgaagcttctaggatggatttctatatccatatttccatatcccttactatataataagcgagccgaagctccgcccacttttttggttgagttaaattggcggacttttatggcgattcgttcttttaataaaaagaagagaaaaatcaaaaaaacgttagaaaaagaaaaagaggaaaagtcagacataattataaccaaaaaattttttgcttcacaataatgcatatttcaaaatattcatttttgtttttattagagttcgagatttccaaaaatgccgggccgggccgggctgacttttccagaagtaaccgggttccgggctcggcctctcaaaacccggtcaacccggttaacccgggttttcaaattgccgggcccggcaccggattccgggttggtaaaattttaatttttacatgttaatt

SEQ ID NO: 19692 - DNA, 2706 bp, Heterodera glycines
atttgaaacggcttaacaaatatcctaaaggggtttagtacctgagtaaaccaacaaaatgaaaaaatggggtgagaaaggacagtacaaagtacctgggatcaaggaaatgaaaaaaaacaaggggaaaatgaataaaaaaggaaaaaaagagtggaaaataaaaatattttaaagagggaaagcaaaaataattaaaatttctaagaaaaaagcggaaaattaataaaaataatttttaaatttgagaaaaacagaatgccaagatgtgaaaataattttttaatttgagaaaacagaacgccaataatttagataaattttaaatttgaaaaaaacagaatgccaagaattaaaataatttttaaatttgagaaaacagaatgccaagatgtgaaaataattttttaatttgagaaagcagaatgccaagaattaaaataatttttaaatttgagaaaacagaatgccaagaattaaaataatttttaaatttgagaaagcagaatgccaagaattaaaataatttttaaatttgagaaaacagaatgccaataattaaaataatttttaaatttgagaaaacagaatgccaataaaataggcagtaaatttttgcgagaaaggtggggaaaaacaatgccaaaaatttgcaaaaaataattgggtaatttttggcacaaaatgtgtaacaatgggcaaaagaaaaggtttaaaatggggaaaaaatgccgaaaaagaaatgaaattgcggtaaaatggcacaaaacggtacaaagattggcaaaagaaagggttaaaatttggggcaaaacaataccaaaaattggcaaataataataggggaaattggcacaaaaacggtgcaaaaaaaaggcaaagaaatgttggctaaataatgccattctggcacaaaaataaataaatggctaaatgggtgaacaaatgccaaagaaggaaaaaattaaggcataaaaaaatgataagggattattgattggcttttccattcgtaaagtgaattaaatgaaatgaaaatgaccaaatggacagaaaaaatcaattaataaattgtttattgtctgaaggtgtcaaattgcataatgggcatgcgggaaggagggcggcaccacaaagtaaccaattaattaatttgtttatttggcacctttccaacacccacgccgcctccttaattgatttgtttatttgaccccctcccccattctcgccgcacgctcttgccccccttccgccgctggtgacgtcaaattttccctttatgagagcaaattaatgtttatcatcaattgccaatgtggccgagtggttagtgcgtcagtctggccgcccccctggggttcggatccgcttggtgcggggaatttttggagaattttaaatgaatttaaattcaacgtctttgacctttaagacgtttaaaataatttaaaattaaataaatttaattaaaataatttgcataaagtcgcgcagtcaaaaaagtcgcgcacccccctgcaataggtttgggtttgcaagaaaaaagtcgcgcaataggtttgggtttcaaaaaaaagtcgagcaataggttttggcttcagtactgaaaagtctggcgctcagatggcccgcgctcacctggcggcgctcaaatggctggcgctcagttggccatgcacccctcccataggtattgatttcatcgctagggtatggggggctaccgtaatccggtgaaatcacagtcattaactactggcctctctctctcctttccgaaccccggacccgaattcgaacaaaaagtcgaaaatttttaagacttgaaaattttgaaaaatttttcaaaaaaggtgtcataccatctaaactattaccgcagggctgccatccgtccttgaatggcaaggacgtccttgaaattgggccctctttcttgaaaataaaaaatgtccttgtatgcaaggacgtccttgaaaatgagcatttggaaaagtttaaaaaaatcaaagaaatttgagaaatctttgtaattttcaacaatattttgattaaattatggcattatgtcatttaaaaatgtaatttttgagaatttttgaaattttatggcattaagtcactagtcactatttttcttaaaaaattagccaaaaatcgcaaattttggtcatttttggacaaaaatctgtaaacaactcgcattaaaaattacaaatttttccggacccccctatcctcaaaaaaattttttaaaaagcgcgccgtaaaaaaacccattttataagcaaaaaaagtcgtcgcatggcttaaaatcgcaaaaattaggcagtttttggtgaaaatctgttaacaaattgcattcaaattttcaaaatttttccccggcggcgcctgtcggcaccgccggacccccccccctctgtcccacaaaatttttggaaaaagcgcgccacaaaaaaagcgtttttaaagcagaaaaaagtcgtcgtaaatgaagaaaatgataagtgaaaacaaaaaaatgttggaaaaaaacaattccggtgaaaaatgcaagccatttgaataaatattaaccattttgcattgcatataataaaaattttaaatgtccttggatttcatgaattttccccactatgtccttacaaatcggcatacccgtccttggaaaccgacttcggacgataccaaccctgt

SEQ ID NO: 19693 - DNA, 3290 bp, Heterodera glycines
atcctaataaataaatattttatatttaaataatttataacaaattaatgcgcaactaatttcaatcaataaatcaatggcaaaatagcaaaagattatgtaaagatgatatgtacatatattaaattaaatttaatataattctaattttatcaaaacaagaagaaaataaaaaagaacagccgactaagccgttccgccagtctgtctgcctcgacgagttaattgaaaaaaaattttttttaaattgtaataaactttaatcactttagttaattttcaaaaaacttcggcatttaaagtattaaaatatacattattttcctaatgaaagtttatccgttaaatattttaaacaaaatattttcgggtgctgacccgaccgagacattatttcattaatgtaaattattttttaaaaatttcttcaacacaaaatatttatgaaaacatgttacaagttacaaaagaaattttttcaaaatcaattcataaacaaagatagtttcaatagaaaaataagaattattttcaaaagaattctctattgcatattatttagtttaattatacaaaacacataaagaataacaaaaaataatataaatgaaaaaacattgagtctgaagcaattaactgaaataattataaaactaattaaaaaacgaatgctaataaaaagaaagcaaaaaatatctaataggtaaataacagtgccaccgttaaaattcttccaatgtgttcgtcgcgttgccgagttggtaatagttaaaaaatagtaataattctaagattcaaaagcaatgctagtgtaaagataaatttttctcaataaaaatgtacattcaaaatattaattttattaatttaaaaattaaaggaataagcctttttaatacggtatgaaataatgaaaaaaatactactacaaaatacaatatacaaataattgttagttatttatggtatagaaaattaattattttgataacaaataaattacaagtggtaatcaatttataaaattatatatttgtttatttaaaaaattatatattcaattcctataatagttgacaagaatatttttataatcaaattgcaaattttcattgtaatagtaaaatttattaatttgaaaaacaccaaaatttgtgcaaaaatcaaaaataaatattacgtataaattcaaaaaaaactaaaacttaaacaatatttgacagaattgttacttatctgataaaaatagttatgcttttattttttattttgtataattattattatttattagttttaacatatttgactgttttatttgaattatcataaatttgaaaatgataatcgattaaattacaaatgtttttgaatttaaacccatgatttgaacttttattaatgattaaaaaattccaaaaaaaacacaatgagaaacaatgattttgctttttttttgagacgacaaacaatttactgtactacgatctgtcgcataaattgtttgcgttcaaaaaattggacatcaatgaggtttgccattttggcgctattttattaaaatagactggatttttgttagtccttcttgttcatgaatctgacatctcttaactaattttatactttcctcacctaaatttgaaaagaaatttcctaaatcgaaattttttttatttttttttgaattttcccgttaaaaaatttaaaatattttttaattttcgggtaggggatccccggggagggggggggggggtatgctacacggggtatgtaccccctggaacaggacaaaacacagcctttgaacacagtcgagacataatacagccgagaataaattttttttaattttcaaacttagaaatcttattgttataaaaaatttttcttagaaaattctaagaaaaaatttttttattttccagcgatttttaaaaatttaatcataaattactatgttttttctaagattttttctttaaaaatttgcttgaaaattttttaaaaaaattattctcggctttctcgcttttccttgttgttgaagcccttgaagacacacatcacccgaattaccaaaaaaatttcgaacacaaatttaaataagaacagaaaaatttccagccactttttaacatatttttgccttttgcagaatgagatcgtcgtaagtttcacaacagacgaaatcacctacagagaccaactcctcaaacattttccgcaataataaatttttcatattgagtaaaaaatataaatattttcatagttattctttaaagtcttgataattttagagaattatcattttattttctgattacattatatcgtggtgagccgaagttacaaattaaatttaattatttttttattttaaataaacaaaaagttatatgcaaagaataccgaaaatttagactataactcaattaaaggaaaattaatcaaatgattattaagtagcgataaatttttttttattattaatttacattagatattttagacttgcaattttttcaaaaaacttatcttaagattatatccataggttctcatttttttacattttccattaatgtttcaaagaaattttaatgtttattataaataagaaattttttaatagaacaaaaattataaaattatttttaagctctacttttaattcaatattaagaatccatttgaatgaactctcatatctattttgaattatatctgactaataatttcttatatccatgatcaaaaagccttcaaaataattatgaaattaaaaacttaataaatgaaaaagatttaattttttcatttctattttcatagtaaaataatttttaattatgtgatatgattataaaacttcatttacaaatgcgattttatttaaaatttattgtattgaagaatattatattcattgtcaatttaataatattaattatattttttttggattttttcatttaattctcataaaaatcttttcaaatgcaatatttttaagtcaacaatttttttgtggttgtttatgattaatttttattgtcttaatctctcgtagaaggttgttttttcacttgttctggaaccgaaaacactcggttaaataagtaattgcctttatttttaacacattaacttaaaattaattttttgagattattttataaaaagttgaaaaaaatattttttcaatgtctttaaattaccgtaatcaaatttaaatcttagtattattaaaagtaaaaagtaagttttttttgttaattaaa

SEQ ID NO: 19694 - DNA, 1933 bp, Heterodera glycines
  misc_feature (104)..(104): n is a, c, g, or t
taatgatgtatgcatgcctatggtaagtcagccaacaatacccttgtacgactaaaagttttgcttcacaaacagttgagcttatccgaatgaacaacgagtgnctaaagctgaagttagagcaccgcgaacgggctcggcatgatataatttttgagaatttggatcagagattaggtgatcaaggaattggtctaattccttccatttctaagcttaattcgggtcaaatacaaacggttttaaccaatccaacagcaacggtaaaacgaattttcaaaggaacatgcctaggcagagcaaatgagatattagcaactgaacatgattcaatttataaggaagctaatcatgatgaaacttatcaaaaattaaattccctcgggaagtctgaagtggaaattgatccaaaattcaaaataaactcagaaaaatcgtctgtaaaaggagcaaatttagacacgcttaaagcattatgtgaagaatttggggatattttcagtaaaagtcaatatggcttaggaaattgtgtggctggtgaacatgacattattactaccacagaggagccaatcgcctcaaaaccgcacagaattccatttaagtacagggatgaattgcagaagcacattgaccaacttcttgcgtcgggagtaatggtagaatctgacaccccttgggtatcaaatattgtcctagtacagaaaaaagatggtgggcttaggccgtgtattgactttagaaagctgaacgaggtcacagtacctgatcactttccattaccaagattggaatcgattttggaaatagtgggcaaatgccgttattatacatcattggatttagcgagtggctatcttcaaataaaattgagcgagcgtgcctcccgtaaatgtggggtgataactgagaacaaaatttatcaaatgatcaatcttccatttgggttaaaaaatgcaacaagtgcatttgcgagaataatggcacatgtgttgactggtcttgaaaatgtcatagcttatgttgatgaaattttgatttttactaaatcagaaaattttgatgagcatttggattgtctcagaaaagtttttgagagatttaggagattcaatttgaaattgagtccgaaaaaatgtacttttgcttcggcagacatggagtttcttggatatgtcgttagtgagaagggatacacacctagtctgagcaaagtagaaacaattctaagcctcaaaaacccgtccactgtgaaggaagtgagacaagtggtgggcatggcaagcttctttaggaaacacattccagctttttcgactattgttgagccattgacaaggttgactaggaaggaaaaatcctgggtttgggctgatgagcaacaaaaagcatttgaccaaattaagaaaattctttctgaaaaacctgtccttatttttccggactattctaagccatttcacatattttgtgacgcttcctcggttggtcaaggaggcgctctcatgcaatgggatgaagagaacaaaatttatagtgcgattgcgtactgtagtagaactttgtcaagggcagaacggaattggccgcctgttcaagttgaattaggtgcaattattttttcgcttcggcagtttaaaccatttatttttatgtccagtgttgagcttcacactgatcataaaccactggcttttcttttaaagaaagccgagacacaccagcacttagcgcgatggctagttgaattacagaattatagcgttaaaattgtacatatagcagggaaacaaaatacactggcagatgcattgtcccgcattcctcatgaagaattgagtccagaggaagttgaaaaacttaatgaaatggaagacatagctgagtttccaatttgtctagcactctctcctaggccgagagtagttcatga

SEQ ID NO: 19695 - DNA, 2038 bp, Heterodera glycines
tggaaagtgccaatcgattttcggcattttcgttcatacaattaaatgcggttatatatttcctcatatttatttattcacagtcgctcacacaacgacatgctgcgtcgtgcttcgtcggaccgggaccgtgccgtggcccacaaccgtggtcgcaacagtcgaagccgttcgcccatccgacgctcgtccactcgctctgacaaacacaacatttccggctcctccaccgccacatggcaatcgaagggtggctcttcgtcagcatcgtcccgttacgtgggcggcggcaagcagcgcgacggtggcagcggcggaacgggccgtagcaattcgcgtacccgagccggaatgtcctcctcatcatcgaatcaccatcaatcgtcgtcgtacgatcaacaacaaaagcaacagtttggtagcggtggcggcactgccgcgctgaatcccttctcccagccgcaacccttcgccggtggttcctccgtcggggcgctgtcctatggcaaacagcaacagtactcaattggcagcggtggtggtggtgggtcgtcacggatgacgtcggcaacttccactgtctctgctgctggtggtggtggcggtggttatgaacggcatggccaaatgcaaggtggcttttcgcgttttatgtgttggcactcaaaaaatccagcacttttttctataagattcaaggaaatataaaagattttcttgcgatttttaaaaaattttaaaacaaattttcggtttcaatttttatttggtcgtaatcaaactgtttcaaaaattcaatttcattttttggggattcttttgtcttttcaaatggactttttaaacgattttcaaattttttcccgcccaacaggacgttcttattataacgatcgttatgccgacacaacaactgctacgagtgcgtacgcctcgcgcaccgacccgtcatatggccagcgcattggccaacagttttccagcggcggtggggcgcgtgacgaaatgtacggtgtttcgagtggcgggggcggtgcgttcggagacagcggttacgccacatcctcgtaagtttttgtaagttgcattgaattgagtgcaacaacctatttgttttgcaataatttatgtatttgtgggaataattaatgttaaaatcccattagaaaacttagaaattttttttaaacttcaattaaaaaacaatagcaacactttaattaatgtaattaattgctttttcctccagggcgcagttcgcttcttcccgtggccaatcctccggcggtggtggtggtggccagccctcctcctcctattacaacagtcagtcgtcggcatgggcgaaccctgctaatagccgtgccacggaaatggtcaattcgcgcgcatttggcacgagcgccggtggaacttcagccagtggcaacggtggttggagcagacaaactgatgacattctctctggtaatagctgcttgagcttggcggatttttttatgaatttgaaatccggtaaatgggtcagggtgcacttcaatttttctccccctcctttcaaacccctgatttttttttacaagattagaaattcaacataatattttgataaaaattgctggaaaattttcaaacatttttattttccggggaggaaactacctgcttcggatcaatcaagatttaaactatgaaaaatttatgccatatcaatcatagttatatatttattttttgttgtgctttcagaatggaacatgtacggctcgccgtcgaagatgaccggtgcttcctcgtcatccggcggtcgctaccatcagcagcaatcgatgtcctacggtggagcaggaggccgatcgggcggttcactgtactcgggcggtggtggaggaggaagacgttattaagcacagggagagaaagagaggagttattttgactatggaaaggataacaaaaaaaaggaaattttgattcatttttcgacatttccctatcatcgaaatttggcaagttttttcttcaatatatgcttttc

SEQ ID NO: 19696 - DNA, 3444 bp, Heterodera glycines
  misc_feature (21)..(21): n is a, c, g, or t
tcaaattaaaaatacaaaatngatgtaataaatgtgaaataaaaataaatcaaatgttaaattaacaggtaattattttaatgtaattgtggcacagaaatttcctactcagaactcattgcttttagtaaatccctgaattcctttgccttattaatttgcaccgctaaaactggaaggttgttccagtttcttattttttcttttttttaatttttttttaattctctttttagttttatcctatggaaaaaattattttgagttttggccgtgtggcgctttactcgtaaaagtaaaggcctcctggacctttctgagaaaacaaaacttttcccagtatcgaggctggtgaccctttaattattttaaaagctgttgttaaatcattgatttttcttctttcttccaatttgtgtaaactcgtgattttaagtctttccatatattttttgtacacaaatccacattttcgaaaagcttttcttgtgaaaaatttttgtacccgttcaattttgtctatatctttttttaaattagggttccaaacttcggtagcgtattctaattgaggtcgtacaaaagttttataagctgctgttagagtctttatttccctgcttttcaacactctcaaaatctgaaagcttctaagatatgcgtttcgtataattttgcttatgtgttctgaaaaattaagtttcgagtcaattataattcccaagtcacgaacattatccgattctgaaatcttttttgagttaataaaatattcttttttcatattatttttccctaaaataaaacaaaacatttttcagttgaaatttctaacccatttatttttgaccatttttccagagcctcaattgctttatccaactgattcgaatggtcatcattttcgtgggcataatataatttaacatcatcggcatacatttttatgccaactgatgccgcttcatttgtaataacggacggcagatcatttataaaaattaaaaagagtaatggccctaagacacttccctggggcactcctgaaaatattctgaaactttctgacaattcttcgccaattttaaccttaaaactccgattttttaaaaagttagttaaaaaattatgaatttttccttcaattccaatctttttgattttttgaagtaataaatcaattggaacagaatcaaacgccttgacaaaatcaatatagattatgtcaatttgttgattcttttgtatagaattatatatatcgtccatcatttttaatatttgagttgtagtcgatctattttttaagaacccaaattgttctttatcaaagaatcttgtactgttcagaaattctaaaattttactactcaaaattcgttcaaaaactctacagacagtgctggttaatgacaccggcctataatttaatggatcagttttttcgccttttttgaaaattggtattaccaaagatgtttgccatacttccggaatttgaccggaatccaaaattagcctaaatatatctgctaatatttttgtaattggctcagcacaattttttaataaaatgtaaggaacattatccggtgaagtggaattacgccggggaagtcttcttaatatattccaaattattcccgcattcaattcaatgtcagaaagtttaatcttattctgtgttgactgagtttgtggaccattaacaattgattttcttaaaaaagacttttgaaatatttctgctaatattttacatttttatacattgctggaaaacatatttccagcattatcaattagagtaggaatctcaaaaaattttgataacttatttcggataaatttgttaactgaattttgcccccgggaaataatttttgactctttttcatttctaaattggttcaattgttttttcacttcccttgaaattattttgtaatttaaaatgagatcacttttttcagggaatttttttacaagcttatgcaaacgtaatttctctgaaaataagtctcttattttttgaggatacgattgttttattatcgattttagatgtctattgggtataaaagtatcatataatttcagaactttatttaaaaattctttatatttttgatcaacggtgtacactgagtttattgataaatcaattcgattttcaagtatcgcccgacttaatttcgaaaaattaatatttttaaaatctcttctataaacactgggattattacgccggaatttttcatttattttaaatccgaccatttaatgatcggaagtttaaaaatgttccaatacaattaattcattaattaattctgattcactagtcattactaaatctaaaattgctttttctctggttgtttctttaacatgctgtatcaattgtttttggtccataaactcaatcagagaattagacatcggatcatttatttttttactttattttcatcccataatatatttgggatattaatatcaccacagaatatgatattttcagaatcactctggtcagaaatgaatttgagtagctttttagtattcggaactgtacaatttggtggacgatatatatttataatttgaattggttttttaaaaagtaatttaatgtgaataatttcgctttggtattttgtcccagagaaaagtgtctgataagggatgtttgattttaataaaattgccgatcctccgccctttttatcatttcggcttgcaaggattatttgatattgaccatgtactttaagttctgattctactgtatttctggagtttaaccaggtctcatttattagaattatagaaggatcatattttttggctatatgttctaagtcggctattttatttgttatcgatcgggcgtttattaataggcaagaaatccaaggatttttttctccggtattccaaatttttttgtctggtttgctcgcgtatccctagcgagttctgagcgggcggggatctttcagagatttgatctccaagtcgaccacaaaatatttgtactcacctgcggcaatgttggcctggtaggcttgttgccgtagggagtataaaattttgagttcgctttgggtcatatccctgcggactttgataaattgcggcaaattagggaattttttcagtgcattacggaacttgtaaagaaattggtcacgggaaaatttgtccaagaatggcaccttcaaaattcggtccttttttgtcccgccctcaggtcgtgtcctcgggtggcggtgaatgtccggcgaaagtttgtctttgacgccgcattcttctgcaatttgttccgccaatgcccgtccgtccatcgcctccggcaatttttcgatgactgcccgagtcgacatctctttgagctgttcggaattgatgattgcctcggtaatcatctgcgaaacggcg

SEQ ID NO: 19697 - DNA, 2198 bp, Heterodera glycines
ttaattactttattgtttttcattaatttgccatttcttttgtttcacttgttcgatttgcttgaagaggcgtccgttcagcagcgattgggccaaatcatccagtgattttcgttcaacgcaaatctgtggcgcgagaacgtaatcgcccacttcgagagtggcggcgtgcaaatcaatgccacgacggtataaagtgattggaagttcgctgttgaactcgcgcatgtcgacaatgacctgtaatttgatcggattaacaaagatatttaatccaattggaaaaatgaaaaataaaacggatttttttaaaattaaataaaatgaatttttttttgaaattgtatattaaaaatgaagaattttcgggggagggtgaccttcccccaccgcctgaaaagatataaaaatgaccaatggacgtaattgttcctcaaactcttcgtctacgatccgttgtgtggaggatgttgccgtccgtttgcgcgagtccgtccgattcattgtcagtcgtcgcaactgcgaaacgctgtcccgactgacgtcaaattctctcggcaccatcagcacctaaaacacaaaagaaaattgagcccttctctttttcgttgatttaagtcaaacgtacgccctgctctctgattagcatttcaattgcgtccgtttccctttggatggacgaaagaaagcgttcctcttcactgctcagggcacacacaaacgaatggacagtcatttggtggtctttgtttaccgctttaaacacctaaaaagttacaaattgccataaatcgttttgggtgtttcgccctttcacctcaatggcccgcgttgatgccaaatcggaactgtacatgatcagatgcttgggtcgcattgtttccaaacagttgatcaaccggtaacagttgttgttgttggactgctccagaaagacgagcaacgaatgaattgtgctgacaaacgatgttgaggttgaactgtttgccaacgatgacccgttgagtgtattctcttcatcttcaggcaattgtaaagtctttaaaaaagagccaatgtttggttgaatttaatggtttgtttcactttatcctcattgtcagtactctttgctctttcagcagatgttccaggctcaatgcagcaataattgcgcaccggcacccgttcgtccacattaatttcgctttgtatgtcaatttcatcatcgtcgccattcccggagtcttaattgaaattgctttcattaaaaatgctcttttctgcgcaagagtgtagccagtagcaacacacatggcttcgggggggggggctgaactcaaaaacagattttaggaatgtatattttttacagaaataccaaactagaaatatatatatatatatatatatattatatatatatatatatatatatatatataaatacgtacatatgtaataggtagggaccggatttataaggacaaaaaaaatccaaaatatggattataatatggacggaaaaatcgcaaaatatggacgaaatatggacaaaaacgctgacaaaaaaaacgaaaattggcacaaaattttctgaaaattggttggaatttttaaacataaacccataaattttccggtcaagaaataaaaaatcatttttaatacataaataatataatttgataattgaggcctcctatttattcattaccaaaaaaatttaatttacttaaaaaaaagcaaaaaatagtaaatttttgcaaaaaattaatttttacccgaattttctgatgaaaaattttttgcgcagtttttggtaattttctgaaaatttttcgattttgggcttattttccaaaaattttccatctttaggggtgtaatttggttgtttttttgtgaaaattccgaaatatagatttaaaatatggaaatatggacaaaaatccgaaaatatgtaaataaaaatcgcgatttttgttcgtaaactcaaaaaagaaagtgtttttcctactaattaggctatggagaagccaggaaaaaatatgtatttacattaaaaaaacagtcactattaataagctctaagtgatcttttaaggttagcttccaacaccagtacgtaaacaaaatttgaggaccaagtgtttttttttaccattttcattttattacataacctcccaattaccgtagctggcagatttcgtata

SEQ ID NO: 19698 - DNA, 1653 bp, Heterodera glycines
ctcagcacggtgctcaactgctaataaacagtgagacggtgtgcagtacggctggtccggacgaccgaaaggacaagtccgtgatgttaccgacgaagatgaagaggaagaaattgaagtgccaaagtttttaaccccaacaagccagacgcaggtaagcagccgatcacccaggaccaataagaaagcagcaaaacagcaaaaattgatcgagaagaaataccacctgttggccatcattatttctgatccgcagagatttggcgcaactgaccgtgggaaaatcattaacccaaattctcgaaagtgatgcgctcgcaggcatccgagtcgagcgtaattccgcgcaccttcagcttgtactcgtcctcccctgttgcgttgttgcgcagccacaagccgtaggccttgggtccagctaggcaaaaaaaaaattccatttattttgatctatttttaatgagtcttaccacaaatgaattccataatcgtgtggttcgggtactcgtcagcgagttacccgagctgctcaccacccgtaagtggttcccccagccgcgtcaggtagtcgtagaagatgctgtcagtgtcctgattataataaattatttcctattttcattttctgtccatttcttttcttgttcgtaaccaaattcaataatcttggtattatttgaaagcctaacatgtttagaagatatttctaagctattgcttcgcgattagacaattaccaaaaaagttataacatgaaattgcaaaaaagtcgaaaattttgaggttttttcctaataacttttttagaagctaaaatttttgtttgttttttgtaaggttaatagagcttgtgaagggctttcgaatgataccaaaattgttagatttggtcaacaagaaaaaaagttataataaaaaaactgaggctggcgccaaaacggcggcgccaaaacgacccgttcccctgcaattacctactttttatttcgcttctctgccgcacatcaggaaatgatgtaaatgacaggttttttccaccttagtttacaaaaaagttaaaccatttattttgccaaataaaaaatgccacaaatttgttggtactatttctagagatcggtattttgaaaaaagcctggacctggacctggattccatgttggacctggacctggattccatgttggacctggacctgccattcctgcactttcaaccacctatcaaagcagacacttttgccgtctgatcatcttcatcatcactaattttgcttacccatcagcaaagtaatcagaatgcccatcggcgtcgccccgcactgcagcgtgcgccaattctggtattccatccgacaaattgctggtgatgttgaatggcaacacaacaacaaaaactgctgccgtctgtatggatggtgcgaagggtgcggtgatggttgttcaactgttgttgttgctgatactgcttgaccaccaccaccaatgtgctgtttgcgttggtaaaaatcgaggaggaggaggaggacaatggagccgcaactgaagatgaacccaagctgttcaccagtccatcaaaaatgaggagcaggacggaaatcgatgtggagaggagatttatgtcacaaaatcgtaaggtttttggacatttttg

SEQ ID NO: 19699 - DNA, 1148 bp, Heterodera glycines
ataattgggactgcaaaaaaacagaaaaaataatgctaaatttgatacctcgtcaagttcaccctcaaaatccttttgtctgaattcgacgtccgcaagttctaatcgacgcgcaataaatcttacaaaaaaaaatcattttatttttgttcaatgtttttcaccgttttctcgcctcaaagggcaaagatgacatcagccaattaatgaagctgaaaattgtgactacaaccagcaaactataccaaatccacagcagaacaaaaatctaaaataatattttaaatttaaaaaggattaaatagaaatttcagtaattttattaaaatatatccgtatgcctttttaaataatttttctaagaattaaaaatactttttcaatgaaaatattaatgacaagaacgcattggacagtgtgtttttgaacattgcccaatattcgaatgtccatgtcacaataggtaacgcgtggaaaattgccggaatcactccatgctaaaaaaattgatttgcatttaatctgaccatttaaaatattttatatttaattacgccgtccatcaaacaaatcctgcagtacgccgagaccataatagcgataattgctggtttgtaaaaaccaattcatcaaaaacatctgaaattcttaaaataattcttacaatttgtgataataacttgtgaaaatttgttctcgagtatttttcaggtccttcatgaatctaacacctattttgactaattttaaaccctaatccgaacttgtataaaagtcgaattcaagtttattgttttttgatttttttttgaaataaagaagaggaactcagaattagttaaaataaatgtcagatgcgtgatcagggacaacaaaaacggcagggaacaaaattccaaactagacaaacccaaaagggtccccctttggttttaacaaaattcaaaatcggtaactttgataatagcgccgaaaataacccatgtgctcgaagttattaattaatttttcacctgcatgcaaacattgctcaaaaacaacagcttgatgcccatgtacagaaaggtcaaataagcctcgtaaaagcgcaaattcagcatccgcaaaaagcgatggtggtacgggtggagatggccgtgcccaaacgg

SEQ ID NO: 19700 - DNA, 902 bp, Heterodera glycines
aaaagtgcaaaatcaaaatctgcttttttctatgatttttatcaattattttaattagaaatttgttaaaattaataaaattaatacttaaatacacattcttcaaaaaatctcgaattaaccagattaatttgaattttttaaatattatactgtttcaatggcgcctataaattttacaaaataaagctatcataggcctaggtccaagcaatttagcttgagttgaagcggatacatttccatataaatatttccattttttcttaattttattcatttattatttttagtccatttgtaattgactttaaaatatcttaaaaattcaaagtaaactggttaaataatttatttaatattaataaattttaattattcttttattcgaaatccaataaaattttagaagaatgtgtatttaagcattaagttaattaaattttaacatatttataatttaaaaaattgacaaaaaaaaatcatagaaaaatcagattttttatttttgcatttttttaggtaggaatcgacctagcaccactttgactattaattttaaatttattttctttgattttcatacacgaagattaggggtttcttttaattttgtaataataaatagggctgcaaattatatgtaagaaaaatcgcaaaacatttacataaaatatttaagaaaatcccgaaatatgtaagaattaggtacaaaaatccccataaatctaaaaagcaagaaaattgttacatttttttgacaataaacaaaaaatgatcattctaaaaaataaaactttttggagcttaatccgacgtaaagcacatccgattgtcaaccaaaatgtttttgtatgccgaataagaacgctcaacttcgcatgaaatggatgaaatcagaa

SEQ ID NO: 19701 - DNA, 2220 bp, Heterodera glycines
  misc_feature (27)..(27): n is a, c, g, or t
cataataatccgcaggacggcattcgnttggcaaaaatacataaagcacttgtaaaaatgtgaaattttacgaaattaggaaaaaaacccaaaattttgcgccaaaaacttaaatttttacgaaatcgaattcgttttcctatttcaccggaccgccacccatccaccgacagtgccaattttgagggcatttctggcaaggaaccgttgctgatcagcaaagtggtgcagaaggcgttcattgatgtgcggtgattgcccatgattagggcccggatttacatggattggatttccatataattgggcttaaatactcaaaattatcatttcacacataaattgtctattgaatttgatttaggtcaatgaggagggcactgtcgccgcggcagccacaaacgtccgaattgctcatcaatcgagcaaagaacgacgacaaaacttgcgttttgtcgctgaccatccgttctgtgcctttctgattcgcgatgactctgtgcttttcagtgcgattttccgcaaatgattcaatttattatttaatgtgtatttgtgttagatttggtaattatttttgttgtaattggatgatttgtataaatcttctttttttttgtgtgtttgtttttactatttttgcatttgattccaatttttaatattcttttatttgccgatgatgaagagtgattggatttacacattaaggaaaatcgcatatataatacataaatatgtaaaccaaacatgaaatacagtacctgaatccgaaaatgttaaaatatttatctccaaaaaatatgcgcaccaagaaatgtgcggaaaaaaatttattctgtattatctctaattgtcctcccctggggattatttctcgacctcctcagaaaaaggggggataattagatacggtgagataaatggagacggggataattagagataatctattccatgcccaataatttgcaatttgacgaaataattgtttatccagcaatttgctggtttttttgaatttattgttggtccaattcacctttagatttgggcttggtcttatggcaaaacttggtacagcataaaccaaattaaaaattgcaaaagcattactttttaataaatcgttaaatgacacaaagtcaaagattggatgttcagctggcggatggatggcacattacgacttgattctcgagttttcaatgccaatagggatgacaaaagtgacagtcaaaaagcataaaaaatcaaaaagtttataatttcgaatgatttcgaatgcttctcccccccaacatcgtgttgttcgatcagtgtgacttcttcacacgcacagccccaactgaacaaaatgccacaactattttagcaacttttctgccctttttagtgactttttaggaaaccatttctcgatgtttagcaactaaaaatcccatccaatttttctgttttctctgctcgtgtcttttcatttttaagcgcctgcttttggcagtggccaaacgaatcaataaaagtgccactgctcttccaagcatttggcacaaatgaccaccaccggccactgctgggccaagccattggctggccagtggccacccactaatgctgctctcatccaataaaataattttccaataatatattttttaattatattcattaataatgtcggctttcaacggtggatgaattattttgaaaattaaaaaaagtgcttcttcgggctttttcttgctcaattgccgaatttggttcttttattttaagcacacaatcgtgctcatctgctgctgctcgtttgtgcctcaatggttggaagggaaggacaaccaaaggacatttaagggaaggacagagccttccccgggccaaaaatttacgaggattaacctcggctcagcgtggcctgttacttagccatctaagccatctccgtctcgcaaaatgctcggcgtggcgccgccttagagcaggctcatcgacggagtcgtgcttaattccgcgcatgcaagcaaagcaagcttggagcacaggcatgaaacagcctacaggtttcttcattgccattggccctcaaattggggtgaaaagggtgccgaacggtcatttgattagaaaatgttgccaaaacttttgtatggggtaaatgggggtcattttctatgaatgccctatcgtttcgcttcttttctcttatgttttgttcat

SEQ ID NO: 19702 - DNA, 1983 bp, Heterodera glycines
  misc_feature (718)..(718): n is a, c, g, or t
  misc_feature (738)..(738): n is a, c, g, or t
tgatataaattgtaacaaaaattaaattaaaaccttgatttttgcattgaaatgtatttttattttctgatttatttttacaataaatttactgaactttaaacgaacaaaataacacaatagaattcgaatttaatatctattaatagagagaaagtcatgaatattctaattaaagaagaaatatttttaataaaaccataatgaaaataaccattcctcactgtacataccaaaaattaataaaatgctcatttataaaatcgaaaataaacaaaaatttaaaaaatctaaaaattgccaaaatgaagaaaaaagttcataagtgaacaaggaagagaaaagcacactcatatattacggcttcgaaaatgctgctaaatatttacttgctgatccgaaaaaaaggaaaataaatttgaaactggctgaccatgagtgaaatttgcttcgctgagtcataaaaaaatcgatttaattaaaagctaataaagtgacacggaaaaaaccactgaaaaaatgattgattaaataacaaagtcgtcttttatcaaagtaaattaaaaaatttttggactttttcgtactttaaaccaattataaaaatgttgtcaagtatgtgcttggatttcagcttccaaaattagaaaattttaactgcaccatatatcatcattttgaaataaaatgcctatcattataaaaaaaaatgagtatntgaacgaaggcgccaaattncaaaatcttttattcccaactgatcaaatctaatcaaacataatttttagttgataattcgtgtttgaaagctttatttgattaaaaatattaaaagtaacaatatttaacaaaaccggataataaaattaatgattcctaacatttgttgatcagaggaaaccggtttatctgtcgaaaatagaattgagcaatgtctgatgttctccgatcttcagcagcagttcgttgcccttgtaccgcatgaagcgctcagactaaaacaaaaaataggtttttgaactgtgaaattgagtctgtccaacctgcttgttcaaaacgtggtgaaggtgttcgattccctgttcactgatccatgcgaaccacccccaacgcttggcaaagtctggaccatgggcgagaagccagtgtaattttggggtgaatccagcggcattgtttgtgtcgaatttagccggatgagtttcccaaagtttcttgaaaaggggaaaatgagaaaaaaagtatctttgccttgaaatagccatgaatggatgagcatttatttgagaaattgtcgaagctgctgcctttgtcgccaactgaatcccaacatcagtgtgacttggatgtccaggagtggactgattcgttcttgtctccttgttcggccccttttggtccattttccgggcggttttttgggcgagatgaaattggcctggtgacggcctggcgcacaactttgtcgatttcgggtactggagtgcctgaaaatgcggcattattgttaaaataaaaaaattaagaagtaatttgtctggtctaaagagatggctgaggttccgcgctatttccttagcacgttttgtccggctctgccttgacaagtggtccactgaactcactcttttgatcctgtgtccgttttgctctgttggtcgggttttgagcagtttcacctcttcagtttttttctgcagctggcgttccagcgtcccaattctgcgtttcgccttgttcagctccgtgcacagcctttgaattggcccttgctctgaaaatgaaattatgggggataaaattgattagaaaatctgatcactgattttacctgtttctgtctgagtggcaccatcggcggtttctaaaaccgtttgggttgactggactgttgctcgaaaatcggtgccagttgtttggtcggtagttgttggacgcgtgcggacatggggcctgataggcgttgttgacagtggccgtgga

SEQ ID NO: 19703 - DNA, 1781 bp, Heterodera glycines
  misc_feature (45)..(45): n is a, c, g, or t
  misc_feature (943)..(943): n is a, c, g, or t
  misc_feature (1002)..(1002): n is a, c, g, or t
  misc_feature (1742)..(1742): n is a, c, g, or t
  misc_feature (1773)..(1773): n is a, c, g, or t
aatagtgagtaaaaatgccaaaatagtgaccaaatagttgcaaanagtccgaaatagtgacctaattttcagccaaaaattaagcaaaaataatttttatttactggttgcagttgcaaatgagctacatttcctttataaaattctcttagcaaatattgacattttttaaatcaaaaattttgtcaagaaaaaaaattttgggggagaatttttgaaaaaattttccaattcttagtggtgcattttaaaaaattttttggtcgattcttaggggtgtattttttgaaattttttttatcgattcttaggtgtgtattttttgattttattgcatttttgctaataaaatctctgaaaaatgtcgaaatagttaaaaaatagtgacaaaacgccaaaatagtgaattttcactattttagtgacgaagcgtgaaaatagtgatttctagtgatcgatagtgagatccaaatcgaaaaatttcaacgcagaaatgcgttttttgagctcctttcttcaaaacaatcaagcaaaaaaatagttaaatcattaaaagttgcatccctagttatcaaactttcaatttcaaaaaaaaatttggttgtcaaatttaattttcatttttatcaatttttaataatgaattgtaaattcttattttagttttttcgtgaacatactttgaattaatgcactatttttgacttaaattttgctttaacttttcatcttcgctttaatgtgagatgctaaatgtaacttaattgggctatgaaaaacaattaattagttaggtaaatgtgagtaaaattggactatccacccaaaacaattatcgattactttctttcttttcctacactcttttattgtcttttctttcactgactctgctctcctctttcagtgttctacttttttattgcaaaagtaacgccatttntaatgagaatggatcttgttgggtgttaggtaaagtgagagagagtgaacatctccaanccagtcagtcattgtgcatctcatttctccacaaaatgacttcctttaacatcagtttatttttttaattttttcatatcccggccaatcgatttgtgagagtatttactccaattaactttacaatctatataatttattttcaaataactaggctttttattaaacaaataatgaatttatgcttgcacaacattttaattatgtctcaaatttattattttttaataaaaagctttttgaaggatctctctttaatgtataaatttattgatggtccaataaaaaatccaattcattaaaacgtgggaaacgaccaattagaaacatttaaattttcgtaccaattggaatttttaatatgaataaataaaaatagtaaatttttaagaaatttttttttcaaatgaaatatataaaattaaaactttctatttttaaataaatgaaatgaaagaaattaatttgacctaataaaataataccttagcaatgtaacaataaattatgatgtatgaatttaattatgaaaaaatgtgagataataaatcaaataaattaacaaaatattcgaattatcaaacaagaggccaaaaaattaattgttaaaaaaccaaaattagacaaaagatactaaagatgctaatagaaaaaaattaactaataaaaacagtgagacagataaaaatgtaattgaaatcaaataaaaatttaattacggcttatgttaaactgagcanattataattgttttttgtttatttcgaaaantttataaa

SEQ ID NO: 19704 - DNA, 240 bp, Heterodera glycines
tgcggacatctacatttttgaattgaaaaaaaattggtaattactctttctttttctccatattgaccatcatactcatactccccccacccttttcttcttccgccacccacctcccttgatagtttaaactgaaggcgggaaacgacaatctgatccccatcaagctaacttctgcaggtcctgctcgagcggccgcccggggatcgatccccgatctagtaacatagatgacaccgc

SEQ ID NO: 19705 - DNA, 1297 bp, Heterodera glycines
ttgcctgtatggacttcttattttttatcactgttttcggacgtgaattttccatttttaatcgatctcgacttaaagttgtttgttcacaccgtttcaagcactttggataaaagcgaaaaatgcacggaaattttgatggtaaaactggcataaataaaaatttttaagtaaattgaggctttaaatttagtttatgtgtccaatcaatgaccatgctcagtttactaaagccatcttctttcttactaggtcattgctaacattgttggtatcaatcaacagcttaaagtctacacagaattttttgtacagtaaactgtgggttaataacacaatacataccgtattttctctaattatcacccactctattaatccctcagtctccaatattccagctttctgagagggttgaaaaataatccaccagtctccatttatcccccatgggtggtaaatagaatttttattttttcgaaaaaaataatttctttttaaaaatttaataaaaaataattaattacctaattcgtaattgaaactctaaatgtttaataaacataaaaaaatatacttaggatcattcaatagcccttaaaattttcaatttatatcaagtttccaaaaatttcatagcattatcgatgtaataagtagggagtccaattatatgcacatgcatatttttttcctggactgtgggaggcctgaaacgcacgaaaaacatgtttttagcttggtttgaagcttataggacgtatttccatatgcatattttgcatatttgtgcatattttgagatttatgtgcatatttgcatatttgtgcatattttggcatttcgtgcatattttatgtgcatatttgggcaatttttcgaaaaacctctattagaacggcccctaccagctaaattgggactttgaccccaaaaatcagaaaattttacgaaaaaatcattttttagcaaaattttctcgaaaatatacactttttatgtcaaaaataagcaaaaaagcaaaatttcgcttttccggttgggttttcactaaaatcagtaaattttagctttatcgtgtttttttacttctaaaatgacttttaataccatatttaaccatttttgaatgttttggcttatgtcggcgcccacgatcgacgaagccgagatgccagagaatgccgaaagaattaaatgccaaaaacggaagagacggagaaaataatttttgaacaaatttgcatatttcgcaattttttattaatttaaatttcatttcatttctctatttta

SEQ ID NO: 19706 - DNA, 680 bp, Heterodera glycines
tgtcacatatattttgtattttaattatttattttaactaattatttttcaaaattgttattaccatttgagggttttttcatttacgccttctcgcgacataccataccttcaaggataaagaaaaagaagttaatttttgatatacgaatttaaaataggtatgcggatgttgagtgatgtcgtttcttttataaaatttgttttataagttaatctattttaaatttaattaatgagtaatgtagaacccaattttgttaattaggtaatggattttttgttcctcttaattatttattttataaaatatttttatttaaataaatgtaaaataactaaaaatctaccgttttttagataaataccaacaaaaaaatgattataataatttttttatttaggtttttttttgttttacaatttatttctttatatcttacatacatctatttatttttataaattacgtattttttcattaaataaaacacattagagtaatttttaatttgcaaataattggtaattattttttctttgtgtgcataatcaattgtacaactcgtgccccaagtgcaaacaaaaattaatgtctcctaagagactaataaacgcatattaaataattttaaataaatatcatttataattatcatttatttttagcagagataatt

SEQ ID NO: 19707 - DNA, 1371 bp, Heterodera glycines
ccaactcccgtcaaatgaccacgaactactttcttattgacctggtaaaaaagaggggcatggtcatggttaaatgaccaccaacttcgtggttgtttgaccaaagttcgtggtatctcttgttgaccgaggtttaccatcaacttcatggttatttaaccattaccaccttcttattgaccgggcccgaatgtcatatatattttttattttaattatttattttaactaattatttttcaaaaattttttattcccatttgagagttattttttatttacgacctctctcgcgacataccctcaataataaaaaataaccgggttgataaagttcaatacaaattgtaagttaatgctagccccaatttattttcggaagatcgagtattttgttattcatttatgtttgctttaaaatgtatattttgtttagatcaataccaacaaaaatgaatattattaattttttatataacaaatttaatttttattaaaatctgttttaaaattaatgatccctaacttccagaatgcatttggctcgccatttaaacattttagaattcgctgatgttcttttttatagcaatatttttgtaatttttaatttgcaaataaatggtaattattttttctttgtgtgcataatcaattgcacaactcgtgccccaagtgcaaacaaaaattaatgtctcctaagagactaataaacgcatattaaataattttaaataaatatcatttataagtatcatttattttagcagagataattcttttaatttcatttaaatttttatttatactgctttaacagtaatgtatattttgccaaaaaacaaaaattaaattaataacgtttttcttagtaaaatttcgaaaattataaaatgtttattttaggttttatttaattatgataaattattttttcttttcatttttggcattaaattattttatttaaatctcatatgacagatgaaattttttgcatctgtaagaattataactgatttaatattgttattattgcgtttttaaacgttctttaattttttcattttttatgaatttgacgaaataaaaaataaatattataaaataaacaattaatcaattttatataagacaaatattataaatcctttaagattaatttttttttccttataaaagaagcagtattaaattttttgcttccaaactgcaaaagtttcattttctcttttatcagtttatttactttagttaatcaaattgatgtaaagcagggctaattaaatttaaaatttggaattatgtaaattttaccgatcccaggggggggattaaatatatttggtaacaatttttcaaatcctcatg

SEQ ID NO: 19708 - DNA, 1795 bp, Heterodera glycines
taataaataatattccaattttaaaaaatgaagaaggcgatcagttagagaccttggcatttatttttcaaataacttaaaatgggaaaaacatatagaatttattactaaaaaagcaataagaacatcttttgctttactcaagtcacttaaaactaaaagcccaaaaattctcataaatatattcaatgttattgtcgatccattttggaatttggttctccgatttttaatccatatatgaaaaaagacattgatgctcttgaaaatgttcaaaaaacatttttacgtattgtttttagacgtaataataataaggatccgggtataacgaactcctccaactctttaaacaagaatccctcttaaaacgcagaataaaaatagatttaaaactcttccatgatataattttggaaaagatccatattcagcataatgattccttttcaaaaacatattcagaactgaaaaatgattttattattaaaaccgcttattgttcaaccaatgttcggtatcattcgttttttattcgtacctctcgcctctataggtgtttgcctaaagaggcgaggttacttaattccattgactttgctaaacttcttgacacctatgatgttgattctttacttttgaaaccacctcatctcattcagtgaccaaatttatttatattgttatttatgtcggtgtcacgcttttgcgtataaattgattgattgattgattgattgattttgcgctattaatagcctaaaatattttttgttagcatttttggaatttatttgattttgggaaaatttaaaaaataataatgaatattttttaggttgttttgtgttaatgaatattttcaattttagataaatgccctcttaattaaacaatttatatttgaaaactgtcttacgcctcaccccttaagttcgcctatgaccaaatggttcgcgactgtccgaaaacgtgcaatgtttgcccgggagtttgtgaagatttgggcaccgaatgtcccgaccgacaaagggcgggttattgtgggagagcggtgagaaaaaaaagaaaatcaaattaagactaattaacaaaatatttaatttctttaaaataaatgtctgaaacatttgttactgtttttgttggctttataattttttttgcgttagctgtacaatgatttgatgaattggcaatgcccgcgaagttgcaaccgatgcggaaacagaaggcgaccacggggaagaatatacacaggcagaaaaagaagacaaatttaattaccactaatttatttattgaattattcacttttccccttccaccgaattctaattggttattggcagggctgccagattaaaattttcaaaagcctcatttggcatgcaaaaaacctcattttgtgtcaaaaagcctcatttttgcagatttattcaaaacacgtttaaaatgatcaaattttgtatttttgattgagcaattttttgtttgaaataagcattttgtgaaattctgagcatgaaaaatcaaagttgtttttttgcggcgctttttacaaaaattttttgggaaacagagggtcccggcggtgccgataggcgccgccggaaaatttttgtaatttttaatgtgatttgttaacagaatttgtccacaaaattgccaaattttgcaacttttagcaaaaattttaagaaataaaggattttttaggttccgcggtgcccatagccccgccggggaaaaattgaaaatttttaccaaatttttaacaaattttcattaaaaa

SEQ ID NO: 19709 - DNA, 988 bp, Heterodera glycines
ttcctggcttctccttgctctaaatagcaggaaaaacactttattttttgtgtttgcgaacaaaaaccgggacttttatttacatatttcggggttttcttacatatttgtacatattttggatttttttcatatatattttcatttttttactattttagtattttttacggaaatttttggaaatcctcaaaaaaaatccaaaatttcggcaaatatttttgtacatattttcatttttttttacatattttgaaaatttataaagaaaaaataagtttgaaaatgttgcctaaaaataccaaaaaaagtaatttttatgtcattttgtggctatttcatattttacggggattttctttcccaaaaaataccattaaaaaaattttatttacatatttggggttttttgtacatattttgggatttttcttacatatttatgtacatatttggaccactttttgtacatattttttgcagccctagttattaggtatataattttgcaacaaaaaaatgagcgagggaattgaagctgcacaaccttctcctgctcatgagcagattcagcaacaatccgttgataggcaaagcgaggataacgagcatcaaccgtcagatgtttcacaagcacctcagcaattgtgattttcttttgcatgtttataattaataaatttattaggtttgatgcgcgtcttccgtttccacctcatcaaatgcgtcctggatttcatcctcgttttccaccatttccaccgaatggcatggggggaccaccaatgcggccaccttttcgtccgcctccaaatttctcgcagcaacccggaggcactcaacctgataacttcccaccgtttttcaacagtcctgctcacagaagtgatttgtttttctttattctgactgtctcttctatttctacgggatttcttaatctttcttcccctgtctatttaaaggttataaaaaaaagatatatgac

SEQ ID NO: 19710 - DNA, 1405 bp, Heterodera glycines
  misc_feature (22)..(22): n is a, c, g, or t
  misc_feature (44)..(44): n is a, c, g, or t
  misc_feature (59)..(59): n is a, c, g, or t
taaaagtaaaaaacgtcagaanttcgagagcgacgatgagaggnaggaggaagagcggntgaaagagggagagtccgacgcttccgaaactgaacaatcgcccgagcttcagccaacaaagaaaaaatctcgcaaagagaaaaagtatgtttttgttataatttacggcaaaagtttgtggtctcgatgatgaaactctttgtatgaatttgtttgaagaattttaccgagtactgagagactaacataaaattatgcttttctaaagtaattgtaaacttttattatagattgaaaaaaggaatatgcgtttttaaatgaattcgctaaggaaattgcttttgtcctctttctcataccattcttttatagggctgaaaaggaaagggagaagctgaaactggaacagcagcagcagcagcaactccagcaaaaacagcccaaacaaccattacctatacaagtggaaaaaccaattgaccccgcaatacaagccgaactcgacgcgcaaaaggaacgtgaaaaggttttgtttgtctcatcttattattcattttattattcttgaattttaggtaccgttggaagagcgtattaagcagtttcgtcagttgttggaagacaaaaaagtcagtgcgacaagttcatgggagaaggaactctcgaaggtgcagcgcattatcatttacaggatttgtcacttgcaaaatattttaaatttaagattgtctttgatcagcgctatcttctccttagtactgtggaaagaaaagctgcttttgaggcctattgtcgtgaacgggctgagattgaaagggcggagaagaagaaaagagcaaaagaagccaaggatgggtttcttaaacttatggaagaggctaaactgcatggaaagtctgcttttcaattacagatcatggcacaatgccttgatttttttaacattttaaggtcgacatttgcttccttctctacaaaatgggttaaagatgcacgtttcaaggcagtagagaaaatgcgtgaccgcgaggcttacttcaaggattacgttgaagaactctacaagaaggaaaaggaggagaaaaggaaggagcgcgaaaaggtgaacaaatgctaaaaagtaaacacttacaattggtttgcaggccaaggatgaattcaaagctcttctgagtgagcaaaatgatctgagacgcaattcaatctgggctatcgtgaagaaacggctggacaaagaagcgcgctacaagaacaaacatttggacagtgaaacgcgtcaacgccttttcgaggagcacgtgaaagactgtccggagccaactgaggttattaagctaatgaatattccgagaaaacaatttgtaggaagaggaggaggaagccaaacggttggcggctgaatctc

SEQ ID NO: 19711 - DNA, 514 bp, Heterodera glycines
cgcccgtcctgaggccgcgaagcggtcgaatgcacttgctcatcacttaacaaacgcgcatgcactagcaacgaagtcctttgcgcgaagcgctaatgtcagcgcccgcccatatataccaaaagtatactgtcttatgaatgcgtcctcgcgatgcctgtagaccaaatataagcgcaaagcatccgtctgaggccgcgaagcggccgaatgagtccacaatatttagaagtgcaaagcgcccgtcttgatgccgcgaagcggccgaatgttccccatagaattaaaaacgggcgcgaagccccgttctgaggccgcgaagcggccgaatgttccccacaaaatttagaaacgggcgcgaagcgcccgtttgaccccaacaaaatttaaatcgggtgcaaagcgcccgtccaagcccaacaaaattaagaaacggacgcaaaagcgcccgtctgaggccgcaaagcggccgaatgttccccacaaaattaaaaaacgggcgcgaagggcccgt

SEQ ID NO: 19712 - DNA, 986 bp, Heterodera glycines
  misc_feature (875)..(875): n is a, c, g, or t
  misc_feature (952)..(952): n is a, c, g, or t
atttgcaaccatccggtgctaccagaaagggatcgtgcctaggccgaaaataggacttttcccgaatttgggttccccgggataattgtgattttcccccaattttcccattccattttaattgtccaattccctataaattaattctccactctttacactcccacatccttttctttgacttctccattatccaattaacttgatcgatttatttattttaaaaatggaaaatggttgcggattgaaactgagaaatggaattgaaattaaatgtgaaatggaattgaaattgaatatgaaaatcggtgaaagtgattgtgatccgaattccaagatatttcagtgaaaaacggccaaaaagggaaaatcctgagggaaggtccgggaagggcgtggggaggaaaaccagaaaatgaattttgtccgggaatcgaaaaagggaaaaacggaaaaagggacggagaagattttgcttctctggagttgctcggtgtggaaagtccgggatgagccaactgatctcgcgtttcccacggggaaaaggatcagcgaaaaagctgatccttaatcccgccctttttgttactgtctgtgggggggaaataaaataggggtactgtacgtaacagtttattagggttgaatcatgtttaatgtgataaataatttgatgttttcattgttttggtttaagaaaagttcattataagttttatgtttattaagtctgaaaatggagcaaaatgaaccccaacaacaacaaggacaggaacagggacaaggacaacaacaaggacagcaacagggacaggaaccgcagggacaaggacaggaaccgcagggacagcaacagggacagcggcccgagatgngcaaaaccccatcggtttgctttataaaattgaataaggcttccaaacttaccctattaaaaatttgggtaatactnggagaattggtgtccctgcttaaattaaaatttt

SEQ ID NO: 19713 - DNA, 1118 bp, Heterodera glycines
gttataagcattaggaatctgtgaattcttgataatttataattgtttgcttttatagggattggagcgcaagcccaacaattcatgggggaacacaatggaggtcagggttttccggataagctcattttgtttacttaacatgcataatgatattcatttaggcaacggaggaggaaatcactggcggcaaaatgcgcccggacatggaggtcattttcattggcgttttatttttcgtttttaaaatttttctatttcgttcagtgcccttcggtggagcagtggcaaacaacggtggacaaggaggctatgggcaaaacatcgtacctggtctaaacggtggtcagggcggctatggacaaaacatcgtacccgctcagggtgatttactcaagactattcagtttattatttttatttaagtgtaaatttatataaaaggtaaaaaaaaacattttttgaatccaaattttacttttttgcattttagctggcgctggcggcgttggatactttccggcggcctaccagcagcacggagggcaaaatgtgccgggtggaggtcctttaaaatcaattaaatccttcacctgaaaaactgattctcattgtgttttaaattaacaggccagtagtgttgttcttcggatgagactgaatgtatgacgaaagactccgtcgatcgcttttattctcattctgtcgtcgtttttcccgctttattttggatgataataaatgctttacaaattgcagtattaattttttatagttgttttgtgaatgtgtatacctacattaatttcactttaatatttatgttcagttttcataataactttttgcttatggatgcgtacaaacctgaaatccgttccaatactttgaccggttgaaaaaaggccgctgcgtccaccctatcattgttcgacccgtgcagtccgtacacaccggtgagaccgaaatggtagccgttttctgcggcatatacccatccgacaattttgcgcgtttacccatttaattatgccaaacacaggcgtgtccaatacaaagccgaccgttgaagaacagttcaatggcggaaaaagacacaatttttgaatttgactgat

SEQ ID NO: 19714 - DNA, 2309 bp, Heterodera glycines
  misc_feature (1337)..(1337): n is a, c, g, or t
  misc_feature (2205)..(2205): n is a, c, g, or t
  misc_feature (2255)..(2255): n is a, c, g, or t
ttaaccccacgagcgagaccgaggccccgaaaaatccgaaaaatttctcaactcgagaaccgagaccgaaaatctcgaaaagtaggggtcagggtttttagggatcagctaggtcgggatcggaataaactgcgaaaaatggcctaaatttccggggtcgggtaaggggccccctgccctagttatccacactttagacccaacaaattttctttctgttaagtgcctttctctgcaacaatattctgtcatgaacggccggtgcttgacccaaaatgccaaatttgcattctttctacaaatggttggacattttaacaaaattaccacgctaaattcataacccaattgttcaaattttaaatttgtgccagaaatacggtttgccaacttttgtgtcccattggcactgatttgtcgagaggtgaacgcacagcggcaggccaacatcaaaatttcgttggactccaccaaaacagcgctcgacctggcgacggtgttccccgaatttacgcagacaaaagagcgaaattcgttgggttttcagccattttttggcgaacaacggcagaatttgaccgtttctttgtttgtgtcaacaaaaatgagtgcgtgaggatgggagtgtgaatagataaaaatgggataatgcatcgatttattatcaaaaaagggacaaaagaccgacaaacaacccaaaatgggacaaaaggtcgaccgacatgcatttaaaacgggccaacgtatcgatgtgttacaaaatgggacaaaaggcctaacatttaccgaaaatgggacaaaaagccgacacaaaaccaaaattacccaaaatataggataaaaggcctaacatatttagaacggagcaatgaatcgatatatattaccaaaataggacaaaagacctacatatacaaaaagtaggacaaaacgccgacataaatcgaaatataacaaaggaccaacaattgagaccagattgatataatggaagccgaaagccaaacaaaaaatgtttttcgcgtcagatcgctaccgtattcaatccgattcgtgcgactttttgtacgccattctctcttgccttgtcgagcgggttcatcaactgcagcccgatgttcagctgcgttgtccgatcccaatgcatttgtttttgggcgaaattgccaaattcatcgaagttcgaatgactaaccctcaattagtgttatgctcgagaatcttggggtcaaatctttgatattttcggtctcgagcatcagcagcctaagccattgatagatagatagatacattgaatattttcgcattccaagaatggccccgaattcacactnctaatgggggggggggggggggtctttccacgagagtttgggtcgagattttcgcttggaactcatatccaaaattggggatgcatgccaatgaggtaaaatttggaaatttgttattttccgagtccgggtaaattggaaaaatttgctattttcagagcccggggaattttggaaaatttttgaaaatctgccttttccaaacctgaaaaatttcagtaattttatagagaaatttcgatccttttcccttgcgtttaaggccgagaatcagtttgaacagttagagaaggaagtgtgccgtgtgtctatccaaatgcgacatgttgaaacagtgtttttgagtgcaacaaagtgtggtgacggagaacagcagaacaatcagctgaccaacatcgggacactgctcaattacacccaccggtgaaaacgctgggggcaaaataattaattaattaccccctctttttcggcattttacaaaaatttttaaatgtttcgctgtgccaaggagaggcgctgccgtgaaaaagggttgtcacccgaatcttgaagtccaacgtttttccgaaatgacccgagtccgcagatttttcttatcccgaattccgtctcgaattttcttctgcccttttcccgacccgaatcccggcattttctcgccccgtggcaaccctgacaggggatggaatccccaggattttcatccctttcccgctttggcacaggcgcctaatttcggaatcgcaaaattataacaaattggtctggaatagtgtagcaatacattgattgatccctgatcgctgttcagagaattggccaattcattggacaaaattacgaatgggtcacaaatgttgagcanagggggacgccattcgctgcggtcactgctcaacctaatgaatgcgctgnttaaattaacgaaatcattttgccattcgacgggagcattcttgatggcacaga

SEQ ID NO: 19715 - DNA, 1559 bp, Heterodera glycines
  misc_feature (48)..(48): n is a, c, g, or t
cattttgtgcaaacgacagggaggcgacggcgcaaaaaggacgatgcngtcactttgtcacatcgctcaagtgtgtccgcggtcggaatcacgcccatgtcgaacagcttgccgagcagcatccgtgccaacaccaacttgttcgggtttttgtcgtccaactcgcggatgcgtttggccatttctcggatctgcaaaaaaaaaagttttttttatgaggaaggaaaaactctggttctaaacccagtaaacccgccaaaaacttcaataatcccggcacgggaccctttctcccccccccccccaaaaaaaaccctgcaaaagtcgaatttttcgatcaaaatcgcaacccttttttgagtttcaatcatgcagcgcaccgaagtccgcaaatttcgaaattcccgggttctaccacacccaaccccctggccatcagcctgaatttgcggaaaacccgaattgtccatcccgctaaaagcaacgcatcaattgcaaaacatacagaattttgtaatttaagcctgggaggcccagcctaagcagttgtaattttcaaaagtttggaaatattttcgtcgttttaccatgaaaaccatgcccacaagttcaaatttcattattcgtcgtacctctctggacagtttgttgtacagtgtgtagtgctcgcgcttctccacatggtaacggcgcatgattttattctcatgaagactgttgtccaactcggccggccaattgatgaagtccactttcttcagcaactttttctcatggaatttcaatgtgcgcaccattttatttttttaatggaaaatgctaaattttaaatcaaatttgtaaaagaatttacacagataaacaatttaacaaattggataattaattaatttacagtgaatgattaagttttagcaattgttcaagtttatacatacataaaaaagttttgttttaatcaaataaaaaatgcaattaaatgtttttgaatgacacctaaacagaggcaaaagcgcaacgccaaatgtggaaaaatttttttttggctaattttgccacacgaaaacctaacaaaaatgggtcggaatcgtttcggcatcaagcgcttttcgaaaaagggggaggggacaaactgaactattaccgaacaatcaacctctcgttcgaatgatacagatttatgaaaatttgatggtctagcaaaaagaattcttggcgcagaaacggcactgtccgctaactatgtaacaaataaaaagttttctatgaccatttaacaaattcactaatcgattaatgaaaaaatgtatatttgttctttagtcaataaaaaaaatttcaaacgaacatttataagaaaatacagcttttggtgaacaatgaatggcaataaaaaaaagaattacctattttcaacgaaaaaatcagacaaaaaaacaaacatttttattgccataaataattcagatgaaaaatgttgagacataataaaataattacatatatattttttcactttgacttttgttgtgcgtgtgttacaaatgaactagagaaga

SEQ ID NO: 19716 - DNA, 1052 bp, Heterodera glycines
ggggcggggcgtcgggaattttccgctcaaaatggtgctagaggcaaaattctctctccgttcagtttatggggtggtgggttgactgcccgtaaaatttgaagtcaatcggacaaggggtgcgcgagttttgctgcgtaagtcttggggtgcgcgaggggcggggcgtcggaaatgtaccgcttaaaatggtgctagaggcgaagttctttccccgttcagtttatggggtggtgggttgactgcccgtaaaatttgaagtcaatcggacaaggggtgcgcgagtttaactgcgcaagtcttggggtgcgcgaaggggcggggcgtcgggaatgtaccgctcaaaatggtgctagaggcaaaattctttcgccgttcagtttatggggtggtgggttgactgcccgtaaaatttgaagtcaatcggacaaggggtgcgcgagttttgctgcgtaagtcttggggtgcgcgaggggcggggcgtcgggaatctaccgctcaaaatggtgctagaggcaaaattctttcgccgttcagtttatggggtggtgggttgactgccgtaaaatttgaagtcaatcggacaaggggtgcgcgagtttaactgcgcaagtcttggggtgcgcgaggggcggggcgtcgggaatgtaccgctcaaaatggtgctagaggcgaaattctttcgccgttcagtttatggggtggtgggttgactgcccgtaaaatttgaagtcaatcggacaaggggtgcgcgagtttaactgcgcaagtcttggggtgcgcgaggggcggggcgtcgggaatgtaccgctcaaaatggtgctagaggcaaaattctttcgccgttcagtttatggggtggtgggttgactgcccgtaaaatttgaagtcaatcggacaaggggtgcgcgagttttgctgcgtaagtcttggggtgcgcgaggggcggggcgtcgggaatctaccgctcaaaatggtgctagagggaaaattctttcgccgttcagtttatggggaggcgggttgactgcccgtaaaatttgaagtcaatc

SEQ ID NO: 19717 - DNA, 279 bp, Heterodera glycines
tataataacgctgcggacatctacatttttgaattgaccttaaattggtaattactctttctttttctccatattgaccatcatactcatactccccccaccctttctcctccttcattttttttttcctttccttctccaaccctctcctccctctcttgatagtttaaactgaaggcgggaaacgacaatctgatccccatcaagctagcttctgcaggtcctgctcgagcggccgcccggggatcgatccccgatctagtaacatagatgacaccg

SEQ ID NO: 19718 - DNA, 2259 bp, Heterodera glycines
  misc_feature (812)..(812): n is a, c, g, or t
  misc_feature (1982)..(1982): n is a, c, g, or t
  misc_feature (2177)..(2177): n is a, c, g, or t
  misc_feature (2184)..(2184): n is a, c, g, or t
taattgagtctattttggcatattctcctcaattatcccattaatcattcccttatctcgccttcacaaattgtgttgttttgattaatgtattaattaaaaaatcttttcatattccttttaattttgttatttttttaaatgttagaatggaagcatttcaaaaataatcatcaaatattaaattaaatttggcaaaatctcaaaagaaaaaataataatttcacaattctaatctgtttttggctcaccactaaaacggctggacaaactcacgctcacgcggtgcgccttttctgcaatgtttcataagttaatgtaggatttatatacctaattttgtacgtatcatacaaatccattttcatatccatttttattctttatttttattgtaagtcaaaataaataagaggtcgtgtaaatcagggatgtgtgccgatgccctcaaaaaaaaattttcggcaatcggaactccgatcccaaaaatgtcgtaaataggcaaccggaaatcggcattccgacaaatccctgatttaattttgatgaaagattccaaatcaaaatggtcctctcctccctatggtttatcatcgagtccaattaaactgcaacaaaagtacccctgccggatgtttgtacttttcaatatccattctattgtaagattttaattgtatttgacattaccataattgggcccgacaacaacaatttacccttttccaatatgtatttgcttctcttctgttcaaatctcttccaagacactattcataatcataataaataaatacccccattaacacagncaagcaattttttttttttttgctttaccacctgccgctgcttgtctccctccgctgcttcttctgcttctagaaaggaatcatttatcataatgtgttgtattgtaaaaaggaaatattatatgtctatgtatgtatgcattatgattgttttttgtaagccctccttaattgtgatcagtcggtccctccctttcccctcgctcatttctccccttttttccccgtccgtcctcctcctcctcctcgtccccgtctgctggctacattctgttgcttgctgatgtcccccaacaacacagaggatgtcgtcgtcatgttttacacacacacacactcgtcggtcgtcaaatatttgcgcttgcgcaagctttgcttcttctgtcagccgctctcccatgtcccccctcccctgtgctcctcacagatcccccaaaattcactctctcgagcacatctcagtcaggtagggctgatgagagagtgtcctcctcctcacaaatccccaatgtatatccctccctcctccctccctgttgatgggatgttgcgaagctgagctgagctgcttcctctctccccatgtcttcttcaaagtcattcattgtcagtcacagttcttccttcctctcttctcccctctcatccgcttcatcttcatcatcattatcatttgctctcttcacgctcaagtaccaactaactcttgaatcactcactcactttgttttccaatgttcccaattttcgctcaaaaatcatttgcgcgggaaggaacgaacgcgtcggcggtcgagagcaaaaatcgctctagcgccccaatacttttttttttggggggggggggagggacagaaaaagcgggtagcacaagttttctttgttttgtttttgatgcattttttctttatttggtcttagggcgcgtgactgatttttgttcagtctcagtgggtctgactgcactgacaaatgagtaaaaaaaccgaaactcggaaaatttgaattttcgtctatagcgccaaaaaatttgggcagaaattcgaaaccttttcattcctccaaaaatgattcttcattgactggtggaattagcccacataaatttcccatccattttatatatgtagtacttattttgggatctcttccgctacccgactaaatttngattgttggtccatttttcaattttgcttcatgccaaaagcagcatcagtaatgccttcagcatcatccatcccatattaatgaactacaaaataataaatcccctggggaaggggggaacccctcacataaatccctcctcctcttcctgccatcggacgtcggcgaaattgggggattccctcccgctgcccnttttttntttgtttatttattattataaattatttttttgttttgtttgttcacgcgattaacacacccattaagcataatc

SEQ ID NO: 19719 - DNA, 1220 bp, Heterodera glycines
  misc_feature (1193)..(1193): n is a, c, g, or t
ttatttttcgatcacgcatcaaccacccaacactcatccgacgctacacaatcacactccatcatcatcagcaagcagttcctgttgaagaaggacgccacagtcagtcagttcagtcaattgacgaaattcaagcaccgcaccccgacgaccgaattctgtccgtccccgtcggccgccagtgttcgtttgtccaatccgccaacaattttttgtgttgtgtgtgtatattttgctgcgaaaaaaacagcaccaatcaccaccaccaccatcaccactaatctacataaacaaacatacacaaatattccaccaccaccacatcccaattaaaaatcaacacacaaatcaaatcggtgggtgtcggctcggcctcccctccccttccgatcgacgacatcgcgtggtgattgttggtggtggtgtgattcattcattcattcgcacattccattcttttgtgctgcagcaaccccaaccccccaactcccatcccatcacacctaaccaacaacaacaaacaataacacatttgttgcacttgttgtaataacaggcaggcattttttgaggtccgttctagaaaaaaagaattaaatgctcacataaaaataaaacattttttaaatcaaattttaggtaatagtttaggaaatctcctttttcaaaaaaaaaacaaaaaaacacattcacgtttagcaaatcctctgagttttttcaaatagaccaactctttgttcgaattagtgttcgagtttgggttcaaatgggtgtccgacttcgaaatctcctaccctgagaactctaaaatcaacttcatctcgaaaaaattagaaatttatatattgcattatttattatccaattttttttttgcacctttcaattaatatttaggtagctaaatttttgtctaattttttactgatgcatattttatttttctgctatcccctgaatggtctcctcattcaaatttatccaaagcaatttgagttaatctctgacattaattaaaagattggatattgtcatatgcacttaagcacctactcaactcacaattgaccccattctcataaaaaccaaagagttaaatgaatccaaattatatttcatcggattcaaattaaaaaaaaagacagttttatttatgagtaattgtttttgactaaatatgtatttggccacgnatttgaagtctctggagttcccgggat

SEQ ID NO: 19720 - DNA, 955 bp, Heterodera glycines
  misc_feature (756)..(758): n is a, c, g, or t
ataatgcgaatagaatgagatgagaatggcgatgagatgttcgctctgtcgccctctgctgttgttgttggctggcggcaatgttaatggagacaaaacgagtaaatggcgcgacggggggggaagtgggcggatgatgaacgacacgccgtataaatttgtcagcagaacgatgcgaagggggggggagggtaagtgtctgaatttgtgatggttttagctgttgaggttgagtgacgaaaacaacggaaatttaatgaacatttattcgcgcaccaatcggtacggtaagtgagcgtgggaaatgggaaacggtagggaaattttgacggtttaatatgcaactgtatcatttatcttaatgtcattctataaaatttgttattatagcacttctcctgctgctttttattctgatgactggtaaaaaaaatagcatttccccatgagattgagaaaaagcaatttcccgaaagaagcattaacggatcatttgaggaaacaaaggatccatttggtcgataattggggttgtagaaggcagaatcggtagttcagctggtagaacactcttccggaaggccaacagaaacggcggttcaaattccccccccccccccgacagtttttccctcaaaggcttttctcagctcattactttattcacgaaaaataaaaacaaccatttaaaaccttttggtgaaaataataaatgtatattgacttcattaattatcattaataatcatttttatnnnatcatttccccccccccctccctattaatttctcaattacagtttcatttttgtttcgtttgaattcattctcccgcccccccttccttcgtctcccatttcatttgttcgaccttttctcctcccctcccattggctctctttcgtgccaccaagaagggaccgcccctttctccatatcgccagcgatgcaatga

SEQ ID NO: 19721 - DNA, 764 bp, Heterodera glycines
gacgactcgtataacctataaatgccacgatgacgactcgtataacctaaaaataccacgaggacgactcgtataacctaaaaatgccacgacgacgactcgtataacctataaatgccacgaggacgactcgtacaacctaaaaatgccacgaggacgactcgtataacctaaaaatgccacgacgacgactcgtataacctataaatgccacgaggacgactcgtataacctaaaaatgccacgacgacgactcgtataacctataaatgccacgacgacgactcgtataacctaaaaatgccacgaggacgactcgtataacctaaaaatgccacgacgacgactcgtataacctataaatgccacgaggacgactcgtataacctaaaaatgccacgacgacgactcgtataacctataaatgccacgacgacgactcgtataacctaaaaatgccacgacgacgactcgtataacctataaatgccacgaggacgactcgtataacctaaaaatgccacgaggacgactcgtataacctaaaaatgccacgacgacaattgtgcgagtcgtcgtcgtgtcattttttggttatacgagttagggttgcacccccgaccccgccccgacccccgacatttttggccatttttcggggttaaccccgacccgaaccccgacgcttccaaccccgaaccccgacccttaaccccgactcaagggcggggttaaatatacacccctaagaatggcatttttgt

SEQ ID NO: 19722 - DNA, 1443 bp, Heterodera glycines
  misc_feature (1404)..(1404): n is a, c, g, or t
ttttaattcaataattatgggagcttctaggattagcacgttattgatgttttaatgattgtataacttttttttttaaattttagtcttccataatttttgtgaaagcgaacagaaccgcacaattattccatctttttgatttgaaattaaaaatgaaaattgatgtttagcagatatatttttttacaatgaaaatttcttacagtaattccatgtttaaaaaatttcattttcggaattggtgagaattttctgtagattctattaatcagtagaattttatggctttgaaactctgttttttgttggaaatatatattttataaatttatattttcaagaaaaaatatgaatgagaaattaagcttaggatttttggaaatttttttgttaatttttatagagtttacccaaaatcaaaattaactaataaaaatcccatattattttgttccgattttcttggcatatgaattagcgaaaatgcaatttcatttgccaaatttggcatctcaaagaaagctttaagcattttgccaaatgagtgattggcattttacgtgtgtgggataatttattttggtttaccttgtttcataaaaattactaaaagccataatgccaaaatttcactacatttatcatctacgttaattaaatcactttgccaaatttggcatctcgaaaaaagctttacgcatttttccaaatgagtgattggcattttatgtttgtgggataatttatttttggttattgtaaggaaggcaaatttctaattggcatttactcatttgataaactcaattccatttaattaataataataataataataataataataataataataataataataataataataataataaataattgccttaataaatttgcagaacatattaatttatgggaatggttttttgcaagcaattttaatttaggtaagtaaaaaataaatttgccaaatttcctcctgcaaaaatgaaagaattttgaaatagtttctatttttattcagttccgagctttagattggccaaaaagatttcttaaatgcttttcaaaaataaaaattgtttgaaaacggaaaaataatttgaattttattaaaataattggattttttgctttaatacaaatttctccctaaaattccaactttaggtaagagcagaatttccttaactttattttaatgacaaataaattttaatttaaaattcgaatatttaataaattcgtgatacttttcgaaaattgtattatacaaagcgaacatgacttttcttttattgtgaaaaacttgacatttgtgtcatttcctttaattcgtgctaataatttattttttttatctcaattttatttgaacatcccctcaatagtgtngtaataatcatttgctatctatcatttgctcataattat

SEQ ID NO: 19723 - DNA, 2172 bp, Heterodera glycines
cataaatcgcgaaatatggaaaatatggatatggaaacccatcctagaagcttcaaaccaagctaaaaacatgttgttcgtgcgtttcaggccctcaacagtccaggaaaaaaatatggatatccatatgattgccatccctagtgatcaatgatcagcgaattaagcttaaaaatcttaaatatcattccttgaaatgaaaatgctaattagtcattaaaacaccgcaatttgcttgaaaaatatttatttttaaattttttatataattcattatataatttaacaaaaattagtttaaaagatcctattttttgtttccaattttaaaattgatcttaaaatttccaagttttaaaagacatcaataaagcattaaaaaagtaaagtgctaattaggcaataaaactccgcatttgcgtgtaagaatttttcttttgaaaattcatttatataatttaacaaaaattagtttaaataaacctagatttggctaacaatttaaaaattacaaactctggaaccatttcagtataagcttattgcatttctcaggtacgctttacgatggtgccacacttttctccattgcgcttccggcacatttgctgctctcgatcatcccaatgtccgtgttcttcttgaccattgaccgaatttgtatcatacgctttggacacaattatggctatcagatcaagcgagtgttgaagctgtcctttcttagcgctttgtcggttggcattctgttcaacttcatcggaatgctctcggcaatgccagtgccaaccaagacgggtgggtcaggatgggtatttaagcattcgggttgcggtatcggccccaattttcgcgattcttcacattgttagatatcccatggcatttgaacggtgccattcccgaacctcccgcgtcttttcttccaatttaaaaaacaaaaattaattattaaacaaaatagtttagatttgttttttttaataccctaatattcgttttttaatttagaatgtgaaattttcggctgcattcttggcactgccgtccaattgtaccttggatggcgcgccttttgtgccattttgaacacaatcagtggcatttggttttttgtggttttttatcggtccaatcgtaaaatggcgtcaacagcaaaaatgttaaacaatgctggacaattgcaaattcgtcgtgccaatcgcgcggtatttacataataaagtgatttcttgaaaaactaaaatattattagaatttctttagaataatttgctgacatccgttgcaattgtcagtgaattgttcctctcatttttgccgcattttcttccatttatttgggaaagagtaagtagagaaatatatttgtcataaattattttaaaaatacatattttcattttaataaatgaattaatcgtgttttattttaacaatttatattaaatacatattaaataactgtaaatgatatttcgttaatttagtttgaattttcaatttataaaatataattgctttatttttataatatgatttataactattttttaaattgttttaaataaaatatttatttttttcattttttttaaatgatttttcgcagatttttggtgccggctcatcgcttggcactggccctttgtccgagttgatgagctcgatcgaagcattgctgttctcctctatatattcgcacatgttttcggcacgggacgccacttcaatgcatggcacgggaggaacattacaacagcaacaacagccataccatatggaaatgaattacagtaggcagaatatggaacgaagacggtctgaccgtgtggtaccaatggcaccgggacaacatcagccggtacaaatcctggtccgccaagttacgcccgtcgagaatataaacaacaggcctgggacctcgatggcacgctactgagaagaagcgagaaattttaagatgaatcacgatttcaaataaatgtgttgtgtgattttgtcctttttttctgaaattgtcctgattcagatggattcgtaattttttaaaacattttatttcaaaaatttatattaatttgattaagacaaaagcttatgttaaatctgttttttaaaataatttataatatgctcaagaagccaaaatctagaaaaaatagtcaagtt

SEQ ID NO: 19724 - DNA, 2437 bp, Heterodera glycines
gtaaagcattcgtattagcatcgaatattttacgactgatcagtcggatcaccctcacatgctcacaatctgtagtgatcgcattgaccatcttcaaatgccgaactgtacaaattaaagaacggcacgatcgatttatcgatcaatttatatgcatattttcgatatttatcaaaaatcgaacgaatcactttcccagtctctagcacaaaaatataaagcaaatatatgtaaatgacaggtgctaacaaaatttggagcgcggccgcactggggaaaatatttcacaatgaagccgaagcaattcctcaaaagcagcatttacccacatttgaacgattttaggtagggcagagattcttcagttaattataaataattaaattttagaaaattggccgacaatttggacccgacgcacaaattcagaaataaatttataaatgaaaacattttcgaatctgaacaaattgacgattaaaaatgacaacattttcagtttgttattctattaaagttaaagaataacaacatttaaaaaaatatttgtctaaacaaaatctaatattctttttgtccattttattcatttttcttgataattttttataattaaataaatttttcgacacctaatctgttttcacggtgacatgatgttattgagccaatgctctgtttgtctgatttattataattagggatgtcaaaaatatgtacaaaaagtgatcaaaatatgtacataaatatgtaaaaaaaatcccgaaatatttaagaaaaacccaaaatatgtataaaaaatgtaaaaaaattttttaaattgttattttttggaaaaaaaattcttcgtagagggtaagataggaacaaaatgtagcctaattagatattttaaaaattaaaaatgaaagtatgtacgaaaatttgccgaaattttggatttttttgaggatttccataaaaaatccttaaaatatgtaaaaaatgaaaaatgttagaaaaaagcccaaaatatgtaccaaatatgtataaaatcaagaaatatgtaaaatatgtataaaaccccgaaatatgtaaataaaagtcccgatttttgttcgcaaacacaaaaaagaaagtgtttttcctactatttagaccagggctctcagatctgaggatttatcctcattttgtggctttttgataggtcaatgaggtttttttttttgaaatgaggatttgaggatttttgtggctttttgaggatttttgaggcttttgagaatttttgagatttttggggaaaattcgtcagattttttaaattttgataagttggcataatgtttggcaattatttagtaatttgagtttttaatagagcttcgaaattttgaaaaaagcctgtatatgtgtacctatatgtatattccacaattaactattttttttactaggtttaatgtcatcaaaaagaaaatttcttattctgagttcaaaggaattaaacgtgtgaaatgtttttaaatattacaaattttcagtcattctacaaaacaaattttttttcccaagcagcgtctatcggcccgccggaccctacaaatcctttattttcttaaaaacttgctcaaaatcgcaaaatttggccatttttgtggacaaatctgttaacaaatcgcattaaaaattacaaaaaattttcaccggcggcgcctatcggcgccgccggaccccccccccccccaccttgttccccaaaagtttttttttgaaaaacgtcgcaaaaaaaaaagcaatttcggtttttcatgctcaaaatttcacaaaatgcttatttctaagaaaaaattgctcaaattgatcataggcaatcagaaataacatttgaacattttaagcgtgttttgtataaattttataaaaatgaggctttttgacccaaaatgaggcttttgaaaattttgatctgagagccctgatttagaccatggagaagccaggaaaaaaaatatgtatttacataaaattgacagccctagtaatttgttgtagctgtgaatttttaattcaggaccattccgtgcaaaatgccgataatttaatccgtgctgtttgttcaacaatttttctgttagtgggcattctgatcaattccgccattgtttttgcttaaaaatcacataataaacaaataaaaatggcagcgaaggaaattcaacacacggaacaaaaatgcacttttatatttaaatattaaatctcagatttcgctgtatttgttttgggacccggggtgggcgaagctcggcttagtactcgaagccgaaggcgaagcccaatttttattcgaagccgaagccgaatctcgaagcccaaaaaacccgaagttttcgaagccgaagttttttcaaaatttttttaattctaaaattttttttatcaccataatttc

SEQ ID NO: 19725 - DNA, 1080 bp, Heterodera glycines
tcatttgctgttttatccatattactggatatgagatatgcttgttaaagaagaacaggctcgagaattctaataattttaaccggcttagttttcaagacaattttctacaaattaaattaccgatttacaccgcaaaaaaaaactaagtttctttgagagtttatcattttccgctccactaaaacatcagtattttttgttctagcagttttacgcgtcccatggcaaaatattctagaggaaatgcgtcgaacaaccttcctgtttaaaatttttttcaattttaaatgtttttttgtaataaactaaatttgttgggacatgtaaaatgccatgggacgcataaaccgaccagagccgtatatataatgaaattttaaatttttttttgcaaaattttttttggctttgttgcagatgccgccgagacggaggagggcgaatacgacgtgaagaatctgatgaacaaattcctcaacatcgacctgacgccgaaggagcgggccagcaaattggacgagttggaggcgttgcgggtggaggccaagaacctgacgaagaaggtcacaaccgaaccgccgagggggggggggctcgaaaaaaaaactttttttgaaaattttgcccgttttacagttcgagcaggccaacctggactcagtggaggtgagcgaggacaagcggcgtcagctggaggcggagttcgagcagttgaagggtgcgctggcgaggggggcagggggcaaacctaaaaaaaaaattttccggaaaatttacaaatttccagaggacaggcatcgggcgcgccaggagtacgagcaggagatggccacggcggcagcgcaaggtggcgaaaaggaggaaattcaggtgtggccaattcaaaatgacccatcctaattagggatgggtggggtaattagctgactaattaccccactgttcactacaggtggcagccgatcacgcatccaaaatggcggcaaaatgggagaaggtgtgtgtggttgcgttatttttggaattttttggacaattaggcgccgttgaggaattttaaactataaaacgacacct

SEQ ID NO: 19726 - DNA, 1810 bp, Heterodera glycines
aaaaagaaagaaaaaagccaatgaaatatatcaattaattgaagtgtgggatttatttggtttaattacgcgtcctaaaattttcgaaactaattgggtaattaattaattaattaaaataatatttgttgacggggaaatagggagaaaaatgcacaggcaccttttagcactgatgaggcggaacagttggggacagacggcaccgcattttggcgcaattttttggatttaaatttttccgaaaattccgaaaaaaccaacaaattttccaccccctcgtcttccgtgcaaaaatacggtctaaaataatatattgctgatgaatgaattttatgcgttttaatcattctttttttgccattttgatcagtagttggaccacatcggcttgcgaatccatcgcagacggaggccaccttaaatcaattttgaaaatttaaatttgagaaaaaaacttagaatttcaatgaaaaaaatactgtaaattaaataaattaaaataaattccgatttaatttaactaattaatacgaattaaaaaaaaatttttttttgaacacagaaatttaaaaaatagcctttgattctaataatattccaagcctttcaaaatgccctgatattaaattcaaaactaatgaaaatctggtttttaaatggcaaaaatgaaaaattcccgataccttaatagagacaagggcggggtcgggataccgcgggattttcgcggaaaacccacgggattaaattcaggaacccgacctcggtacaccacaaaacgtcgccggccccgaaacgttgccgggacataacgtcgtcgcaaatttttttttaaattctataaaaaaaatcaagaaaattataaaaaattttagttggctagcctaatacgaaaaaaattctagaaaaaattagaaaaaaaaatattaaggaaatacaaggaaacaaaaacttttttttttcgttttttttggaaattcggaaaattagtttttattaagacttagattttcaaaaaagcttaaaattttaattttcttgaaattttgaaaaatttttataattttttttttggcggcgacgttttgtcccggcgacgtttcggcggcgacgtgacgttttgtcctgctccggcccgacctcggagtccgcccggcccaatcgttttcccaaaatcttcgggattcggtcggtatccccttctcgggatccgtcacggtcgtttttcaaaagcttcgggatttatcttggattcggtcggtttcccgactcgagatgactccaacccgagttggccggtccggtctcttttttttcatgatgtttaattttaattttttaattaatttttgtcccactgttcgtccgaattttgatggacgcggcctccgctgcccgtacagtgtccttgaccgactgcatcaaattctgcgcgttcagcaccagctgctccatggcctcctcgtcctcctctgtccctggacgggcaaaaagcatttttaaattttaaaaagcaaaaacaaaaataaataaacaaattaatatttggcaccgcattttggcattatcaaaaacatacaattattgaaactgagaaattgaaaagagtgttatttttaattagtttaataattattgtataaatttattcttttttatatgtatgaattaacttattttgtaaaaaataataaatttgccattaaaaaatgctttaattaaatttttttttaaataaaaaaataaaataattttaaaataaaaattgttgtttataattaaatataaaaaatcaaattaaattaat

SEQ ID NO: 19727 - DNA, 2485 bp, Heterodera glycines
aataaatcattaaaaatggagaaaaatcaggagaacattatgggttttatttggcttttgtaacataaatatgaaaaaagttattccagaaattatggaaaaattcggattttcagacaaaaatttataactcgcttctgaaaagatattcaggaaattaaaatgctacaaaaatccgcaatttttagctctattttataaattttacttcacatttttatcacttttttgaaaaatgttataaaaataaaagtgattttggaattcgggaccgaagggggtgaccaggatttttgattgaaaaaattttttcacaaaaatcttccaaaaacatgtcattagggctattttatgacgctgatcacgaatacgtgatcagattttacttttaacatcgataagacctcagaatccccgtgtgattggggattctgagggggggggagggggcaggttcgaatccggacggtgtacattatttttctatgctattttcactgtttttaattaatttgaagacttcttttaaattattataattcatttataaatattcaatctgtacgtttcaaactctctttttaattaataaaagaataatttattttattttttaaaatttattaattgtattatatttttattttactttttaataaacatttccttaataatctcgcgcgtcgtttcgtcgtccaaacaatcacaaaccgatgcgagcagcaattgctttttgtcagtgttattgaaatgattgcaaaaaaaaaaaaggaaaaatcctttaacgttggcaaggcctattaaccgaaacatttttttttcattaatggtaaaatcggctacatttttttaaattcaaaattttggccaaaaaataattcgtcaaaaaattggcgacaaaaatgatcaaagaaatatttgtgcaaggaatatttatcaataacaattgaattttttaaagttttgtttaataagaaacgattatgaccattacaccgcactaaatttggttctttttataccccttaaaatatttttaaagagccaaaaatgcctattttttgtcacacccatttttttggggttttgcctgcaaaatgatttacataatttattttttgcaaatttcttttaattccaagatggacaccgctgaaaggtcggcacgagcaggcgggatcgccattctccgttcccggtcaaatttggagaaaaaaacggaataagatgattcagttaaaaaatccaagtccaggcaattttcggcaacctggatttttgccgccccctaaaaattcttattctttaaaaaaaaaattggctcaaaatcgtaaaattttgtcattttttgaacaaaatcgttaagaaatcgcattaaaaattacaaaaaattccccggcggcgcctatcggcaccgccggactctcttccctcacccatcccaaaaaaatttcggaaaaatgcgccgaaaaaattgttaaaaatctgtttttttgattctgaatgtactgaaatttacaaattgcttatgttttccacaaaattgttaaaatcgattttggaaatatataaatttctcatttcaaagccggaattgctcagaaaaagttggcgttgagaaatatgttgctaatgcttaattttgttgaataaaaaatgcaatttaggttttggaagcgcgttttaaaaaatatccttattttttaccctaaaatcttatttttgaccagcgatgtacttattttgggaaattttcaaggataaccctgaaacaccgagaaattttcattatttgagagtcaaaaaccgagactctgatagtacaaccctagctgatcgattaaaatttataattaaaaatttaaataacattttgccaaaattaaaaatttctgtaggccttgtccatccactcacacggcgattcaattttgggctccaagtacaaataagtttattatttatttagtaatcagaacgccaaaactttgcaaaacttaaaatttattggggattttcccttgtaaaaatagaagagccgatctcgagttaaaaacttaactttcacaaaataaactttgaatcgctagagggggccaaaatatgggcctaggcaaaatttcaagaaaagttacccacaggaaaaaattttttcccagggcaaagttttttctttttctctcattttgacgcactatttccatgtctctaacatataaaataacacatggttcatttttttgccaataaacaattttttaaacttttgactaattaagaaatattcttcagaattttccccttcaaatgaccacaaaatggtttttgtttggctattattgcccaagtaataagctaaaaaaatttcataaaacaaagggtaaaataatagtgtgtacctttttactgtttgtattggttcttttggcgctccggaattttataattattttatttatttgctccaaaaaattcaaatttatac

SEQ ID NO: 19728 - DNA, 1230 bp, Heterodera glycines
tcgatgttgtacgtaaccaacgctttttgaatatgattttttattgccatgaaaacttttattaatgaaaaaataattctgccttcttctttaaaagaagaaattgaaattaacacacaacatagggaggacttgaacctgggacccctcttttggtgactaactcacagaccactaagacgaaaaatccagcataattgtacttggagcccaaaattgggccgctgtgttaaaaacccaaattcaaattaaatgattgtcaaatcctcattttccaaaaaaatcctcattgacctatcaaaaagccacaaaatggggataaatcctcagatctgcgagccctgttttaatgtaggtaaataaattcagttttattcagatcacagaattggtaaatttaaatggcaacgcaaagtaactttggaaaatttcaacagcgttcaagtcgacaatccagtaaattagtgttaggagtttgtttagtttagggaattaatgtattaaaggtcggatcatttctcaacaacccacgaaatgctttgatgaagcggctaaacgacggcgcattcagcaacaattggagtcacttgagaaagtccgtttattggcggaaaatgatgcatttcacgtttttcaggataatttccaagaggatccccacgcgaatatcacatggcacaaagcggcaccaaaatttgacgatgaaatggtttttggagacaaagaaaagaaaaggcgaaaacggaaaatcgcgtcaccctcaaaagtcagcggagcggagcaagcaagtgaatggaagtcgggggaagagaaaggaatcatttgatcattcagcgaaaaagggaaagaaaattgtggccgctttgacaaagacgcgatttaggaagacatttgctcaacttttggaggaagcgcaggtaaaccaaggcaaaataggggcgcgaattgttaaaaaaaaatcatgaattagaacttcggcgatttttggactttgtttaagtttggatgaagggttttttaattgacaaatgtcatcttttgtcagagggagcatttttcatgactttttcaaaaatgatggacccgagaccattcttatggcctaaatatgttggttagtgagccaatatccaaatgtttatttttattaagcgaaagcgcgaggaagaaactcaacagaggcggaaagagaccggcccagaactccttttgcccacctattacgaagtg

SEQ ID NO: 19729 - DNA, 1339 bp, Heterodera glycines
cactccccttgttcccaaaagttttttgaaaaagcgtgcgtcaaaaaaagtgacgtgaaaacaaacaaatcgtaaaaatttattattgatcccattaacaaatttgaccacagacctttctccaaccctcggatctcttcaaaaaatcttggacaatccattaccccattttcattatttatcggcatcgatggatctctcactttaatttagaaaaattggaccaaaacaaaactcaaatattttcataagactcaaacttgagtttttacttactccaattctattattaatccttttctgttctcagataaataatatctaagtcaacaaaagctcaaggaattctcaataaaatggccgattgttggggttcgttttcctatgtatcaataatattaaaatggtttcatcaaatggtacttttgtttttaatttcgatttcctcccgtaactccacatttttgttcagacgatgaagactacgacccatccgcgcaaatggcggacaaaatcgccagcctcggcttggacgacgtcattcggcaacagcaaccgaaaggggaaaaagtgccgacgcaagcgacgaataacagccgaaaagagggcacagcgaaagagggggcgacggaactgagcgaaagggaaaagagagaggcgcaaatgagggcggacggaacggcggcgatggatttgttcggtttggaattcgaaacaatccgaaaaaggggaaaagccaagccaaaggaaagggaaatagaaaatactcgaaataaagttgcaaaactcaataaatatcgaactcacattttctggccttatttacaacaatataaacggtatttagagtggtaacaaatgggaaacaccaaagaaacagtttaaattctgggaaattgaatggatttcacttttaaattctgggaaattgaatggatttcactttccctctttttaggcttggccgtcgagcgcaaggagcccacctttgacgaccttcgcacgaaggacgactttcaggcatttgcggataaattgggcgaacaaatcggggcgaggaatgaccacgcgaattactcactgtttgtcagtgctttggttgaccatatgacaaagccaagtgagcaaaaaaaaagggggaaaaaagcaaaaataaaaaccattttaagtgagcaaattgcaactgcaaatcgtcatggcaaaaatacaggtgaaaagcaccgtggaaattttttgaaaattcgagtgcaatttgttaacagattttcaccaaaaactgccaaagtttgcgatttttttagcaagtcgacgactttttttgttttttaaaaacgttttt

SEQ ID NO: 19730 - DNA, 1509 bp, Heterodera glycines
tcacaacatttcgctgggcacctgcggctgaatggtttcgtaattgcattctgcgtagatcggctgctgttgtgccgtcgtcctattggcattttcctcctccgccacttggtaaatgcccttcagaagtgcgttcagttggcccatcaatccgtcccaaaagaatcggtccctgaaactttgcgcgtcccacagactccacagctgcacattcagacgcatcatatggcccaactcttcgggcagtttgtccatttgattttgcagctgtttactctgttaattggggaggaaatggcatttaattacaaaaaattaaattatttttggcatttattacaaaattaattttaaatttttttcatttgaatcattctgctgctactgaccacataaacgatgagtttgtgcttggccaatttgtgtgagatggacacttgcaaagtgttccattcgtcccacagaaattcgggtgtcataaaaatgagaagtgcgcggctgtgctgcaccaaaaagtccaattcggcattatttccctgcagttggtgcccgtccgtcttgtaatagccgcacttgtgcagcaaacacagggaaaagcccatttccatcagaggccttaaggggtgaatggcaaaggaatgatggcaaaacggtcggagtgattgggaaattggccatccatgccataattaatccgcttggccattgccatttgtccgttccttccctccactcaccgacaaaattccctctccaacaatcgttcgtcccttttgtggtagctgatgaaaatgtcgtagctgatcagcggcactttctccgcatgttccggcaccaacatttgctgaggcgcaattggcatcggactgctgccgccgctggtgggcggcgaatgggaggaggccaaagagtcgctgttgttggcactgatcagacaagtggtctacaaaagatgatcaactgatcaagcgaagcagtgaacagagagaaaaattcgttttttaaaattaacatttgattatcgatgtttaaaaaaagggacatcgtcagccattccatttttgactaattcatatctgctgatcaaaaaagtttccatttgtcactttttttgaccacacaaaatatcttccctttaagctgattttccttgtgatcagttagcctttttctttgactctgatgattctttttctctctctctttttctctctcccctctcccccgcccttctctctctctctctttttctctctctctccctccccccctctcttttctctctctctctttttctctctctctctctctcccccgcccttctctctctctctctttttttctctctctctctcccctctccccccttctctctctctctttttttctctctctctctcccctctcccccttctctctttttttctctctctctccctcaccccctctcttttctctctctctctttttctctctctctctctctcccccgcccttctctctctctct

SEQ ID NO: 19731 - DNA, 2379 bp, Heterodera glycines
agcaccaagttgcgcagttcgcacatgtagaagagcagctctgggcagaaatctgtagatggaaaatatacacttttaatcagataccaaggccgaaaagctaaaattagaaaaaaattgaagtgaaaaggaaactattttattcatgattggtttttttaaatttttaaagggaaagtcaataaaatttaataaaattttaaagaagtttagcgatcaattggaaaattttcgaaaaaactttgtaattcatcagaaattgtgaaaaaatcgctagaaaatttatcctcacttgtccaccacaatggtggccaacccgctcctggccatcgcctttttgctggagaatgcggcttgcatcagctgaggccacagttcgctgtgccgcaacagccacagcacctcgtcccgggcgtaggccaagcccatccaaacgaatagacacttgggcccaagcagcccgggctggtcgccaatcagcaggcacagctcgcgcagtgccatccgcaaaaagtgccgtcgatgggcatgcaggtggccagccgcgtgcagcgtgtgcacacctggagggggggggggggagtagggatggcatgttttttggtgaacttcatttatctcacaaaacaattaccaaaatctaagatttgaaaaatatgggttttctaagaattttttgatcgctaaaataagcataaataaaaaaaatttaaaaacaaatgaaatctttaaaaactgcgaatttaccactatttcgggttttacaaagtcttcttctaaaaaatgcatttaaaaaaaaagaaatatctcttgaaaaaaaaatttataggccctttttcttgggaagtcttctggttttcttaggaaatgggaagaaatcagggacagcaggcaaaatgtgtattattttacaattttctcggcattttcccacaaaaacggtactgagtccacagaaaaaccatgccggaaccgcgtttcaattaggtctttaaaaatctaattcgatcaagcaccatcgtaaaaaaattcgaaaatttatcaaaaaaaaaattctcaaaaaactaataatacataataaaattttttgaattaaaaaaaaaattttttggcattaagaacaacattgtgtcctgcgcgcaataattcacaataattcaaacaatgaaacactgactgaccatctttcagctcgcccaccaactgcttgaccatgccgtactgttgttggtgctgctgttgcgattggtggttgtgttgctgctgctgcttgatgtgctccaacacggtgtgcaccaacggttggacaacaatgcactcgtcacggaacaaatgaaccaccaaacagtgctgaactgcccgttggtacagcgggccaaggttggccgaatgtgccgggtccaccagcaaccgatggcacaccgtcagaccgactataaataaatcgtggaatatgtggtgggtgatatgctgacaaatgccacggcatttcatccaaatttatattaaaaatagacatttggttggataaaaaacatttaaataaatatgcaaatttgttggaatagtgctaaagcagttcaaaacaaaaccttgaaacttggcttttatcaattggttatgaaaaaagattgatgttttttcatggttcactctttttcgtcaattgagtcataaaaattccggcatttaagttgaataatgtggccattttcaaaattttccaaattttttgttctttcacaactcaaaaatagcttttttgacttctccactcatttatttaaaagctcattctaaaaaagcattcatgaacaactacattcaagcagaatattgggtttaccgccaacaaatttttctgaaaattatagaaaaagtcaagttcccaatgaaaaatcgtagaccaaatcaatggttttgaaaaaagctgagctcggattcgttaaaattgttgctttttttgcactctgtccccacaaaaatgtgtttgtatataaatagtaaccaccaacaaatgatccactggtccatggtgtccagtgaaaggtattcgcatgcgattgtgccggtctgtgccgcgtaaagcatttgcttgggatgggccaccagcgagagcagtgccgcgtcgcgctgctgttccgccgaaatgttccgcttgaaataaatttcgcgcagcgaatccaacgcggcagcgaccaactgaaaacaaaaatggatgagagggaaattcaaatccatcaatttatatgaagtttgtaaaaaattatttaactctacagcagggatggcacggaattccgatttccaacgacatttgttgtgttggaaccccatttcagaaaatttttgggatcggaattccgctttccaacattt

SEQ ID NO: 19732 - DNA, 2491 bp, Heterodera glycines
gtcccttcatgttctactttgaaatgaaagtcaccaaattggggaaggtaaaatgacatttattaactaattaaattcacaaaattcgcataaaattattgtttttggcattttttatatttacatttttatagttttgcctcgattggattcgccaccaaagaaatgccattggacggagcaatcggacagcatttgaacagttacgggtaccgaagcgatggctcatttggctgcaatggtatcagtcggccgtataaaatgggatttggcaccatgccaatgccattcaacgcggcgattggacaacagagggaccgccgctacgttgggagtgccaattggccatttccattggaatttgtgcccgtgccaatgccatcggacggcgcattggcattccaatcgccagcattttccaccggagatgtggtcggatgcggcgtttgtttggccactcgacagatctttttgacgaagaatgtccgacgaaccggtgggccaaacacaaaacaaaaaagcaaataatttaaattacaatttgtcagatgactcctcttttttcactacaactcccatcaattctctgtttccatgcgtttctctgtggactggcgacaaaattgaggcgaactttgggccaagtttcaaattcaatttggccactctttgaagaaagccgaagaaacaacggaaagggcgattactcatttaattaattaattaattcattatccattcatttttcactttatttttttcacatttattttcagttttttatattatttatcatgcgtatttgttaacaaataaattttactgttctttttgtttgttttcattttttcatgtaaaaatttgatggaaaaaatggaacaggaagaaactcttgaacctgaagaaattaaaaacttaaagcaatttttaaaatattaaattactcaaaaaatctctttttttctttgccctcatttatgtcccattgtgttacaatttaaaacgtttttctcaaaccctttgcccaactgtaaaaattaattaaaactaaaaatacatatttctatcatatgaaaatattaaataaaaaaagtctgtaaaatataaaataattataaaatttttattataaaatgaaaaaagaagaaaaaagcttacaacaccttcgattcccaggacgtctccgttccaagtactaagaaggcccaacgttgcttaacttgccagatcggacgggatggcgtgctttcaacgtggtacggtcgtaagcacaaaggccccatttgaaaaccattaaatagtcaattttgtaatgcatttttcttctttggttaattaacccaacagaacaatggttgttaatagagaccggacaagagggtcggtcgaacggtttcggttaaaaaccgaaaaaaaaccgaaaccgaaaaaaaccgaaaaactcaaaaaattctcggtcgaacggtttcggttaaaaatccgaaaaaaccgaaccgaaaaaaaccgaagaaaaattttcggtataccgtttcggtttcggttttttttgaatttttatattttttccaaaaaaagcaataaaacatttttattaacagaaaaagctaaagatcacctctgaactaaattgtaaagctattgaagaagctctatcgaatggtgtactaattttggaaaattgaaaaaaggaagccaaaaaacattttttttaaatagtgagaaaaagtgccaaaatagttaaaaaagtccaaaatagtgacaaatagtgactaatacaaaacttttagtatcactatgatgaaattaccttacaaatagagatgattgaattttctattcataactctttcaatacctaatttaattctatgaacttttattaggtgcgggttgaaaagttacccgcagctgagggttagtcaaccgggttaagttacgttcaactcaggattgactcaaaataaaaaaaaccaaaaacacaaaaaatatttataaaaagtgtaaaaaaaattatgaaaatgtcatctatttaaataagtaaaatgctctttaaacaataatcgtatctttgtacaaagaaaaaaatccgctttcaatagaaaaaatatataaagaaagaaaatagacaatattatcttttttgaaaattaataacctaatatgttataaaaatggatataaattatatccttttgcatattttttctgcgcatgtgcaatgaagaaaggggttcaaattttttttttaatataattttaatgctattttttaactgattttgtctaaaaataacaaattttaggattttgggcttatttttttaagaaaagataggtttttggggggccgacgatgccgataggcgccgccgggggaaatttttaatgaattttgttaagaaaatggccaactgatttttgataaaagtcggtcggttttttcggttttctgattatttcggtcggtcggtttcggttaaaaaccgaaaaa

SEQ ID NO: 19733 - DNA, 2563 bp, Heterodera glycines
ccccagacatttgcgcctatgtccaaaatcgggttctaacttacatttcgtcaatccatgatagactaaacagctttaaataagcgatttaaagtgcttgtattcaataatttgatcgtcagaatttttgaaaaaataataaattttgcaacagaattattgtttctaataaacccaaaagaacctatttttcataaatttaatgctgttaaaaacctctaagattgaaaaaaatgtaagttagaacacgattttagacagattttaaattttatgatgaattgctaagtttttttcaaccccccccccccccctcccttaaattagacacattgtcagattgctcaccttatttttgattcggttggcataattcaaagaaccaagtgtttcaatggcatcaatctgattcgggttgacacatgtaatcattagggttcgactgaaaaaaacaaaattttaacaagaaaatttcaaaattgccgacctgttaccgccaagtgagtcctgaaggagacgagtgagtttcgagtcgcggtacggcacgtggacagtaccaattcgaccttttgcaccgcccagcgcagaaatgacattgccaagtgcaagctgtgaagtgtaaaaaatattgaattgctgcgcataaacaaatttctatttttggcaaaaattgccgaaatttatgatgttaatgcttatttttttgtgtttttacattatcttgaaaaatactgtaatatgagtacatttatagaggggggcattcaaattcaccatatcaaatagcctaattgtaaacagaattatgcagctctggatttgaatatacccagactttccccccccccccacattcgcttaccagtccggaattgatgctgatgctctcctttactcggtcaccggtggcgcccgttctgctcaggcgctcagagccagccaaatcaataaaatggaacttggcatgcaatgtttccaattcagttcctcctgtgcccatcttctcagaactttcctcctcatcatcaccaccttcatccgctgtgttgttctccttttcgtccgaatcgtcctaaattatgcaacactaattgtaagtataataaaatgtcacaccaccacccgcccaaatgttaatagtaaaaaacattggtcccgaaaaatgattggcaccctatagctcgaaaaatattcaaatccgaatgcgaggcgccgatattgagccacaagaaggcaaggcgcgtgttcaccgcctcggattaccccctaagaatttttctcaaattaaaaaatttcgtgaaccaatgtttctttatcattttgcccctccgccaaaaaaatcccgtacatcaaccggcaccactcgagtctgcttgatgttcaaggtgaaaatggcatgtgagcgtgatgactgtttgttcatatttgtcgctgcagttgttcgattttgggcaccaatggccagcgcggacagaatgtcctcctgcgaattgacacttcgcgatgatgcacccatcagcaaaatttcgtggcttgtcgggttctccatgatcttgatggaggatgagtcccggtccggtgacaaaagatcaatgagttcctcgttgtacagctacaaaagttgacgcgcaaatatacagtataaacagttagtttggtgtttggatacatcaagaaggttggcaaatgccagaatatcgcatgagttaaaaaatgggcaataatggtaaaaagtaaatttgggcttaaattgatagaacaaaaaaaaatggaaattggttttctacctctctcactgccttaaatatcgctgcttttttctagagaaatgagtaaatttgactcaattttctgagaatttttttgggtctattgtactctttaggcgcacaacgactcgactttcagatgtccaatcaatgaccacagtaagcgtcattggtcaactttttttcttacttggtcataattttctgtttgctgcatttagcccagaatttagtttggtatgacgccaaaaatgcaatagattcaaaatgccaaatcgtgatttttggggcaatactttgcttgggtaatcctgtattttattggtcccataaaaaaaagagattaaaaagttgtttttatgcaattcggagtagtacccgggggttttcgggggctctgatctatttcgaatccctaacccgaatccgaacatttttttataaaaaaattttaaaaaattgttgaaacgcatttcctatgatttttcggggtcgctaatcacgaatctaacttcagttttatctatgccaaactccggacccgaaatcgaacaaaaggagaaaattaatttttcaccaagaatcacatttattattcaaatgaacggaatataatagaaaataaagatttaaggccatttagtgaatttgaatcgattttggacaatacatgtgaattttggtgaaaaattaatttccgacttgtgttcgaattcgggttcgggattcgaaataggtcaaaattgatatcatattcgtgatcagcgccccgaaaacccccgagtattactccg

SEQ ID NO: 19734 - DNA, 2582 bp, Heterodera glycines
agtttttattgcatttttgttaatgactttttcaaaaatcctaaaataggcacataaggcactaaaaccctgaaataggcaaaaattggcattataaaagtcatcgtagacaccccaaacccagcgcaaaacgggttttcgtgcttatctttgcgtattaagtgcgcaaaaattttaggcatttgcctaaaaaaggaagcccttcatataataaattcatatgtgaaagaaactgccactttataaataatgaaaataaaaacaataaaacactttttactgaagtgacacgacactatttgtctaattaacggacggaaattaaaactaattagtcggcggaagtgcggcgtttttttctgtttgttgtttctctttgcttctcccactgctttttctttcgctttgtgtcgcttcgcttaaatgtttctgcttttcgcgcattttgcgcggaatttcatactctaattacttctataaatggcacatctatttgtaatttcttagtcaaggtgcctttcgctaaaaataatttaataattcaatgctttctaaacataattttaatctatttattaatttaacaattaattaatagcttttcttctattaatttaaacagaattaataatattttagtatattcttaatttaaccattaattaatagcttttcttctattaattaaaaataattaataatatttagtctatgttaatttaacaattcattaacctgtgatcgtaccgccgatgctctgaatgcatatgatggccatttttcagcaaaagtcaaactaataattaagttgaacaccttttctcgaatattgcctatttttggctaattttttcatcaaaatcgctaaatcataaggtgatctcgtgcccttaacatttttcatttcgagattcccgagaatgcagcacatttccattttctttcatatttcgacgaatgtcaatttttaaattaaaaaaaaatagcgctttctctttttccgtccattaatgaatggagagggcgatgaataatttgttttattattcattcttttctcttttcgcgcccccttttcttccttttctcgactcttttgcctttcccttctctaaccaaagagaaaagagagaattttaaatttatttttctgtttttttatttttgtttggttttctgtgcattctttcttttttaatttgttttacactaatgactctatggaacgccgcccgccactttacttttttttacgattttgaaacatttataaactgtccttcacacaattgagcgattagacaaaaagatgaattaaacgaggacttgcgactttaaaaattttatcttctgctcaacagtcttgaatttaattcggaaatttctttttctgtttttggcattgaatctcgatgccaattcttgtcttgtttctcggcactccatttctatggtttcggggctttattccattttacgcatccatggctatcctcagtctcttgggccataacttttttccttaattggccaaagcattcattctttgtatcaaacgaagcttaaagtctcgggaagttataatgcaagaaaagagcaagtaccggcattaagaaaaaataggatgagaaaaaacaaaattccgattatttgagtggaatagagccgcttttggttccgcagagtctcaggaaaatttcttcgatcagtctcaactttaaatatctggttttcgagactcggtatgtctcaaggtctaaatccgcaatcttcagccttgaccttgcgctctcgagaatgttgtctcataatattacgtaattcaaaataaaaagtataattatttattaattaatctccttttgtccatcattccatctatcgactcaccccaaaatctctccacaaagatccttttgtattgtattcggttattttattatttgttcagccgcagcggtcggatttattcaattgtcccgtccggcagaaacattagtgagcggagcagcagaggtgttccagcccaatttgtgcgatcgccttctaatggggtagcggatggaaagaaagggggcgactttctcgggccaacaccattcatcattcaacacattcgtgtctctctctttctcaactctctcattttctccatactccctttttacctcgtctactatatctccgcttcattttcgtccatctctcttttttatcactcgttcctctctgcttttgctatactattctcccgttcactctttcttcgtttttccgtcattaattctcccaatttactccatctctctctatctcccattttctctctctgtcgatttccccctccctaatccactgttaatttttcatctccgatcacttctgatcatcaaccaatcatatccatcgatcaaagttcatcatttttacaatacgcttattattttctgcaacgcctctgctgatcgatcacccaacaaaaacattcttgctctttctctcactctctccccctccctatctctgctccctatccatgtatgggtgtacttttttatccatttcgctatttcgttcacact

SEQ ID NO: 19735 - DNA, 2114 bp, Heterodera glycines
ccacaaaatttcacaaaatttagcacctttttcgcgttttgatgaacaaaagggccgaggcattgcccaaggaagtgtttaatgtgaccaatttccacaattttttgccaaattttgttcaaacgagcggcaaattagacatcaacaaattggacgacttcaaagagccattcgacggcaaaagtttcaacacttttctctttcaatcggtttgatcagatgaaaaataacaaatttttattaaaacaaaaattacagaaattaaccgaacaatttggtaaaattctatgcgaaatttgccgaggtaattagtggaaatactaattgattaattagttatttaatttttcattccaccacttttagaactcgtaaatgatgttgagctgctccgccgtcttcaagcagaacactttgacgtcatacttgccgaactttatgatccgtgccccatggcacttttccatcggattggcgccaaaacgaaacttggcactttagcgttgccgttgtaccaaatgactgtccgtccatttggtataccaacgctgagcagttacgtgacaagtgagtgaatgtgccaaaggggagggaatttaattaataaatttaatcaatttggttaattataatttagaataaaatacttttatttaaaaatattacataaaaaagtacaaaaaaaaattgttaaaaagatgtgatcacaccaatgaatggaggtcacaaaatgaattttgtggaacgatttgtgaattttgtcaacgatttgtgcgattggttgtttttgtcggatttggtggtttcatatgaggtcagcacaaaaataaaaataaaaatgtcaatttatatttaatttaaaataaaacaaattgatcttttagcagcaagttattgctgaagcatttggccaaaatttccccccgctgaaacaaattatgcgcaatgtttccctgctgtttacaaattcaaatcaagtcggaaaacaatggcaaaattgtcggaaaattaattttttagttctttgaaatgccgagaccaatttcgaacaaaattataaacattggaggaatcgtggaaatgaaagtgaaagaattggaaccggtaaattatgggataaaacaattttaaaaaattgaaatgaattcttaagggaattaaagtcatcgtggacaattccctggatggcacagtgattgtttccttcggcacttttgccgatattaactcaatgaaaagggaaatgaaaatggcatttttggaagcatttgcccgctttccgtactatgaatttatatggaaagttgaactgtctgatgaagatgccaaagtgtttgccaagtacaaaaatgtgaacccggtcaaatggatggaccaaaaatcgttgctaagtgagttaaaaaacgaaaaagtttgaaaattcagttaatcattgatcacttagtaataagttcactaaaattaattacccttaatttctgaggctttaaattttttcatattcggtcaatgcctaaattcttggtatcaaacgaaagctcaaagtctacagaaattttttatttagcgaattgcggaataaatgtttaacagacaaaaataaattgtcttgaatatacacgaaaatggtgaattcctgatttctattgcatactttttcttaatattaacatgttattttcttgtattttcgaaattccagaaacattgcgctttcgttgttacgaagaattttttttttaattttaacaacaaaaagcactaaaatttcaaaaatgttacatgtcggctcctatcggcacagacgggtcaccattttagctgtttttttttttgaaatttagccctaaaaatggcaaaagcagttttttttttgacgataaacggctagaaattcttgtttttgttccccggcgctgaaatttttaaaataacactggacaatggacaagtaagaaaaaattatatgccaagaaatttaggatggtcacttaatggacacgtaattgggactaaaccccaattttgttaatatttatataaattaagtaaaaagggccctatattaattattccccgtaaaaatttttctttttaacccaattttggccatt

SEQ ID NO: 19736 - DNA, 937 bp, Heterodera glycines
tatcattttgttttctttcattttcactattcataatcatacacaataggcgatagataatgcgttcattatgcataaattaaatcaaaattttcggagagagttttaacatacctatttataaactattttaaatttaatcaatcatattaaatagtaaacaattaattttcataatttatttgtatttttctatatttgtttttctattaaaataaatttaataaatataatcaattatatttttctctttaaatttcatcaataatttttttttaaattaatttattcttttttatattcatttattatttttaatttgatattttaaattttggcgatatgattttaatgttgccaacaaccagaaaaaacggaagatttcccgttgatgtggccaacaaccggaatatttcacgtttcatgttgccacaaccgggagttcatttgatgttgccaacaaccggaaaaaacaaccgtaagatttcccatttcatgttgccaacaaccggaaaaaacaaccggaagatttcacgttaaggttgccaacaaccgggagatttcccatttcatgttgcaacaaccggaatatttcacgtttcatgttgccacaaccgggagattttcatttgatgttgccatgattttccgtttaatgttgccaactaccgaaaaaacaaccggaagatttcacgttaaggttgccaacaaccgggagatttcccatttcatgttgcaacaaccggaatatttcacgtttcatgttgccacaaccgggagattttcatttgatgttgccatgattttccgtttaatgttgccaactactgaaaaaacaacctgaagatttcacgtttcatgttgtcaacaaccgggagatttcccatttcatgttgcaacaaccggaatatttcacgtttcatgctgccacaaccgg

SEQ ID NO: 19737 - DNA, 2344 bp, Heterodera glycines
tttaaggtccatttggcaaattttggcgctattgagaacgcccatttgagtattttaatacagaatttaatcgatgtgatcaggtcgagaaatgcacgacaattagtgaaagagtttggcgacaaatatttagaggaagtgatgaaggcaagttaaattgttccataaatgggcgagggcaggagcagtttaagcagcaaattattcgtttggcaatacagtggccgaaattgtcaatttcgtttttaagtttctcgacgaagcaatggcagcgtcaaatgagtctctcccgcttgccaaaattgtgcctgttttatgcgacgcctttgccaaaattggcaccgtttctttcggctccattttccattctttgctcagctcaacggaattgcacagattcactctttttgtatcggaatgcagcaaacgcgatgatttgttcgatgcaaatttaaaatgaatgatcaaaaattggtcatttttgaactgtccaatttataaaacaagtataactttttatgtgcaagtcatagccacatcattcaaaaggcaattcggtagagaattttgtgctctatccaatgagcatattcaaaatttctcaaaaaattttcccaaccccataagaattttttttgaaaattttcccaattttcagtgtctcttagggtgtcccgatcactatgaaggagtgatctgatcaagttggtgtaaaagacttttttgttcagcatcaaaagataagcttgcatgaattatttcagatttttaagagccttttgaaacagttttctaaggtttgttcaaagacttttttccaccagtgtatttctatttgttttttaaaattgaaaaataaatgcttttgattccctttcccataaatgataatgttttcgaattctcattttcctttatttatatatttttaatcattcactttactaaatattaagatttgaaggaatttgatgcgagaaaaaaagcgattgttaaaatttgctgaatatttgggacattgttcacgagaagtgagcctttctcttatttcgcatttcattctttcgccataggcgacagattacggaaagtgtgtggcaacgaacgcggagagaattcggaaaggcgactgttcgactgagttcgaccgactcatcgcctgtttaaagaagaggcgtaagttgggacaacatatttctgttgtttcgggttctagtagtttgctttatcatcagtttgtcctttcctttcggcattttgtccctttcattttgtctttgtcggcattttgtcctttcctttcggcatttcgtccctttctttttttctttgccttttgcgcccattccatcctttgactgttttctctttttagaagtgcgtctgtaaatcgctgctccgatgaaagtcaaacggcttaagcgtgccgctcacattttgactttttaccgttacaatttccattttcttcccccattttccgtccttctcgacggaactttttgccaagcggcgcttcagtcgaaaataaatcttcgagaacaaatgctaaaatatttggcgcaatccgtggaaatggtcgtcacgaaatgcgttttgaatgagctgcatcagttgggaaaaccactccacggcgccttggtcatctgcgaacaatttcgaattgccttttgcccccacaaaccgatgaggacggcgtcggaatgcatcgctcatttggcgagacggtcacgagaagaaggaaactcaaaacacattgtggggacgcaggtgggcgagcagtgacacagcaaaaaggggtagagaaactaataggccacgaaaagtcggactttggacccgaattcgaacagaataataaaactcattaatctaggaaaattggcaattttactgattgtgaataacaaaagtttaggatgaccaactgatggagaaattacgaaaagttggcggggtgccaatcatgtcaattcgcttcaatacaattttgctggaaaaggtaaaaaaatagtgaaaacgattgaattttcgcaaattgtttagccttcagaggaaagtaaaaaaatggcagaggaaaaaccatcgaaggaattggaaagagtcaaagaattaaaggacgaagcatttgcatccggagaaaaaagaaggaaacgcaaggccaaagggccaaatccactctcatgcaaaaagaaaaagaaaagcggcgaggggaaaaaagacggaaacgcggggaaagtgcccggggcatttggacaggaagagagcgaacggaaagggaaaagcgacgaagtgaccgaaagcagcggaagagacaatcccacgaaagactctagagatcccc

SEQ ID NO: 19738 - DNA, 1723 bp, Heterodera glycines
  misc_feature (41)..(41): n is a, c, g, or t
  misc_feature (65)..(65): n is a, c, g, or t
tcattaaagtctgacaattacgaaaagtttcgggcactttntaatttcgtaattttatttgacantaattaagaattttgttgtatatcgtaacaaatataggaattcaatgtttttgctaatttgagaaatttaaattgtaggcactgcgttgggctgacgaacggtgccgtcaaaatggcatcgaatgttcgggggaaaatcgtcggaaaatgcttggcccaattttgatggctattcgattcccactaatggcacaggatgaatttgtgaaaagcattggtgagtgtgtgtaagggtgttccggagactcaaaaaattaatgaaattttgcccaaaaacgctccgactaacggaatccgatcctactcttgttactgtagtcaatttatccataataattatttacactgctttgtgagtagtaccacgacttgattgatgcttctccatagcgcgaattgaatttattaaattcacaagacacagtattttcttgttttgactactgtttttgggtacagtaagactattcgtttattgattttgcctataattttgacagttccgtccaaagtgttgactgtcgaagaaatgttccccgttttactgtcccatgcgacgacttatactgaaaatctatgaattttctaaaattcttaaaatccgttcaattcacagcaatatcgtaaagataaagggattttcgtggaatttgagacggcaattccggaagaaaaacaagacggaattcaccagttgagtttctcccttcaattaaattggaatttatgtggtaagcaattaaaaattgaaagaaaaaattttgatttccaataatttttaaaattcgcagaacccaaaatattaaaatttttgattaaacataactgttgttcgattttttaaagtttcacaaaatctcgatcatcacaaaatttgacccccgtccaaatttcatcctttttttttgtccttcgcacagaatttgaatcgatctgttactgcttggcgacattgcgaattgtttcacaaaagcaagataaagcggaccacattcagacccaacgccatttgttccaaaaaaatccatcgatttgtcacgaaagtacacttttatgcaaaatgccatttcagggtaacataaattgtaaatttagataagaaaaattaatttatgatttgatgagttccgagaatgggtggcacgacgaggagaaggacattctgacggttactgtggatgtcattgtggaaaatggtgggggagaggggggggggggggttaaaaagggtggaatcggacagactcggcacgggtgctggactttcctcaattggcattttgtgcattaccatttgttgcgattctgacaatgcaaaatttaaaaattcatccccaacttaaaatatttgatgctatttttagcagaaactcagccatcagtggacaacaaattggacaaactcaaaaacagcagaagtgaaacgcagctttgattaatggcacaaaaaatgtgccacattgaatttgcaatggattgggttttttccgtaattactaatgagtttaaaaaatttttggataatttttcaccggcatcaaacacttaatgaccattcgcttccatcggccattgtctgtcactttgttcggctcttccatttggttttataccattattttaacaattcgttcagactttacactaactattgtatt

SEQ ID NO: 19739 - DNA, 2722 bp, Heterodera glycines
  misc_feature (142)..(142): n is a, c, g, or t
  misc_feature (2607)..(2608): n is a, c, g, or t
  misc_feature (2624)..(2624): n is a, c, g, or t
  misc_feature (2632)..(2632): n is a, c, g, or t
  misc_feature (2639)..(2639): n is a, c, g, or t
  misc_feature (2656)..(2657): n is a, c, g, or t
  misc_feature (2667)..(2667): n is a, c, g, or t
ccccccccccccccccggaaaattcaaaaaaaaagagaaaaattttccgttgggattttttcgtttaaaagtcaggcaaggatgctcattttgctgccattaactgtccttttttcgccatttttgtggtttttcccctccnccttcccttttttttgaccattcattcccccgcatttccctgtgattggcttcgctttttgccctttttttgccttccgtgccgcttaaatgtgccgcagccaatatttagaagaaaattttttgccttgtgatcactttggtcgttttggttctgttgggtggtgccgctgttgtgtacgttttggtggcgacaacaaccgcaaatccgtcgacgccgccacaacggacgcaacgacaaaaccacggcggaggggcggtgacgcaaacaccccgaggcggaagagtgcggcaaaaagcagcagccgcaccgattggccatcatttggggacaaatgccaacggcggcggagggagcgaaagaaaaggcgccgcaggggacggaccaccgcacttaacgcttaatcacaaaacacattaattaacaaaacgaacagcgcactttttcacattgccttttcacgacgcttcatttgctttgaatttaacccaccaccttttgctttttctagtcatttgtgtactgcgtgaacacattttaatatgcatatttaacataaacaaaccgttaaattccacgaaattttcgatttcgaaatttgtatgcatttttaataagatttttcaattccttttttagtttagttgataaattcatatcatttaatttctaaatgaatgactcatttaaattttgcctttgtcaaacgataaattttaaattaaaaagttagttgaattaaccactccaaaaaggcattgattttgcattgtttcaaaaacataacgattcttgttcactccatccgtttcagtagtgattgttgtcatgtcagtgatattcttcctctcatattccggttttttttgttttgtttatttgtaattttctgtttgcacttattctttgttgtatgatgttatgtatctacagtatttcctaaaatattatcccatgattttagggaggagtactagttcaggggagagtattattcaaaatttttatcacaaaaagataatttctgctcaaatttaaacaaaaatgagaactccaagtcccgaccaatttaattaaccccaatcccggaccaaacccccgccgtcgggttttcagccctaaatcaaaagctcttccaggaatggacagaaaaaaagttaaacgaattcaatttgaaaaaaacagaatttcgtgcagcaaatttgggatttttaaaacatttccgacctatatgtgaagagctagtatttgattttaggtaaaattttttaggagagtactaaaccaggagggagttctattttaggaaatacagtatcttacttttgtgtttgtcaaggctccttttttattactgtttctaaaagtctgtaaattgtcgtcgtcgtgcgttcatcgatttacccccttttcagcattcaaatagagattctattacagaatacgcgtcccattaactcttcgcgtcccaaaatttttttacgcatcccattattattggatttagcggaccggtgttagcagttggaaagttagcgggccgagacctaaaaatcgaattttttgattagaccgcctccccccgaagttaagggtctaaaataaaaaatccaaagggacgcaaaaaaacaacaggaagcgtagaaaaaaaccatgggacgcgtattctgtgcactttaacccacggtgtcccattcacacagctttcttaatttgcagaaaaagataatcatcctcatctgtctgctgattctcctcattgtggtcggccttatcgttttctccgcgttcaatccgttctgaaaaacttccaaacaaaagtgcagcatcggaagcaacttcatcagcagaaaataggacttacaatagttggagagggaaaacaacgttgaaatccgcctttttatacaaatatttttgcattttctggactctttcattcgcaaaatctcatattcccttcccccccctccgcttaattaatcggcctcaaaagagcaataaattttaaatttttgattgagtttttgatgcccttctaattgtaaattagccaaattccaattgtttttcccttatttgtgtcccttctttcttttgcacattctctttgaactcttccattttgttgttctgctagtgctctttttcactataattaacacaataaatgcttttaaccattcatttaattaccattcccccccccccttttccttttgtcatttttcgtccattttcttccgtccctttctctttttagaagaagttgtgcctgctcgccttcggactgaccattctgattgctctcatccttttcctaattattaaattcgggactgggtcatcgtaagctgtgaagttggagtttggaaattaaaccattcgtctggtcatgcacatacattttgatacgatcgctagaaaaacggctaagtccgtcagatgacatggcattggattgnngagtagagaatactancaaaaggngaattgngttttgcatttctctgnntgtaccgtgngagttttcgagtgtttacttttgcatgaaattccgactaaatgatatgcttaaaa

SEQ ID NO: 19740 - DNA, 2377 bp, Heterodera glycines
tttttggaaattttcgatttttttcggaaatagaaaaaattttgggcctaagcgggacatttgagtcccgggcccataactcgtcaggggtcggttttagccaaaaaatgccttagggcaaaattgtagaactttttaagctctatctaatggtatactatatgaagggaaattttcaaaaattttcgagctaggccccctagaaattttcaaaaattttttttgggttgaaaaagagggtgaaaaatatttttctggggtaaattagggtcctgagcacaaatatgatgtttattttaagtttcagattttttggaatattttaaaaattctttattttttggcaattttttggccctcgggattttggcttaatatttgaaaattcataacaaatcgaagggttgatcaattttacaggaataaagccttaaaaatagagaaaaatcaggataattttatggactttatttggaatttctatctaaaaaaggaaaaaagttattccagaatttctggaaattttcgatttttcagaaaaaaattcagaactcggttctataaaggtgtttttgaaattttaaatactgaaaaaatctgcaatttttttctctataatataaattttattttgcatttttatcacatttttaaaaaaagatacaaaaataaaagtgattttggggttcgggaccaaaggggggtgcacatggtttttaagtggaaaatttttttcaccaaaaatcctccaaaaatatgtctttaggggttatttgggccgctgatcacgaatacgtgatcagattttacttttgacatcgtcaagacctcagaatccctgtgtgattggggattctgaggcatcattttttgggggggggggggcgaagttcgaagccgggcggtgtacattatttttctttgtattttttgggttaattttcattacttttaataaatttaaatgtttggttttattaataataaatttttttagtttaattaaattattttttgatgaataatgattttcatttaaattatttattatatttaattaaagaatttcagctattattttaaaatttaattgtaaaatttttttcattcaatttaaataactatcaattattatacatttcataagggaggttcggacccgggcggtgtatattatttttaatgcattttttcgttatcttcaatgttttaaactaatctgaagatttgttgtagattattttaaaaaattttttacattaaagaatttaattatttattttttgaatttgtaaatttcatctaaaatttattaaataatcaatttttaattttcaacgttattttcaattaataaatggaggatttatttttaaatttaataaatttataattcatacaatttttaatttgaatttatgttgtacctcttctaatcactgttgtacctcttctaatcatagttgtacctcttctaatcactgatgtacctcttctaatcaccgttgtacctcttctgatcactgttgtagcacttttaatcaccattgtacctctcctaatcacagttgtacctcttttaatcacagttgtacctcttctgatcactgttgtacctcttctaatcactgttgtacctcttctaatcactgtttacctcttttagtcactgttttacctcttctaatcactgttgtaactcttctgatcactgttgtacctcttctaatcactgttgtacctcttctaatcactgttgcacctcttctaatcactgttgtacctcttctaatcactgttgtagcacttttaatcaccattgtacctctcctaatcacagttgtacctcttttaatcacagttatacctcttctgatcactgttgtacctcttctaatcactgttgtacctcttctaatcactgtttacctcttttagtcactgttttacctcttctaatcactgttgtaactcttctgatcactgttgtacctcttctaacacatcttccaacaatttttgtacctcgtctgagctcaacaacatttaaatacgggcgcgaagcgcccgtttggcctctacaaaattaaacaacgtgcgcgaagcgcccgtccaagcccaacaaaatttgaaaaacgggcgcgaagagcccgactgaggccgcgaagcggcctaacaagctaaaaaacgggcgcgaagcgcccgtcttgagcctcgatgtggactaaaaacccctaataattttttaaaaattcaaaaaaatcactccaaccaattcgatcaatttgaatcgcttcacagcctaggtagcgaagctcaagaagcgcgaagcgctttatcccaagcccagatccgacggttcacgcacccgctagtt

SEQ ID NO: 19741 - DNA, 1703 bp, Heterodera glycines
tattttatcaaataacaaatttatttataccattaacactttaaatgaaaaacgcgaacaaaaaaatcattaaataatgtataaaagtaaaagtaatttttctcataaaatcgtggaaagccattttcctttttcttttattaattattttatataataaaagatgggttataaataaggaagggatgcgagacaaatttcccattatctctccctttcctttcttttactctcttttcttttccattgcaatttactatctttttttcccactccctccttctcccacacacacgcacgcgtccaacagactgctgctgcacagcaacacgcgtctgttcactgtctgcccctcccatctgccgctgcccgcatagacagacagtcatacagtgcactatttcccaccatccctccctctaacctctacatcctaggaggagaaatcttttaccttctttttctgtgctatttcttttgccttcttcttcttcttaactatttattttcgtctcttttctttatattctcttctttttcaaaacaatttcttttcatctcttttcaaattcatttttaacgcaaaactcaaacaaaacgccacacaaattcaaacacggacacatacgggctgtatcgtttcgaatttcagaaattttttattaattattattttttaagttactaaagtgtgtgcttctccaatttgtgtcggtgtcttaaaacgcgaatgatgagtcagtcagcttattccttaaattgatgtgagaaaagcgataatttgtcttttaatgtgtgaccttcttccataaattaatcccttttgtgttattttattatccatccgtctctcttctgttcatattattatgatcagtagcatcattagagcagccaaatgttttactcatcagtctcatctctgatgcgattttcttaccgtcgtcccccaattaccgctcattataattattagttgtttttattgtactgtattaattaatttgttccgctgctgcaacaaatgctgatttgtgattgagtgacccattcattcattattattcattttgttcttttataaatcaaaagacaagctgtgtttatctaatgcatttttgatttttgttttgcatatccggttttatgataaatttatggaaattccctaataattttctctattaatttttttaagaaagtcggaaaaatcatttgaatttattatgtattttcacaaaaaggaaagcgggtttcgcaaaaaatgaattgacgattttaaaccgggatcaggatcccgtgcaaccctatgaaaaaagagattgcttactggactgaaattagtgtaccgaaaagtgaaataaaggcgctaattttcagttcaaaattgcaattttttacgagttcattctcattaaattttgtcccatcaattgaactccaatataaaaatgcctaattaatcgttaattagacaccaaattgacttttaaatgtttttaattttattgccacattttctagtgttatacatattttgctgtgttacctattttgggattctccgttctaaaatgaacgatcattgtgacttgctgaattatacttcctgttcttcagccgaccaattgcttagcattccctcccaacagcccgacccaccgaaacattccacgccataaagtgcgcaattaattaacaaa

SEQ ID NO: 19742 - DNA, 1246 bp, Heterodera glycines
tgccgggttaaacgcacaaaaaacaagttgtttttttgttcattttttctgtttttaggttttcgtatattttttgccatttttatgcatccgatttatttacatatacatatttgagaggttttttcttataagatacatttgatcactgatttgaattatgctcggtcgatcattctcaattcattcattccttctgcggctgatcactgtttttcttcgttttgtccatcactcattgtcagttcagatgacggcccttttgtgatgttttgtccggcttcttctgctggtggcggagacaatgggctaaattaagcaaaattttaattatttaaacaaaataaaatgccttttttaattgctcacccgatgcaattagtggtacgaaaaagccaaacgaagacactgttcaaattgttatcccaattttcatcattcttctgctgctgaaccgccgcggtctccccaataattttgcatcgtttcattatccatcggttgtcccatccctttgttttggccaatgtcagcttttcctttgtccattcgttcaccaattcgaatggcaccattggcattgacgacaattgcacataaaaatgaatttcgtaactgacggaagaaatggcattggcacggagaaattgctaaacaatttggaaacaaaaatcacaaaaatgttgggccacacctccttgaaattgttgatccaatcgaagttcgtttgtttgttgtaacctatgcaacgcaatcgcttgggttgtccatcttttctcggagagtgcaaccatttggacaatgcttggccagcagaaattgttgaatttggcacatcaaaatcatcaccaaacgcagcgggaaacaaaccacaggaatagattgaagtcaattggttgagatcggtgagaattgttggcgaaatgagacgacgcaaattgtccaaatgataaccatcgtaaaagcccaagtggcgaatgttttcagaaaaaatgggccaaatttcacgaacaaaaatatcccaaaccagctgctggccatccatgtctcgtgatgatggaatccacaaatctaaattggtgcctcttttgtcaaaaaatttggtgatttgaacgaagaaaagcgatgacggagtgatcgatgtaactgtgaaaatggaaggaaagcttttattgtcatagctctctgattttgatttacccatccgaagacgctaaaaaaggattttgctgggcaacggacggtc

SEQ ID NO: 19743 - DNA, 1628 bp, Heterodera glycines
aaacgaattttcaacacgaattaaaaaggagcggatggccaaaaaatcagaaatccaattaagggttttacctttaaacccaattttatgaaccttatataaagtaagctatggggaataacatcaaaagcttttacgaaaatcaatataaacacagtcaatattttttccattgtaaataccgtcaaaccaattttcaagagttaaaataagttgggtaacagtagaacgacctttaacaaacccaaattggtgtagggagattaggtcatgttttaaaaggaaactagtaattgccctgacaacaaatttttcaaaaattttacacagtgaacatgtgagggcaattggtctatagttggtgggacaacttttatccccttttttaaagagaggaattattatagattttttccaaaaggtcggtaattttccggtatcaaatgagattctgaaaagttcggtaacataaggcgcaaaagaatttattaacctgaaatttataccatccggtgaagtattatttttatttggtaaagatttaaggacccggccaacatcaacaacattaaattcaatatcattaattacaggagagtgacaaaaatttttgcaaaaatttcagctttttgatcaggagaaaaaataactgaattatcataatttaaagtgggaatcttttcttcacatttgatatattttcttaggtacgagaatagtttgttcttaccaccggatagttttttattttcacgtttaccaacaaagtttctggtttggatactaatatgaagggagatacttttatataggtgttcatatttggctttatctcgtttcattaatctgaatagtctggccttctctttaatagatgctaataagtgcgctggatatgatttagacttattcaaaaattttgtttcaggtatagtaatactcaaattttccaaaacaaagtcagtgaaaattttgtatttgtcctccatagtgtagaaaattttaatttcagtttaggttttaaaaaattaattttaaacaaaacagcggaatgatctgaatcaaaaagtccaccttcaacgctagcagcacttattaagtccttatttgtacataaaacaagatcaagaaaagattcacctctagttggctcagtaatgcaggatgtcaaattgtatttgttataaaaactataaaacaaatgtcccattttactgattgggactaaattttccttgttaatttttaaatccttagatccaaaattaaagtcaccgagaattatacaattctcggtaacataattatccaaaaaattaaaaagtgacttagctttactaaaactgacagaggggggcctataaattaaaataaaatttaaagattttgatttttgtagttgtaaaattaaaatttcacaaccgtatttagattcagaaagtttgataaaaaattgtagattatttttaaaaatgagggcaacacctccgccctttcggccagtcctattggtagaaagaatggtatatttttccaaaaatttagaatgaaaaggaaagttaacaccatccgaaccccatgtttcggttaaagacaaaaaatcgaaatttaaggattcgaaaacctgt

SEQ ID NO: 19744 - DNA, 857 bp, Heterodera glycines
  misc_feature (765)..(765): n is a, c, g, or t
  misc_feature (811)..(811): n is a, c, g, or t
  misc_feature (813)..(814): n is a, c, g, or t
cttcctttagtaacatttcaggtcgtaaaacgtattcgcgagaagtttacaagcctacagaatgaccaacagttcatgttgaagcgacagcgacacactgatcttcatgcaaaattgaacgccatcaaaaaggcactggaggagtggaacaaaagggaggaaaacgatctctattagtcgagtcatttgctctgtgatgtatgaaagaagtacatttccccccttttattatattatgggtacttcgaggtatgactgtcgctttgtgttttattccttttgttcgtctgaggacaggttgtagcgaaagaggaaattattaaaattaattacgtacctaataactttttggctacacctgttctaataattgacatagtattatggttagttcttctggcacaacactcattaaataacgacgagtatgccaatttcaattgtgtcttttcattctctcggtgttttatccaaaagatgttaattctcttactacaaatgtaatctaaaaaaggaatggtccgtatttttactttctttctcaaagggattatatgccttatattctcattattctaagtgttttttgatagcaaaagatgggaaagaaaaacaggctaaagcagttgctaggccgtttcaacgtggacacaaattgcgaattaagaggtgggcgaagagcgaaaaggacaaaaaatgtttttttaatggattttaagtcttgccttattctcttggtgacgctgtctgtgaaatgcttcttanagtcgatttaaccacgcaaacagtttggctatagcgaacgtccttnanntattggatgaggtgagcaaaaaaggattttaatgttttgcaaa

SEQ ID NO: 19745 - DNA, 1415 bp, Heterodera glycines
atcaaattttctgctggattgtccattacaaattgtccgggaaccttttaaatacctgtcgttgttgtttgaacaaagttggcttgcatttttatgttcattgattatgagccgactcggccttgtaaagtgcgtcgttggatctcgaaatacctattacatttacatgaatactgattgtgagtctggttctgtaaaaaaacgcttcttacaagcgttccatcattagacgaagatgaagcgccatttctttgcgacagagaagcatttcttctgctatttggcatctgaaccgaagatttctaaacggcaagaagtgagggtgtttcacggacaatccgagtcaccgtcaaagatcgtgacataatttcgtgtttgttggtctctgtttcggtcattcccgtgtcattgtcttgttcgtcttggtcaattacgagactgtccaaaagtgagcctggagttgatgagagagcagcttcgggagaaaagtcatcttcctcttttttgtccaataagtcactgccaagtgcaatcgttgaaaattgttgtggtatttttgatgagatgcattccaactcagcgcacgcattggtcgaaatgccacatttttcaaggtgctaaataataagattccaaaaaaggccttataaagagtaaatcgaatgttgtaattgttccctcacataaggaaggaaacgttgctaggaaactgattgtgagaggagggacagaataatccctcaaagcaaataatgacgaatggccaaatgcttttataggttcgtataactcaccgacaatgaaagactcgcagaataaacagttgcacattttgagggatcggagttctccaggacaacaagttggttgagccgaccatttttcacttccatgtcttaaacaaatgggtgagggaaaggaaagcaaatgctaagacaaaagaaatgcctagaaaatgaaatttcggattttcatttgctccatcttttgtttgtgaagaatcattcgaggctgagaaggggaaatgcagctgatgcgaaaggtcgaactgcgaaaccaattcaaagggttcccaacgaatcgaagccctgcaaaattcaaaaaccaatgaatgcattctgtcagtgtttctaaacttacacttgtctatgcgggcatacacacaaatataatccacaatggtcaaacaaaggcagctaacagcagaccaattgaaaagttaaatggcggttaaatcaaaataaaaagcgttttttcggactttttttgttcgctttttgcgaattcgtccgatggttggcgacgccgcgaactttgagccgttcagaggtggggggattctgctgatggaagagcacatttgtggagaaaagctaaaaagaaacaaacaataactgagaaaagcaaacggagga

SEQ ID NO: 19746 - DNA, 973 bp, Heterodera glycines
atggctctgtttttagtataaaattttatttttaaataaaaaaaaattttcgtgtggaaaatttaaactttttcatgaaatatttaaatattttcaaaaataaattaacaaaatcgcccggaaaatctgtaaaataccatattttattgataaataaatttatataaaattatttttgaaattttaatccaaaaaacgaatagattattaaaataaaatataaattgggatttaattgccaagaaatgagtgagtgccgtcgaataaacaaataaatgaatatttaatggcaccaaatgaatgccaacggcggcgggggatttttatattctccgcacaattttatggacagagcagacggaagagaagagaataaaaggggaaagaatcctccaaaagcgcagaaataataaatagaaaaatgcggcacaaaacgaagcgacgaaagggtaaaaatgggggaaaatcaacggaagggacgaaagagtcccaaattggaggggggggaggcaaagaatggcacggcacaatcagtgcaatttaagaaatattaagtcggagggggaatggcacaggggattaagctgcaggttgaaaaaggaaagctgagccaaattgggaacagaaatgaccaatcgaaaaatgtcgggacaaatgagtccagaaaatgccgtaagaaaaagtaaagggatggcaacattaaaatgataaattatgtcgccgaaattgtcgatgaaaaatattataaatgaatggctaatgagcaaaaattaggagggggggggggggggacgttttaaggagagcatggtcctccacagaatgccgaaatgtggacaatggccgaagacaaaaaaaaaaaataattaagcgtttccaatttggcagagctgggcctgatcaggacagggccataccggccaggccacagttggggcaggaaaagctgagaagtgcagtgccctaaggcaaa

SEQ ID NO: 19747 - DNA, 1619 bp, Heterodera glycines
aaggtggaaatcctaattaaaattatttttaattgccaattaaatttttggtaatcaatgactctgccactgatcactgattgattgatcagtctatctgtctgtcttctgtttgtttgctgtcccacctgaatgtccgactgtttttgccccaatgctgcaccgtcatgatcagcagcagcagtaacagttccgtcactgcacacattcactgtagcattgtcctccttgccgtccaccgaggacacctttattaggcaaaggaaaacaaaatcaaattcggcacaattttttggcatttcattcatcaaaaaacgccacgagggaaatgccatccattaaatgtggatatttggagcttttcatattcatttaatccaatattgggcacaaaagaacagaaaaagtggatggactctgatgagataaaataaataaaaataatttaattattaattaataaaaatttaatttgggacgccaccaaaaaaaaaagaaaagagaaaaaagcctgcctggaatctgctgctcatttggtgatttgctttttctaaggattttatgctttatcaatttgcagcaaaaaatctaaaaaaaataaataaaaaatgaaatttaaattaaaacattgaaatttaaattgaaattggaatttccgccggagaaatgataaaatgataaaataaaagcacaaaaatatgaagcaaaaatggataaaatgtgaagaaaaaacgaatggaataattgggggatggttcagaaattggagaaattggatgaattatttgctcaaaaagagagaatcgattaaaaataattgcaaataatcaattggcaaatttttgtttttaatgattttttgcgagaacattggcacttttagaattaattaaaataattagaaatggtcacgcctttcacattaattaattacctctttaattaccccgtggtttgaaaataatgcaacaaaaaccgctaatttacgttaaggtttcatttattaaaaattattgtattgctgggataatttgttggttaattgtctcatttggcaattagggctaagccattattatacccatgtaattaagatgtaaattaattaatttcgctcaattaataatttatttaaattaaaatgcttttcaaatgttagcacctcgaaaaattcgcatttttacagctgctgaaccgcggataaatttcagtgatgaactaattgtaagtgtaatgctaatgaggggaaggaagaaacagctgactacttaagaaaattagggggaaaagggggagaaaataaatgaaaaatcgagggaaatgttaattttttaaaattaaattataattttttaaaatgccaaaaatttaatggcaaaattatatttttgtggcaaaatatgactcttttttttgtcccgctgaaaagaaaaattggatttgctttccctggcggagaataattgcatttggcgggatgacttttgctcaagagtctcgactttgtcacggaaagcattcaaagaaaaaaagtgaacgaaatataatttattaaaattaaataaaaaattattttttacggcgaaaaaccctttcaaaagaagcggcttcttcaattg

SEQ ID NO: 19748 - DNA, 804 bp, Heterodera glycines
atatttagcctcgtttaaaatgactggtggggagaaatgcgagcaatttcatagaaacctcagaaaatttcgaggcaaaaaaaaccttgtgataaatcaaaatctgttattttgattttcaagctttacgctatgcctcaaaatgcccacttttaaaagtttcaccgaccttttctggttacagacttgacgctctcttatcagactttcttttcttttagaaatgaccccggcaagttcattagtgttgtgctttctgccctctcggcaatggtcaatctcgaggtggcacaaatcaacgtcctttctaaagtggatttgctaacggacaacgcgccttttcgtctggaatatttcgaggagctgcccaatttaacgcatctgaccgactgtcttaatgtatctttgaatttaaagtttaatgcatatctttttatttgtttttcaggatcatcctgccttaattcgttacaaaaaattgaatcagtccctctgcgaaatgatcgaaagttatgggatggtcaattttgtatcgctggacgtccaaaacaaagaccggatgggctttttgttgagattagcggacaatgcaaatgggtttaatctcgcaaatgttgaagatttccggaaagttgtaatgaatgattttagttgaaattgtttgctcttaaagataaaattatttttaactcaataattatgagatatttttgggaaacactttgtcagttggttgttttgctcggaattaaaattatttttaactcaataatatgagatatttttgggaaacactttgtcagt

SEQ ID NO: 19749 - DNA, 1751 bp, Heterodera glycines
gaaattggaaaatcaaaagaaattatgcttttcggactttttctcattcataatatgcaattaacctcagaaaaaggggaaggaaagcggaaaagagaaggggaagagagtgatgaaggtcagtggagagacgaggcaaagaaacgtgagaaagtccgtgaaaagattggggaaaatgagcaatttaaggccgaaggtgagcatacggtggaaagggtacggtgggacggaaagggtacggtaaaaaaagtgcaaaagaaacaaaaggggaaaccaagtgtatatgtacattcattgagctgaataaccaagaaacattggacattgtcaaccgtttgctcctctttagactgccctctttttgctttgccatttgccaattgccttttcatccaccgacattgacaacggcgttttgggtaattgctgaaattctgtccttttttggtctgttcacttattttgtgaaattctttttgtaaaggaactcccgaagttatttgtggtcgagattttgtccattttaaagtcgtcacaaaaaaggtaaaacaaaaggaaaacaattgaaatgaaagcaattaagcctttcggaggccgtgtttatgtcaaaggcgaattcggcaatccgaagtgcgtggagagtgcggggacgacgagggatggcacggaaagggagggagaagtcggcatcggacgggagggagtcgggaggaaaaacgcgccgaagacggaatttggtgggaagcggaggaatgcttaatgggccaagaataatcactccgttaaatccttcagatgctccggccaaaagagaaggtctgaaagagaagaacgaatactttggacaatccgagcataatccatggcgaccaatcggaacagtgccggaaggggaggaggaggagggggaagaagccgcgggcgaagggacggcacgcggaggagcgaacgcggcggaggaggcggcggacgaagagacactgcgacagctgctgctggtccgagccaaacaatggcaaacaaagtgccggaaggaatttaggagctgcagaagcgccacaaccacaacaccaacggctcccaactgacaatcccttcccatttgcccggcttcgcttccgctgaccaactgaagcgttggaggagtttcttgaagggaaagccgggactcgacgggcagggctttcgccgctacggcagccgactgagcccagacgcaaacggcgaatgcccattggtgaagaaaacaaaggccgaccaatggtgaatgaagtccccttctgaaggtgtgtcctccgtgtgaggaaatgaaggacaaagaaagtagtgggaaaggggcgggcggaggcgggagacagcggagattggccaaagagcacagtgccgagctgaaggtgcccttgggcgagtgcaacacgcgacgggacagaatggtaattgaggcagtgggaaacggctaattgccgggggtgcactaattgcaaacttacttaggccaaccccccggggatgcaagtcagcttcaccatcgtcgtcagcttccaccccaacttcatcacgcgtctgtcgtccgttctctccctttctgtcatttgtccactctttcaggcgttgaccgtgcttacaacatccaatgtgcttatcaggtgatgaaagctttactttttccgtgcctttgcttttaatgagtgccatcagcaggaacccgaaagaattctcagtgctcaaatcgatgtgaggtgagtttaagc

SEQ ID NO: 19750 - DNA, 1494 bp, Heterodera glycines
caatttaaaagtgaaattcatttcatttttcgaattgccatatgcctttctttctccctggccaacgaatgtttggccgaacatgccgagcccccgtcgttgttcatcatcacactgcccgtgccgcccttttcgctcggtgcgtttccgccgcctgcgctgcccccgccgggcaccgccgaaacggcgcccgtccgttgggcctccaaatcatcggacagcaccaaagaaagggacttcttcagaagtgggtcacctgaaagagctgaaggaataccaatacggttaacctcttactgtatattaatttcaaaaaagtcataaatagggttataaattgtatgattttgcatattttttctgcgcatatgctatgaagaaaggggctcaaaaatagcatttctacgttaaaattttttgatttggtgaaggtttttagtgcatataaaagcatattttgggggttttcgagaataaaagcatattttgccatttttgggcttttagagcatatttcggtcatttttagcaaattttcacaagaaaaatgcgaaaaaggcgaaaaatacacccctaaggatcgaccttttgtgaatttttaaaaaaatacacccttaaagatcggaaaatttttaattttctgtaagaacttaaggaaaaaattatttatatagaaaatgtaattttgttttagcatataataaaaattcaaaaatttagaaattcaatatttttgcaattgtctaaaaaatgctccttagtccttgttttggtgttttcaaagtcaattcttaatttatagacaatttttggcatttttttgagggttaaaagccattttgggtaatttttaaggcatattttagtgcatatttgggcatttttccggtttttagggcatatttgggggatttatcgtgcatattttatgcgcatatttggcattttttagtgcatacaacttcgaaccctagtcataaatcaattttttggttagtgtaaaattaatttgaatttaaaaatatgcaaatgttaatatgagatgatacgaattgaggaatggaaacccaattatataaatcattttaggattttgagttcatttacgggttaattgtgctatttgggaattcggcaaaatgcaaaataggaaaacagcataaactgaatccgacttctacaacattctgcaccaataattgattggaaataaacaattaaccattaagtattcgggaataaattaattaattagcgtgttccccgccgtgcttctcctttctgactttcgagtcgtcgctgttgcttcagccatcccagcccggccgggcccaaaatgcgctggaggatggcttgctcgcgctgcggattgttcggcatgaacatgccgcccattgctgttcaacattgcgatggtggcacattgtttgtgcccgggacggcccagcgcggacagcgagtcgggtctgcgcagcgtgccgttgcatgcgcgag

SEQ ID NO: 19751 - DNA, 813 bp, Heterodera glycines
  misc_feature (804)..(804): n is a, c, g, or t
gtcaattaatataaagttaattctgacgaaagcggcgttaagaacatgggaagtaaattgccaaaactaatttatggggagaaaaataaaacgaaattaaattaatttggggccaaaaatgtaatttttatgtgaagagataattcatttttagaatcgattttggaccaaaagtggcacagaatgcggcacaatgcctatcatttgaggagaaaattgcaaatgtaattggcctgtgccgtcaaaaaaaaatgaagaatggcatttttgtgatattaacgataattgcataactttgccttttaagagtcataaaaagagaatttgccaaaaatagacaaatgccaaaggcattgccaaaaagagaaaaatgcataaaaaagcgatttggacacaaagccaacgttcgctactttaaatattggccaaagaggcattagatcgaaggcagcttgcccgggtaggggacattaagttgtcatgagctgacagatgcaaaatggatggatttcccccccccccccgtggccaaatgttttgggaatggcgtatgccattgcctcgggggcgacccgacaagccggcgctgcccctccgcgctaattggcttttagcgccgacggctttgtgccgtgccaacgaagccattgggcaccatcgccctggggggggggaagacgaagaaatagaggaaaagggaagagccgggcaaaggtaaaaacggtggggagggggggagagaatggcaccaaaaagtgagtgagtggcgctatagtgggataataatgaatacttttcaacaanaaaataaca

SEQ ID NO: 19752 - DNA, 1183 bp, Heterodera glycines
aatattcttaattttcaaatgtgtgaggatgaatacaaaacctttatagatttagcttattaaaattgaaaataaaataaaacaatgcaaggataaacttcaaaattatataattgaaaatagaagaacttgtgaaaaaggaaaataaaaataatttaaaacagagtaataatttttatgattactagttaggatacgattttgtgctctaaaatctatcaaaataatgatgctttacaaaaattcttgtccaaaaaataaagaaataaattttggagatgaatcttaatgctcaattttctgaaaattcaattgtctttggaggtgtatttttcgttttataaattttgcggaataagtttttggcttaatgccaaaataggtaaaaaaagattttcctttttttaggaaaataagtataaaaactcaaaaagtaacttaacaaccacaaaaactattttgtgcatttcagaccataggaagttcaagaaaaccaggtaaaaactataaaaatcgtatccctagtatttgggacgaatagaaacagaaggttccgagttagaggccgatgaattagaaaaccgaacagcttgatcagatcgcggggttttgcgacgacaaagcagataaacaacaataagcccaaacaacgcaaggaaaccaactccgatacccgaaacaacgatcagaatggatagtgattgtgattcgccacccgattgtcctaacaaattgtcaaatgcgacaaaaattaacccagaccccacaatctctgctccttttttacgagggcttttccgattgatgagccgcctccttttgccccgcgtttcattcttttggccgctacatccgtttgttcatgcttcttttcttttggtccaccatccatttccggttcttggttctcagttttatatattttttaatataaattttatttacctggcatttgcttgtacggttcaggtttagaaccgcccgatttaacggcgcgatgctgtcgcagaacagcgcagttcaatgcgctgatgtgcgcgatcagcagactgaaatattgacaaagtcaatgattgggcagggttcaacacccccccccccccccccaccctctacaattactatacataagtgccaaattgttcatgttgtcgtcaagagtagggcccgcttgtttggatga

SEQ ID NO: 19753 - DNA, 987 bp, Heterodera glycines
  misc_feature (26)..(26): n is a, c, g, or t
ttgtttctataatttattgttttttntaatggttacttttttaccaaagtttgatcattctatgggaaaaagatacttttttcttacagaattgatcaaagttgatttgttttggaaaagataattatttgattaaaaaaatattttatttaccgagtttttaccgtttattttttcaacaataataatttttattacaaagttaattaacctttgtagaatttttttaccatttctataaatatttacaaaaattcaaaaactgattaaaaattatttattgggttgaaaataatgatggaaaaagtacaaaagttaaaaattcaagtttccacgagagactttattctctgttttatttttttattttttacattcatttatccccttattttttacttaattttatttatttttaaactcattttttcttgcagtaatcgtagagcatttctgcgacttcattcacatcggttttttaaaaagtgatgtaatttatatttattttcgagttttatggatttcaaaattatcattttttaatgttctggttttgacacgttaaaatctgagattgtttagataattaattaatttaaaaatatttagaatatggtaattgtttttattttaaattatttttgcctcaataattttgttaattttactaaactatgtatatttatcatttttagtggcagctctaaaaaacataatgaaaactgttaaagttgctatttatatttagctaatatgttattatttataataaattaatttaaagcattttttcttattcttttttctttaaaattgatttaccctcgaatcttcgaaaaatacttttattaaaatattgttattacaaacagattagtgatttttaaaagtgcaaattgataaaattttttgaaagttagcaagctaataattcaattcaagggatatcatatgaaatttgtctaacgccacagcatctactgataa

SEQ ID NO: 19754 - DNA, 2564 bp, Heterodera glycines
  misc_feature (61)..(61): n is a, c, g, or t
  misc_feature (123)..(123): n is a, c, g, or t
  misc_feature (201)..(201): n is a, c, g, or t
aatgtgctcatttttgaacaaaatatgtcaaagcttttctggggagtttgccccctgttcnccgatttttaaaaaaaagctccgcaaaaaatagtttgaaaaaaagttatcataaaaaaattngagcgtttctattcaatttcgttaaattttttggctctaaattctgagggggcatttcgttagagtaactttctgacnccgccccttgtccatgtattttgcctggtgctgcttgacctggttgatcagtcgaacaaagcatcgatcaactccgttcgtcatcggtctcctccgctgctgctgttgttgctgctccttcgtcgcatttattgtcattcgctgttcgtccagcgaagagcgacggcaccactcaagcaattgcagcaaaggcatcagaatgggcttgtggacgagcagactttgagggcactgactgctggtcaacatgtactcgtacagacggatcaacatcatctgacaaaatgggggagggatagcaaagggaatcctcaaaaaatattggggggggggaacagtgggtaattctggcccaaaatttgcggattcaggtgacctcattgccgttttaatcaaatcgaaattgtataaaccccaaaaaatcaagaatgtttaaagcgtttgttctgtgcttctcacctgacatttgggccgcgcattggacggaactttggtcgcccaccgatgtacttttagaagaatttcctcgttgaaaaattggtccaaaatgggcccaattgacggttccgactgtgaattgacctccatcaccaacaaatggcaaatggtggacagcaattcgcagacctcaagaaattataatggacaatccatttttttgaagcctcaaactttgtccaatgaatcgcgtccaaattgcccggcggttatttccagcaattcctccaatctgagaacgcaaatgactattagtctttaaaatattttttcaaaggaggtcaaattctgctgacgaatctcattgtccgctgagttatctatcaaaattttcagcgcctaatggaaccaccgactcttactcttttttaaaaactaattttttgaagaattttagtttttttaaacagaaaaatcccttaaaataaccttgtccaacttttctccaactgcgtctcccatgcgcttgggtcagaggcgaattccacagaaagcacaaattcggggaggaaattcgccatggctccgtcataacttaaggcaacaatgagcaattatttaattagtattatgtaaatgtaacaaaatgggtgatgaagcaaccaatttaaggcattaaaaataattaattctttatgatttaccccgtgcctaattcggcagtgcccgccaattcgtctcggccaaatccgattggggagggggaggaagcactgttagaagagccctcggcatcagatgaggcggaaactgaacgttcttgggaggaagtgaggcgttggaacagtcttctcatcaaatgaccgaaaatttaaaaaattgggaaatgaaagagggaaaaggaagaaaaaagaataatagaagagagtaaaaagggcaatacaaaatgatgtattctcggtgccatggaaaaaataataatttttaaccattttcgctaagtttggcattagggaccaaattttgcaaaggaaaaaacatggaattattgggatacgttaggcatcgccgagaaaattaaggggtcaaatttattaaatttggaccgagttaagagcccgggactgaggtgaccaaatggctttggatcgaaccgtcaaaagcttaaaatcagggctcctagatctgaggttttatcctcattttgtggttttttgataggtcaatgaggatttcttttttgaaataagcatttgaggatttttgtggtttttaagttgaggatttttgaaaattttggggaaaattatcagaattgttaaattttatgattcattttgataaattggcataatgttttgctaaacatttaattggttttttaatagagttcaaaacgaaagtttcaccctaattttccaaaaaattttgctaaatttaaagtttttccgagatccacaaaattaggtgcaaattttgttttattcagagaacaatggtccaaggttgatgattttaaccacattaatatgtatttgtttaaaatgggttaatatttattaaaatatctctttgtaactttattttattaatatcgagcattcgctgtgcattaaattcttaaaaagtccatttgtaattgcttcattgttgttgttgttgctgttggtggccattgtttgtcgttgtgtaagggccgatgtcacgttcattgttaaagcggaccatcttaattaagtcccaatttcaacaatcattaattttaaatttagtataaagcataaacataaaattagaaaagaaaactcgctctaaaattcgataaaattaatttttgttttttaaagaaaagaagttaaaacaaaatttatgaaattatttgtttaaacatcatttatcagttatttttccgctcttttttactt

SEQ ID NO: 19755 - DNA, 904 bp, Heterodera glycines
tttcgtttaaatatattttttttcgttttttagggcatccaaattatggcaaattatcaacatgccagcaccggacagctttcattggtcagtaaattgaactaggtaattgactggaggggctgtcttttttggagtttgtgtgatttttcgtgaatttggcacaaaaatttaaaaacaaatgcacttgcaaatggaattgaacttttcaactccaaaacgagaatttaaccgaacgagccacgcgattctgttattgagaaaatatgcaactcaacaaaattatttgaaaattttgctcccttgaagaaaattcttttctttccaatttatgtcaatttattgagaacataacatatagatctccgtctccatgcaattcggcggttgtgttgcgcgtgtgttcacttccgtccaggagactgccggcgattggctgatcattgcgccgtttgtgctctcttcgctgcttaacggaatgatttttttgcaaattcttttatatgccaaaaagaaaaaaacggattaaaaaattgttttatgagtgaaaaatgtttgtttaaccgaggaaataaattttttttgcaattctaaattacctatttatgtttttatttgcaatacataccgtatttactgaattagacgactcctgctgagggctctattttcaattttttccatcggtccatatcaaatttttctcctatttttaaatttttgattaaattctattaaagaatttgtctttttagcctatttttgttaaataatacattcttaattgacaaactatcttggtatatacaacaggacaaaactgaatagtttaaggtggtggaccaccggtaacacaatttgaagaattttataaaaattgcttacatattagaaaaaatttatt

SEQ ID NO: 19756 - DNA, 796 bp, Heterodera glycines
gaagggcgaggggggagaagacgatcagcgtcgggatcattcgagggagtgatcagaggaagatgatccctcccccccccttcggatcatcatcttcatcatcactcagcagaaaagtcccaaaattccctaaaactgtcagctggcgccaaaggcaaaagccgaagagcgccttctactttctctcctcatcaccccctccccccccctttccgtcccccaggctttgctcctcataaatcctcctgcaaaatgtttatctccgcagggacaaaaaattggatttactattgccatctccgttggactttttggcacacatttccggcacttggccagcagagaaaaataaacaattttgacaatccaaaaaagggagggactgatgagggggagagaagaatgaagcagcagattttaggagagattattagcagcagggtgacaaaaaatgaagaatagaaaaatgagaggagaaaagttttaaaatgggggcggacatttaaaaaaaacatttgcattaatttccctttgtcactctccgccgatgattttcattctttgaaccgacgaatgaatgaacggaagcaaatggaaaatggaagaaatgatggacgaaacaaattgagggggggggggggcttttgagaaagggacaagtggagctaaaaacaaccaaatgagcaaaagagggggtgaagggggatgggaatgttgcggagagaggacatctgccggaggaggacaatggccgagtgaatagcgaacgcattcgtctgcccccccccctccctcg

SEQ ID NO: 19757 - DNA, 1661 bp, Heterodera glycines
  misc_feature (1653)..(1654): n is a, c, g, or t
aagggaaatagagaaaggaaatgagagaaaaaatggaaaagttaaaagaaaaaaagagagaaagggtaagagaaaagcgaaaagggaaagaaaaaaggaaaaatagccaaatgcgcagataaattaaaaaatattgtttaatttagaacaatatctgaaagaatcaaatgatttcgattgaattttaatttttaatctgtaaaatggttaggtatatgtacatgttccaactttttaacctttccctccccagcagcagcagcaggtgtctcaagtctcaattggtccgattggtttttcaaaagtctttctctcaccacagtccgatcacggaccatacccaaaaccttaatttctatacaacattctcatttatttgtaaggtcacctaacatattcacggcatggaaatggtggaattttgatcgaattagaaccccaaattggggagggaagggaagggagagagtgatcggtggtgcggaaaggggaggaggaaaaaagagaaaaaagagagagagagagagggaaagagagggaaagagagaaaaaagagagagagagaggaaaagagagggaaagagaggaaggtcaataaaatgccaccacaaatgttgaagtacctattcacaaaaaaggaataaaagccaaaaacaaagataaaatttgactcgttaaaatgggcaaattgaaaaggaaagttgcgtcgtcggcggaagaaagtgtttttctttgtttttgatcctttgatcatccgtccctcctcccccactgatcatcccccttttgtatgtctcccatttgtccccccccccaaattcctacccattgtttgtgttgttcgtttcttgcgctcgctgctccaatggaccaatgattctcttctgtttgcactcgctcaatcactttttgtagtcattttgtcaatacaaatgaccaatttaatgtttgatcaatttgctaaaataaatgaaaaggtaaaaaacaaaaacaaaaatataattagtggtgccattgttgtaggatttgtccatgctaatgccttttttgctgctttaccgccataactatccatccatcagcaagaaatgagtaatgaggagctaatgggagaggagggaaagggaaagggcaacggacggagggacaaaagcaaaggaagaagcagtggacagcggaaagaggaggacgggactctcgagggcataacaaatgtccgtcgccggaaggagcggcgggggcaaataaataatgatgccgcccccacccccgccctttccccctctcttctctctgtctcatccaatctctgcctctttcccccctctcatccaaaatctctcttctgctgctggttgtccgtattatttattgactattaatttggctcccgagaagtgacattgccataattcactcgagagcgccctttcatttaatttatttctgtagttttttaacgtaacaaatacatattgggcgccgatgagcatataaaaaaaagttcatagtaaagacaaaaatttttcttattttatttaaaaaatttcgtcgttgcatattctccgagataaatttaaaaaataaaaaattaattgaaattgtcaaaatttgcaataaaatattatttcttatgcgagcagctggcataanntttggaa

SEQ ID NO: 19758 - DNA, 1731 bp, Heterodera glycines
  misc_feature (246)..(247): n is a, c, g, or t
ccccttccctaaccctaaatccccttgggaaaagaaaaaatttcctttgtaaaaaaaagggcttttttttttcttccgattttttttttcattaattgaacaaaagattcgtaataaacttgaaagtttcaaaaaaagtccggagaagcgttatttgtcagacatttcatacgcaactgaggaggccgtgaattgggagtggaactcgttgaaccgaatgccgtaacaacctctgacagcgtgacnnaacagaatttgaaagaggctgaactctcaacagtgacctttgagcgcggaaaaaccaattatgggaccgattgcctatggttgaacggtatgtttaagcgccgcaaaaaataataaaaaataaatttccaaactattcaggatttcgttttacacaccactcaggaaatcgctggagatgcacaaatcgcagttgctcagcatatataaacatcacaaacaacggcgaaaccggagctagtggaaccttgagtcaaaaagaacacaaccacctcccagcacctcagaaacaacaagtttgtataaatttaaaaccaaataattaatgctttgttaaaggcagagtcaaggcgacagaaaatcaaagaaagtgtcctggccgagccgtgtctgaagcccacacgacttttggctaaagtgaggcgatcagcaacggatgaagcctttgttgccatgagctccaacaatgcgttgactgaaatgatgcggcgtgagaagaaaaagttgctgggaaacgtcgacgtgcaggacccactggcctttgtcattccagcaacgttacgcgaaaaacgtggcgaagacatcgtcttgtatgacagtcgcaatgtcaggcaaggcgaaaaggacgttgtccttattttcggcagtgttaaggtacattttttggctataaaattctgtttgttattggcattcctttagactctggacattttgcgccaatgtggcacgtggcacctcgatggaactttcaaatgtgctccagcgatgtgggagcagtgcttcgtcattggtgcttcagtgcatcagaggatgtgcatcagcatgtggtgtctcctgcctggaaaacagcgacgctactacgaagaagcactgaattttgtccgtgaacgcacctcaccagaggtcccaggcaaaggttaactcttcgatttacggaaaaggaataaattgaaaaattttatttttagttctttgtgactttgaaaaagccgaaatggcggccgtccgcgcggttttccccacggcactgattaagtgctgcatgttccactacgggcaaagcctgtacaggaacttcaaacgacttggtctcgtgcatttgtacggcgagaagacagaatatggtgaggcagttcgcaacacattcaggtaaaaaattaaatttagatttaaatcataattttttccagaagggttctctctttgccgcttttgcctcccgacattatcagaagagctttctcaattatcgtggcgtcttctcctcctggaatgccagtgttcttcctttacttctctcgaacatacatcggcttgacacagcgccagttgttggatggtgttaacgcatttggagataatccactcaatttttcacccattggcaatcattgtttgtttaaatttatgcattttatttccaaaaatttaataattagctgcactctggacaacaatttcgaccatcaattcggaacacag

SEQ ID NO: 19759 - DNA, 1924 bp, Heterodera glycines
  misc_feature (1896)..(1896): n is a, c, g, or t
ccccctccctttttttaattttaaataaaatatttttggttttttcttccggtatggttcggtttccctgcacactctcgtagttcacttggtcaagagtacacctcgacaatgggcggactgttattcgaggtaactgcaggcatagggcccccgctcagtggcgggtctcattcgccgtgcaataccaaatcgctggaggcccatctgttgaattaatttattgaataaatttaataaagcatgagaaaataatgaaaaacgccaaattataaaaataatagcaaattcaatattcaattaagtaaatgagaaagggatttaacagctcaaatggactgagatagacttgagaccgagaagaaaaaatgatcagatgaattgtcggtatcgcattcccagaatattttttcataaaaatggcctctcattatgacagaggggaaacgaccagaaatactttaacaaaacggtacccccccccacccccgcccggaatttgaaaacatttcgaattttacaatatttacctggcacaactgtacgtaatgctgaacacctgctcactgaagaaaagttagaattttttttattatggattaattttctaattaaatgcaatcaaaattaattgttttatttgatcgcaccgacacggctgtctgcacacgcagtcgggctgagtggcagaccgcgcagccgctgtgcatttcacgacggagacactctcctgcaaatttgaatttaaatgcattgttagtaattaattaattatttttgctaaaaaaactttattgctggtcctaaaatgataattgtttctttaaaacggaatctttttcagctgatttttcattatttcaagcaattctcatttacaattttctaaaaaatatagaatttttatgcgtatgaattccatttttgtgttatcatttaaataatttcttgaagattaacactaactcagccgcgggtcgcccacgggacaattgctgaagttcaaatagcgaggaaaacgcgggtcgccacatctgttgatttgccaaaaatagaatatttgcagattaattatccttattattattaatttattattataaattttattcctagtaattaatatttattaattattatttcatttattataatctgtttcccgactgttcttcttacccgcactttctgaccagcatccgttggatgcacgaacgttggcaccccttcagcagaaggggattttcaataattaaattcgctaatttaggttatggatttgtcacatttggataacttttgattattacaggattttgcaagattttacctcagtggaatattccttgtcccgataaatatattcatcagttttgccttgctcaacacattcgccgtatggacttggcaaccgattaacacatcttcaaaattattatatatttttatttaatttttaaatcattaagctaatgttttcttttcaaaataattaaatgtttttttattactcacttcaaacggatgccaaatgagctaacgaagccagttggagcactaaaaataatttatttttaatttttttgaaaataagcaaattcattcctatggccatgtgtgtccggaaagggctgttcttcaggactaaaaacaagaattgaaatcaaaaagtacagtacgccacgcattgacttatgcacagtaatgcgaacaccggcagcttctgtcgagggcaaatagtcgctgacattgacaaaaacttggaaacggaggcctaaatatttgcaaagatttcaaatttcttaaatggcatttttcattttgttttttaattgaaacgcatttttaccataatttggcccggctcgttcactcaacacatttttgtcccgggtnggcattgaatgtgaaacagttgccataa

SEQ ID NO: 19760 - DNA, 2389 bp, Heterodera glycines
  misc_feature (33)..(33): n is a, c, g, or t
  misc_feature (2376)..(2377): n is a, c, g, or t
ctctagagtatttttgtttaaaaggggcgaagnacctgaatatgccacatttagagaatgaaaaagcccaagaaagaacaataatccacattataaagttgcctcatccgaatcagccatagacggaaattatttcagtttagctcagcattacaaacgttttgaagcaattaattattcagctccacacaaaaattatcgtaaaaactctccaataatttcaataaaaatacataaaataaattcatggcttaaaagcgtcaccacctttactatgtgttgctacaccatttctcgcgactcatgtaaattcattatttttctttctatgtctcttctgtgtccatgcttctcggcccctggtcagtcgggcgtacgacagtcaatgaaaggcttctcccccccccccccccccgccccattcccctcacagctgacagatgtgctgctaatgctaatagggaaaaatgaaatggacgcgtaggcgaaaagaatcattcatcagcagctattcattctgggtgggacaagtaagggaagaaacgaaggaggcaaagccgaattgagaggtcaaaggcaggaacattagtagaaaattgggaaaaaataattaacacaaatgtgcaaattattccctagctgttggagttaattactgtttaaattttaaattaacaagtgttcatcgcctaatagataaaaattcattaaataaagaaaattatttattcacacttttattcaataaataaagttatctatctcggaaatttattcaaatgtttcccaattgtttttacgagtgttgataaaagatgaattagatggaagatttaaagcggaagaagtcgatgataacacaccaaaagaattatgatcagatacaggaagtgggtcaaattgactaagattaggactagaaaaaatattacttgtaattgtcgaattattttgatcggataaatcaatgagatcaccgacagaatgagcactttctatggatggtggagaaacagaacgcgttttggaagagggagaaaatttatccaggttaaattgtgaggtgtcaatcgtcagagggtccaatttctgtttgtacttcgaccgagaacgggcaacagacgaactcagccttctctttttgactgaagaaatggcatcctcttttcgtcttacgctcagtttgtttctgacctgaacttttttagatttttgtttaacacttataaaatttcaacacactgataacgaatggatttgatccttcaaagcaccaattacatcagttgcatttcctttcacctatgaagtaagaaaactttttttattagattatttgacacttttccaataaataagaactggtgcttctatataagaacccacgaattggtttttatcagggaaataaaggttttgtcttgaagaggttctcgtatggaaaatcaaatatttaattacttacagaagacactgcttgttgcagcatatccgtagtcttgttttgaaaaaagatataatttcacaaataaaatatttaagttaccgtaacagcaccgttcttgtccaattggcctctaactcccatcgattgagcctctctttcaaattcgtcaatggttgtcctattctcattcaattccgacaatttttcatcaataaatctttcgaaatattgcaccccatcttttccgatcaaggaagacagaaattgccggaggctaggacgttgtttttcagtaaacaatttcctgtcccagctgtaagaaccatgcgggtctattaaaagcaattgaaaatgatcaaactcaaactgatcagacatacccacaacaagaccagatacgtagttgccaaaaatcaacgcgttcgtctgcaaaaaggcccttgccagtgaatcagaaataaaaatatcgctggagaattttaaacgattccgcaaaaaattgaaagcttctaacggcagtttgtcatcatatggagaagtaagaagcttctcatccacgtccattataacaacatcccccaattccgccttgttctgagtttggaatgtttcttttggaattccgattaaatacggcatcggagccctaaaagacagaatataattaattcaaataaaaaacaattacattagcatatcagttaatttatgtggtagaatcggaataaacaaactttgcctaaaaatttaaatatttcaataaaaaaaatcaaacactaaccaaataaatggaaaaaacagttttgaaatgccgaagacgcaagccgaaagttgactaagtttggaagttgtaaaaatgatccttctttccttgagtattcttaaatttaaaggtagacaaaaaattttttaaacagaaatacgatgcnngtaaagctgtat

SEQ ID NO: 19761 - DNA, 1662 bp, Heterodera glycines
ctcggaatttttgaaaaattttacagaaattttaaaatatttcataagttaactttaaagttataaatcaaaattactaaatataaatgtatttatgtattaaaaaattaatattaaaaattaataatcaaattcaacaattgataaattggactgcaaaaaaatcaatttcctaacattgtctcctttaatccggtttcgcaaatccgtacaaatgagcccggctttagaaaacaatctttcgctttcaactgatccacaaggtgcgctcagaaattttcgggcaacacgacaaagaagaggccattttccatgttcttctttcaacttccagtaatagaaaatacaaacagaaattaaaaacagaaattaaaaattctcaagaaaattaagtttttttgagtccggcggtgccgataggtgccgtcggaaaaaaattgaaaatttctatgcaatttattaacataaattgtacaaaaattgctaattttttgaaaaaaaaactcaaaaaaattccgaaaaattccgacttttcatcaaaaatttcggaagtcggaagtcggaattccgaggccccaaaaattttcggaagtcggaagtcggaattccgaccccaaaaatgtcggaagtcggaactcggaagtcggaattccgtgccatccctgacgcacataagctattacaccagcaatttaaaaaaggcgaaaaagcggcgcctgcgtttggagaaagaaggaggaagacccaattttggtcccccgacccaacctgcaccaaaaaaagcgcatgttgtgtatcttttggtcagtacatggtccactgtactgggaactgctggcacctggcactattttggacagtaatagatacataaaccaactgcgggcggtggatatcgcttaccgcatccggcgccagcagggccaatttgacggtcccctactctttcaccatgacaatgctccgccacaccgttctcatttgacaacccagtacatttcccagacattgaattggaatgagttgccccacccgccttatagccctgacctagccccctcggattaccacctttttctttctctcaaaaactttttacggggtaggcgcttcactgaagacgccgaggtcgaggaggcggtggggcagtacctgacctcaaagatcggcacagattttttccgtcgcggcattaggaaacttccttctcgttggagaaaggttgttagggtccagggaaactattttgttgagtgatattgtatttatagttgttatgatggttatttttgatattttatttataaatttttttttctaaaaaagcgcccttttttatgcaacgacctagttaatgacagatgggatggacctctgattcctcaagtttttcgactaatgtacattaatttcattatttgggtggttttggttaggacctcgtcccacgacggtctccgtccgtcagctgtccggtgcaaatagtcaatgcccgccaaatggaagccgtccacgccgtggccaagccaaaaactgagcgctgcccgcacggcactcgaaacatttgcgttttgccggttcggtaccggcaaatcggcacgattggccacgtggaaatactaaaaaaggaattaatttaatattcgagcagagaagcggtag

SEQ ID NO: 19762 - DNA, 1596 bp, Heterodera glycines
  misc_feature (1578)..(1578): n is a, c, g, or t
  misc_feature (1591)..(1592): n is a, c, g, or t
tccagtttttggacctggaagccaaacttcattttttcgcactgattaaccaaatgaaataaacccgcccaggagtttctcagaagaaatgattgttgggggtttatcggtaatcaaaaggaaacatattcccgattccactcccccgttgctactctgttatgcttggcagggaggacggtggttgggagcaaattctgcttaaccaaacagacagaatcacgccgcctattgagtgtttggtagaaccaagaaattcaaacgaatttttgagtggtgatgaccaggaagggcctatcccgtgttttttggaaccaaaaatcatgatcggagttcgtgaattctggcgttttattctggatcgtagggaaattcgaccgggaatttttgaaatccagacagttttcggaacgatttatgggggcgaagaaatggcaattgcctcgaaccccgggaattcgctaacctgcacaatcattcaatcagcacacattcagccggagtcagacgtcggccgcttctgggcattagagtcaattggcataactgactgtccaaaattgaatgatgatgaaaaggcactgaaaaaatttaatgagtcagtttctgctgaccctgaggggcgttatgaggtagctctcccatggaaggaggagggagagtacccggcggaaaatttcagattagcattttcaagactttctgcacttatacggagactgaaggaatcgccacaactttttagcggttgtaacgacattatacaggaatatttagagaaaggaataattgaaaaggcccatcgcgctaaaagtccgcaacatttcttgccccaccatacagtgatgggcaaaaagcttcgaatcgtttttgatgcttcatcccacgaaaagggtgcccaatcattaaacgaaatgttattttcggggccaaatctctatcctgatttagccggaaaactcattcagtttagggccacaaaataccctatttgggccgacatagaaaaggcttttctgatggtaagtctgaaagaatcggaccgtgaattttcaaaatttttgtgggtaaaaaatatatttgcaccactttctggggaaaatctcctcgttttccgctttcggaggataacattcggaatagtgtcttgcccttttctattggcagcgacgctccaacatcatttggaagcatttcccagtgagttagcagaggaaatccggtaaaaatctctgctttacgtcgataaccttctgcttttggctgattcgccggaggaagcatgcagaaaggcagccgaagcacagaaaattttcgccgcggctaaaatgcgtctgtgcgaattcattgcggctgatccgtcaagtttggacgaaatacctgaaaatgatcgcctccgaaatgaggcaccaacggtcctcggactaaaatggactatttgtgaggacaatttgtctttgacttttcctacggttcctagtccggatggtttaacccggagaacggtcctaaaaacagttgcgtcattttttgaccccttagggttatgttcgccttgtttggttggggcgaaattgntttttccaaaaannttat

SEQ ID NO: 19763 - DNA, 1730 bp, Heterodera glycines
ctgccgtattgtggtggacgcgtcctccgcggatggtaaccgcgtgtgttgcgagtaactgttttctgtctgtgtctgcgactctctcgtgcgaatttgaatgccaggtgggcccaagtttgggcacagcatcatcagttggacttcttcagaggcagaaccgcgtcgccattgttcactgacgttgtactgctcgtgcaacggctcctttacgcgtgaatgtgcgggcacaatttcgcgcgcacatcgaatgcaccggcgggcgggcgcaggggacgcttctcgttgtttttgtagccgaatttcatgggagaattgcgcttggccggttgcttgtgtgtgaagaatgatgtggccgccgaacaaagcaatccaattcaccaactcggcaagttgcggcgcttcccgtcgtgcccattggcagtgcacgcgctgctgctcctcggtgctttcgcgtgaccgcaacggcccgtggcttatcgtgttcttcagccaaacagtgagcggagtggcacgttccgcttcagcttgccgttgcaacattgcgtgcatgacctgttcaacgccctcggattggcctgtgcgcaactgttgccttgttgccttattcgctgttttgatggtacagaagctgtgtgagacgcgttcgtgtgaggactccaactcgcgcacgagttcaagctgttcatcgcccgaagcatcggtgcgcattctgatctctcctccccagcgtgccaactgccgcgtcagttccaccgcgtgcaaagagacaggccgatcgtatcgcaggtaaatgccttggtgcacatcgcctgcctcacggcaacggtatttctgcgcaggtaatgcgtgcgcaatccatcggatcaattcgactcgctgattctgttctggtcgatgtctcgtttcgatcacaatcgcatgctcttccgttgctgttcttgtgcgcagtacaggcagcggtgtactcagctcgttgggtatgcgcacagtgaacgcgtggtgcgcgaatgcggtgtctcgttcaagctcgcgggacactgaaaaatgcatgtcctccgcagcatcggcatccaaacgagcgtcgttgccaaatgaagcaatgtcaactgttgccctggcatgcatgtccaagcccaactctctctttgccttcagctcgtaattgaccgtctgctgttcatcaccagcttctcgcatttttgcgtgcattggcattcctctttgtgcacaaatttgcatcatctccgcattccgagcatccgcctgacgctgcagattgagaatcagcgacacattctcctgcgtgctttccaacaagcgcattgatgcaaaaccgatgcgttgcttgtgcggtacacgtacgcgatgcttttcggtgctcgcgagtttgctgaaatgcatggtcagcatgcgatgcgcttcttttggtgcctccgtgttaagcacataattgccaccgaggcgcgcatagttgcgagtgaggtcgacctcggctggcacaacctcatgcatgtacattgacgacaaatgcgcttgtacgtctaccgcctccgtgcaacgcttcgccatcctctcgccctcgcgtcccacccacactgttcgttgcgcgtcttcgtgttcagcctctcgcgtgtacttctcggtcacggtctcttgctcatcccccgcacttttggtgcgcaattgcagcggtaagtcctcaaagttttctcgcaatccccatctga

SEQ ID NO: 19764 - DNA, 1399 bp, Heterodera glycines
tgcaaaaaagttgcctaaaattggaaaagcatgtcattaaatgtgtgaattttccaaaatttcctcatctttatccttccttttgcacaattgtaatccaaaaacatttgaagattttcaagcgtaaaaagctttcgatcgtcagccaaacattgccaaggattttttcattttgaaaaatcgattcttatgggtgcatttttgttttttattgcatttttcataataattttttgttgaaaagcagaaacttttttaaatttcacaagtcaaaatagttgataaaaagtcgctctaaatcaaaaagtgatcgaagaaaatatgttttttgcgcttatctcaccatatggctagacttcaattcaaggggtaaaccaaaaacacgtttaatggttctataatggcgtataattaatagaaatcatcattttttggcgtaaaaccgacgatttcatggcgaaatgcaatttttttgtcgaaaaaatggacaaaattgggcaattttagccttttaaaagggtcaaacccatacaaatttggtatcattcgaaagctcttgacttgttaagtctaaaaaccaaagaaaaaagtcgaactgacgccatctaagcaccgggacaactgagtcccagtgaaaatggatatttcagtaccgaaaaataataaacgggaaataacaatttaaaagcaaaatttcgcaaaatggagcatgcgaagacggagcaagtagtggggcgagacggagggcttggaagacgtctgacgagcgccacaggcggttgactgcgggggcccgaagcgtacactcctaggacttaaacctgtcagaaacagtcagaaaggggatgctatatccttacataaaaatggtattcttgctggtactacttcaattttttgaataaataaataagtaaaaattttataatatggttattaatgtttcacccatttctagaccattttggagtacctgtggcaccgttgttgaacagattatatatatttgtggttgtctcctgcggaacgtacaacacatggaaactatgctatttcacatgcaaatccatctgtgactttaaatttgagctatttattgacacattttatttacatcttctatattatttatctgtatacgatttttaagctctatgaactgccatcagaggtaggcaataagttctaaaataactccaatatgggcactaaaaagctttattttacggcgtgctaaatgacatgatgcttctatatggtaacaaaattaatccaaatcacttttgagatacacaatttttataaaacttcttgtcactaaataaaaaactagttttggagaagaatttttaagaaaatcttacatgatttcgggtgtattttcctaaatcttttggtc

SEQ ID NO: 19765 - DNA, 812 bp, Heterodera glycines
gaatgggtgcatttaaaagggggaggggagagaaaaaaagaaatttgagagaatagcagctgatcaaaagcggaaaagggccatcaaaagacgagggcaaatcagttcaacatcactcattccaaagacacactgatcacttcgacccattccgatcagcagcagcagcaagcagctaaaacaccaccaccagcgccacctccgcccgtcgtacgtttgtccgctagactacgaaagagaaaagcgatgtgtgagcatcacatttaagaattgtccagtgcaaaaatgtgatgcaaagtcaaaccattgaaaacaaaggtcacaaaagcacgtggttttggcgttgggacacaaaaaaatgagtgaacttaacaaaatcaatcactatttattcaaccgactgaaaaattgagagagctgagtcaagccaaatcttttttaaggaaaagtataacttgggcggtattgtcgaactcggcatcggcccggtatggatgcaaaaatcgcttttataaaatggtattctctaaattgtttaaaaaatggcgattttttattacttttttcatcagtccactttttgcgatttttcgttacttaaattctccctactcggcaccgccgggtccaaacaacggctctaatgcactttatgagtccaatcgaatttatgagtccaaagcttttttatgagtccaatcaattgacattacctgctttttatacaataactttgttcatgttcgaacaaaccctatctttttgatatcattcgaaaagacaaagtctaaatgatataataatacgagaaa

SEQ ID NO: 19766 - DNA, 1148 bp, Heterodera glycines
tttgaaaaatgcaagtatatttaattggtgagtattttcaaaattatagttaatcaagaaaggccaataattgtcctctattagtgaaagaaaaaattcctattttactccgcagtattcaaagtcaaacagctgcagacagaaaaagtataactacttttaaattaaaataattaagagatgaaaattttaaaatatcttcgtagtatccgctactcaaatcttttttgcattaaactcattattttgagcataagtgagtccgagatagaattacacaaaatatgtgaatatgttcttgtgtttaattaaggcctttatgcgcatcttttaaccctttaataatagaagcgagttgaaaacagtctcactataaatatgtgcttattttaaaattatgaatacctcttttgaaaaatgcaagtatattttaattggtgagtaattttcaaaattattagctaatcaagaaaggccaaaaattgtcctctattagtgaaaagaaaaaattcctatttttactccgcagtattcaaagtcaaacagctgcagacagaaaaagtataactacttttaaattaaaataattaagagatgaaaattttaaaatatcttcgtagtatccgctactcaaatcttttttgcattaaactcattattttgagcataagtgagtccgagatagaattacacaaaatatgtgaatatgttcttgtgtttaattaaggcctttatgcgcatcttttaaccctttaataatagaagcgagttgaaaacagtctcactataaatatgtgcttattttaaaattatgaatacctcttttgaaaaatgcaagtatattttaattggtgagtaattttcaaaattattagctaatcaagaaaggccaaaaattgtcctctattagtgaaaagaaaaaattcctatttttactccgcagtattcaaagtcaaacagctgcagacagaaaaagtataactacttttaaattaaaataattaagagatgaaaattttaaaatatcttcgtagtatccgctactcaaatcttttttgcattaaactcattattttgagcataagtgagtccgagatagaattacacaaaatatgtgaatatgttcttgtgtttaattaaggccttta

SEQ ID NO: 19767 - DNA, 1872 bp, Heterodera glycines
tgcaggtcgaaaacaagaagcaacccaaggaggcgatcaaggagccccgttaagagtcggaaatgcagaccaagctgggttatctggatgaaaaggtaatgcaagccatgaaattggcttttactcaagctctgaagtcgatttgtgaatacatggttgaaactaggcggtgggcttcctccgcccttttgtctaatccaacaaattttgccaggtcagtgttcaactcaggaaaattattggcaaaaggcattggccccaacctgatcagaatctggccctgtgttgaactggcaaaagctgactaccaattctttccattggagcaagatcagagccaaactgaatgctacgagctaattcccatcaaatttggaacgtcaagtggaaccaaattggcattcgtcgatccaaaaacaatgatcgtaagttcagaatcaaaaattgcaccatgctcagaatttcgcaagcagttaattttcatcaatgatgcactgtatgaagttgatcagtggactgctcaagtaaagcaagtcaaagtggacaaaattgggaaagttggagaattcgcacccgaaattccgtcattcaaaccacacacatttcattatttggctttagtcaatctctccgacattttggaacaggtttacgatgccaattcgccaaaaatcagtgaaattacctatggccttcgatccacggacacaattgtcacaaaaacaatgtcaagccagtggaaagcagtcaagcaagagctgaaggatgcgattttcggcggatggatcagcacctaccaaacagttattgcaataatggttgcaattgtttttgcagacttcctggtacgttttggcttaatgcttagagctgaataccttggcaaaggaatctctggaaaaatggccttcggaactcaagccaattcaacttctgtgcacaatgaggatagtacaaggagcaaattaaatgccgcatcaatgcccaatttgcccattgcagaggaaggaattgaacttactcctctgaaactcattgagcccatcgagatgcgaatgcgcgccaaaaggagattgcgcaaggccagcagaaaggcaagttttagaattccggcccgcactgccctttctttcgcaaccattttatttttttccttctccaactcatctctcgcacaaaattcattgaatttgtcatcaaattgctccaatcttcatccatcctcaaatttaacacaattgctgattgttgccatgctcgttttgctcttaatcattattatcctaaccaaatggttcctctttcatcactctcaaaacactaacggaatgcctcactcacaaaacctcaacgaattatttgttagtaaatatggacaaaattgggctactactcacctgcaggatgtgaaagcacatctcgaattcttgcttaatacaacccactatctgaggcatgccctttcacccaaacatttcctgcactttaaagctctcataccaaatttgggagggaatccttatgtaatcgtcaaggatgacgggtctcttcgaaaaaggcacgaagccatttcagtccattcagtcgaaatagccagaaattatattaatttaggctcactaaatgaattgaacagccttaacccgcagacggctgtggttatcgcgcacatcaattctcttccaattcgctgtctcatggacactggcgcgagtctcagtgtcgcacctcgttcgattgcctcacaattgcgctgcaaactgatcccatcactcaaagaagcaatgagcgcatcaggccacataatcaaactcaaagaatatgcacagcttaaactcatcatcgggagggatcgaaacacaagtcacatta

SEQ ID NO: 19768 - DNA, 788 bp, Heterodera glycines
  misc_feature (11)..(11): n is a, c, g, or t
  misc_feature (109)..(109): n is a, c, g, or t
  misc_feature (119)..(119): n is a, c, g, or t
acgcaaatgcncagctgtcaaagtggaaatgggcgccattatctatgcattgcgcgaattcaggccatttatcttcatgtcagatattgaactgcacactgaccacaanccgctcgctnttctgctcaagaaagcggacaacagcccacatttggcgcgctggctgattgagttacaaaattatcaaatcaaaatcgtgcacatcgccgggagccaaaattcactagccgatgctctttctcgtgcagctgaagataagcctctgtctgaatttcgcaaattgcaggaattggatgacattgtcgaatttccggtatgtttagccatctcgcaatacgaccgagtggttttggacccttttgtcaacacggtgacgatacgacacaaggatggtaactcttatgaggtaaatttggaaaaagaactcaagaatgatcccgaggccacggcttatattgattttctgaaaattggcaaatttcctgactgtttagatgagaaagaaaaggacgagtttgccgtggccactgttaattttcaattggactctggcatcctttatttcaaagaatcgggatgccaaccacgaatttatgtcccaatttcgttgagaggcctaatttttgaatcatttcactcttcccttcttggtggtggtcatttgaattaccgtaagaccttagccaaatgccgcaagtattattggccaaaaatgcactcagacataattttgtgggtcaaattatgcattacgtgccagctgagacatcatcccactccggcttatc

SEQ ID NO: 19769 - DNA, 1309 bp, Heterodera glycines
  misc_feature (10)..(10): n is a, c, g, or t
caggattttntgagtgaaaaatttttttcaataaaaatcttccaaaaacatgtctttatgggttaattgggccactgatcacgaatacgtaatcagattttacttttgacatcgttaagacctaagaatccctgtgtgattggggattctgaggcatcattttgaggggggggggcaggttcgaatccggacggtgtaacattatttttttgtgcatttttacgttattttcaatgattttaattaataaaatattttgttgagttaataaataaaaaattatatttaatttaatttttttttgataaataaattttataagtttaaattaattatttttttaattgatagaatttcatgtatttttttaattaaatttgttaaaaatattttcattttaatttaatgaatttactaatcactgttgtatcaatttatatttaaagatttgttgtaaattaataataaaagaatttatgtaaaaaataataattatcttttaataaagaatttcatattttttttaattgtttataaaaattaatttcatattaatttaaatattcaattattgtacatttcaaaattctctttttaattaataaaaggaataattaatttattttttaaaatttataataaattgcattcaatttttgtacctcttctaatcaatcacagttgtacctcttctaaacacttttgtacctcttctaacaattttgtacctcttctgatcacagtcaatttaagtgaattaaagctctaaaaatagagaaaaatcaggagaattttatgggttttatttagattttctttcatgaaactaaaaaaagttattccagaagttctggaaaaattcgaattttcagtaaaaaattcataactcggttctgaaaagatattttggaaaagtaaaataatataaaaatccgcaattttttgctctattttataaattttattttacatttttatcacttttttgaaaaaagttatagaaataaaagtgattttggggttcgggaccaaagggggtggacaggatttttgagtgaaaaaattttttcaaaaaaatattccaaaaatatgattttaggggttatttgggccgctgatcacgaatacgtatcagatccaattatgaatcgttagcccccaaaccccggggattgggatctgggggttttttttgggggggggggggggggggggggaaaaaacggggggggggggggatttttttctttctttttttttttttttttttgtttttttttttttttttttttttttatttttttttttt

SEQ ID NO: 19770 - DNA, 1161 bp, Heterodera glycines
agacctgaccttaaatcggcaaaaatcggatatggaagtttgacctactttctggcccttttcttattatgtccagttcttgaaaacagagatttgacctcgagacccagtctgattatcaaaaccgagaccatagaccaaaaccgtgagaccggagactgcagcaaaaaacacgattcttttaatccacccccccccccccccctctgcacagatggccacgctgcgctcgcccttcttcggcgagaagagcaacatcacgtcgctgacgcagaagatcagcgacgcggagtacccgccggtgcccgacgacagctacagtcagccggtgaccgcgctcatacagtactgcctgcgcccgaaagcggaggagcggcccagcgcggcgcaagtgcaccgtatggcgctgctgatggcacagcggtgggagggcactccgccctactgatgatgatgatgatgatgaagcagtcatgagagaggcgcgcaattaatttttaaaatttaaatttccataattttccaatttgtatttgttttttgttgtatttgctttttttcacttacagtaccatgccctttcaactacagtaccatgcccattttaaaaacttacttacttgtatttgttttacttaatttccaattttgttgttttattgtttttttgttttcatttaatttcccaccacaatttttggcatatacagtacatcactcactcattcccatttaattgtatacggtatacatacacataaaaatgctgtcgccagatgaagaattcactatgggtcaactccactgtgcagagaaaagcctagtactatctcgtcgtttctctttttctttgtaatttctctcactttggcgtactatctcttcattttaattatgtaaaaaacaacatttacttctctccgtctaactttttttctatacgttaaatccgtaccaaattttgcatagcgatagagaaaaaaattctgcatcgaatgatataaaagttttttgcaaaaataaggcaaactgtaaaactatttttggttaaagcctataaatattttaaaggatttaatgtgtaaaaaaaagaattttaacatcatcaaaccggtgcaacaacggtgggacaagagagaggagagataagcgcagacggcc

SEQ ID NO: 19771 - DNA, 795 bp, Heterodera glycines
caaatttgttcaatttagttggaaatgaagaaagttacggctaatcaaaataaacaatcaaaatggcagtgataagcgtaaatttgaattagcgcgaaataatttacgccaaatacgctatttggcgttatgagcaattttgtctaacactgggcttgacccatagtgagaattgtgaagagacagatagaaactctcgaagtgctttcaagagtcttgaaaaaaaaaataataatattggtacaaaattcggttagaaaaaccaaaaagacgaaaaaattaacaacaaaaaagtgttttttctccccggctgattttttgtttaaaaataatttattatactaatatttttaataccgattaaatttaattaattaatttttaaattcagtaaattaaagttgtggaaaaagagcgaaagaaacaaaaagaaagacgagagagtacagagaagagttttagtgagtgagggagagagagagagaacgagcgagagtcaatgagaggagagagaagagaagtggtcgtcggcgtgcgacgacatgacgaccacctgctgctgctgcctccccacttactctctcttcccctgtctattggcacacacactctctactacgcttttctcttcaggaagcactctctctcgtccgtcttgtttctttcccccatttgtccctcccgttaaacgctctttcccccactttttcaatatctctgctcccaaatgtgcaattttggtcgcctaaaatgctacccatatgttttcgatggtgcccgttccgtttccgaaac

SEQ ID NO: 19772 - DNA, 2439 bp, Heterodera glycines
tattttatttttttaagagaatgcttcattatttataattttattttatagatgataagattaaattctagtaaatagtctattttataattatgcgtaaaaaacgtccatggttcattgtcttccattcctcctcctccctcttcttctccattattttcctccgctaattcttcttctcttccctcctcttccttattctcttccatttctcctcttttcttttttccaccattaacttttaaaagaatgaagagaagacaagcgccgatgaccattccaattacaaaaggcattacgcttttcacctcgctaataatcgcctgtaaaaattgttgttttcaaattattattaaaaaaaatttgcttacaattaattttagaaattttaaagcgtaaaattcttataattttgcaaaaataatttttttttttttttgctttaaaaagaaacattgcgtgttaagaaaataaaaatgttgcaaaatatggccaaatttttctgagttgttttaccatttcctgacatttttgaggtaagaattcgatttatgttggaatttccatgcctcggaatgccatccatcccaccagttacatactttatttagttgttaatgggattttattttttgtgaaaagaatgctcatttttgcaataaaaccaaatcaaaattatatatacagtaccaaaaaaacacatactgtacctcaatttcccggcaattcccattcactttaagtttgttttcgataatctgaaacttaaaattaatatacataataaaaaaaagtcaacttaaaaaccatttctttaaaaaatctcgaaatattaccaaagtcaaaatagtgacaaaaagtctgaaatggtgacgaatagtgaaacaattttctgccacaatttgttctttggcccttttgtaatttggtcaacaattaaattgcacctttcgttactgttttgtaaccaattttcactaaaaaaaataatttggaaaatttcaacacatatcgtgaaattttaaaaatgaaaattcagaatatgtcaatttttaaaattactgtttttctcaggacggtacggtgccagcccaagttttggactacaacttttgtcgttgttggccaaatctaacaatcttggtatcattcgaaagcgtggtgagtcattccacaaaaaagctcagtgattgattggtcattttccggaagcctatcgcaccactttcggggcaccaaaagtgcctgatccggaacccggaccggcccggttaagaacaattttttgttcagtttttcaaaggctatctcccaggccgggtccggttcttgatccattcacttgaagcccgtcatgggtcgggcacatctgccggaggaccctcagcctcgcccccgaccctgtcgatggccaacccaagctaagcttgccggtaccagcgccttttttgtacagctcgatgagctctacaaaatggtatcaatggcgtcaggctagtctactacaaatggagaaaattggcgagaagtgatgtcaaaaatttaaaaatttgaaaatgacttgcgtcccgccgtacattagtattaaccggacggcaccgtgttttgtgaattgaataattaaatttatttatttaattttatcgatcactgagcttttttgtggaacgacctagcaccattcgaaagcccttcacaagctctattagccttacaaaaaagcaaaaaattttagcttgtaaaaaagttattaagaaaaaactttcaaaattttggtttttttttgttatttcactaagcaataggttagaaaaagcttcgaaacatataaagctttcgaatgataccaagattgttagatttggtcaacaatgaaaaaagttgtagtccaaaacttgggctggcaccgaaacggcgggcaccaaaccgtcccctaccggttttttattaatctcaaaaatgcttttagttttcgtaggtttaatcttttgctgttgtaactaattgctcttgatttttgcattttttccggttcgttaagaaaggaactacttcgttttattcttttcagcttagttagctgtttttttttatattttcataattacacgatacttttgggtcagtgtgccgtttttatttgctttcgtcgtttaaagtccaatgaaatcatgttcctcatcggcaagtacttgttcgacaggtgacacaagcagtaacacagaggcagcagaaggcacgtttttttcaccaattttgatttacgctattttttgaggtaatactagtaatagtatggtttacaggtcccacaaaaaaaagaggcaaaaaggggattttatgcaattcttcaaagtcctttatggttctcgagggcgctgatcacgaatataatattcatttcgaccaatttcgaaccccgaacccaaattcgaacaa

SEQ ID NO: 19773 - DNA, 917 bp, Heterodera glycines
caggaattattctcgtcattgtcaaagcgatgaaataaaaatttaccaaatgtttacttacctcttgaacttcctttgccggcactttagttctcttcaacaattctttaatgcattcggaggccaatgccggcgctgacaccgaagccaattgagaacggaaagagccaattggagttcgacatgcttccaaaatgaaggcttccttaaaaaagaaaacaaaacggtgacaattacaattttcttgaaaaacatttcataattttatttttatattattgcaatgaatagagcccggaatgaaaaaaatgcaggaatggatcagaattcctgcaaatcccgtgtattattccaatccgggctcatatgtatattatcccaaaagtaaaccttaatagtcgaaaatgcacgtatggatgtcgaagttaaaaatggatatttgccaattagtaaaaacatttaaatacaaaattttgtttccttctctgtggaattagtggactttcaaaataaaaccatcaaaatttaaatgaaaacaaaaataacattacaatatttgcggtaaaacttcggttctattgcagtttcgcggctaatcaatgataataggctcttttcttgcgtttttaagttcctgagactttaagctttcagtttatacaaagaatgcagtcattgacaaagtatgtacctaagaaaaaagttatggcctgggaaacttggattgtcattgattggatgcataaaagtcgaatggacgcataaactgaattaaccccttttttacgcaaattaattagaaaggattttttctttttttattattccggcggcacatcatttctagacaattgcctcgaaatgagtgtttctccgccgattgctttcccttcgccttctcattgccatttttcttc

SEQ ID NO: 19774 - DNA, 1875 bp, Heterodera glycines
ggggggggggggcccccccccccccccccccccccccccccccccccgggggggggggggggagggtgctctcccccccgcggcgaaaaaaacccccccctccttttttttttttttttttattttggggggggggggggggggcgcccaccccccccccccccccccccccccccccaaaaaaaaaaaaaaaaattttttttttttttttttttctctggccccccccccccccccccccccccccccccccccccccattatatttgggggggggaaaaaaaacccccccccccgaaaaaaaccccccccccacccccgcgcggttttttttttttgggcgggggggggtgtgttgttccccccccccccccccccccccggggggcccccccccccccccccccccccccaaaaaaaaaaaaaaaaattttttttttttttttttttttttataatttttttttttttttaaaaaaggggcgggggggggccccccccccccccccccttttttttttttttttgttttgtgtgtggggtgggggggcgccccgccgccgccgcctcttttttttttttcctttcttctcccacggggggggggggagagggggagaagaagaaaaaatttttttatatttattttttatttttttttttttttttcttttcttttcttttcttctacacacaacagccgacaagaaaaaaaagaaagaaaaaagggtgtttgttttttttttttttttttttttttttttttttaaaaaaaaaaaaaaaaaaaaaaacaaccccccccccccccccccccccccccccccccccgcgcgcggggggggtttgtttttttttttttttttttttttttttttttaaaaaaataaaaaaaacaaaacaaaaaaaacaacaccacacccccccccccccccccccccttgtgagaaaaaaaaaaaaaattttttatttatttattaatgaggagggggtgccaagaaacaaacaaaaaaaaactcattatgtccccccccccccccccccccccccccccccccccccccccgggggaaaaaaaaaaaaaaaaaaaaaaaaaaaaaaaccccccccccccccccccccccccccccccccccctttttttattaaaaaaaaaaaacaaaaaacaaaaaaaggaggggtgtttttttttttttttttttttttttcccccccccacacaaaaaaaaaaaaaaaaaaaaaaaaaaaaaaaaaaatccccccccccccccccccccccccttttttttttttttttttttttccccccccccccccccccccccccacaaaaaaaaaaaaaaaaattttatatggggggggggggggggggggggggggggggggggcccccacccccccccccccccccgggggggggggggggggggggggggggggttttttttttttttctcttttttttttcttctcccccccccccggcggggggtgggggggttttttttttttcttttttttgggggggggggggggggggggaggggaaaaaaaaaaaaaaaaaaaaaagaaagggggggggggggggggggggggaccccccccccccccctccctcgggggggggggcggccccctctcttttttttttttttatattattattttttttttcccccccccccccccccccgtgtttttttttttttttttgggaaaaaaaaaaaaaaccctcttttttttggtgggggggggggggggggttttcccccccaccccccccctttttttttttttttttcttttttttttttttctcccccccgcggggggggggggggggggggaggttttttttttttaaaggggggggggggg

SEQ ID NO: 19775 - DNA, 1757 bp, Heterodera glycines
tttttataacagagaagaggcaaagtgacattggccattgatgtcacagtgaaagatgataaaaaggagaaatcgcatttctcgatcccgacaaatccaacggaataatttcgatggaaattgaaaaagtgtcggaatttgcgagagaaatcgacagaagtgaacgtaaaagcgaatctcgtcacttacataaatgggcttccatggaaaataaattgaaaagaaaaatggaagcactgacaatgagaaatggttgggcttttaccttatgcgtgaacaagaaggtgcaaattaaatgctaattaatactaattgtaatgaatttccattaagataattattttttttaattttaatttattacaatatttaaggaactgatggatccaagcaaaggattttacaataaaagcgaggacaaagtgacattggccattgatgtcaattatttatttaaaaaataattgaataatataaagttaaataatcattttgtcagtttgcaagcaattttaggctggtttgaagcatcgtacaaacgtccttcttggaccgtaatcgaggaggctgcggacgcagaaactcaggctaacggagtgcaattgtcatttggtaagtattttacacatcctataaaattctaaaatttttattgtttgtaatcttttatgtcccacaaaaaatactgtatacgcttagtgaatttgcgcatttttttggtttttgaaaataaaaattctaataaatcctaatacatgtgagttaaataaaactttcgaaaatataagcaatgaataaacctcaaaattaatcaaatttatttaatattaatcgatgtttgttctatttttaatggtgaatgttgaaaaatctgcttaaagaaaaatccaaaagtttttgccttagttcaaaccccttaattgaaaatcatttcttaaatttgttattatgatttatagtgaaattggttaaattttcactcttttgtattgaattaaatatttttaaactcctacagacaaactcgctcaccggaacatcgaagactcatacacggtgaaacaacgcgaagcgatcgcattcgatttggtaggggagaggaattcgtatcgagatgctaacaaataagcacggaaaataggtctccaattgggaaaatcggtttaaaccattttttgcaccggttcaaaactcgaaaatgacgcaaattcaattatggttaatcaaggaattgctggagccgagcaaaggcttttacgataaaagcgaggcaaagtgactttggccatcgatgttacagtgaaagaagcaaaaacggaggacaaatcataaacaattaaggagattgaagaaagaaaaactctaattcttatttaagattattatttttttacttcataattaataacccttttatacattttcttatgtgctgataacaatttcaaaaactcgaaaaatacagaaaaaagggaactcccaactgtttaaaacgatcaaacccgggttaaatttagtatcacccgaaagctcatgaaagttgcatggttagccgttccagccattgccttaaaaacacgaaaaatacgaacatgaaacacgaaacgatcaacaccactggtttagatgattaatagttttcgtttttctgtttttttcccaaaagccccaaaaatatcaaaatatttatcacaatattgatttaaaacttgaaaaaatgattataatgcatagacttggtttttattatgcaattt

SEQ ID NO: 19776 - DNA, 917 bp, Heterodera glycines
aaggttcgtcaggcgggaggccgcgacatcggcggagtggcggcgccgggtgccgccgctcgtcccgggcaaattctgtggcttttgggactgactcgtctccaaactcaggtgggcactttgtccgtcacttcgtttcgttttgtccccctcactttgaatttcgttacttttgtcaatgtttcgtccgttggtcccttcacattatctttttgttttccatttgacgcttttcttttttaaatttttggcattctattatactttttttgggttagttcactaaatgccattctcttctcttccttttctttcgtccaactctctgtccgtcgtgccgtagtgctgcctctcttccgtctctgtctgtctctcatttgccaatgatccctctcccgctccgtttctctgctgatgtcctattttctcttcagatgagagttgtgaaggctttccaagccactgtgcagaattcccacccgtcttcgctgtctcttcaggcgggtgaccgtctccgccagtcttaccggcgacttcgaattgcgaaagaaattgagcgtgcgtaaatacttagcatttttttgcacttcttgcgctttgttgagtgccgcgcggattttattttggcatttgcgcttttcgtattctccaaaaagccacgactttcctatcttctttctgtcttcatctcttgttcagacattttggccctttgtcgttctaaattttaaatttggttgaggaataaaaaaagtccttaaaataaaagcctactttattttaggtaattaaatagggtaagtatttaaatattacgctaactttcactcaaaaatgaatggaaatctcggcgctatttgcaaagagtaaccttttgaaatttatcaaaaacaataggggggacccgttttgttttg

SEQ ID NO: 19777 - DNA, 1091 bp, Heterodera glycines
taattaaaaaataattttaacttttttatggtttcttgtcccataattttttcaaaaaaaaccccattgggggggggtaaagtttcggtttttaatattgaacaaggttcataaaaaactgcaaattttcttggcgatgcctataaataccgaaggagcccaaaatccccgttcaaaaaaattgaacaaaatgctcagttggtcattttgggtaaaactctcaaaaaggttcaattatattaaaataattaatttaaatgaattagttggattgtttttccatgtaccattgcttagcgcttgtcgtaaagaacttccagcggaatggaatttgtcttggtgaaatattctgctttcgtcttccatttctgcatcctcatttcttcctcttttgttaaccaatttccggaactgaggttcatctttagacggcaaaataaatggcattttggagcccttttttaagtcggaaataaactaaaagggaagttgtggttagaaaacaagaattctctcttggattgggtcggcccactccatacgaaggccgcgccccccccccttttcggtgcttcatactaacgaaggagggaccacgtccctatttaaggtatggtcatattcttgatcagtaactcggagaattccgtaagacataattcgtgacttaaaatttttctaaaaatgggggggggagggaatacaaattttacttaaccctgaattgaacaaattttttgtgctaacctcgtccttaagaagttcgtccaactcttccttgtccatttcctcgtccgattgccaatgtctcgcgtaaacatttgacgtgtcgacgacttcgctcttcagtgctcgccttagcatttcctttttgtcttctgtctccgttttcaaagtccgttcaatgcctttgactgggctttccaatcgtccaacaacagtctcttcgccttaagaattcgtttttaaaaaataacttttatcccgccaatgtgcctttaatgttcttcaatttgctgcgtttgctcgccatgtcatcgtcaccaaagccttgtgaaaatatgccctcagattggatgatcctctgctcc

SEQ ID NO: 19778 - DNA, 856 bp, Heterodera glycines
gtagggtggtacacaaattgtccctctaactatcatttgagctttcggctcttttggtgcccattgctttggtgcgttcccgtcgcgggtgccgtaagtaagcttttattgctgaagcaaaatccaaagcatagaaataagagcgtttggcagaagcctgccggaatataaccgctgcagtacctatctcactaatatcaatcgtaattataaaatgcctgctcggctcatttcccggtgatttgaaatctggaaaataaagaacgacatctcgaattattatctatttccgttcctcgagtgcttccgtttccttttcacccatttttaactcatgtattacgctgagaacctaaagacagtgtagcgtctatagtactaaaggaatgaataaattgcctatagtatgtcaaaaatcctaccagagaatgacgctcattttttgttgtggctcgttatgaatgcgatcactgatatacagtatatctgcgcccatttctataccatatctcctgcgcgaggtgacccgcaaatgctacgtgcgatcccacaaaaatgaaaatttttctaattttaattttaaaccggcatttctaaccccaaaaaatacaatttcaattgcggatcaattgctcttacaatgatttcgaggtaaataaaatgccatcaatataccaccaacaaaaattggccaatccttccgtaaaaaagaaaacacatgaaccttagcaatggagccactgcgttacacaagccaaaaggcataaccatgaattcataaaggccatattcttggttgtaggcaggtttttcaatgcaattttccttctattttcattctgccagaaacctgaca

SEQ ID NO: 19779 - DNA, 1388 bp, Heterodera glycines
tttataaaaaaaaaatccgcttgatcaaatactagtaaagcttgacttcataagcttatcgcatgattatcgtaaaaccaattacatccctctactcattgaaatgaaaccgattaattgaaaataaaacatttaatttatttaattaaaaataaataaatttgtccacgcctttgtggtggcaacggtgggcaaaaagaagggtgccgctttcggcttcttgggcggctcctttggcttgttgcgttgccgaatgtgctccaggtggggcaggccggcccaacgcgcgggcgccaggccggacagcgtgtacagcgacgggtccaactgcgcacgctcgggcagttcagcggaaccgtccagcgacagcgtggacagagacggtgctgaacaatgaatggggagaaatggctaatatgttccctcattatgtagggaacgttccccccgtcgtggtttcccctcgaattttttaaatttcaatgttcgatttcaaaaaacttaggaaattttcaagaaaatttcaagtaaaaaaatatttgaaaaattttgtaatttaccataagattttgaaaaatcgccagaaaattttttctaaaaaatttctccgtttgaaaatcaattttaaaaaaacaactaaattttttgaaattttttaataaaacgttttatttttctttttttctcaaaaatgtaaacaattaaggaaaaaagtttcgcaaatgtttaggtttaaaactttaagaaatgttgataaaaaattttcaacaaattcaagactggttaaaaatagacatcactagggatgggatttttaggtttttatctattttttttttgcggcttagttatgatgagagaagcccaaaaatagcattttctcctaacaattttcgatttagagcgactttttagcacctaaaaacacctattttggcgttttggcacctaaaatagtttacaacctattttggcatttttcgaatttttagcacctattttgggattttcccagaaatttcatagtaaaaatgcaataaaaacgaaaaatacacccctaagaatcgatcccaaaaaatttaaaaaaatatacccctaaaaattgaccaaaatttcagaaaatattcccctaagaaatgaaaaattttctcaaaaattcgtctccaaaatttatttatttattttcttgaccagttgcaattgtgcgggcgaaattgataaaaaattagtcacattttgaatttttgtacataaaaacactggattttttcaatttttaacacctattttggcctttttggagctttttagcacctattttgcacttttttagcacctattttgtacctattttgggatttttagcacctaaaagtcccatccctaga

SEQ ID NO: 19780 - DNA, 1857 bp, Heterodera glycines
aaatcccaaaaataaaaatattataaaaaattatataattattactttaactcgtcggggatcgtaccatagaaaaacgggaccaggtactttccgggttgaaaaaccgggaatttttggctggcaaaacagggaaaaacccgagacttttcccggtcccggtcaaaaccgggacgtaggtactcagttgtacgttctttcagtatcaggtcccggtcgcgtacaactctataaaaataaaataactggacaaaaaatttatgaaaattgtcttgaatttttgaaaaaacgaacacccgtgaattttttgtcagtaatgaagaataattttagatacatgaataatgagtttaataattaaaattctttcctcacctccatattcagcaacaaagcctgttcaaaagccacaaaaacatttggcaactttttaattgaaactttggcacaaaagttggcacattcttttaccaggccactgatgttatatttgtcagctataattaaatagtaatttatttaaaacccaatcataaattttcaccagcttttaaaacttccaacaaattattggcatccaatccgttaaaatgtttcgtgtaaataaatgttagcatcgttttgaacgcgccaatttcaatgtcggggatcacaatttgaccttcattgtaacggaacattgctttgaaaacatcggaagcactggagagaatcgctctatgagctgttacaatcttaaaaaagatcaaaaaattcaatttaaaatactgacgtaaaagtcttgagaatttagtaatttttcctacaaataaataatgataatatgttaggactcgggtgggaatcgaacccaccctaaagcccaatccgtgggcatccgaccattgagctaccgaggcatatttattggtcttatcaacattgaaattttgttgatcattaaactatattcaaaatttatatgcatttgcttatagattttgcagaaaatttttcgagaatttacaagatttccataaaaatatgttctaaaaatgtaattgtttatccttgggcattaagctatggtttttgctttttttgactcgcctcctttttgtcatccttcccaaccaaaaaatgaacatccgaatattctcctttcttcaacactttctccatttgatctgccaaagaattgacaatttttccattactggtgccttaaatttgaaatttattaagaggaggaatatatataagcatttcatggaattggctaaggggcatagccagcggaatttcgtattttaggaatacaacaggaacttagagaaagttcaatatatttacagatttaccttctttatcttttggcgggaaagcttttacatgcaaattggcaaaggcggaaaatataatagaataatagaatgcatatttcattctgtcaccttaaattagaaatttaaaaaaattaaatgttcagttggtcttagagccgagaattttgaaaaaatcgggatcggattccgggatatgattccagatgaaaaacccgggtttgctcggattcgaatcctgattttgccatggtcccgatccgggagtcttttagtgctagattccagccgggatatctcactatcagtcggcaaccctaaaatgtgaagtgggtccagccatgtaaaattaaaaaaatggggggaatgaatctcggaatggaatctattttaatatgaaaaaataatgaattttaagcgataaatcagcttatttatatgcccagtttgtagtggttgtaaacatttatagggaaataataaaagaaaattcaggacaattttaagaaacgatcattttgctgggaagatacaa

SEQ ID NO: 19781 - DNA, 2962 bp, Heterodera glycines
  misc_feature (2899)..(2899): n is a, c, g, or t
  misc_feature (2912)..(2912): n is a, c, g, or t
  misc_feature (2916)..(2916): n is a, c, g, or t
tttcatcgtaactgggctcagataataaaagcattttcttattttcatctccgtccccgctctgccccaacttattaatctcctgcatgataacatccgcattgttctgcgggtacgcccgatacggcacccaaaccggggaagcaagcccagcacccgtaattgccactccaaacatccgcacttttcgcttcattttttcttccgtagtttttaaagccacctttatcatgttgtcgattgcatccttcatcgcttcatcggggcgctccacatccgggttgacacgaaattccgtaatatttttcgtaaatccaaatttttcgcaagttgtcgattggtaatccatcaatttataattttccatttcttcagcaaaattatttctgaacaaaaaaattttttgaaataattcttaaagggtattatcttataattgtatttataattgtttaagaaattatttttttatttaatttattaaaaatcacttacccgattgatcggaaatcccattttttggccattggcacggcgggttggaaggagttcacgcgtttaaaagacattttaaaacaagaaattgaaacagaagaattaaagagagcagagatttgaaaagaaaaagacgtaggtaaatagtaatagatttaattaatgcaaataaaaatagagcggagagaaataaaattagagcgtgaagagagtttaatgaaatccaactatttagttgaatgatttgcgatttgggccgggtgtgcgaaataggcaaaaagggggagggatctagtcacgtgactgtctggggttgccttaatttagggggtcatcaatcatttcggtagacagctgtctcattttattcaaaaccgtgcaaaaatcgtttggatattccttatttcgaaagtcatcaatcattttttttttgacaggtttgcaaaattacgggccatattgcgaaatagttggacccaaaactaaaaatatggagaaatttcaataagaaaccaatcaatcccattttattgacagttgacctaattaatgggccacactgcgaaataattggaacaaaagtcacgtgcagattgcgaaataatggaagagaaataaaaacacatcaatcaattttggttgacaggtgacctacttttgaaaaggtttttcatcccgatttatttattcattttcgatttttatttttaaacacaatttaaatgattaattttattgtccaatttataattgatattgtttgcagtcatttcaattaatttgcacttcttccaaattccgttatcgatttttttttcgcggcggcggcatcgcggcgcggggcgagcggggaggaaatgcaaaaaaaccccgcactgttttggcacattttcaataatgaatttttaatttcaggattagagaaaccgtcataaaaatctcaggatttgagaaaataaaaccgcccaaaaggtttgggatcaaaagatttaaatttgcaaaagaaaaattgaatttccttcacctgtcactttggtgacagacggatgattgatgaccttcccgcggcgctgcgcggcgcggagtgaaaaaacacccgcgaggatttggggaaattaaaatccacaaggcggcagacttcaaagaacaccctcccataggctcgggattggaacacccccgataggttttggtatttgggtggcatcttcaaaggaatgcgcccctcccatagatttgggattgtgcgggaaaatgtccgggcggcaccttcaaagggttgcacccctcccataggcaagggtttgtgcgcgaaacacccgcgagatacccgcgaggttttgacactttatactactggggtgtattttttgaacaaaaaatttttttagtcgattcttagggctttttttcgtttttattgcatttttacatgggtttttccgaaacttctaaaataaacgctaaaaatggcggaatatgcacaaaaataggcggtcaggcattaagcataaaaccccccgaatacaatagaattcaatattattaagttgtactttggacagtttttatgtgcatatagaaagccgaacaaatggaaacacgaaaaatgtgaaatggaaaccaaaataaaaaatggggaaaagctaaagctaaattgacagtgatggaagtgacagtcgacgcatggaaaagtgagtcaatcaaagaataaagacagaaagccaaaagtttgatagaaagcttggtcgtttagaaacggtaaagatgttcattatcacttttgtctgtagtttcttccttttctcttcttcagctgtggtgatgcaaaattgctggatgaaggcttctcctcctcctgctgcttgttggataaagaatgcttctcctcctcctgctgcttgttggataaagaatgcttctccatctgccgctcaatttcagcaagtgtcaagaaaatggttgaatttttttcgatgttataagcaacgattttttcaaagtccacgagtactttaccatctgctttttggcatataagtttttgttgttggttgggcaaaatgccaatctcttggatatttccgattttcgtcttcaaatcgcgcacagtgtccgcacgttttacacgaactgggtactttttctggttatattcaatgaaaatgtcaaactcaactaatgtcttgtaatgatattcataacaaacgtaaataactgcgccttctttaatttcatattgttccattgtataccattgttcaaaaaacatgtcataacttccaggagattgacgactctttaattttatatcatctatgttaatgtccaactcccttttcagcatttgcatggccttcttctccaaatcttctacgtagtcgctttttctgacccaaattgngtaatttttctcngtanaatgcacaaaaatttcatattcatcaaaatgtatgataatgacttg

SEQ ID NO: 19782 - DNA, 1625 bp, Heterodera glycines
  misc_feature (1543)..(1543): n is a, c, g, or t
gctgtaactgttgttgcagttgtgccaattggtccgatgaatggttatgttgttgtgttttggcccattgggtgtgccaatggcattcgaattgaacgataatgcggaagcagatgacgatgatgatgaggaggaagaggatggcacattgaatgatgccaatgaatggaggggcgccgaatgagagcctatgagaaattaaaactttaaattaattttaatccttaatttttattaaactcaccgggcttaatatttaattaaattaaacgattaaaatcaaattattattttccaggtaataattaagcataatggtttcatcaaaattatattaaaacaagattaaaaaatcacaaatatttttattttgttaattttattattaatatatttatttaattgaataaaaattttaccatttttaagaattaatgatggcggtagaaaaatgattgctgttggttgcgctgttgctgatgttggcattgtcgcaaggaatggggggaagaacattggcattggcacaatgggtggaacagtgccagaaacattttgtggtggggatggcgatttgcgcggcttggacaacaaattttcaatggaaaaattcgctgccaatgaggaaattttcatttatataaaattttctttattttggattaactaaaattaggcaaattaacaaattacaattccgtccaaaaaatgttggaatattaaatttattgcctcgcttcgatgagaaaatactattttggcattgtgccattatagaaaagccaaatgccatttcgaatcacatggcttttgtgtaatgctaaaaatggaggaaaatccttttttgtgattgctttgatggcccatatatttaagaacagaaaaaaggaaaatcaaatttatataaaaaaagaccatgggaaattgaatgctaaataaggaaaaattcttattgtattcattcaaaaacatttaatgtaaaattaaaacaaacaaaattccaagatttatttcttattttcccaaaagaaataagttggatttatggaaaaattgtgatttttcaatgacaaaaagtggaaacaattaattaattggtgtcaattagttttaataagtagcaaatctctcaattaaaatttgtcgggttggttcttattctccaaatccgtgaagatttaacactcccaaccttagtgttccagcctaattttaaatatggcatttactgtgccaaaaaattatggcaacccaaaaaaaaattgggaccacgacgaaaattgtcgggggataatttgaaggcggccagcaagacaattattattataaacaataatatggaggaggaggaggcgattgtggcaccgctgcaggtcgaggtccagcaaaagctcaacttgtctattaactatcggtgtccccacaaaaaaaatatataatttattttcattttcccctttgttttgttgccgacagaaaatggctccggcgccgccgcatttttgaatatttatttcaacggcacttccctttcgtgccggcngggaggatcaacccccccccccatcatgggctgagaggatatataatgatggagtgaaagggtgctcgggcgtgagaaaatc

SEQ ID NO: 19783 - DNA, 1136 bp, Heterodera glycines
tttctcatattacctagggatagcgagagtctcggttcccggtctcgggattttagtctcggaaaacgagaaatttttacactgttaaggatgaccctttcggagaaaggtgaaacgatgaaaattatgaaatttttaataaattttcttaacaaaattctttaaaaataccaaaaaaaaaaattccgggcgcctatcggcgccgccggcccataaattcgcctaagatttcaaaatttgaatataaaatgcctatttttcagtgaaatccgaagaaaatattcataaaattacgtttttttctaatgcggcgcctattgcagcaaggggtgaactccgtctagccaattccatctcagcaaagttaaaatctatcttttttcttggtaaaatcagcaaaatcgtatcattcaacttaaatttttcaataaaaaatggcctttttgtcttaaatttctcacaaaaaaatccaatttttttaccgctgcgtctgtcggcgctgtaggtgaaaattttgcttttgaaagtgcgagttgattgttttatttttttaatttttaaattcattgtaacataagaatttaatgcctttttaaatgagtatttttcaagaaaaaaatatttcttaaacttttattacataactattttgctagaaaaggtattgaattattaaaatatttgaatttttattaattaaccatgaatatattcatgtcccttgttaataagtcttttgtatttctttattttatttaaatgatagaaaattcttctatcgttttagataatatatttaaatattttttttaatataatcaaatatatttgaatttatgtatttataattcaaaaaatctagagagaaaaaataatgaatatttaaaaaaataatttatgacacagtttatttactgttatatggaaccaaataaaatttcttagacaccaggaacgatttccatgtcataacggtcagcgcaacattttgatatgaatattggtaatttatagggaataaaatttaaaaaaatttttttatttccgtttaattatgaaataatcttatttaactttcttaaatttaatttttaaaaaatattttcaattttgaataattattttccaaatttttt

SEQ ID NO: 19784 - DNA, 1340 bp, Heterodera glycines
ccccccctttttcaaaaaaaaattttcaaattttttttttttcgattttacgccatttggggggggttttcagggtcgcagaatcccgatttctgatatcattttcggttcattttgagccattaacccctgattcgaacaaaaagttgaaatttaaattttcaaaaaattcacatttatgcaacaaaaaataataatgaaagtaatagttaaacaaaagtatttttatcaaataaaaaaaataatatattatattattttattgtattaaaaacacgaacaattccaaaattttaaaataaaaaactcaatatctaaaaacatttttaatcatataacaactgtatatgtctatatgataattaaatttgtacaaattataaataatattaatagataaaaccttttgtttaagtttagtattataaaaaaaattctggaataaataagcatgaggcatgaaaatttaataatttatattaaactgattcaaaaattaaaattaatgaattaaacataatcatttgcatacgattagtcaagccaacatggcaccaagttaaactcagctagtaattatttataaaaattaaaaataaatgaaaattcataacaaaaatgcctatcttcagaaaataagtaatgccatagaattaatcgtaggaattagaaaaaattctataaagcaattaatatttcaaaataatatgatacaattacacacgaaacatgtaccaaaaaattcattaaataatatacaagtttttttaatattaatttctcgtttagaatgaacacttaaaatcctaaattgcaaagatccgacgtgtaaaaaaatgcattgttcattctccatgaatattaaaaataatgtatttattaaaaaaattcccgatcttcagaaaataaataaattacataaattttttgtattcttgtttatctaagatatgcatatatatttcaaaaaataaatttcattaaataatttacaaattttttttctaatttcgcgaccagaatgaacacttaaatctttaagttgttaaggatcattaaatataaaacaaatcgaaacagtaaaaaattatcggaatgtatattttctgtcggatgatacatttatttgcaataaaaatgattaaaataaataatggaggactaaaaaaaactcattacaattgaatagtgtttaaaaaagctgaaaaaaattattgataaaacgaatactttagtttaaataatatcttgagagaaataaaaagcaaattaaatgttaaattccagtattgagtgtcgcatagaacagaatcataaataaatttagtttaaaataaatg

SEQ ID NO: 19785 - DNA, 2052 bp, Heterodera glycines
aatagttttttttttaatctttttaggttttatgtcttgtgctaaaataacatgcaactttaaatttcaaatttagaacagagtattttttgtgttttatgaattaaagaagcgctgtttagtaaatggatgcttcctttgaccaattcggtggtggaggatggggtgaccaaggcgaacaagaatttgcagcttcacaattccaaaaaaatatttatgacaaagttcctgtccccgttgcaatcgatgtccttatttccatgactggtgatgaagaaaaatatgttcttggaaatttttcttttaacacggtaatttgttgttgttttttgttgttgtaaattcatcattcttttcaggttcaattgatgggaaaagttgccaatgtgtcggaagttgaccaatgtacgacttacgagttatgcgatgccatggccacggatattcgtgtggcaaagagatttactgtcattcgttatattacggctgacttggttctttttccatttctacttatttgactaatatttactcttccataaaagcaacccgttaaagacgaggttttcacaattggccaattggtccaagtaattggaaagctgcggctgtataacaatcggctgagtgccgtctgcttcaatatccgtgaaggttttggtgtaaacatttcgcaaaaaatatacttaaaattcagttgaaattgatgagattgctattcacaaattggaatgcaaacttgccaaaatctactttgagaaggttttgtcctctcctattttaccacttccaattatttaggatttgaatatttagaatttgactgaattttcacttgggattgttgagaatgacacgattttccatggcaaagtgtccaaccaacggcctggctcgtcgattggccattcttttgctgggaatatggcaacacctaacagaaaactaagcgggacaaccactcaaatgactgcgaataggccgcaaatgtaccaacagaagcaacagttgaactttccaacgcattggacgcatcagcagcagaaagtaattggccaaattggaaaaataaattaattgcttatcgcttaagatttacgagttcattaagcacaatgcaattggcgaaggtttgtttaataaactcatgctttttgtgtccctcccttattttttttcgttaccatttgctaaaatctcagttctctttatttttttattgccgattcaaacttgagggggaaaggtcacaaatggaaactgataatatgttcttgcttcgttggtaattcgttctttctaaagcgggtgttcacaaggacgtgataagaaatgcgctgggtcttaatgcgagttgcaacacggacttggcaattctgagcaacgagggatcgatttacgcaacaattggtaattgagcaatgtgctaaaagctttcaaattcgttacgtttagatgatgaccattttgggaccattgtgtgacgtttcagccattcatttttcgttgacttatgacaattttggtcgatctcaacttttccatttaatgcttaaacttgcttattatctttgaaaccctcatcagttgattaatctctattcttaatttcatcctaattgattcacttttcttgctgttatgtttcgaatgactcccgatgagtgccgttcaattgcgagcgaaggcgaacgatcccttagagaaggcgacgctgttaacggtatgtgtgcaggcttttatttgcaaaaatgaaaaacatgcatatatttgctccgaatggcgaattttgaaattcggtagtgccggtgggtcaatggcaaaaaaaaacaaaaattcggaaaattagatttagaagtttaatagaataagtgaacatttactgttcatgaaatggtgtatcatgggtaaaacaggttgatttttattcccattatgaaaaccagggaagtacagagcaagagattttttgttatactggcctgcgtccatcgatgatgaccaatgggtcatgctaattctgaaaagggcctttttcgaaagggcccatta

SEQ ID NO: 19786 - DNA, 1554 bp, Heterodera glycines
cagattcgtgatcagcaatagaaaagcccagaatgcatgtttttattagatgtaaatttatttaaaaaatcaaatatgtgatgaaaaatcatagacaaaatcaatgatttttcgaattctgagcacagatccgtaatcagcgtattttttcacactagaaaagtcgaaaagaaaatttttaaatttatttttcgccgggacaccgatttttccagtattaccctaaattaaattgcttattgctttttcatgatgcatttggccattgcacgagagcgccaggatcgcgtgatgtgcgggttgggtcttgggaatattggaaatgcctatttttacttgggagaatatgaactttcgattggacaccacgaaaaggtgagacaacagttttacccttatcaaaatatttccattaacaaataagcgaattgaacttgcaaagaaacttggggaccaggcatcggttcgccgttcttacagcaacattggcaatgcctatgcattgatgggggattacgaaaacgcagaaaactcctacaggtcttcatgactgtgggtgaagcaaaattgtaatttgcaggcttgccttagcattggctcgtgagatgaatatcccggaattggtcgaccaattggacgcggatttggagaacctcagccatatcatggcgaagaacaaaagtgaatttcattagtatcatttggaattgttttgtaaatgttaggaatgggcgacccttccgcaaaacaatctgccgatataacgttcacaagcggcggaattaattcgtcgtttggaacggaatcaataaatttttgtttgtccgatgtcacaaatgccgatgagaattccgaccgcgacgaaatgtttgaacaaattgcacgactaaacagcaaacgaatcggcgaccaacttgcggattttaaaccagcattgcgcgatgcgaatccgcagcacatcattttgggtaaaatatatgctaaacaaaaataatagaaaattattccaggcatcagcagcgcttctaacagccgtcgcttttctcttccgagaaggggaatcggaaaaatgatgaagtcattgagtcttaagaaaataggagttggggcaacaccgaagcgtggaagggagcaaaaggacgaagcaactagttcgacagacaacagaccgaggagcacttcatctttgaaagttgggcttggaaaaaacgctgaagtcaaactggagttttgaccgatcattgcacaaacagtcgataatttattgttcatttatttttaagttggactttttatatttcaaaaatccgagaacataaattttggtgaacaataatggctgctgtgtcgtcttcatattcaataagcactagccttgtgtttgggtacaaacagaaacccgtcaggcactttccccagcagcatttcactgatacgaacccagtccgaactggcagggcttaaaaaatggtgggactggttccattccttttgctctgtacctcgaaagaagcattgcgagctcatctcttccgcggtacaacggcggacgat

SEQ ID NO: 19787 - DNA, 1087 bp, Heterodera glycines
ttttcgttggcatttattgataaatttaaaattatttacaatatttatagaacgaagtgccaatggaaatgccgacggcgatgagaacgttgcgcgaagtgcgcgagtcaaagggccaccaactgcacacatttgcccagcagctcgtccagctgacacagcacgtgcacgtggcacgcaaggagtacgacatggcacaactgagcactgaaacgaagccgttacgcgaaattcgacgcgatgcggtgggtgactaattagacgaaattgtttcatatatattatttaattttaaatttaataattttccaaaatgatgttatgacaacccctataaaattttttatatttttcgtgtcatgactctccaatttgctcacaggtgtgcaaacagttgcgcgagttcctcagcgagaacgagtggtgcgccgtgttgatggagaaccgtgctgcgttgggcgagcgcgtgcacaccgattggcatgacagcgtgcatggtgggcgcatgagtgatttgttgcaaaggcctgcactgcgtgtgcagcacgctgcagtgctttctgctgcctggggcaccaccagtggcacatattataggcgggcacgcaccggaagcacagtcacaaccaccacaaccactgccatacgcttacccgttaccatccagcacatactgtaggggagagaattgggcatactgtatcaaaaaactgtatttaaaacaattaaaattaaacaaaaacaattctctccctttccccttgcaataattaggcactaatttttcactttatgcacaattattaacaattagggtcccctcccacccaattaggtcctcccaatgttcaatttgcttttgctctaacatttctttatggccaactcaccgctttgaaggggcggggccgactgagcaccgaccgaccgaacgcttttcgcatttccattcgtcgaaaagtccacaaaatttgtgtgccatttttatttttttgattggtcggaaaagaattatacaaatttcatcccaaaaaattttgttgacatcaaagtgttgcatgcttcttttttactccttctttttttt

SEQ ID NO: 19788 - DNA, 1383 bp, Heterodera glycines
gagaaacgttgaggtatcccggacccgagacgtacactttcttagacatgaagaagttcatgaagaaaccgcgagcagcaccacgcttagcgagctgttcactgtctccagacgctccgattccggcttcatggacacagttgtgcacgaacgacattcagcggaagagagcgtgcattacaccaccggacaaccagtcatggaacaacggacgctgcaagtcgacatagaccgacggacgagccgagcgaagacgcaagtgcaagatgttgcagaaacagcacgcgcaacaaggagattttctgttgaaaatacgaaacagaacgtgtcgctgtctccgctgcaggtgaacaataaagaatggccaaagaggcgggaagaaaaagcatgcgtgacgataaaaaacggaaaagggacacgcccagatgctgctgcggtgtgccaatatttgatggtacccgaaaaatcagagcgcgccatgagttctcgagctgcactcgcctcgagtgggtcgagttacgtgaaaaggttaagcacggcgtcagaggatgaagcagttgggacgacgagcgcaccggcaccacgcgtaattggcattgaaacacgcattgagcaacagccaacgccgtacatacggcgcgagaaaacggtgctgaggacagagtcatggccaaagttggacagccgagccaaagtggaggaatggctaagggggacagaagagggaatgccggaagaaatgggagaggaacaattcggagaagaacaggatcaactgcagaatcatctaacagtgacaaaggcagaattggctcggccggaagaggcgctcggagtcagcgttgagaagccggaaagaagggaagcgaaggaagagcgccggatgagattggagcggcaagaaatggccttccagctggttcagcagctgttgagtgcaggacgaagtgaagcatcgctttcggaaaagcaacgggcaatggtttccgagcagttcaagcagttcggcctggaggagatgagcaccagcattgtgctggagcagctcgaagaagtggcgggcagacccgaggcaaaagtggcgctcaaagcgtggaagagcctggaagaaggactgagagtgctggctgttatggaagaacgggtcgggtttgaagcaacctggacgaccggagagacggagtcgggtgctgagaagacagtgcagttggcacgtgttgaagctgctcagaagcgagttgaagaagcgcaggagcagctaaggaccttccttacagtgttggtcgggccggaacagttcgaagaagccaaactgctccagaaaattccatggcacacgtcagccgaataccgaggcccggaatcgcgcgaagaatgacgaaa

SEQ ID NO: 19789 - DNA, 575 bp, Heterodera glycines
ttcatccgttcctatttggcgacatttttctgatcagtgtgccgcctgccgcccacatttggagaagcgggcgggcacaggatgtgaacttctccgccggataattccttatttcgatttggcagatcgatctctgcaatccaccgtactctgtcccgccggggctgtcagatcggctgaccgtttcgttttagggcccccacttctctctgcccttctctgatcattatcatcattgcaaattgtgtgtttttgtcggcaataagccggctgtcgcccgctttcgcttgattgtttgtttatttgttttcgcccgccgctgttcaatcgtcgcacaaatccccggcgggggaataaaagttgcaaatttctcccccccccccatttgtccatccaacaatttgagagaggatacacacagcacaatcatcacataaaatgtgttctcagctcacatagggccgggctcccccctcttcccccccccctctctttgatcacccggcctccatttcatgtgatcttgataggtactatcaggtattttatgtccccaatagtgaatcttacattgt

SEQ ID NO: 19790 - DNA, 1174 bp, Heterodera glycines
tttttgctgtgtgtgccgtgccatcgtcgtttccgccgtcccggccaaaaaaaaacgataaaaatatggccataaatctttttttttgtgtgtgcctttcccgagagaaaggcgcccattttcctgcccatttttcgcattgtctcgtcccatttttcccttcaaacaaattttttttttttttgttcacccaaacggcgaaagcgaaagaaaaatgacgacgtttgaccaacccgaggaaaatgaaagttccaaattcactcctcccataaaatgaaatggaggagagaaaagagaagaaagtcatgggacacggcgaagaaaatttattggcgatgggacggagtgatgggggaacggagccctaaatgggggacaatttggccggaaatgtaccaatttgtgcattattgttatgggagaaaggtgtgccaaaggtggagtgatcagaaacatgccaaattccgatggagtagtagtgctactcgagagcctcggtctcgactagagaaaagtttctcgcttttgacagtatttgaccggaaataaacaaatttgtattggtatggagaaggtgaaggcatgccaaagattggaatgaaaaagaattgtggataaaagtgtgtgccaacggttgggcgatcaggaaaattccagattaatgatattcgagagtcttgggctcggcccgagaaaagtttctcgacctttttcggtcttggcaaattcgcggtctcgagcagccctactaaagcagaaaaacggtggggagaagcaaatgggtgggagggaacaattaggccagaaagaataatatgtgagtatctcggtttttgtttggaaagagttggcacaaaagggaacgggtcgttttggcgccagcctcagtttttttattataactttttttcttgttgaccaaatctaacaattttggtatcattcgaaagcccttcacaagctctattagccttacaaaaaacaaacaaaaattttagcttctaaaaaagttattaggaaaaaacctcaaaattttcgacttttttgcaatttcatgttataacttttttggtaattgtctaatcgcgaagcaatagcttagaaatatcttctaaacatgttaagctttcgaataataccaagattatggattggttaagctctagagatcccc

SEQ ID NO: 19791 - DNA, 2588 bp, Heterodera glycines
ttggtactttcctgtttggaaggcacaccacatttacaatatgcaacaaacattgttcaatattaaaagaagacttattttgaaggcataaaagcaacaatttccgccaaaatttcctcaaatgcagcgacgttacgtcgctaacagccctcgcgtcatagaaattcgcataaatacgaatcaaacaattttaaaaaaatggagtgtgccttcaaaacaggaaattaccaaatattttaatatgattgaataaacaaaaaattctactttcttcaaattgaaaatattaaaaaatataaaagtagaattttcaagaattattgcggttctggttgactccactcataattattttaattattttttaattagactaatttccattaagctaattatgaatgggtatgagatatgtctgagcattaaaaatagaaaacgggcgaaagtatcgcacaaacaatgggcaaaaatgaatcagcccaaagtagagacaaacactcactcactcattttccattcacttacggcgcggtggtaaggcgatttgcgacggacggacgacgaaatgtaaacgatgggaaaagcacagcaaaaaaaaaaattagggatgggatttttaaggatgaaaaagtccaaaataaggccgtaaataagggcgaaaaagtcaaatttagggtataatttttaaaattgctgttttttacatgaaataatttcagactaaggcaaacaattttattcactgattgcagtacaaataagctatattttagaaaatttttttcatttcttagggtctatttttgaaaaatttagtgtcgattcataggggtatatttttcgaaatttttttgggtcgattcttaggggtgtatttttcgttttttattgcatttttgttaataaattttggacaaaacgccaaaataagggcaaaaacttattttaagggcgaacatccaaaataaggatttttaagggcgaacatcaaaaataaggatttctaaggtctaataagggcgtgaaaacgcaaaattttcagacaaaaaatgtgtttttcgtgtatttctcgttgagttaaagccgcagaaaaaataagtaaaaacttagaaatcccatccctattgatcattgaaattaatgcatatttttaatttgttttttattttttccgctaactaatttattttataaacttgaaagtctttaaaagagttctgtcgcacatcatttatattgatcgatttctgatcattcacaatgcgtattaatgttcttcacggctcagcgtccaaatcagccatcaaagcccattccaccgccaaatccgccgccaaatccaccgccgccgtagccataacgctttttccgaagtggaacacttaaaatttaatttaaaaaaggaacaaaaaactttttgaaaaatcttcaaattataaaattaggttgtttttttttgcacttttgaagcattcaatttttaagaaataaaacttccaatttttgccgaaattttcctaaaaattggcggaatgtgaaattacggcgtcaaaaagtgccgtaattggtctggcacagccattagaaagaaaaatggaatgccaaaaataaaaaataaaaatttatacctttcaatttgattgtccactgctggcatggcaattgttaatgaaaggcaaatggcaattaccagcagaacaacaaaaatggtggacaaagaagacattttcagtgtgaaatttgctgctaaaaaaatattcgaatgatttccaattaaacactatcatttgcctttaaatagaaaggtttgcgcacattaattagtaattaatacttgcaaattactaattaaaggcaaattaggtgcataagtttttgtaaaaaaaaatccatccccaattcgatgaatgaatgaataaaattaaaataaaattcatcaaattacgtgatactcttgatactctttggtcggaaacaacaaaattttgttcgttgaatccaaaacactttgaataggcttttaaaaaatttaaaaaaaattcaaattaccatttttaattagaggtacaggaaaagcacacgtttttaggacttcaagacgaatctggcattccacagcgtaatttgatcaaagtaacgccagaatttgttttttcataaatttttatgcatttttagggaataacggtccgatcgaacagcattcttttaatgttcgaatgattttacgaaaatgacaaggcaaaatcatgggaaaattttgccagttatttgaaagaaattaattgttttttctaattaaaaaaacagtttcaaaattgtaagcatttcgtaagttgctagtggtgccgtccatccgctgacgaaaaacaaataaattatgccaacattttaagtgcgtgccacgtttttttctgtttctctgtttatatacaaaaaaaaaattttaatgtttgacattatgaaactatatataataaattgtttttacataaacatattaaaaaaaatccacgaaatataacaaaaaattaaaattaatttcaattaaatattatttagcgatttaataaatgcctcctcatttt

SEQ ID NO: 19792 - DNA, 2555 bp, Heterodera glycines
ccttggacttgacttccaaaagcgtttgacatatttacgaattatctgcggaatttgggcatcgacccattctctcgtgcatttaatgtcttcgaaatcgacaaggcaacgcgaaaaagtgcgaatcattagcatgtcaggactaaaaagcaaaattagcattgggtcgtttgagaaatcggttccaccgaatttggtcaatctcgtaaaatgtgtcagcaattgccagcgtttctctgatccaacaatcgcccgttcgcagataaatgaggccgagagcgacggctgctgcgggagaagtcaaatgggtgttcagcgtgggcagttcgcgcacgtggctggagcacggctggccaatgccggaatggtcagcgtgccgtgcggtcgattgtccggacgttcctccgttgttgtggttggcacctgaaaacggctcagtatgctcgcattttgggactgtccaccgttcaaactctcgaccactccttcaatacctcctcccccgggcgtgtaagcacggccaagcgacgaattagccccgcccatccttggccccaccacattgttggcacgcatgcaagggcattggacttggtcgtagttcaaataggccatccttcgctcagccccctttagcagtttaatcagacggtctttcaacgagggagacgacgaaatggcaatttcagtgtcactaatttctttgccttttcctaaaaagaatggacttaaatgaactgccttgaaattgaaaggacaaacccaaattaatcagcccaattgcgaaaccggcggccagcacaaaagaatagcgatcttaagggaaaagtgtaaaagaaattggtcagaatacagaaggcacaattatagttttcttcaaccattggtatttttgtttgttttttaacggggcaacaaaaaaaatacatacccaaaaataggttattagaacataagtgaaaatttgtattttttatgttgttttttgtgcatttcggtctgaaggactaatcacctgaagattggtcgctttcacacggcacttctaaggacatttgattcaaaagcctgacaaaaattacgttaccgtgaaatagcaaaatgataccctaattgtaaggctgacaagaagggagcagttcgaactccccaccccgtatcaattcaccccccccccccctatctcacaatcactaccctcactttttgtaaaattgcaaaattaatgttttaattttctagtaaataacttttatggggggaggaattgttttttcttaaaaaactttattttttgccagagaaattttctgatacaaaaaaaatttgttgagggagtcaatgtagcataccgtgaacaaaaagttctgaagtaggactttaattcattttaaatggaaaaattcaaataattgtcagcccattgcgttaatattactggcttgacacagtgtgatttgtggtctcacagaagagaagtcccaaggagagaagggcggcagtttgtacgaccaaatcgatgcgaaattcgcagagagtcggttggaggaggaaaggcaaatgagtggcgatgattttgtatatctgtgaaaaatttattttttgattttcttaccatttggcggaatttataaaatgcgtcagcacgccgtaacataagtcaagcccccttccatgcccccccccccgtaaatgggcataacaatggagtgcaccctctcaagaccccttgtacattttgatgtaccgcctttctctccaccctcccccaaattcattacgtgcacttcgctcgtccctcgatgggctgccgcacatccgacgagcaatgcgatgaccaaatgtctattgttttgagtaagcagcaggtgaatgtcgtacaaattcatcatgcttcgcacgttgcccacaaagccagcggctaaaataaggccggcccgaacagtgttgggtaattcattttcagatgaattattggagaaaagacgccgtggaaagtcgccgcaaaaggaaaggccatgggccaaagcgttgtaaaaattagcccaatccatagcaattttatgggtctaaattatttgaattttggtgaaacccgaagagcagcaaacgggaaatgaatcgttgagcggatagtccacttggttacggccggagtgaactcggccattcagacaaatctgtcgcatgcccatcgcagggtccgaattttcttccgagaaacaatgacgggtacggaaatgcagcatcgcttgaccaaacggacgggtgagcgtacggatagccaccgacacgaggaattgttcgtgctgttcacgctgttggacatcgttgaatgaaagcttaatatgaaaatcaaagactcgtttctaaaacaatagaatgttatcattcccaaaagttcaaacaacggagacactcacaaccatttttcatcctttccttaccccaaatgctttattcgggattaaaattggcattgatggatcgagcatttgcttagcattgtaaagtctcaaatctgtcgtccaccgcgggactgtgacccatttgtg

SEQ ID NO: 19793 - DNA, 1244 bp, Heterodera glycines
tgtcccgcttaggccaaaattttttctatttccggaactattcgaaatttttccgaaaaaaataccattcgatagagctcgaaaaactatgttttggaagtggtctccgttttgccaggaaaattcgttaaaaaatcataaaattcaaaaacccgaaaaccattttttaggcctaactcgaaaaattttgaaaattttcgaaattttaaaatttggaaaaatcgggcttttaaagctctacaataagtctgctggccaccctgcgctcagctcaaagcctaatgagttattcgcctggtactgaagtgggaaaaaaaaattaactgagtctccgtgtctgtacaggtccgggatttggtctgatcaaaaaataaaaaataccggattatagaggacacttctgcggagtgccctcacagcgggcactttttgattcgggttttagaaaaaaagttaggggccctaaactgcaagaaaaagtgagaaatcgcttctcgggactcagtcgtccgcgctgaatttttttctatagttttcccggattctcctcaaaaagttgtaagacccttccaccactttcagggcgctcccggccttcggccgggagattttgttttttgaaacgaaactcaaaacctatataacatatatataactagcgtgtggcggcgcagtaattgctcggtgtagacagatgctttgcacagtatttgctcggtgtagacagtatacttttggtatatatgggcgggcgctgacatgagcgcttcgcgcaaaggacttcgttgctagtgcatgcgcggctttcataatcgatgcgtgtaccacaacatgcgtggctccccacccttccccccacgcttcccccctggcaacagtgattaatgaaagccctccacctttgagtgctcaaaattagtatttttacttgaattggaaatatctgttttttttttgttgctgtgcttcgaaattgtaaggtatattctgttgggtccaagttgaacgtccaaaataaatgtaattgaatctaagctgattactttactattcaccgagtattaatattagagcctggacgggaccgtggaaccgctgggatttttccgggatttcccggcccggcctttgtttttttatgattaaccaccgggaacgggagagacctgggaaaataggagtgactgttccgggatcccgccacggttcattttcaaatcccggtcccggcctgcctagctggg

SEQ ID NO: 19794 - DNA, 263 bp, Heterodera glycines
gtcattctatgttactagatcggggatcgatccccgggcggccgctcgagcaggacctgcagaagctagcttgatggggatcagattgtcgtttcccgccttcagtttaaactatcgggagcggcgcgtagcgggggaggtgggtggcggaagaagaaaagggtggggggagtatgagtatgatggtcaatatggagaaaaagaaagagtaattaccaattttttttcaattcaaaaatgtagatgtccgcagcgttattata

SEQ ID NO: 19795 - DNA, 1264 bp, Heterodera glycines
tgccgtacagattaaaatgcttacacgtcatatatctatgcataaagcatttaaaagcgatttgtctttttcctttgatatccatctacagaaattgccgtctgtgacgaaaacattatgatcaatcactgatttgacgtcatatttttcataatgctgtttctatttgcaaatatttctgacaccacagcaaattaagacgtcaggaaattgatggaaaaaagaaatttaaatttaactgagacggaatttggctgatgtcttatatttcattttgataaaatgatttggtctggtcagtgatatgatgtctcatcagtaatatgaggcaaattgaaataagcccaagcagagatcggttccaaaaatgagtagtcacaaatttcacaattcgccttcttttatgaattatgcgggatttgcgggattaatcctatcaattttaataaaattgaaatttatcgaatagtttcgacaaaatttttacaaaaaagttttttctgaaaaattttccgattttgggggatcaaaatcccaatttagctgctaggggccgttctaatagaggttttttgaaaaaatgcaaaaatatggacataaaatatggataaaaagccaaaatatggacaaatatggaaatatggagataaatcgcgaaataaagaaaatatggatataggaatccgtcctagaagcttctaatcaagctaaaaacatggttttcgtgcgtttcaggcctcccacagtccaggaaaaaaatatggattcccatataattttacgccctaattatgagtgacagcaacatattaaattaaattcttatcaactttttaaaatttatttgacagagcggttggcgccgcgaagcagcgcccaaacgctcgtgtttaaatattctgataaaaatcaataaataatttttttaagcaaatatagaaatatgccgaaaacatttttgaaatcacctttctctttttcatcttgttttagaattttaaaataaagcatattatttcgaaaatttctgttatattttatgttttcaaaaatttcggacttccgacctttttggggtcgcaattcagattctaatgtccgaaaaaattttttggggcctcggaatgccatacttgggcacagattcattttcgaaacattataagctgacgcagcttgatctttaactgaaatgaaaaatgtattttagtactaaagatttaatattttatttattgtttcatttactaaaaatccaaaatat

SEQ ID NO: 19796 - DNA, 1359 bp, Heterodera glycines
atgtaaatacatattttttcctgcattcgccatgctctaattagtaggaaaaacactttcttttttgtgttgcgagcaaaagttggacttttatttacatatttttacatatttcggggttttatacatatttggttcatattttagactttttcttacatattttcatttttttttacatattttgaggattttttatggaaattttcggaaattctcaaaaaaaaaaatccaaaaattcggcaaatttttcgtacatattttcatatttttattatatattttgagaatttttgtaaaatttataaaatttcttgtgaaaaataaaaattaatcaactaatttttaaaatactaaaatgtgattctaggcctatttaggtcatttttatggcattttgtgcctatttcaccctttccgaagaattttttttctaaaaaataaccattttaaaaattttatttacatatttggtacatattttgggtttttcttgcatatttcgggattttttttacatatttatgtacatattatgaccactttttgtacatatttttgacagccctaattattacatatactaaggataaaattaatgaatttgctcaaaaatttatttaatgagtaattccaaaaatttataatgagcattttaattgcatttatttttccttttttacttacaattttctacagtttgatgctcagaggcatactgcaaaaagtcggctttgaggccgagataaaaaacctttgcaaaatctgattccgcgaaaggaagtagcgtatcatcaataatcgacttaattttaattaaaaataagacaaatttagtaaataaaatttccatgaattcaagaaaacaaaatatttcgtaaattattatcactcagtctacttgtgcagtttaattaacctaattagagacaaaatgcaaaaatctttctttaaacaattgttttacgtacaaaataagtcactgaatacaaatccaaggaaaaactgaaaaatgctcaaattggattttcaccgttttttttttgctaaacaaatgaaaaccatgattgaaaaacggcttaagccatatttcgaggtgtaccatgactccgaataggccatttttcggtctatccccgacccggacgctaatcaccaaaaattcgaaaatcaataataaaatttcaaaaaaataaaaaaattttaaagaattttttgaaacattttttggtaaagtgcattggtacaggaaaacctagtaagtaattctccataaaaagaaaaaaatttctttcttagatatttgtggaaaattttttaagattttgaaatttctgtttggaaatttaaaaaatttga

SEQ ID NO: 19797 - DNA, 2655 bp, Heterodera glycines
  misc_feature (852)..(852): n is a, c, g, or t
  misc_feature (1816)..(1816): n is a, c, g, or t
tgcctccgctaatccacgactccgtcgtaagtgatattcgtcccgtccgctgaaagtttcgccaaaatcctttgaagaagtgccgaatcgttgtgcgacttcaatgccgtcaacaacattagacagttgaattgttctttattcaattcactgaatttgaaaccggcccgcaatttacgatgtctgttgataaatagggcgaggatttttagtggcaaaaaaccccaaaataattaactaaatagtgacaaaaaaatgccaaaatagtggcaaaaatagtggcgaaaaagttccaaatttagggatgtaattttttaaacaactatttttaatttgaaaataatttaaaattaaggaaaaagatgttattcactgattgcagttacaaaatattttcttagcaaatattgaacaagaaaaaaaatttgggggaagaattttttccaattcttaggggtgtatttttgaaaaatttttaggtcgattcttaggggtgtatttttcgtttttattgcaattttgggaagttttccaaaaatgccaaaatagtggcaaaaataatgacaaggctccaaaatagtgattcctagtgatgaatagtggcattaaaacgaagaattgccgagctaaaaatgtgtttttcgtgcaattcccgtctaaataaagctgcagaaaaaatagttaaaaaactagaaatcctcgtcctacaaataaacataaatgaaaataattaatttaaataaatgtctcttcgggtcccacccgaacatagccaaaaatccgctggggcgtgagtccgtatttatcaaattttatttgtgcgcgagattttggcgttatgtgcatggttanatcgctaatctccaacccctaccaccagcaaacagcagaggatgcttattcctcggtccagttcttttaatgagagtgtacatcgatttatttatttgcaacccaaaccagcgaatcaaagttttgtaagcctgcaaaattcataaaaagggcaaggtcaaataaatttatggcctggaaggtgtaaaaacgagtttcatattcttttggtcataacttttttatctggctaattatttgaaattttgcaggcccatagaatttgttacatactgaaccaactcgtactgccccgtttcacctttttcagtaaaaaaattctcaacttttgtcaaaatcaaccaaattaaatataaacattttcttggtgtcattcaataggccttaagattcaatttactagcaaaattcaagaaaagcttcacatatttgaaaaataaattagaccaacaatcctaaaaaaaagtcgttcatcattttttttttaaatatgatcaaattttttgaaaattttcaaggaaattgagaacctcaagggctaattgtaagagtgaagcgaaactatttgatttgtttgactttgacagtacgagtcgaggcggtacgagttgggtttcatccatatacctatcttaataggcaatcgagcccggaattttgaaaagggtccagtttttatcccgatcccggctcttttttcaaaaaagccggaatcggaatcccggaaaaatccggcgggaccctctcgagatctaatcggtatgtcctatttctagcaaaaatgtcaaaattgtgtccccttttgcatcggatggagttgttgttgcgcaccggaaagggagcggatgtacactttttggttggccgggaagatcaaaaagaggcgagttgctaggggaaaaggctctaatgcactttatgagtccaattaattgacaatcccgcggtttttatacaataactnttgttcatattcataacaaaccctatctttgtggtttgctacgaaagatgagagaactacacttatattatttatttaatctcaacaggtattctgtctctaaaaaaattttcgagaaaatcaataatatccctcataatcccaagtaactatatttataaaataagactttttaggtgtacaaataatcaaaaaccatattttaatatttcgacattcctaattccaaaaatgctactcatttcaactgacatcttcatgagcctgtcgttagttgccgctttttctcattctgctccagtaactcaagggaaacgtaagttttcgaaactaattaataaaaatacttgaatttcattaatcaaattcttccacgaatggaagaacgaccacagagaatccaccaacttctgctggggctgtctcatcagtcgcacaagttgccaccgccgtattggcagtgactgccgccggactgccggatgccgactgtgcacgacgaccgattgggtatgccaaagaagcgtagactgaggtgacctatgttgcttctgccgttgatgccccgttgtctcaaccagaatcagcaccaactcaaagctttgcgacagatgattttaagacactggtcggtgccacttactgtgatcaaaagagccgtgtgttcacgcattatttatcatgaatatttaattgcgattaattccgatttttattttctgttttagttatttaaatttaacaattaattgtttttcctcaacccatgaacaaaattaaacctaacattctttttttagttttttggttttgactggaaaattattaattattttatt

SEQ ID NO: 19798 - DNA, 1415 bp, Heterodera glycines
tcataaaataggcagcgttttttgaagaaataaaatattggccagaaaatgcggtgcaaatggacaacaaattgccacccaaattgaaaatttcgcacagagaataaaatgccaacaaaatattcacagagccacggagtgttcttaaaaaaattaaagcctaattaaaaaataataatgtttgaaaacaaatcggcactttgtcctaattgtaacgaaaatgacggccaaattcatcgtggcaccaatggtcgccacaaagacaataattatgccgtaaatgacccctgtccaacatggctgctgatcactgcaaaccttgatcaaagcttccatctttatttgagtatgaaaaatatagcctttattaaaattagcttcaaaagtctgaaaaaccaatttttatctcaaatcagaatataaatatgttttaaattctttagttatgattagagaccgcattttgaggcctatgccttttttttctgcgcactcgttcccgtatattaaccataaataacacattttccacttggttggaggcttctatgttgacttttattatgcctttttttgcctttttcgggatttcgtgccttaaatgccttttttggcattttggcgttggtgccttcttttgacgtttttttccgattttagtgccttttttggcgttttttccgaaaattccattaaaaatagaataaaatcgggaaaatacacccttaagaaacgacttgaaaaattttcggaaaatacacacccctaagaattgaaaaattttctcaaaaattgatcgccaaaattcatttttttcttgataaaaaattctcggtttaaaaattttccttattcgaaaaacattataaaatattaataaccatttaaatgcccaaaattaagtttttggttaagttttacgtgttttgctccctaaaaaaccttagaaaaattttttaaaatgccttttttcatgcctttttcgcgatttttggtgcctttttatccgagctctactaatgacttatttgaatggaccaagcccaaccaaacaaatgcaaaatcatagagtaaatggacaagtgcagaacaaataattggggaaggatgaataattcgagaggactcactgaagaatgagtgatgacagctgaccacccaattttaaatattgacgacaaacaatttaaataaataaatatccaactgaccaatgcaaagggcaaatattagagagagacaacaaacggagagggacaattaaaattacaaattacaattgaacaaagggaagattctcgggatttttttaaataaattgaggggcttttaatgggtaataaaaaagttttttgtttctgaacaaaagttttgacgagtttttcgaaaatcaaaaaattataaaataatacgaa

SEQ ID NO: 19799 - DNA, 2989 bp, Heterodera glycines
  misc_feature (2206)..(2206): n is a, c, g, or t
  misc_feature (2963)..(2963): n is a, c, g, or t
aaaaaataatttttgagttactagaattaatgccatgttttttttttaaagatatttttttaaaggatcccttaatcctcttgtccatttggcaagttgttttcgcttaggacgatcgagtgatcaaagaataatttcttccgagcgttttcgtcctaatggtccactccctgatcacttcaatttcacatgtacgcaaggccttttgtccatttgtcttactaagtaatgttcaattaaattgggcttagtaatagggcgcctgtgaaagtcaaatttcaaagaagaaaaaagtttattttttgaaattataaaaaaagtttttgaaatttttctacatttatcagtttaaaaaattttattttcacaaatactttttatggtaatgaggaatacccaaagcaaaattggcgaacttcacttatggaaggtccgtgctccgttcaccccccaacaattgtcagaatgtcaggtgacagctgatcgacatcacctaatcatccgggcgcctactccagacttgttcttaggcagctaaatacgagctcaaaaattcaaaatcttcccatttatagtagcagggtccattgtaaaaacaggaaaaaatctttccggaacaactcctccttatcctccaccatctcaagttggcgagtcatcacctccgggtccggcacaattccggtctctacacaaaaattgcatttctttaaaacccgctattgttctatgggagcacctcttcccccccccccccccatatcagaattttcttaaatttcaaaaaaaaaattttttttttaatttttagatttttttgaaattttctgttgctattaagttctctcaacttttcttaaaattcgttgaaataattttagtaagaaaattttgcatttttttactatataaacgcaccgatctcaagcatacgctcgccaatgaaaatgtcttgctgttcaatttcgacgatttgccttacacattgtgcgagccgttcggccaattcagtagatgcatctatgagcgaatagtgagtttatataccgtatggaaaaattgcgtttcagttcgatcattacttaccgtatttactcgattatagccccccccccgccctctcaaatttcagggggtccattcctttgccagagctttacggatttgtttgaacaaaaacaagtttcactaatagtacccggttcttggtggtgtttaagctgttcggcaacactttcggcaacagttccgcagcagccatcactgacttcaccaccgttctcctcgtcgtcgttggggggaacgagttcgatggaaatgccatcaccaacaatttgttgttgttgttgggcaacactttcggcaacagtgccagtgccatcgctgacttcgccgccgttctcctcgtcgtcgttggggggaacgagttcgatggaaatgccatcaccaacaatttgttgttgttgttgggcaacattttcggcaacaatgccgcagcagccatcggtgccatcaccaccgccgttctcctcgtcgtcgtcgttggggggaacgagttcgatgggaatgtcatcgcccacatttgcatcctcggcgttgtggtggtgttcgacaactgcggcggacggagggggaccacggacggaattcggagtgctcgcgagcaaatggtgggaaaagggtgaaacacttaaaaaagtgaattaaaaaactaataattaaactaaaattggatgccatcgactgaccattcgttgtcaaagggaaaacagtacaccaccaagtcaagggaacagccgagcacctaaaaagggtcaaaaaccaagtcatccatccattcgactcacgaaaagaggcccgtggaaaaccaaaaaaaaaacagacacaaatgatgttaaatgttggcggtacacaccaaaacacagccaagacataacacagccgggaacaaattaatttttttttcacttagaatttttcaagaaaaaaatcttagaaaaatcgaagtaaaaaattttccagagatttttataaaaaactttgtaattcgtcattaaattttgaaaaatcgctttaaaattttttgaaaaatgtctttttcttagaattttctgatttttttctagaagactttctggttttgaaaatttattcccggctatgttatgtttcgactgtatttcggtggttgtgttttgtcctgtcncaaaatgtatgatggttttttcccggtttttttttgccaatttagagcaattccacctgtccctgactcactccttcgtgaatgggacgcagttcgaggtgcacctgggccacacagtccgccggaccgatcagcacgcgtacattgagctcggcggtggccaacggtcgggccacgggcgctgtcgccgtcgaagatgatgaggagacgccggaggagccgccactcgcggaaaaggcaccgccgccattcggcgcactcgtcgttgtttgtaccattggaccctcaacaaacaatgtccattcctggaagaaacaaaacgggacgtcaacacaatcggagaggggacacagaattttttttgttttttttgctctccgggccaaaaattgtttcaccggtatgccaaaaaggacctatttttgccatttggggtcaaattttctaaaaatatggtacggcggagctgttttagtcgtcaccgataattttttttttggagttttaataagacatgggcaaatccaagcaaaaatttaataaaataagtaaaaatttctggccttgtcatccaactcgttgcactgcttccgccggttgtacagcgtcgtgacaaattcaattgggtcgtccaccacgcggtcgggccacacaatcacacgccgattgcccaccgagcaagagtcctccagggagcgcattttggagcggaacagacgatgcctgaaaaagcaaaaaataaaattgcaactcccanaaagagcgcatttttcagtttatttt

SEQ ID NO: 19800 - DNA, 837 bp, Heterodera glycines
cttcccccccccctatctccaaaagttttttaagaaaagcgcgcctcaaaaaagcgtttttaaaaaacaaaaatgcgtctcctggctaaaaatcgcaaaatttgtcattttttagacaaaatctgttagcaaatcgcatttaaatattacaaaaatttctcggcagcgcctatcggcaccgccggcctcatatactctactttctttttttggaaaaaacgcgccgcaaaaaaaacatttttattgattttttaaattttgagtaaaattttcttggcgctgcattgaacggacagattgaaacccttaaaattctggtaattgcattcagttttagattaaaaaataacaaaatgtaatgctttttaactgtttttacaaggtaacaatcaattttttcaaaaaatcttttttttggggtccaaatctttgttttagccggctaccagacatttgcggacggacatttgcggacggacttttgcggacggacatttgcggacggacatttgcggacggacatttgcggacggtttctgaataaaaaaaattattttttaagaaaattttttggaagagtgggcctcgtcagtacggtctcttccggttaaaaagcaactaattacgtgtgtttcggcccaaccgtagacacactaacttaaaaagcgcacacaaacaaacaaaaaaaagcaaagcaaataaattttttgattaattaatattttaaatttattaatggcttgccaaaggcccaactggcaatttaaatataatcagagacactcaagtaggtcaagttttttgtcattttgaatggcatataaaaactaatgttgt

SEQ ID NO: 19801 - DNA, 2017 bp, Heterodera glycines
  misc_feature (32)..(32): n is a, c, g, or t
  misc_feature (1963)..(1963): n is a, c, g, or t
  misc_feature (1972)..(1972): n is a, c, g, or t
tagttgcaaatggcgaaaagaccgcgcacagncatgggcaatggactcgtagtacaccacgtctttctcgtctcacatgaacatcatcatggcgtaaccggagccaatctcaaaattgcaaagaaatcaattagtgtgataattactcacaaagaaaaaagatttacgtctcgagattcgtgtagatgaaatattgcgtgaatcgcatcgcaaaacaaacgccggccgcccatttgtcatatggtggcagtgtcggactcagcgattctttaccgtcctcacttttctaaaaattggaatttggcttcaaccgattgttttttattccgtactttgtccgtctgtttcgttgcgcccgcaaagcccacaaaagtttcttgaaacttaaacacctgaaaagattgggagaattaaattcaaagattggttgatatttgttgcttaccagcaaaagaatcagaaagatgttgaaaatggaagtgaaaagtgcgggcattgtgaacatggaaagtttgaggaaagaatggtcgctgaattcgaacaaaagcactccgtcgccgatgaaagtgaacaccatttgaagggctgaatttgagaaggcactttttgtggttttccaccatttaaatgatttgcctgggccaaggattacgcccaacgctacgccgccggtgatgtacgccgttgctttggttctgtcttcgggcaaacttgcagccgaagcgaaggatttgagcaggccaacctaaaccaatggaaaaccctaaatttctttacaaaaacaaatttggttttcacctgtgcccatccgatgccgacaatgaaacgagagacgagcatcacataacgcgtatgttcaggggggaacaactcgatcagaaagtaaatcaagttgccgacaaacatggtcaaattgcaaaggattctgaattgagcaacaaatcagggtagtttaacaataagcagatttttataaaaacaaaagggtccccctttggtttttgataaaattcaaaaacccaaagtctaaaaagtatctttttgaaattttttttcacttttttcaattattaaataacgtgaaatgcgtaccatatgttaaaaaaacaatttacataaaaataaagaaaaaaaaattagaccaaaaaaaagttgaaaaaattttcaaaatctgtcactttgcatatagcgccgatttaattctcttttagatgaattttcaattttgaaaaactttctgttgattcgctacgcttttgaacttaaaaaggaattgcaacaaatacgaagcaccttctgaagtcagaaggtgaagaaacattttgacttccaaaattgaacatgttatgttttcccaattttcctcccaataatttggcgaataacgaatgaaacggcactaacagaggcggcttcagcttccctatttgatttgaccaaatgccgaggagtggcgatgcgataatttgcgacaccgaatacatggtaatcaccacgccgaagaatccttcggacactgttttgtccttctgaaagcaaaaaatttttgcgtttaagttaaaatgacatccgaacccaaagggactaacagttctcaagaatgggtacatggaagtaaaaaacatggtgaattggacagaggaggagaaggtgagcagcgtgcacaggtaaatgcggctccacgcggtcttcggccgttcatccgcccgatcagccaacgaatgctgaagcccattcagcggagaaattttgtaggagccgcccgatttggccatagatcacagagagaagaagccgatcaacggcgaacggagaaaaatggtccaaaaaattcaggagagtaaaaagcaaaaactgaaaaaaataggacaatgaaagaaagacataagtgaaacatagcataaagcaccatagcaaaaaaagaggcataaaatatgaaacaggtatgaaactcagttgctgngaattctanaaaaaaaattaaatccaattacctatgtatatgaaaaagcattga

SEQ ID NO: 19802 - DNA, 2132 bp, Heterodera glycines
  misc_feature (22)..(22): n is a, c, g, or t
aaaatattccgttcgatatttntgggggatttaaaaaataggaatttttttacaacatcatctaaataggtaattgcatgtttttcaattccttcgaaactctttaaaaagcggtgtaaaatcgaacaaatctttgtctagccgataaaaaattttagagaatgaaggagggaaaacaaatttttttttctagaaattttttaaaatatttaatgggcaaatgactcataatcacttcggcggcggtccgtttccgtgtctctttggccatcatttgcataaagttggtcaacaaccgtctaagcattcaatgaaaagaaagttttcgcaaggcgcacaaaattgggggaagtgtttttgaatgaaaacaaaatttcttgcccttaaaaatgaataatttttggctttttggaatagaagccggtgaaaattttatgcaaaactattgaagcaacgaatcgaaatttttaaatttacaagaaatataatgccaagttctcttgattttttttgctttcaaggacgtccttgttattcaaggacgaaccagagccggccgattttacacgtactttcattcatcatttctgttgtctttggacaatgaaaatttaagagaccaagatagacaagaaaaagctagatattttcatttgtccaataattttgattttttcatttttttttcaaaaattttggaaaaaacctaaattctttaagacacatataaaacgcagagaatgttagcgccatcctcagcctcagcagaacaaaatcacaaaatgttgatgccctccccaacaaaacatcacaaaaaaatgttgttgccatcggcggccatgaaaatgcgtcgcaaatgctcattcaatccggcatggcaacaccaatacgcatttgtccgccgtagcaaaaagggcaacggctttttttactgtgcctattgtgagaaggacatcaatgtgcaaacaatgggcatttcagcggtcaaatcgcacattgacaacaacaaacatcggcaaatggagcagcaacaaattgtcatgtcggcggtaattggaaatgccgagaacggcgccattgttgcggcacatcagcagcagcaacaatatcaaatgaataatcataattgtaatgctgttggaggagtaaaggcggaagaaccgccgttgcaacaactacaccaacagctttttggtacgacaaattgcatggggattttacataaggatgaaccccccccccaattcgtgtacttggccaaatcgtatactgtttttggaaaaaaaaacggtaacgaaacgatgttttgtcgaaaaatggtacgggtcggagcaatacgatttggtttttttaccatttctaccatttgttaagttgtatagagaccaatcatcagcagcagggctgggccatatgcttttggccataatttatgagccaattttgggttccgtaattacggattaaattaaaaaattttcatgctttccgtgtaattgtgaaattggtcttgttgaacagaacaattttaccaaattgataccaacaacaaaaaaccgataaattttacgactttttcttattttattgcattttttaatttgtttttttccaaaaaaacaatttcttcctatgctaatacatatttcatttaatatttttaaattatcacatctgatcagcaggcaaaatgaccaaaacaaaaaatcccggaaattggtggtattatttttaccgatttggcaattcgaccgcaaaatgcaaggtggaaggctgtccgtacatcaaaacgttgaacgcatcgcggagcaccaatgtgctgtcattccacctgaaaaagcatcacccccaccttttcaagcagcgcgaacaatttttgcaagacgagaggcaaagagtggacaaactgttcaacaacaataacaacaacagcaaaagcaataataagccattagaaaaagcatatggaggagcatttgcaagtgaaaaaagatttggggaaaaatgagagaaatttgggcatttaattacccataattacggtgcttttaatgacaattgacataaatttgcttaaacgtccccagccctgctgaatggatggacttttgttttgaactattgccgaggct

SEQ ID NO: 19803 - DNA, 2178 bp, Heterodera glycines
attaatgatattttaattctttgttttatttctcagaaaagaagtatatattttggcattcattactttgcagcatttggttttgaataattactttttatacagtaaaaatgtctttttccagttttttaattaatcaaattttgctattaaatagatttgtatctttcaataagaccaggttgagtgaaaattggtacattttaacaaacatgctaggaaaaccctttgaagcagatacggcactcaaaagatgaggagaatgaattttgaaaagatgtatacgaaaagggaaattaaagaaatactttgaaatttatattatatttatacaatctttaattaataaagtttattaaagaaataattcgttagaattattttttttaatttttaattcgtggtaaccccttaaataatgtatagctaaattatattttaacaaatatcaacaagattgtgctttaccaaattatattgataaaacgaaacatcaacctattaaaaagataatttattattttcatttaaacttcttaactcccgtatagattaatttggatttttatttcgttaagtttgtttcgttataaaaacttattatattttgcccttttttgttttcaaaataaatttaataagtaattaataattttataaattcttttattaactttttaaaataatcttatcttcccatttgtttttaacaaattaatgcttaaaaagtagataatattcccaatcaaattatcgattgattttcgatcgataatttgagtgtgtctactttttttttctctgacatccccttccacaaacccaaacctattggatggtctcctcgagagagagagagagtacattctatgatttctctgactaatgaaatcgactttaatttaatttgtttttttaaatttattaatcgataattttatttgaccccccccccccatacctattggatgatctttgattccttcaaccgaaacctattggatggacttgtgcgcgagaatttaattaatttaaattttaattaattaatttaaacgagcgagagctgcgcgactatttccgataaattatggaaaatcaaaaacatggtcgcggtctcgaaccgttgagagtggaagcgaggagcttaaccacttggccacaggggcagttgaaaggtatgggataattgttgactttatgatgaaaattccgttaaaatttattaatcgataattttatttgaccccccccccccatacctattggatgatctttgattccttcaaccgaaacctattggatggacttgtgcgcgagaatttaattaatttaaattttaattaattaatttaaacgagcgagagctgcgcgactatttccgataaattgtggaaaatcaaaaacatggtcgcggtctcgaaccgttgagagtggaagcgaggagcttaaccacttggccacaggggcagttgaaaggtatgggataattgttgactttatgatgaaaattccgttaaaatttattaatcgataattttatttgagcccccccccccaaaaaaaaggcaaaacctattgtaaggactgtacacaaataatcaataaacccaagcctattgcatatatcatatccgaagctttaagtaaattagcaaaaaacccttttcttccggctgggctcgaacccataccaacttactgtgctaaccaattggccattttatgccactgggaaagcaaaatccaattcattaaattgtaaaaaaatgacgtcatcatggaaagtaaaaaatactccgccccttttcttgttggtcacgcccattggtttttgttttgctttgctaagaatacgactccgccttttggctttttagtttcttttttccgcctccattttttttttttgctatttaaccacagtttttctaaataaaaatcattcgtgttccattttttaaaaaattccatcctccttcgttttttccgatcttcctgcaatgaattctcttaaacgctttcaactcccggagcaaggaacacgccagcaagaagagttggattccgttgaaccgaaaaacatcagcgatgtggtcaacttcaattcggccggcgttttttatgttttgggaaagagtgacaaatatgccagtaccgtgtttacaaagtccaaat

SEQ ID NO: 19804 - DNA, 2353 bp, Heterodera glycines
tagagtcttggaaattcaatcacggccagccctgattagaatacggtaaaaaactgtgttggagaggtggttatggaagacatgtgcttccaaatgtaattttttttaaattaaaatgaatttaaaaaatcaaatttgtttgagaactacagtaggacggcattagcccaagtggatacggtagaaattaatggtgtggtagagattcttatggagggagtgctccgaagtgttaatttttttttaattccaataaatgaaaaatagaggcatctgccacgcttttgcctcacctgtccgatctgccagtgttctgctgctgctgcatccagcagcaactccggctgtttggttgtgttgttggtactgctccatgtcgttgttgttgctggtgttgttgttgttgttgtgtgtgcttgttgctgtaacaaatccatggatcgcgactttttgctcccattttttgtggttgtacaccaattctgctgctgctgctgttgatgttgttgttgttgatgatgatcactatgctgttgatcatcatgctcattagcataattgttgttgttgctgttattgatgtaatttgccgtcggcgtcattaataagccatttttctttttggcattatgttgctgatctgcttaacgaaaatccggtgcaatattcgtcaaaaatttgttaaaatattggaaaatctccccggttaagcctgaacgaagcttcagatttttttttgacaaggataagtgcgcttactctaatcaatccagcttatgaccaggtttatcagtcggattcctttgaactgttacggctacaatctgcgacttaactattcagtcaagtcttgaatatttgcccactccattttgaataattcctacccctgcacacgcgccgcaatttgttgttcaactgcagctcgtcctggcactgttcgtcgccgtcctgctgctggtgctcccccttgcgatcgtcgccctcctccgacagaataagagcactgatcagcgcgtcaagcaacgagttgcgctgccggctggcccgtgccatggcacgctcgttccgctcaagcccatgtgcgagccgttcagccaggaacatgcccagtctccgctcgttgttgccgccgtccagtcgttcaagcgtgtccttgtgccgcaacggcaccgatccatcaccaacggccaattcagtacattgcgaatcatcctccatggaccacgaatcgactaactgaagttcaagctgttcagcagcagcacccatcgacgactgttcatcatcagcatcatcatcgtcgtcgtcgtcgtccattttgcagctgggcatttcgcgcatcattaacggcaagtggttgttgtccggttcgcctgctgggagcgattcgcgtgccgggcaaggctcgccggatgagtcccagcgctgacttactgtagtagcaatgttttcattgttgttgtttttgttgttggcgatatgtgccagtgactgatggtgttcaacagcagtagaagatggttctgtgttacataaaatgttgggtatggtataataattatcgtaccttcttggaaaagattactgcgaatttttttaaaattgaaatttagcaacgaaatcacgcaacctcatttacaaatataaaacaaaataaacttgcaccctcaccatgatcgtcgatatattcaagacgttcagcaacagttgccgccacattgcccacggcatcggcaagtgaccgtgccaagttggccaacttttgctgttggcaaatgccatcctccgccaatgatgacaacgacgtcgccaacagttttggccgattgttattgttgttgtcgtcgggctgttcaacgagttcgacgaaatggcggtagtcgctgcgcgagttcaccacgacgacgaacggcgactgttgggacagagagtggggtaccgcggtcgctgccgcagtcgctgacgctgccagcatcgcggtgcgctcgctgggcacgccgcagaatgtgggcgacaacagtgcgccaaacgaacgctttgccatcgctgacgaagacggaggcggtggtcgataggttctgtgaattttagtgaattttgtggaaaaactttagaaaataatatcaaaattcgaatttaattaatggcataattttctttaaaatttcaatggcatttttttggttgttgaaaagaggccctgataaattcattaagccatcattaagatgaggactatggatgtgccgggtcaaaaaaaaagctggtggggaacagggacggcacggaattccgattttcgaaaatttttggggcctaggaatgccatccctggtggggactattactt

SEQ ID NO: 19805 - DNA, 2386 bp, Heterodera glycines
  misc_feature (2371)..(2371): n is a, c, g, or t
ccgatgaaagtggcttttccgtgtctttgagccacaaaaactttgtgacttctctatcttctggttccaaagaaatctgcaagaaagcagcttggatatccgcgagaagaggaaatgtggggcatcggaatcgcaaaagcattccgatgagatcaggtaaaagtaccggacctctgtacaaacagtcattcaaactgtttgtaccccttgtgtgagcactcgcgtcataaacgacgcgaagttttttgcccttagccaacactccttgatgcggaatgtagtgctcaagagtgccaggtgcttccctggcctcttcaatgataccttttgataactggtcgttgattgtgctgttatattgctgtagaagttcaggagaatgtctgagcttattcaaagtcgacattaaccttgaaaaggccattctgtagttcgaaggaagattcggtgtctcttccttccacggccatttaactgaatatcgtccgccgttttcacgacggattgatttgtcaaacagctgcattgctgtttgatcatcatcttcgttggggtcttcctttatccctaacgattccaaattaaagaaatattcaatttctttaacagctggcatctgcccttgattggattcatcaatggccaccattgacactcctgtatttgggacctttggtccgaagtctgactctccattaactagagggcccagtgttgtttggatgacaaacaacccaggcaaaacttcctttttgctttggaaaaatttccaaaagtgccgagcacttatgagaatctcaggttcgtcctgagaaaaacttagagcttggaaaacatcctgctcctccgatgtgtaatcatctgaattccactccaccattttgaatggagtggaaatttgctcggttcgattgagtaggatttcctcccacttattgtcactccgttgaatttgaacggagtagacaggtgaatggaaccgtattggtccattcctttcaccaccgaaaccgtagacttccatttcttcggaagtcaccttatgtggtttcagtttttcaattaacgggtcagacatatatgaagtctgactcgctgggtcaaaaagaaacatggctttgatcattcgacgaggatcgcgacttgaccggaccctcaatcgtcgggtcatcaaaaacgcgtgtgacttctttgtcacaacgctggttaaaacatttgttctttttccgtcaaaaattgatatttcagacggattttcccttattcttaagggttcatttaatgccgaaaaatgattctgagtcggacgaggtggttctcctcgtctgttggaggactgtttcttttgaacagcccctcctttggatgtttgttgaggagtggttcctctcggagcgtctccttcagaatagcagatcatgaagtggtgtttttcaccacattttggacacctctttggtgagctgcattgttgagagttatgcccttgcataaggcaattaaaacatcgatgttgatcagcaagccgccttctgcgtgctccaggtgttggatattttggacacttgcttggtgcgtatcccatgtcactacaaagagaacaaagtgggttcgttcctcgttctcgaggagaaaaatgtgtttgttccctctgattaacagtgttaaatgatctgtgtatttggggagacatcatccccacagactcatttctgttgttgggtcgccaatgaccctgacgaaattggttgggagagaaatttgttcctctcccttggaaattgttcctctgcatttgaggaggaaaatttcggggtttttcttccccacggaagacttgtgtacatctttgtacttcttccttcacttcaacaatggaagtgattgccttgcgtaggtcggaacaatcaaatgttccacctgaacgcatttccttctccaccacttgagtgaggagatagtatggcaatttggattttatcgtggaggccatgaacttattttgttcattttctccaaaatctgacaactgctgacaaatcctttcaatggactctgaaaactgcctcagagattgaaccgaatctgacggttttgaaagatggagcaactctgattggagtgtctccacaattgacttctcatccccaaatcttttcttgaggatttctaccactcgcgggtagttttcatctgaaggcgggtacaaatcaattgctcttcgagcaactgacttctcgggaagacatcccaagagataaatgtgttttttgaagtcttcaatttgaagactttcaactgaagtctcaaacagcttccaaaataaaggccattctcggggttcacccggaaaattttggaagcgaaatgnggcggcaacatcact

SEQ ID NO: 19806 - DNA, 1625 bp, Heterodera glycines
acagtacagcaccgttctcgtcgcattgcgtaccaaaacggacattctcctgcgcacatgtcaaagtcgaggatgtgcagcacttcatacacctttggcattgtttttgactttttgcttttccttgttgtcacctcctccgctccgttcacttcgattgtaatcgattttggtgtccgcgatttgaaaacaaatccgaagtttcgtgccgccgatgtcagcgccgcttcgtccggactttgtgcctaaacatgtgaatatatgcgggtgttttgctgtggaattgccgtgcctgatattccaacactttgcccggctttctctccggcattacggtgtggcaaatggccaacaaacgccaaaattcgtggaccaaaaggtgattaaaattaattagtaataaatattactaatatgttaatttgcacttcttcgacgcccctccgcgtgtcctccaccaatgtccggtcgtagaaacggaagtgcggctcgtgccaatgattgtccgaaaagtccaacgccggcggcgtttccttctcctcgtcaatcggcacaatttcgccacgttctgtcattacatcgccataacttcgtccattgatcgaacactttttgaacaccgaaaatggacaaaagcaaaataaatttatttgaaatatttaaaattaattaaatttgtttgttgttaaaatttacaatttttaattttaataaaaattaatttaattattttttaaaattaaaaaaatgtaaatattttttataatattttatcatttcttgccattatgttctgcgtcagtgtccccgtcttgtcactgaatacgtattgcacctgtcccaactcttcgttcagtgtgctcgtcctcgcccgtgccggagtgtccgttttgtcgtcgtacattttgatgtcgttgttaatgaatttcgagtgggccaaccgaatcatttcgacactttccattggggagagggaaaaccatatgcatacagtatgacgaagaaaatgcagtaagacaaagtgaacgtgaaataatggcatttgaaatgggagtgatttggagaagctttgctcgagagtcaaattcccgagtggacagagtctgcttttgcctttggcattttgcctttgtttgcccggggcattccctgcggcattacctaatgtatagcgaaattggcacgacggtgttcagcaaaatcatgtaggaaaagaattggagggcggcgatgatcagtgccttggacggtcccactgagttttggtcggtttcctcgtcgtcggaggcgggcaaagaaatgccattgaaagaagtcggcatggaaaggacttgtttggtgctgacgacgaactcatcccatggcaaaaacacgcggaactgacggcccgtgacgtgctcccaaaggccggacatcatagtgcaaatcaaacacattgccaacagaaacagaacaatctgaagaaggagaaaaagaagaagaagaagaagaaggacgatggagtggaagaaatgggaaaagagggaagaaagaaaagggaggaaaagagaaaagaaaggaagaagaaaaaaacagaggcagaaaaagagcacagagaaggcgaaagtgtgccgtggctgaggaag

SEQ ID NO: 19807 - DNA, 2411 bp, Heterodera glycines
acaaaatttttaaagaaagtgcaaattttttttttttttttaaataaattagttatttattaagttgctttccaattttcgttcgggaaacggcttcttatttggaacacctttcgttttcatatcagtgacgatacaaaccaacccttcaggcgtttatctattaaatctgctgtcatccccggtggcactacgaaattcattcaagtattagacaattcaatttaaatcaaggaaaattattttagcccccagacgtgtgttggaacgcaccgtttaaaaacaaaatcaggcaaatttacgatgaatggatggtgaatggagagaaagaaacaacggcgtccggaaatatgaaggctccgccaatggagacgtatctgcaatggattgtcaccgcctggaactcactctcgaaggaactgatcgccaaatctttcctgtcatgtggaattacggaggaaattaatggaagtaaagatgagctgatcaatgttttcaaggtcgtctatttgcagttttttgtgtatttttcaagtgttttaaggcggacggagccataccgaatgggcttaagcttctgagccaacgtcgcaatgaagaaaatgttgtgaaagcacttgaactaattgatttaggacaagatgaaagcgatgtctctgtcgacgttgctaatgaataatattttcatcaaatttattttcttttttaataaaattgatcgccccatgaagtctttttttaggggcctttaattagaggggggggccttctaccagaggtgggccttctattttcaacccctccaaaaaggggcctttaattggagggggccttctaccagaggggggccttctattgttcaacccctacaaaaaggggccttaaattagaggggggccttctaccaaggggggggccttcaaatacaggaaatacggtatttggtacatattttgggttagggatgcgatttttaggtaagaaaaatcccagaataggtacttaaataggtaaaaaaaaatctctaaataggtattaaataggtacaaaaattccaaaataggtaccaaaataggtaaataaaaatttttattaacgattttttagtggaaaaaagcaaacaaagagggaaaattttggttctacatatctctttgtaaacgaaaatttaaatatattaatattttcttagataatattgacattttaaattaaaaattttgtcaatagaaaaaataaataaattttgggataaatttttgagaaatttttccaattcttagggtgcatttttgaaaatttttttggtcgattcttatgggtatattttttgattttattgcatttttgttaagaattttttgaaaatccttaaaataggtaaccaaaatgccgaaataggtataaaaataggtacctaggtaataggtagaaaaatcccgaaataggtaaaaataggtattataaaagtgggtgtagaagctccaaaccaagctaaaaactcgttttttatgcttatctcaacgttacaagtgcgcaaaaattttaggtatttaactaaaaatcgcatccctagcaataaaaaataaaatataccccaaagaatcgacccaaaaattttctcaaaaaatacacccctaagaatcgatccgaaacttttcaaaaatgcactcctaagaaatgaaaaatttgtctccaaaattttttgtgtttaattactagggatgggatttctaagtttttacttattttttctgcggctttaactcaacgagaaatacacgaaaaacacattttttgtctgaaaatttttgcgttttcacgcccttattcgaccttagaaatccttatttttgatgttcgcccttagaaatccttattttggatgttcgcccttaaaataagtttttgtccttattttggcgttttgtccaaaatttattaacaaaaatgcaataaaaaacgaaaaatacacccctaagaatcgacccaaaaaaatttcgaaaaatatacccctatgaatcgacactaaatttttcaaaaatagaccctaagaaatgaaaaaaattttctaaaatatagcttatttgtactgcaatcagtgaataaaattgtttgccttagtctgaaattatttcatgtaaaaaacagcaattttaaaaattataccctaaatttgactttttcgcccttatttcgcgaatttttcgcccttatttacggccttattttggactttttcacccttaaaaatcccatccctaatttttttttttttgctgtgcttttcccatcgtttacatttcgtcgtccgtccgtcgcaaatcgccttaccaccgcgccgtaagtgaatggaaaatgagtgagtgagtgtttgtctctactttgggctgattcatttttgtccattg

SEQ ID NO: 19808 - DNA, 1913 bp, Heterodera glycines
agttggaaccggagggcttgggttatgggcatgcgtggcacccgtgagcagttggaatgggcatgcgtggcacccgtgctcagttggaatgggcatgcgtgcacccgtgaacagttggaacccgagggcttggcgaatgggcatgcgtggcacccgtgaacagttggaacccgaggcttggcgaatgggcatgtggcacccgtgagcagttggaatgggtatgcgtggcacccgtgagcagttggaatgggcatgcgtgcacccgtgaacagttggaacccgagggcttggcgaatgggcatgcgtggcacccgtgaacagttggaatgggtatgcgtggcacccgtgagcagtcggaaagcgagggcttggcgaatgggcatgcgtggcacccgtgctcagttggaatgggcatgcgtggcacccgtgctcagttggaacccgagggcttggcgaatgggcatgcgtggcacccgtgagcagttggaatgggcatgcgtggcacccgtgagcagttggaacccgagggcttggtttatgggcatgcgtggcacccgtgagcagttggaatgggcatgcgtggcacccgtgctcagttggaatgggcatgcgtggcacccgtgctcagttggaacccgaggcttggcgaatgggcatgcgtggcacccgtgaacagttggaacccgagggcttggcgaatgggcatgcgtggcacccgtgagcagttggaatgggcatgcgtggcacccgtgaacagttggaacccgaggcttggcgaatgggcatgcgtggcacccgtgaacagttggaacccgagggcttggcgaatgggcatgcgtggcacccgtgagcagttggaatgggtatgcgtggcacccgtgagcagtcggaaagcgagggcttggcgaatgggcatgcgtggcacccgtgctcagttggaatgggcatgcgtggcacccgtgctcagttggaacccgagggcttggcgaataggcatgcgtggcacccgtgctcagttggaatgggcatgcgtggcacccgtgagcagttggaatgggcatgcgtggcacccgtgagcagttggaacccgagggcttggcttatgggcatgcgtggcacccgtgagcagttggaatgggcatgcgtggcacccgtgctcagttggaatgggcatgcgtggcacccgtgagcagttggaatgggcatgcgtgcacccgtgaacagttggaacccgagggcttggcgaatgggcatgcgtggcacccgtgaacagttggaacccgagggcttggcgaatgggcatgcgtggcacccgtgagcagttggaatgggcatgcgtggcacccgtgagcagttggaacccgagggcttggcttatgggcatgcgtggcacccgtgagcagttggaatgggcatgcgtggcacccgtgctcagttggaatgggcatgcgtgcacccgtgaacagttggaacccgagggcttggcgaatgggcatgcgtggcacccgtgaacagttggaacccgaggcttggcgaatgggcatgcgtggcacccgtgagcagttggaatgggcatgcgtgcacccgtgaacagttggaacccgaggcttggcgaatgggcatgcgtggcacccgtgaacagttggaacccgagggcttggcgaatgggcatgcgtggcacccgtgagcagttggaatgggtatgcgtggcacccgtgagcagtcggaaagcgagggcttggcgaatgggcatgcgtggcacccgtgctcagttggaatgggcatgcgtggcacccgtgctcagttggaacccgagggcttggcgaataggcatgcgtggcacccgtgctcagttggaatgggcatgcgtggcacccgagagcagttggaatgggcatgcgtggcacccgtga

SEQ ID NO: 19809 - DNA, 2015 bp, Heterodera glycines
ataagaattgggataaaaatgatttaaaaaacaatttaaaataaaaaaatattataattttaattttgaatgggaatggaaaggccgacaaattccaaagtgcctttaagaagccaacatatttattatcattcattcattcagaggtcctcacactcgcattttgtcaatgaatttcatttccatattcattccttgaaatttgaggaacggaataattttttcgttttttttttttgcgggggatggaatgccaaaaatttgaaaatcggagaacaccgagcggagaatgtggaaggaaggccacacaacagtgagagcagagaaggcagaggcttggccgtaaagcatttttttcacgtaaatcgaaatgtgaaggaggaaaaggggtggggaaggtatcaatttcatggtcgtcatcacatagcacgagcacgaccacgacgatcgggcagagtggttgtgaagcgtggggggaggcattgttcggactgatcagagaagctaatggcttggccataaaagcgatgctaagggaggattgatcagaaagcggtgatcagagaagccaattgtttggccatcaaagcgccggaggggagaagcattgtgtggagatgctgcgggattgatcagagaaatagaaaggtgatcagagaagcaggtggcttggccagcgaaggaggggaaaagaagcagcaacagtaaagaatggagaagcatatagagaaaaaaaaagctgtgcatacggatcagagagtggtgatcggccatgaaatcgccggaaaagaaagcaaagtgctgcaggattgatcagagaatcagatcaaaagcatggaaagaaaaaatattgcgatagatcggagagtggcgatcagtaggtgctatgatgaagtaggggaaaggtgttgtgtgaaaaagtttcaggattgatcagagaaattagtaaagtgatggagaaaaaatatacggttcacgaaaaagtttcaaactggccagtaaacgagtgataagataaaaggccgcatggacagattaaataaataagaaaagtgaccagataagtcggtggcttgggaaaagattgaaccataaatgaaaagcataagcaaaaaaaatgccttcgaaagaacattggtgattagagataccgaaggcatggcaaacaaaagtgccgccggagagggaaagccgccagatcgatcagaaaaggaagggcgatcaaagaggcgcggcggctctaaagcatggccaacaaagcgccggaggggaaaagtatatagggacggggaggacaaggacaacagcaacaacaaaaaaaatgcttaacatacataagcgcacaaaacattaatgtgtgtgtgctcttctgctatgtgctgctgctatgagaatattttcgccgtcgggggcggcggcggcgggcggaggcgctatcgattaacgcgggggcggccaaagtgtggggggaggcggggaaatcggtgaaaagatcagcagcagcagcggcaacagagctggctgatgaaggagggagacgagacgagacgagagtgagccagcagcaagcaccccccgagaatgacagtggggggacggggagggtgactgatgggaaaatcggggtaatgggggggggggaaaggtatggagtgaatgatggcggcgacggcgtcggcggcggtgtagacagagagagagagtttaagcttaatgggggtggagaggaagctggctggcttgatcagcagtatgcagtgtgcaaaagcggaatgatgatacgaaatttggaatgcccatttttgattcggttgatcggtttggaagcagcagaacgaacggcgccgtgtgcctttttgatcactttttaaaaccgggagagagagagagagagagcgagagagagagcgagagagagagcgagaggttgattgatcaagtggaatttttggagggggcaagagaacgggagggagaggctttgatcagccggaaagcgaaaatcgaaagctttt

SEQ ID NO: 19810 - DNA, 1730 bp, Heterodera glycines
tttgctgtggtaaaattatctttcgtcgtgcaatgatctatttatcctccttttctgcatcagatcacaaataaatttttgatttattatttattattgggttcattcaccacccccgccccacccgcgcacccaccaaaacaattaatgaattaattcgctttgtgctggttacactctcccccaatttgtggaagagcagcaaccgcagcagcagtaatagggaaggttcttttgctgcgcatagcaaatacgtcaattccgatcacattactgcacagcattaactttcttctttctttctttctctctctctctctctcaccaccaccacttattaatgataattagaaataataattcactaattagtggctaggtgagtcatctaccgccacattttttcctttttgctcggggcgaaattgcgtggcaatcactccgcactttgatcaccaatttttcttgtacacaaaatgattttttcctcaataatgaatgttctgatcaaaatgtgaacaaagtgagagccatgaacaccctgacactccgatcaaaaaagtttaattattacaataaccgggggaggggaatcagtcggccgaatttcgtcacagtcatcggaggaggttggggtatcaggccgaggaccaattttgttaatttgtaaagtctgaggcccattctgagcaagaaatgctagaaaaaattaatcgaaacgttaatttctagtacattttagcagaaacaaacaatcaaaattttaatacattgagataagagaaatagagactaaggagttagaaaatgatcaaagttggagatagagagaaaaaaaagttatacgaaagagactatagtgatcagcgacctaattaaagacatattggcagaaaaaaaagagaaagagagagggcgaaaaagtagagggagagagggggagctgagaaaacaaagaaagtaacacattaacgaatggacaaagttggcaaaaatgggtgcagtattcgtgatcaacgaccttaaaaccccttaaaacttattttcattaatttctaaaacaatatagattgtcagtttgtgaaattagagaaagaaaagagagagaaagagagagagagagagagaaaaagagagagagagagagaaaaagagagagagagagagctaggaaaagtagaggaaaagtacagagacaaacaatgaggtagagatattgctgcggggatgagagtcacaaggttgcgcagagatgagaatggaatgtgccaaacacaataactcaccgcaagcttcgactttctccgtcctttcttcatacgtcacattttacgccccattcatggtttattgttttgttgatcagagcagtcggctgctgcggcaaacagtggtaaaactgattgctgcgctgatcagccaccgatcggtgtcaattagtgtagcgatcaatgtgtccggtgtccccccccccgcatcacaacggtcgccgtgcgtcgccgcattcccccgcggtgcacagtgctgcgcgaccccttcccacagcgcggcgccgacggcggcaagtcgaatgacaacggcggcggacgcagcgcaagcatatgaagcggtgcaagtattcacgtgaataacacattgatttggtcccttactcagtccatcgcttcatcaaatgatcattaactaattaattagccaattagtagtgactataatagttctgtctattg

SEQ ID NO: 19811 - DNA, 1837 bp, Heterodera glycines
gtatatttcaattttttgtttccctccaaatttggcattattccgccccatttggcaggtgacgcgcaaaaaaatcgaattgaatcccttcgcgaagggatttagagaccaaaagggcgacgaggaggaggaggaaaacggagacaaaaggcaattatttaattactttaaaaatttggtgacaaaaaaagttcagttttttggccgaaattgggacggcggacgaatggaaaaggaaaagcaaagggacggcggacaaaagcgacgaaaagtcagcggagagaaaataggaattttaaatgaattataacatataaatgacgagctgctcgggaagctttgaggcaaaaccatgggcgggggagggttcgaaccgccgtctgtgacttcccggaccaacgttcaaccggctgaactgccctggccctgtcttctccggctccctccccaacctttgcctatggagacttttttctaattttcatccccaaaatgccatccccccgcttcgtccacagaaatgccaccgtctccgtccgttgccccactaccgtactggtgaagtcctaccgtagccccccgcccgccccaccggcgcttccgtcggtgccgtgccatcactcgacccaaatgcgtacaccggtgccccgaccctttcctctgcactcgccgttttggccccctctgctgccgccccatttgttgagcggccttctcctccgaatcggtgccaatcaacagcaaatgagagagcaggcaaacagcgggggacggcagacagagaagggagacgagtgaacgtgtgaagaggagagacggcagagaaaaatgtgaaagaaacgaagcaaaaagaattttatcagtaaacaaaataaatatttatacacaaaaaagcgcagaaaaaggcaacttttcatctctctgtatacagtttctcacttttgcacactctctcgccgtgtctctcatttcgtgtccattttcattcgctcaactctctctccaacttttccttacttcccttcactctctcctccctttgcttgtctgtcgtatgttctcttttctcctctcgcttcttttcctctctcctcttgcgctgtctctcctctttcgcctccctctctcccctgatccgatcatagtacgacgtgctgaccacgtcacggggcgtttgaaagccgccggtgccggactgagtttgtagaatgagctgtaagggttaaggaggagaagctaatttacgaatggcggaagaataagaggtgatcaaaaaatgatcaatggaaaaagaactgatcataaaatggttaaaaatgatcagaagaaaaaaagccgatcaaaaagtagtctaatggtgggattactcgactgatcagacctgtccgccaagccaactcatgcacttgttcgactccatctgatctctctccgtccgatcgagtccggcaatattcatcgtcgcttggcgagtgccggccgcaaccacctgaaacggacgaagacgacagacactcttgtcgagaagcaatgggctttttctcgtttaaatcgaccaaatccctgtccttctcgtccgcttactcttatcgcttcgcgtccgtcccgtgccgcgcttgtctcattgacgcatgccaaccttggcagtgccgctcggctcaagatcagctcgtgcctgctccattctcggcccccaatgctaaccatcttttcgggccgtttgctgccgaataatcgtgcgcttttcgcctcggggttggacctttgggggagggggggggggagaagcatattaaactttgccatgcttttcctttgtccgtgcttcactcactga

SEQ ID NO: 19812 - DNA, 2162 bp, Heterodera glycines
  misc_feature (2137)..(2137): n is a, c, g, or t
atcttcttcccttagccagttttaaaaaaaaatatataattatcctaaaaaggcaagtaattaaataaataaataaactaaatacacacacactcacccaattagtggccgggttgtgcaataaagactgtaaataaacataaataaaattagtaaaaaataaaataataaattaaaatgagcaaattttacatggttgccgtcgccccaggggaaaggctaaaaagatttaaaataaataatttaatttggaaaaacaaaaacaatttgagagcgaccacctttcgacgcgtggccaaatattcgtatgcgacgtactcagggcgtggagaatggtgctacgaaatgggaacaaaacaacaattaattaggtatattttaatgaaaaaatatataatgggtcattaattaattactttaattttacacggcttccccatttttgtttcaaaattcgtgaaaacaaatttcctagtgcttttgtagctgagctcggattgtggcattgcttttgagtaccgggacaacccgaattcgaaggaaaagtcaaaaaatgaaatttttttttcaaacttagcatttttgctgtaaagttggcttaaataattttttgttgctgtatcgatgagtacacccaagtccttttaaaaaaaaatatttaaatttaaaacgcagtttttaaaatgttttacggaattttgaaccaaattatggcaacaaatgcttatgcagattaaaaaaaatttaaaattgtgcgttacacccaccacattctgatggtccttccatccgcaactgaaaaagaatttcgtttttttttgagtttaaataattgtttttggcgttgtgcactcactagcccgcgaataccaacagtggcatcatgacgaaagcggagaatttcttccagaaggcggcaatctgaaaattttgtagtatactatagactcgtctttattaccatgtctaatgttaaaattgggaagggaaggggggggggtggcaaaatgccgtgaaatttgtgttgccatgcaatggaacgtgtcggcaccaatcagtcaccaaaccagtcacacaccggcacggcgtcacgcagtccggtcttgtagtgcttgtcaaagtcctcaaaatcgttgccaatccaatgcgtgccgctgcccacgccgcgtgccgacactgcacgcagtgccaccggcgacgggacgcccactggaacaaataatgatgttgtaattgaaatgtcataaaatttggtttttttatggataaccggagcccggcaatggtaaagttttgtggtttcttcgaaaaataaaattaaaaatttcgaaaatgcattttcgaggctaaaaaaatacgctgatcacgaatctgagctcggattttgcaaaatcattgattttttccatgacttttcatcaagtacttgatttttcaaaattttaagaaaattaatcgggcataaaaaactcatacacagatgttgtagagcacaaaaagagctttcgaataagctatctggagaagtcgagcttttagtttttttaagattttttgaaatttagttattgatcctttgtgggtcatatgagacggggtccggggttcgagcccgcttggctgcggcttattttttataatgatatttgatgaaaatcatagacaaaaacattggtttcgcatgatcagagctcggattcattttcaacgcatttttaacccctaattcatcagaaaaaataaaaatgaaatttctgaaaaagccaagtacttgatgaataatcatagacaaaaccaattattttgcaaaacgtatttttttagcctagaaaatgcacttcggaattattttattttatttttcgaagaaaccacaaaactaccattgctggatatttggttgtttttcgttgcttgtttttgtcaaaagtcggagtacacattgttttggttttgccgtacatcaaaacaacgtcgtcttactgtatctgatgggttttctcccattgcataaattgtttgtggggacatttgtccctttctggcattgatttgacctcctcagtctgttgcgtttggtggtttggttgagtttgtttttggttgcctttttacgagtgtctctcccccactgtcnagtgccatcctcggacagtgagcag

SEQ ID NO: 19813 - DNA, 1132 bp, Heterodera glycines
atttattaatttaaaatgaaattaatttttttgcaaattcaaaaaatacataatgaaaatttttaagtaaaaaaaattacaaaagtgattaaaagagctacaaaagtgattagaagaggtacaacggtgattagaagaggtacaaaagtgattagaagagctacaaaagtgattagaagaggtacaacggtgattagaagaggtacaaaagtgattaaaagagctacaaaagtgattagaagaggtacaacggtgattagaagaggtacaaaagtgattaaatgagctacaaaagtgattagaagaggtacaaccactgtcgaaaaggtacaataattgttggagaggtacaaaaattgttggaatggtacaacaatggttaaaaagagtacaatcatggttttaaaattaaataattaaggaaatcgtttattaaaaagtaagattaaaaattgaatgtaattaataaatttttaaaaataaaataaatttccttttattaattaaaaagagagtttgaaatgtacagggattgaatatttatttaaattgaaattaattttacaaattctaatttaaaaaatacaggagttctttaataaaagtaaataaattattattttaatttaaaacatcacaaaaaaataatttaatttaaattaaaaaattttattttttatggattaaacaaaactatttatatttattaaaatgaaaattaataatataatatttatttaatttgaaatgaaattaaacatgtaaaagtaatcaaaaaatgcacagaaaattaatgtacaccgtccggatccgaacctgcccctcccccctcaaaatgatgcctcagaatccccaatcacacagggattctgaggtcttaactatgtcaaaagtaaaatctgatcacgtattcgtgatcagcggcccaaataacccctaaaatcatattttggaagatttttggtgaaaaaaattttccactcaaaaatcctggtcacacccctgtctgtggtcccgaatctcaaaatcacttttatttttataaaaattcttaaaaaagtgataaaaatgtaaaataaaatttattttatagagaaaaaaattgcggatttttgtagtattttacttttcc

SEQ ID NO: 19814 - DNA, 2692 bp, Heterodera glycines
tgggatcagggctgggcgaagctcggctttgcactcgaagccgaagccgaaggcgaagcccaatttttattcgaaaccgaagtccgaagctcgaagcccaaaaaacccgaagttttcgaagccgaagccgaagttttttcaaaatttttttttaattccaaaaattttttcatgacaaaatttcggttaaatatcaaatagaccaaccaacaacccctttcgataaataaatataatgattttttttaacaatgtattttttaaatttttataattcttagaatactcacagtttttgagtcaatttaaaaaataaagggaattttggaactccggcggtgccgataggcgccgacgggaaaaatttgaaattttagtgacagatttagttcaaaaatgaaaagattttgcgattttaattgttaaatttatattaaatttccgtcgaaaaaagaataattttgaaaaattagaagaaaagaaagtacttggacgggaactgatccaaagaaacataatgaaaagagcaaagagcactaccactcgaccatgcgtgtgaacaaaaacataaaaacaaaaaattaataaatatatattaatttaagtttatcaaaagcccatcactaagggtgcattttcacattgaaaactcaatctttaggggtgtatttttcccgaaacttcgggtaaaatagccgaagcacgaagttcgaagctcaaaaaacccgaagttttcgaagccgaagccgaagtttcgcccacccctgatctgggatagaatattcttcatattttctttaccattattttaattgaaattttaattaaaaaaaatattccaactttttttctttcattttaagcatcctaaaaacccaaaaattaatcaattggtctttttttacaaattctgttaacaaatcgcattaaaaaatacaaaatttttcccggcggcgcctatcggcaccgccggccctccttgttccccaaaagtcttgagaaaaacgtgccgcgaaaaaagcggtgttgaaagcaaaaaaggtcattgatttacattaatttacatggccggagaccccttcgcaaaattggaaaattggccgctgatcccttgttttgcaataatctgaattttgaggtctacatctgaattttagtgttctttatcctgaatttgaaaaaaaaacttggtcaccctcaatatacatatacttctgaacaattctaatgctaaaaaacaggcactcgcgcgaaaactgaataaaaattttgtatttgaaaaattttgtccaaaaatttttacgttggaaaattaccggtttttaccggtaccggtaccggttttttacaattaccgattaccgctcaactctagataatactagtgagctgagttcccatttttaatcataaattaatatttttttagaaatctcaaaaataaaagcagtaaaaacgacgaatgaaaaaatcactcatttttgagaagaaaaaaaagcaaatttttgaattaaaatctgtgtacaattaaacaggaaaaaagttggctttttttttgcctttgtgcctgttttgaaactttttatttgtgctaaaagtggaagatttaatgatttaatcacaacaaaggggaactttgaaaaatgcatatgttaatggaagggtaacaattagcgaagtcaattgcaatcaataaaatatgttcagttgatgggcaattattggatgtacgaaattttgtgtccttttcgcttaagtcctatttttttaggttgaatttgaatttcaattcgttttgatccgtcaaaatattttcatttaatttttacattatcgttttaaaattttaaaaaatggaaaaaacttataaattttaagcataatctccatgctaaaaggctttgaaaagttatttgctggaaaatgaggtgatcatgaatttgaatttgatttcgaaaaatcaatgtttttgtctatgattttttctcaagtaccataaaaaataagctgcagtcaagcggactcgaaccccagcctccgtctcatatggcctctaagggcaaataattaaatttcaaaaaatcgtaaaaaactaaaaacttgacttctccagatattcaatagctcattcgaaagctctttttaagctctacaacatttgcatgtgagttatcaaaattttaaattatgtaaacgaaacgaaataaaaaaaaagcgcggtcttttcaatttcaaaacatatcaaaaatcacaacaattttaacttttatttttacatacctacttcttctggctttgtttttcctcatatatatgttacacatgtttcggttctattcactttatgagtccaatcaaaattttatgagtctagttcatttaactttctttaaatggtagattcttttgttttttgtaatattaccttcatcattcaaacttagtgctttcggatatatcaagaacaaagggattccctaaaagtcaattttagttaattgattggactcataaactctgagtggattcaaaatgcgtttggactcataaaatgcaaccgtactatgacaatttccatatttttccagtttagatgggtaaaaataaattcactgttattgaccatgacaatttgtctggtagtccggatagaaacagtggcattttgacgaactcgcttgacatttatgag

SEQ ID NO: 19815 - DNA, 2041 bp, Heterodera glycines
ttcgtcactgatcggcgcacgtcgtttgtcttcggtgctcttcgccgccgccgccttttagaattggggaaaatttgtaaaaaaaaatatacaaatcaaacccccccccccccacattttttgcactggtccggtgacgcgctgctttgccaccgactttgaaaattttcataaaattccctcccctcctcataacagacggttttgcctccaccggtcgatttcgtcgtcactgccggtgcactgagcgccacaatttcatcgctctctgtctctaccaccaacacatgaaaaatttaaatttaatgaaaagaaaaaattttttaaattttcttacttgcccattttccgcattgggcgctgtgtcgccgcctccatcggtcgccgccgccgccaaaacatcaacgtccggcacatgaaaatgggaaaaaaaggattatttaatgagaaaaattttgaaaaaaaaacattttttttcttacttgtccatttgccgctgtttcgccgcctccaatttcattgctccttccatcggtcgctgccgccaaaacatcaacgtccggcacatgaaaatgggaaaaaaattatttaatgggaaaaattttgaaaaaaaaaacatttttttcttacttgtccatttgccgttgtctcgccgccgccatcggtcgctgccaccaaaacaccaacgtgcggcacatgaaaatgggaaaaaaattatttaatgggaaaaattttgaaaaaattctttttacttgctggccattttgcgcatttgccgtcgtttcgtcctcgccaatttccctgtcccgggaacgcgcgccctacaaatgaaatttatttgattttaattattaaattttcaaaacaaattcataccccccaatgcaccgcgctggtttctataccagaaggagtaaaatactaaacaaaatttttttaattttatttttattttttttttggaaaacaggtaaaaattttacatttttcataaggtcggtggccacatttgccgccatccgtttgaggtgggatggcggcccacccgtcctcttagcaaagttacgtttcatttttttaataaaaaattggaaaacaattctaaaataacaacaaaatatttgcttaaattgttttttggggagtttggcgtcgctaaagtgaatgaatgaatgccattcattcgcccccccccctgccctcctcggtccaatgacctttcccagctagaaagcgtatggggaaaagaagcagagaaaacgacgccttattggcgtggtcatctccaccgaaaaatgaccccctcattcgcttatcggcacccccaattttctctgtctgtctgccacttcacaatttgctctctctctacccgctctttctcccttgccccctgcaatatctctcttcctcccttgccccacaatctgtctctttctctcttacgtcacaatctctccttcctctatctctcttcatcccttgcgcccttcccaccctcttccccctctcctccatctctcactcttttcttttctctgccccacaccactgcctgcgccccgcgccgccaccaaatgatcattaatcaccgcatcgctgaccaaaagtttttttttgccaaaaagttttacatcactgtcgaaaagtttaccccccccccataagcaaaagctttgtcccccattccacaaaagttttttaaaaatttccattggccaaacttttaaacgttttaccccctcccccatttaaaaatttaaagtacgtctacttaatgaatgccgattatgaggagagggaattattgctgaagagacgtgccgaagtgaccatcgattcttatctttggaaacgctaattaagattttatgatgattaatcagaagattgctatattatggtctagatacattaaaacctccccaaatcagtgaatgggtccatttctgatgctttatctgaactagactaaagtaccgctaaactattagtacttttgagtctaagtcggatcgcgacaaacacatagatgacaaaa

SEQ ID NO: 19816 - DNA, 1714 bp, Heterodera glycines
ccatgccatttattgtgttgcgtcacattttatcatcagcaattttatcaacgattaatcacaattaatgagttatgtaattacatataaataaaatacaaaggaaatggacgaatttgcggtgagcaagcaaaagtcaaacacatccaaacaataacataccgtatatgctctaattatagcccatgggggattatttttcaacctcctcagaaaaggggggataattagagactgggggattaatagagactgggctataattagagcatatacggtaattaagtaataacaataacacaatgtaacatcacatcattttcggtcacataatcgcatcaatcaatcaatcgattaattaattgattaattaattcattcatctttcttctgctgatcactcggcccgggagaagcggcgtcgagaagactgaaaaacgatgattcaattgcaattataactcatcattggcattttatgagagtttatgagtccaatcaattctaactttccttgattttttgtactttaccataattctgtccatttcaaaacaaaaccgtacatttttggatacgaattgaaagcacaaagtctaagcaattgttgacgattggactcataaaatcattaagcatttaaaattgtcgttcacccatcgtcgtatccgccgtcactgatccgaatgtcaattgggttctgtcgagcttggaattctttcaacacattatgccaatttctcccattccacgcaattggacaacggaagagcaaaaaggcatttggtgattgtaaaagtatcaatcgttctccagtcacttcgttgatcagttcaaatggcacaatgaagtcatgcggagacggcggaaagcgaaaacaaatgaaaaaagaaaccggagaagaagcattggaaaatgccttaaaatgggacaaaaaaatcatagaaaacctaattaaaagggataatcaccgctttaaacggttccatcattgacgaccattgatccgccgatgaattcaaacagtatccgagccacttcggcactttcgccgacaattctcaccgatctcgaccaattgaattcaatctattccggtgatttgttgcccgatgcgactgttgatgatgattttgatgggccaaatgcaacaatttctgctggccaaatgttgtcaaaatggttgcacagtccgagaaaagatggcatgccgaagcaattgcatttctttttgaaggagccaccaaatatggaatgggccaacactctcaaaaaggtgtggccatattttcgttagccaactgattttgattgcatttaattaatgtccgtccgttttcccattgtttagcattttctccgtgccaatgccatttcttcggtcagttaccaaattcaatttactgttcagcaaccgtcaacgcaaattgtgccatttgaattagcgaacgaacagaccaaggaaaagcggacactgatcaaagcaagcgcaaatgtttgggaagaccgctgggtaatgaaacggtgccaatattgggagacggcggcggttcaatgggcagcccaaaatttggacggatttagcactgtcgagtttcattattacgtcgaagctggcattgggtgagcaacaaaaaagcatttgattttgtttaaaaaattgtgccgaatttttaaggctttgtcgccacgtcgcaaatggtgtccaattatt

SEQ ID NO: 19817 - DNA, 3149 bp, Heterodera glycines
  misc_feature (41)..(41): n is a, c, g, or t
tgttgtgtaccaacaatttattaataatcaaataaaaatanatgcacaaaatggtgaggtcggaggagtgcagcggcggaggataaatgtccaatgcgaatgaatggagcggagagccatgagtgagggaatgggcacccttataaagacgcggggtcagagaaatgtggaggagataggcagagagggagacaatggaaataatgtaagacagagaaagggggaggggaaaagtcaataacagtgatgaggtgtaagtgatctttgatcctatccaacaattaattaattaattgcaccaccattgggctccacagcttttgcgcgcacaatgtctttctcaaaatgggcgcataatggacacagcttgtatgcacatcaaacgcaatccaacagcagcaatagatgggtcgaaagctgtgccgccttttgtcaaagggcgccggcgctaccgatttggcggcggcaacaaattttaaggcaattaagtaataatgatggaaaaaacctgaaaatttaaatgggaaaatatgtaaatggaaaccccataaattaatagataaataagcaatgcttgttcaagaaaaagcaggaatgtgaaaagctggtttcaaaattattgcgtaaaaaattggaaatatcagggtgcgtgagtgtgtccaatctcgggtaagaaatttcacgcgtgcctcgaagcatattaggttctattgtttgggtttaaaagcttgtaaaattaattgagttttcaaggaattgttgataaataatagatagataccagggatatttcaagtttcgcttttagccttttgcattttcgcttttttaggccttttgcgttcgcttttcgcctttcatgtacaccaataaagattgggtttaaataaacattaatattgcaaataattttaatttttaaccattttgccaaatcttattaaaacaaagcaaatcggggtcgcaaccaaaagtttatgaataaattttagaaaaaaaaattcgaattttcccttttttgggcattttgctttcgttttttattttggtttcgactttttatttttgcaacattcctggaagatacctatttttacacaaattcgaaattttttggaccttttatcccatttaagtgccaatttaggaattttgtataaatcccattaaccaggctccaaccaaatcattgcacaaaaattcccaagttttttcttaaaatttgattcaaaaagatactccaatacgttaaaatgatcaattttagaaaaacctattaacaatttctccccttccaattcccaaaaattttttttggaaaaagcacacgcaagtgttgtgaaaagtgggggcactgctgaatattaataaagctgcgctggggttcgtccgtccattaaaagccaaccgccgcactcgcggggacggcggggggcaatcggtcgcaacgtcagagccaacggttttttggccatctcagtttagcattagcattattacgaatgaaatttaaagaaaattaagtattaaaattttaacaaaacgctaattttcaattttagtcaaaataaatttattattcaaaaaatgttttgaaattataaacgaaaaataatgaaaatgtaaaagttaattctaatagcttaagaaatgactggcttcgtcacctgctgtttttattacaatttttaaaaattttaagaaaaaatccattttttataagaaaaagtaataaaatattttttaaccaagaaaagcctcgaatgtaagaaaactccagagtgaagtaggtaaattgatttattttttattttaattttattacggtacattctatgttttttattttaatcaatttttttttttgcttttttgccaccaaattctttaataaaataaatttatttctcaaaaatatttatcaaaaggaaatttatttagttttttcaaaaactaatgattaaaaacatcatacaaataaaataaaggaataaaaattaatatattcgatttgttaaattttataaaaacttataaataatgaataatttttaaaaaaatatatcagtttatatttattattaaatttggtgaattggaaagcatttaaatagctacggaaataaaggagttattaaagttcaaattatttttaataacattggtgcaaaacttatgtaacaccgtaattatgtgttaaaataaacattatttactttaaccaaatatttaagacacattcaataaatacaaaactagcttttaacgtttcttgctttccacttttcatgaacaaaactgcgagttgaaaccctacaggtaaaagcaaccatgaaatgataaaaaaaaagtgtatacgaaaataatatttattaaataattttatataaaaaatctcaaactatttctgctggtaaattcgacactgagtattttcgacaataagtaatttcgacaatattagaatgaaattttttaaatttaaaatacgaaatttgtgaatgaaattaagaaacattaaaaccttaataatattttcaatattttggcattataaattaaataatatatttaacttttagctgatcagcattatataaatgaaataataaaaaatttcaacgaacaaaaataattaatttcataatttaaatcaaaagcacttatttttatttacaaaagaacctaaattaaagtagcaactttgttaacagattttcataaataaatgatcaatttttgcggttgttacatttttgcgcgttaaaatgatcaattttagaaaaacctattaacaatttctccccttccaattcccaaaaaaattttttggaaaaagcacacgcaagtgttgtgaaaagtgggggcactgctgaatattaataaagctgcgctggggttcgtccgtccattaaaacccaaccgctgcactcgcggggacggcggggggcgatcggtcgcaacgtcagagccaacggttttttttggccattctcagtttagcattagcattattaccgaataaaaattttaaagaaaattaagtatttaaaaattttaaacaaaacgctaattttccatttttagtcaaaataaattttattattcaaaaaaggttttgaaaattataaacgaaaaaataaagaaaa

SEQ ID NO: 19818 - DNA, 2507 bp, Heterodera glycines
aatcctaaatagacacgacgctttcattataaagctttaagggaggaaaagtaatacgaatatttcaatttcttacttatccgaatagacaaagataggttacacacgaacatttttatagaaattccggctgaaactaaaatccctcttttggtcttaacctatgatttttggcccattatggatgaattaagtatagaaggcgtcgcagaaatacattcatattttctaaattcgggtttcagaaaactaagatttaaaagaggctgaattacagatgcttttcaaattttgggtgtatccgaatagaaagaagttggaaatcagtacttttcacgcctataaaattcgggccgaaaaatattggtgtttgtgactagaaaaattgcagatgcatatcaaatgactacagaaaattacagcctccaagaaaataattgctttgcacaagcaatattttgtagagcccatcaaacacattgtgcttttaggaaaggcagaattatacaataggggcctttttattatgattacaacaaatcagcatggcgtctcaatgatatggtatgtttcagttaaggtttagccgatctacaaatttcggcactgtctattttgtaaaagcgaatcaaattcctttggattccaaagtggaattacagaattgcgacggcaaatcctaaatagacaacgacgctttcattataaagctttaagggagacaaagtaatacgaatatttcaatttcttacttatccgaatagacaaagataggttacacacgaacatttttatagaaattccggctgaaactaaaatccctcttttggtcttaacctatgatttttggcccattttggatgaattaagtatagaaggcgtcgcagaaatacattcatattttctaaattcgggtttcagaaaattaagatttaaaagaggctgaattacagatgcttttcaataaaattccatcaccggggaattatcacaaatggaattgggcaccgggatgggacaggaaatggagggcaccggggccacagaacaaaaatcaataaccgggggtcaaagaatgatcacgaatggggttatcacagttaaaggcaaatggaagggaggggagagaaacggcaaaaatgcctaatgaattttggttgtgaaattgggggcatttttggccgcttaaataacaataaatttaaataaaaagtggcaaatgtgagcagaacaaaatgggccgagaatttgggcacgaaatgaaaaacgggagacaaaatgaacagatgaacaaaatgggcggaaaacgggaaatttgggggttcatcgttctttggagtctcattcgccgaattggggacggtggcagaaaagttgcggttttgacaaattggtcattaattgtgcgcggggcatggaagaaacgcagaaaaacaattaacaatttggagggaaatggggggcagaggagtggaacggggtgcgcggggcatgtgaaagggagggggaagggtcgccacttcctttcttcaattctgctgatcaattgatcggcagtcggaatcccagagttccgacattccggcgtgaaaaagatgggcccgtcagaattcttttcgtctgggcctcccaaagggcgagtcttctgtaaggtcgagatggctctgtgttcgtggttgttggtaccgagccgttctggcgatcatgtccaatttgattggtgacatggatcgatgctctgccctgcgcgctggtggtttgggggttcgtggcatttcacgcagcggcattccctcttcgatcccgagtggtttggaaacggtgggtcggaatgtcggatgcgggcgtactccaacgaggctgagaagagtcactcggatgggattgagcaaatacgccagagtgcatggcagaacaatgtcgcgcagcatgaggaaggttgaataaacgcaggcgactcgaatccaccatgtgattgcttcgtcgatcaggccttttagccagcgcatggtgaatccttctattccgcccttcaacgcgcccaaagcttcagtccttgccgtaatgtgctgttccagcttgtccttgaactgctccgagttgatgaattcgttgatgtgcgggaagcgtgtcgcgtcagactcattgtcgagttgccatgcgtggaagatcaatggatgaagttccaaattgctattcgtttggttgatcgttgtttcgtacaattcgtggacgtagtccttcggcattcgtcgtgctgtgccggttcgagagacaatccataaccagatgttgggattgcttcgcagttgaagatgatggaaccgatagctattacagcttgcatgttgtgctgtcagcgagaggatgcgaagttccggatccaggaaagctgcgatagctcggtcgggaaagtgcgcagtcacgggaatgtagaggcgacagtcaatcattggcctgtatgagaaggcctgaagcgaaatgttgacacatgaaacacctccatt

SEQ ID NO: 19819 - DNA, 2591 bp, Heterodera glycines
cattaatagggatgggatttttagtgctaaaaaatcccaaaataattaactaaatagtgagaaaaaaatgtcaaaatagtggcaaaaatagtggcgaaaaagttccaaatttaggggtgtaattttttaaatagctgttttttaatttgaaaataatttaaaattaaggcaaacaattttattcactgattgcagttacaaataagatacatttcaaaattttcgggggtaaaacgcatacgattatcggccaacattgatttgtaaacagaaaaagatcgttcaacgtcacaaggtgtcaaaggagcaaatttgtaaaaagggaaaggtttggagaaacatctgactcagtgtttttttcggacagaatctggcaaaattgggagattttttcaattccatggttcttgtccacaatgtccgcgaattttttgcgaatttcgtttgccttttcgccataaacattgtccatttgattgtgaacgcctgtgaatacatccatggcatcgaaaatggtcattccttgtgtttccaattttgtaattgcagtagccaattgcccaaaatttgaatggatgtaagcaaggtcctgccaaactgaattgttgaaagtcaattgacattctttgatacacactgcatcatccgaattgaaagaattcactacctaaacaatgcaaatcattactacaaaaaactaaaataaataattgacaaaacgcgccattgttccactgtccaccttttcaagcgctttcacagaaattaagtgcgggggatgccatttttccatccaattttcctatcaacaaattggccatcattcgccccattttatcagtagtctcgtccactgaaatccaaacaaatgcttcaccaatgtcgtctttaatttttgtcattgtctaaaaatcaaaattgaaaaaaaaatttttgaacaatttatataacctcagaaaaaagttggaccaaataattttttcgaagagttgattggtccggcacggcgcgttgacaatacttttccaaaaatgaactcaaaactgcattgttcagtttaaaaaagggaatgttggccgatacaagtgctttgcaaaagtcggcagaaaattggtcctgtttgttttcatttgttgtcaaaaaaggctgatgctgcttgcttttcttttttgaaaatcggtccaaattagcgcgatgttttgcgtgttgttttaaatggcaatattgcgagcatggaatctgtggaaaattatcatgttgctgatgttgtttgttgcaagtcgttgttgtctttacctgctgttcacaaacttgacagaagattattttaccattaatggagtaaatttcttcgccttcaacttttttgatccagtcacgaataaatgcagatttagattgaattttgggcattttgattcgatatttcctttaaaaatatgggttttatttggtatatttgaagaaaattagtgaatattcctttacaaatttgtaaaatcgcgaaatagtggcaaaaataatgacaaaatgccaaaatagtggcaaaaaattattttagtggccaactttcgaaatagtttttttttagtggcgaagctccaaaatagtgattcctagtgatgaatagtggcactaaaaacgaaaaattttcgaaaaataatgtgtttttcgtgcatttctcgtcgagttaaagccgcagaaaaaatagttaaaaaactaagaatcccatccctatacattaatactaattttgcatttagcacaattttcactcggaatgcattgatttttggtaaatgaaaggacaattaatttctttaactttaacatttacaaatttagggttaaacagaacaacaattgtccgatttgtcgcgcaaaaactttcataatttcattaaaaaacggtttattttaatttgaaatacaataaatttttaccatttatttaattaatttagcgaaaccaaacgcaaatttgaactcagaaattgttggcgatgaaaatgtgtgatttctgagtttgttcattttttgtttgtttttctctgatcattcattcattttgctttgttcgggatgacatttgttgctcgtttttttttgaccaagaaaaactatttgcttcttaattttcaatgattttctttcttatttaacacggccaaactgatttatataatttttgaaaatcttagaaatatattatttgattgctcataatattcactaaatatgtaaagcgagaagataggtgaaggtgctataatagtcgataagataaagtgcatataatgttactcattctaagaataatttccttagtttaacaaatccgtcatacttttcaggtgtcattttaatacttttcttcaagaaataactcattaacataatatcaaagcaatttaaattcatttatgaggcaaaaaaattccattaactgaaatggtgagaagtttcgattttgagaaatatttattccactaggaattgcaaaaactaaacgcgaaagaaataaaataaaatgtaaattggttaattaaatcgttcaaaacagataccattgcttttattagtgtgatatc

SEQ ID NO: 19820 - DNA, 2167 bp, Heterodera glycines
  misc_feature (2128)..(2128): n is a, c, g, or t
  misc_feature (2145)..(2146): n is a, c, g, or t
  misc_feature (2156)..(2157): n is a, c, g, or t
ttttttttttttgcatttcttttaattgcttttttgttattgcacagtaatttgagtaaaattcgttgaaaattagtttaaaaatatatttttgtttctaccccattcggggcattggcatattgccaacggcaaaatcattataattcggttaattattgatgccataatcctccaaagctaagtgcaaagctatggaaatgggcatttggatgcactttgtaaagcaatgggcatggtcatgccacataaattacgtggaaaatatgctaaattggcattaccacacccaacaaaatttgccatgctcaagcctctgtgggaatacagtaaattattgatttttatttttataaattatttttacgttttataatttccattggcatgaaaaagttggacctagaagcctcaaaccagggctgtcaactgaaaattttcaaaatctgcgtttggccgacaaaaaaccatcgtttgtggtcaaaaatcataatttttaaaattctattccaaatttaaaaaataaataaaaagtttttcggtgcgctttttccaaaaaactttttgaagaggggctggcggcgccgggaaaaatattgaaaatttgagtactatttgttaacagattttcaccataaattactaaattttacgatgggtccccgcacttttcttgtgccgaatcagtgagtcgccaccctacttttccattttacccatttttttggtgctgtttcaggaagaagtttccatacaaaacgcaattgaacggaaagagttcctctaagaaacgacataaaaattaaaaaaatacaccccccccccccctaaaaatggatgattatcaaaaattaagttctttaaattatcttttgtttttgctcatttttgaaaaaatgattgaattcgcaatagcagcgcttttccattccaggatggcattgcgggcgcgatcagtggcacgggaaaggagcacaagggactgggaatggctgaatgacaaaagctgcaaaaatgatcggatattcgggagcacatcatgaagagttgattgaaattgtgtactaatttggtccatcctttgaataagtcttttaaataggcaataatttgaaatcatgcatttcagtgaccttttacaagaaaaaattacacgcaaattgagctaaaatacgaacatgataataaaaataataataatggatattttatctatctattatttaaaaattatttttgattcttttttctcgcttttttcttatctgtgccccaccaaattaagcggttctttgatctcccccccccccccgacctttcaattacgctcaatgggtgttgctctcgatcactttttgtcacatccgacccaagaccgaatcgccgagggtcccaaattgtatgctttcccgaaataaaggcgttaatgttggattctgcaattatggggaataatgggatacaaaagacccttcagtaatctccgacattcaaagccaattccctactttttaacagatttcttacacattaaacatttggtaatacagaaaaatgtaattttttgtgttcatgtgccaaaattctcctgtaggaaacacttaggcaattaaaataattttggattttactaaaactttattaattttattttttgccattcttttggattcttggatggcaaattcggacttttttgctttcagttgtgtgcagatggtgatgtgcctgagagtttcgatgccataacttcaatcatttaattaaactcattcagcttatccagaaaaacaacaaaaagctcagaggggtgtcgaaatgcttaccaaattgttcttttcaatttttgaatgaattcagtgaagtgaagtttatacccaggtattatacaacaaacacttaattaaaatcattgtatgttaaaatctagaaaatttattaaaataaaaaaaatttaattaataaatttaaatgaaatgccacaaaaatattaataataaataagttaaaaatacttaaaactaaaggaagacaaataatattttgtgttgaaagaagtgttgcgtaaatgttgtgaattatggctttctgctcgaattcgtgttcaggatgtaaaatttgtcagaantgtatgtcagaatcggnngtcctactannatgacctgca

SEQ ID NO: 19821 - DNA, 2068 bp, Heterodera glycines
  misc_feature (50)..(50): n is a, c, g, or t
  misc_feature (2032)..(2032): n is a, c, g, or t
gggggtcccccccccccccccccccggggatcggcctgattaagtgcttntcatgtaccaattccactgccatttggtttgtttttagctgcacactacgctcactgtgcccgattttatggttggccaatactttcccgaagtgatcgacggagtgttcaaagcgttggaggatccgtcaccagcggtgcgcgaagcaacgataacagttctgaacgaaatgctgcacaaattggagccgaaagaaggaacagagccggtgagaagcaaaggcattggcacggcaaacgcgaaaaagtcaggtggacatcaacagccattgtgaatgtgttggtggcacagtccaacgctcacacggccacggcacgcgaaatttctgttcaatggatggaccaagtggcaaaacgacacggagacaatcacttttggttgttcagattacttcgtattacggtgaccgcgtcctgcctcagctgtcctcctttctgctttcaattcttccccatttggccagcggagagaaaggtcttattacgcgttccgaccatctcaaccaaagcctaacggaattggtacagtatttattttattatttttattatttagctaatcccatttgtcatttggttagctcaaattcgactcttcaattcccgtcgagccgaccgttgaagtgcttttggcccatttgcgccacgaccgaatggaaacgcggatggccacgctgaattggattcggcaccttcactccgtccaaccaaataatgtaccaaatgatctaacccttttttgtggttaaagaaattgtcagatgtttcgctacatggaccgcttcttccccattcggctggaacttttgtcggacccggcggacgacgtgctaatgttggacattatgctgatcacggaaatttgtggccaaccaaaacagcagcaacagttggacattcgcactttgagacttggcgaggaacttaaccaagaagtgggggaggggagtggaaggtcactttcaacagcaaaatccccagttaagctgaagtccgtgtctccttacttggtcaaattcagcgtggccttgcttaagatgttcaaagacgatgacaaattaatcgacgagcgcggcattcacattgtccggtgcgtttttcaccagttgactacaatattgtaaattggtgcttcaattaagacaggtctgcttgttgcttgagccgacggatgtgtttcgttcgttggcattacttctcggcacaatggtgaacatcgacggatttgtccttccgactgcgggacaacagcagccacaactgacaacggccccctcaggcaccaaagacccctttttcgaccttcaatttgttgccaaaatggtcaaaatcctcaaccagattctgatgactaccaggtaaataaatccatttgtcggtcgatagaaaataatattttattttctgtgagctgtttcctctccgtcagcgactccgttgcccggagcaaaacgagtgggccgagttgtttcagaatatgtacaaatgttgggcccatcagcccatctgtttgctgtctttgtatttgctttcgcagaattaccaagtcaatattcaatcgaattttgtccttttttcctcgtaaattattcactgtttcagcccgcgttggagttggtcccgagactttctgagattgaaataacctttgatctgctgacagaggttgatcggcttgtgcaactcatcgagtccccaatccttgcttgtgcgtctgtcttctcgtatatatttcatattttgtttatttttttcagatgttcgaatggatttgcttcatcccgaccaccaaaaatccctttctgcgcttctttctgcccttttgatgttgttgccgcaaagcgaggcctttaatgtcctccaaaagcggcttcaggccgttccccatttggctgttctcgagtgggttattagtgcgcccttaaccaaccgagggagggaatttctctcttctatcataaatttaactttagggaatttgngtcttttcatattaaaattcgtacttttagtagtat

SEQ ID NO: 19822 - DNA, 706 bp, Heterodera glycines
aatccatgctcagatcatcgctcccactcacaacaggagctgtacagggcccaagaattgataggcttcctgtcccaagagtactctcatgggcaaggtgccaatgaggatatcatccatacaaattttctaattttatttttgttcgagttcgggtaaggggttcgaaattggcaaaaatgggtgctgtattcgtgatcagcgaccccaaaaaccccttaaaacttattttcattaatttataaaacacatttataggcatctgaaaatgtgtgttaaaagtatcatgtaaaggaaataaataccataaattttaccagattaagcctaggcccaaggaggcctagcctaaccgaggggaaaagtcagtgttttcgttttgagattgcttcgatggtcggcgatattaacgcctttccgtgctctgatgatccaagcattgatgggaaggacgaagaaacaattggaggagggacgaacgacatttctcagcagcgaaatgattgtggggacggggacaaacgatgcttcgaactgtcggtgatggtggccgagcccgggttcagaagacgcggaattgctctcgaggcctgcaagctgatgattgcttacattcttcaacgcataaggggaaagccaaattttatcgcgaaaatcagtgccttgggagggccccaagtttggcactcttccgagatcggctgaa

SEQ ID NO: 19823 - DNA, 2109 bp, Heterodera glycines
  misc_feature (2042)..(2042): n is a, c, g, or t
accagggctggccgtgatcacggatcacggctcacgggaatcacggggtttttggggtgccgtgatcacggatcacggctcacggattttttcaatttttccgtgattttgatccgtgattggcattttatatagggaatttttgttgaaacgaaatcctggaaactggtggtattattttgagcggcagccaaattcaacagccaaatgcaaagaagaagggtgctcatatattaaaacactgtcaacttctctgagcactagcgttttatcatttcacctcaaaaagcatcatccaaatttatataaacagcgtgaagattttattaatgaagaaaagaaaaaatcagagaaaaaacccctacaactggcaaatccattgaagagagcctttgcaaatgctttttgtttgacgtcaatagaacaatcagttgaagcagaagaagaatctattgttaaatcgcccattttgttatcattaaatgccaaaagtagcaaaaactttttcttttttttttgtaaattcttaattttgaggtcaatggagcaaggaaggagcctatacaataagcgctaatcgagctttgatggaaatgctggccacacaattactgccatttaattttgtggacggagagggatttcgttgttttattgaaaagttgcagccaaaatacacaattccacacagaaaacactttgcattacatgaactgccgggtagttttgacgcaataaaagtactcaatttgcttttttactttgaaaaattttttatttaagaagtttgttatcgcggaattggattctatttacaaaatagggctaaccagcgatggatggacctcaaaggataaccgtcactctttaatctctgttaccggacattttttggacaaaaaatttcgaccaacattttatgttcttagtacaaaaccaataaagggtaatttaaaaataactaacaaatcaaaaaaaaaacaaaattaagggcgacatacagcagatgcaatttctgcttttattcgtgaaagcttgaacgaatttaaaatttcggaggacaaaatctcagcaataacacgcgacactgaaaatacaatgaaaaaagtttcaaaagatttgggatttgaatcaatcgattgcgctgcccatgtacttcaattggtaattaaaatttaaaaaatttaaatttcttttttaggtgtgacttaaaaaaattgatgaagaagaaagattgaaggaacttattgaaaatgtcaaaaaatttgttcgaaaagtacgaaagtcaagggttttgacagaaaattagctgaattccaatccaatgaagaaataccacaaacggttttgctaaaaaacacagaggtaattatattattttttaaaattaattacaaaaaatcatttactctgcttttacagaaccgaaacgcttcaagttccattatcattccactctttaaagttaattatttaacaatatatcttaatctaaatagcatttaggctattacgtttgcattacgtaaagagggggagaatcgattttcaaatatcaaaaatacaattgcattggccattgaaaagagactaaaccaattcgagaaccaaaaatatttggtgatttcgacccttcttgatccacggtttaaggctgtttatttggattgcaatcacgtagatggctacaaaaattggctaatcagtgaaatcgagagttatcacaatgaaaattacgtaatgaaatatttattttgagtttatattttaatttttagtataccgatgagttgttagttgaaaataatgcaagcgggtcaagttcaaccgacattttttctcaatttgaaaaagatgctgaattcgaccaattaattaatacagtaaagctttctttttaaacaatcgcattattgttcatttcacaggcaccatcgcccagcccatcagcgttagaaataaaacaaaaggctgaagttgaagtgaacgaatattggagagatgcgaaaattaaggcaaaatccgatctttatgcttactgngaaaatcattcacataaatggccgatgatcggaagaattgtgcccaaatttctttctccacccgcta

SEQ ID NO: 19824 - DNA, 2396 bp, Heterodera glycines
tgatcgacgcaaatggggaaatgggatttctaggcaaaatataacataaaacagcacaccaatttgttgcttaatcatggacatatttgcgttttgaaagaaaactcaaatcagcaataattgcaatttttttgagatttaaatcatcgaatttcgaaggttccaaccattaaaacaatttgacaaattcaaaaattcaccaaaaaaaaacataaaattcgtgcggtatgaaaaaaaactttttgacggtccgatgccaattttgtgttatggcagcaaaaaaaattccatcacaaatgggacaatgtattgattgacatacaggtgcgaatatgcccttgaccagcaaaaacattcaaaattgtcggtgccggaaatataatatttggtgtttgtttttggcaattttattaggcaacgcatggcggatgaatgtgcggattggcatgtaacagacggatgccggccatcaaacgcttgtaactgttctccaaattctttgccgacttcgggtccaaatcgacgatacgaatctgtaaataaaaccaaaataatttgtaatcggccgaagaattaaaaaaaaaaattatttaaaaaattggattaaaatttaaaatgcccccataaagcacatgccgaatatgcaaagtgaaatgaccgtccgtccagcccatgcacacgaatgtaacccctgtcgccgacagcagaaatctacagtaaaatgcacaaaatgattaaaaaaacaatttattatttaattgccgtaaatgagcaaccatttcatttgtgatggcatgctcatggacaagccgaatgctaacctaaacaaattatttggtgttttataatgcatgctaaaatgtgtctggatttggattatattagcagccgggacggagcaaaattcccaattcgaattgttttatataaaaaaaaatggaaatcggacaaaattttaatttttttttttgtaattttttattgggaaattcgctaaatttttgacagtgaataaaatgaatggcaaaaaactgagagtttcatttgttaaacgtgtaaatgtgctcaccatcagtgagcagtctttgattgtcgcggccagcaaatagcgctccaccaacgagcgcgggtcctccttctccagaaattccaaaaaatttattggcaacgacggaaaacttttgtaggagcgcgtcaacaaatttgcctttctgcgcaactgattctaaattcaaataagcatttaaaattagttttttttaaaactaacccaaaagatttgcttactaagaattttgaaatttaaaaaaaatgacgtaaacggaaaaagttcgaataatattgtgaaatgtgacagaattgtatggcctccgtaatcagaaaaaatcttcgtagtggacattttctgtttcctaaattttctctttttttctactaataatataagattttcaaaatttttttaaaatttcaaaaaaaaaatccgatttttgaataaaaattccatggcctaatggttaggattgaaaaaacatcagtgtgtgttcacctgcacatcgtccggcaaactcttgtacagctcgaaggcccgcaccattccgacggtgtcaatgcgttgagcggtcagcaaattgttcagcacactgccctcggtcagccgaaacttctcccgccggtcgtccgcaacaccggccaaaatgcaacagatctgaaggatatatatttatatatattttgttttaaaatatataatttgtgaaagaaattctatttgtaagccaaagtcccatcgttcatagtttaattttttttcctgaaatatttttttattatttttttttaattcaaaaatttttgtgaatttcgcgccatttttcgttttttaatggagtgtgtgcgtgcatcaaacagagaaagtgagtatcaatcattttaataatcgttttaattatcaattcaagtaaatcccgtaaaattccgaaaatcctgcccatgatcaccaaatatttgcgaaataaaaaccacaaagcacacacaccgcggacacaaaagtgtcaatgttcgctccgtcgctgggcccatggccgccgccgccgtcggaggccccggcggggaaaagtgcggcgccgagtgcgtgcggttcgaacgcgcagccgtcctcgtgcaccacgttgccgtcgacgaaaaggcgcaggttgtggtgcggttggtgcagcagtgagcgcagcgcccgctgcattcgcgcgcgcacgccgctgtacaacgccaacggacagaagtcgtacatggcatggaaggcggagctgtgatggcacttttcaatctggacaaagtggggttgaatagaattttgtaataatgtaaagttaactattttaaataaatttaatggaccg

SEQ ID NO: 19825 - DNA, 2612 bp, Heterodera glycines
aaaaagaactaaatttagacatccatttcaaactagtattggtgacatatttcttttgtttgaaacatatgaacttatttcgacctaagttcaaaaaaaatattaagaaaatcaatataattcaaaaaatttcaacgttgaagtcttcggcacccggtgcccaaaattttaaagttctacgcaaaacgaaaaaataaatttaggcttccaattataccaacataaatcgaataccccaaaaatttaaaatacacgttcgtttcgaatgtaagtcaaataatttggtttattaattcaaatttataattgcaaaattactcaaagaaaattaattttatatattaggtattaaaaaatgaaaatatttctttatatgctgatcaaatgattcaaccaaaagaacagatatcttacaatgcaaaatcttatctaaagcagattaatatttcatagttcgatcaaatttaaagaaattacgaagaaattcatacctttattatgtatcaatgatcactgatcatattgcaagtcataaaaatttcttattttcgattgaaagaataaattttaaaattataatgatgttaatcgataaattgaaaggaaaaacgtctcagagaagaaaggattatatatttaaaaattccaattacatacaactaaaattatagcaaaaatgaaaatttttacattctgatttaattaccctaatttaatgttcgataaacgataaatgcgttaatttattgaaaatttttaatggtcgttttgtgattatattgaatgtgaaaataaaaaaattgtgaaaattaaatgaaaaatttaaaacaattatttagtataataaataaattataaattaaaaccttttttatagaaaattggagcagaaaaaaagtgtttctataaaaagacatgaaactaaaaaacaacatatttttaatttaataaagagtttttaaaacaataaatcatttattaaaaattactactcgaatgaacttaaatattaaatgagggaatcataaacatggcacggctaatttaatgttttcggtgaactgcgcgaggcgaataggatgtttgacaaactggttaagataaatgccaatttttatctccgaaaaagtcaatcagacaaaataaacgatttaataaaaatgcttaaacaaagcgcttgataaatcaaaacagctgtaaaataataaagccaaaaagtcctaatttataattaaatgaaacgattattcatataaaaacaaaatataattatttaaagggtgattgtaaaaggaatattaatcctaattcatcataaacttgtatgaaaagggaataataagtgttatttattgtacgagaaatgattaataattaaacatgaaataaaaatacaaggtcgaaccgaaagtaactcgaataaactgatttaattaatttaaaaatttaacaaaataattatgaaaaattacaaaaaataaatattttttatataaacaagtatttaacaactaaatataaataaatgagtcaaaaaaatctttaaattattaatgaaactaaattaaatgaaataaattcaaaggagacgagtgaattttaaatttgtaattatgagctcccggcactcgacgtgagccaactcgaatccaattcaagagagttgtaaaagtgcgattttgtatcgcaataaaatgatagaaatcgacgcaaattctttaaaaataaagtatctaatatggccaataaaaagaaatcatttaaaaatattttctttctttaaattttttggtaacatttaaatgaaacttgttcttaataataagtaaaaaattgtttatcatttactagttaaaatcaacattaaaattaactaacataataaatggttttaaatttctatggaaaaattggtgttttttctgaaaacaaatatacattataaagaaaatattaattaagttatactttaaatcacacttaaatgtcgaaactaaatttattagacattttgtttaaataatttgcattaatgaactaaatttaaatatgcaaataaatttgagacaaagaaagggataaaaacaacaaactatataagatgaattatatttgcaaaataaataaaagtttatatgtaattaaagagaattaataaagacttcgaaaaatcaagttatgtagcgaaatggatgaagttacgcctattagtgaacaagagatagataaataattatttaaatatatataaagataaaaaaaattgcaaacatttataacatgttcagaaatataaatagaattaatcagtacacggcaataaattataatataaataacgcttacaaggtatgatgactaaaatgtaataaaatttaaatgaaatggtaaaacgatacttatggatattattcttaaacaaatatacggaccagggatggtccaaattggaaaataaaatgcgaaattttttctccaacttttttaatagtcaaaattagagtagagcgggaccgggaattttgggcttaaccgggtccgggaccttttcagaagggaaagcgtaggactttttggctgagaaaaccgggaataaaaaggggactggtccc

SEQ ID NO: 19826 - DNA, 1796 bp, Heterodera glycines
  misc_feature (53)..(53): n is a, c, g, or t
tttaatttttcggcggaggaggaacggggcggggaatgaagtgcatacgcttntgaaaccaagcctagtccagttttggtccattcattcatttttataatttgagaattcatgaaaataatatttatttagcattaatgagagccgagaattcgttggttgctgtgaaaatgttgcctggtcaattttttattaaattaattaaataaaaatatttatttttatttgtgatttatagaatatgctgatgatttgtcaaaaagtgattttctgcgtgagattgggctgatgaaatcgttgggtttccatgaacgtcttgttaatatgcttgcatgtgtcacacaatcggagccatattgcttaattgttgaatattgctgtgatgggtgggtcaatttggtgctaggtcgtttcgtaaaactgccaattacagatttttcgagaaaattcaccataatttttcttaagcacaataaaattaaataatcttgatatcatacgattcagctggataaagaaatcattaaaataaattctttaaatcaatttaaaactaaaattaaactccttaacgtataaaatgaccggaaaagtgaattatctctttaattaaagatattatatattttatatagtgatttggttttattaatcattgacctcattcttatatttaattttgttgtgatttctttttttgtttaatgtttaatccatattactcgaggacgatttaatctatgacacgtccgcagagtaagtggattactcccttttgtggacttttttctttttttgcataaataaataaataaaagatcacttcctccgtcccttttgagcgttacttcgccaaagttttgactatttttaaatgaaaaataaatttatttgccccattttaaagggcttcccccattcggcacggaatggaattgcttttggtggactcggatttgacaattgttgacggtgaagtgacaccaacagcagcagaagcattagcagtgggaggaaacggtgagcgaaaatggaaaaaatgccgaaggacaaaatgtcaaaggatggttattaatggcgggcatttaaatttcaatttttctcatttctaattccctattacaatcccccccccaaccaaattccagcagaaaatgccatcccttccgttgctgctgtcgttgtgccatcgtcgccttcccccgtcgacgccgccgtcgttttcgcgttccccgtttttccttcaccgtccccgcttttgccatgtcccgccttcgatgttgacgtcgtgccctgcgcgtggtggaaacgcccgtcggcgagtgcacacgcaacgcgcgcttcatgcagcgcgtgtgcaggcgcatgtgcggcttttgcgacgcgcggccgacggaaaaacatttggaatttaaatttttgaaattcaattagaaaaatttatatgcaaatttatgattttgatcaatcaatcactaattcataattgatatttgtacaatgaaaaaagtcactcataaatcagaaaaattacagaatattttaaacagtaagaaacagaatcagcagaagagtggcgctagttggaacagttactgtagcttctttgtttcacaacaattgttcacattcaatttacctttacggagagaaactaggcgtaaaatgaaggagatgaaaataaatcaggcgttgatccgttctgaattcttaaaattcttcaaaaaatttgaaattttatggcgtaatgtcagaccctaaaaatactttgttttcttaaaaattggcttaaaatt

SEQ ID NO: 19827 - DNA, 1499 bp, Heterodera glycines
aatatcagtatataaatcaaagcgggggagagagaccctttgatttgggtttgcaaaatttttggcataataaatcgtgaattgaactagctgttatacctttcatccattttcgaccaaacccgaatccttaactctaattcaataagtcgaaaattttccttattttgaattcttgttctagttgtagttagggatttggatttttggtcaaaaagaaagatatcctgatcagaacgactcataaaactcccagaaacagattttacgatttgacgacacctaaaaaatttccaattttattttccgaatttatttcatttggaattctatgaaaaaggaattgtcttttgctaattaggtagcaaattacgaaaagaacatatgctagcttagtttgggcttatttcatgggaaaattaggtgggcggtactgctgcgcatatgtcgtcgtccaattcacacaatcagtcgttgttgttgtctgctgctgctggtggtggtcatcagctacaaaggccgccgccaccgccagtttctgtccaatccgccgccacacattcatcagttgcgacaaatgcaacaacacaacaacaccagcaacaacaacaccgtttcctcacaaatcatcaacagcaacaaaatgtttctggaacaactgctgcggttgtcaagcaacaacagcaacaagcacaacaacagctcctgaacagcagcagcaccatgggagcagcagaattgagcagtattttgcagcagacgcatcagcagcaacaggtgtttgttgctttgtgattggagttcggttttggagctggaacctgaatcaagattcaaataaatttttggcagtttggctttttttttgctggatcaagatttttgtccaggatagttcttgttcaatctgaaaactcaaatacggaaaaacaaacaaacaaatgaatagaaaagtcactcattcggaaaatacattaaaaaggggtccggaaagcggttttttaaacaaaatctttaaattttcaaaatttttgatccccaacccccctattactgaaccatttgaatgttttatttgaattttcttcaaatccatcgcttgctgatttgcttctgttcatagtttcagcttcaaaatgctggcgttccattgctcggtcttcccgcccaactgctcgcatcaggcatagagaactcgaacattcttcaaccaaatgctctgcgtatggtgcccggcacccaatacgccataatgggtatgttcgcaaggtgcactattctccccacctccaaaaaatttaaaaaatcgaaattagaaattaaaaaaaaaatttttttttaatttctacgatttttttaaaaaaaattttcggagggaggtgttgttcccttcttcgcatacttttttaataaattcacaatcaactcattgcccatccaattgtgtgcagatggacctggcggagcacagaatttgattctgcttgccaccgccgcta

SEQ ID NO: 19828 - DNA, 816 bp, Heterodera glycines
  misc_feature (37)..(37): n is a, c, g, or t
gcatatcggtcttttcaaactgtttgttcatggctanaatttcaaagttacattgatgcgacaaaagcaattccatctcatcaacaaattcagaaggttggcaggagtcgagtcagaaaaatacaatttttaatttaaaagaaatttcattgaaaactaaaaaattttttttgctaatttttcaatttttgctagcaaaaaaatcattttaagaaaaaaattaaaaatttatacgaattttatttgatcgaaaaataagcattgaaaaaaatgaaaaatcgctagactacctaaccgaaaaacaaaaaagaccaccaatccgctgggggtacccaaaaggaatccatttattgcactttatccgacttttgattctggcaaacatttcccacttttcttaacagtgtctcgttgacatcggtgacaagccgtcaaattttgttggcagtaaaaaatggattggatcattggaattgagcttttgcttggagacaatgttcggcatcaatgccaaaattctttcgtccaaaagtggtgctgatttggcagaacatgcccgggctctcatttatcattttgagaatggcggagcccctgtgatgattggtgagtgcctcccggttttttggaaaagttgtcggggtcgggagcgcctgaaaatgggagtcgaagttcagggatctcgtcccgggtctttttctaaatcccgaggtcccgttcactgggtctttttctaaatcccgaggtcccgttcactgggtctctttctaaatcccgaggtcccgttaactgagtcattttctaaataccggcgat

SEQ ID NO: 19829 - DNA, 798 bp, Heterodera glycines
ctttttcgcatttgatggacaaaagggccgaggcattgccaaaagaagtgtttaatgtgaccaatttccacaattttttgccaaaatttgttcaaacggcaaatttaacattaacaaattagatgaactcataaactcaaaagccgtttgacggcaaaagtttcaaaacttttctcttttaagcggttggtgatcacacgaaaaaatggaaaaattgttaatcaaacaaaaataacagaaaattaacgaaagtaaaataatttaattataaataattcgaacgaccttttattaattgaaaaaagaaagtaaattaattataacatcgaaaaataacaggataataaatgatcaattgcaaaatttttaattaataaaggggaatgatttattattaatttgttaaattaattaaaatgagcgcgaccgattcaaacatgtcgtccccaccccctcagaatccccaatcacacagagattctgaggtcttaacgatgtcaaaagtaaaatctgatcacgtattcgtgatcagcgtcataaaatacccttaaagacattttttcgagtgattttgggttataaaattttttcaaatcaaaaatcctgtgctcccctttagtcccaaatccaaaaattacttttatttttataacttttttcaaaaaagtaataaatgataaaataaaattcttattatagagaaaaaaattgcggattttatgaatatttttatattttttagcgcctttttgggcgcttcgcacccgttttgtaatttttttgggacattcggccgct

SEQ ID NO: 19830 - DNA, 1071 bp, Heterodera glycines
taaaataataatgcacaataataataatatttatttcatttgcccccgattccccattttcaaatgaataaattatatattcatttttgtcctttggttggccatttaacaaaattcaaaaaaagaaaagaaatctcaggatgaatttgacttgaaaaccacaaaaattggcatttttacaaaaatcagttagcaattctttatctttttaagaattttcgagaaagaaaaagcatttcttctgcttcgattggcaccgccggactttcttccctaaattttgtttgaaaataattttgttgtcattgtaaaaaaagtttttccctttgatttcaaaattccacttgcccacccaccccttctgctgccttcccgggctgctaattcactcattgtcagtgccaatgtccctttttggcactaattaactttcgcttacaaattaatgagtccgatttatacgcaagttagaaaaagtgtgaataaaatgcaaaacttgttttgttttgggaatgttctcgctttgtgcttgcttttctctttcaatttgctgtcacgcggcgaatgaggcgtatttggcacgctttagcagcggcgttctttcgtccgcccattcctcgcgctgtccaatcgcttccatcacttcgatggtgcgcgaatggccaatgccttggcaatgaatgaatgggagggaagggaatcctttctttttctgtgccgtccttctcacattttttgttcgtttccattttatcggtttttacgaaaattgcacgggaaagaggcgaacgttggccattttgaaagcaggcattagctgaaaatgttgctaatttaaatgccaattaaaatgaaacacccgccgctccgtttatagcctttgaaatttaaattggcattttccttttttggcacttcgtccattgtgccataatttctttctcttctcaccacagtacaaatagaaccaatcgtgcttcaattccgggaaaatgacccgtcgtccgtacaccgtcatcttttgccattcaatgagccgtgcctcggcattgtccgtccaatagaccatat

SEQ ID NO: 19831 - DNA, 1220 bp, Heterodera glycines
  misc_feature (1189)..(1189): n is a, c, g, or t
ccttcttccccgttggcgaattgtccgcatcttccggtgacgaatcttccgcatcatccaatgacgaattgtccgcatcatccaatggcgaagcgtcttccaacggcaaattgtccgcatcatccaatgacgaatcgtccgcatcatacctgtgcaaggggggggggggctcagccaagaggtttttttttttgctctgctcttcggccaaaaaatttttttctccagtgttattaaaaaattgaatgagtgccatcggcccttcgtccgttggcattttgccattctctcatcctttccttaccacgacttcgctgtgtccgtcccgcacattcactcgcaccaatttgttcgtcggttccgcactttcgtccttcttcgagtgaatctcttgcaccgcgtagacgaagtcaccgtgcgcggcaatgtccgcatggcgcagcaaagtgccgtcaccgtccggcgtttcgctttgaatgatcggcttaggcaccgcgccgggggcggacaaaagccaaatgccgccggaatggcacaccaaaggactcccgccgttggcattgtgccattgcaagcacagcgaagcgccgccgtattcgtggacacttgaaaggatcaataatgttggcaaaacatatgatccgcttattttcccttaatcgctgccatttcccacctattcgtcacggaaatgtccggctgagtccattatcttccaacggcaaattgtccgcatcatccaatggcgaagcgtccgcgtcttccaacggcgaagcgtccacgtcttccaatggcaaattgcgcgcatcttccaatggcgaagcatccacgtcttccaacggcaaattgtccgcgtcttccaacggcaaattgtccgcatcttcttcgaaagtcagtgcacctcccacagtgcgctcatgcttcacagatgacggcttgatcagccaatttttgcgccaattaatcggtcggtattcacttactgtgtgacaatcagtggacaagtccaatctgatcagagaagaagccctccggggaccactggccagacagtacagcgccctttgatcaggcgacagacacagatgcttgaagacggtgaagccgagttcagtgggcgaaacgaacggcgtgggcggcacaccgtcgcacaagtgcccaagagcgtctccacccaaagagcggtcgngaaaacggaggacagcaattgcagacccatc

SEQ ID NO: 19832 - DNA, 1056 bp, Heterodera glycines
attcaccgccgacatccgacagtgtccacagtgccgtctctgtccatgccaatccgaaattgcttcgtccattgtccaaaattgttcgggccggccctcgcaatgttccgtcatcagccaaatccaccaagtggacggaagtcctctcccacgactgaacaaatcaaatgtcgaagaagtcccattccgtggtgtccaccatgtacgggcggttccattggatccagaccaaccaacggccattcggactcactcttggcgacgcgtaaaaatcggcaccttcactctaaaggagttcattggcatttgaatgagtgccatcggcccttcgtccgttggcattttgccattctctcatcctttccttaccacgacttcgctgtgtccgtcccgcacattcactcgcaccaatttgttcgtcggttccgcactttcgtccttcttcgagtgaatctcttgcaccgcgtagacgaagtcaccgtgcgcggcaatgtccgcatggcgcagcaaagtgccgtccacgtccggcatttcgctttgaatgatcggcttgggaaccgcgccgggggcggacaacagccaaatgccgccggaatggcacaccaaaggactcccgccattggcactgtgccattgcacgcacagagaagcgccgccgtattcgtggacacttgaaaaggtcaaaaatgatggcaaaggattcaccagctttattttcccttaatcgctgccatttcccacctattcgtcacggaaatgtccggctgagtccattatcttccaacggcaaattgtccgcatcatccaatggcgaagcgtccgcgtcttccaacggcgatttttcgttgccaaccttcttgtcagagtccagcgaagagtccgcacttttttggggaattcagatgatgacatagcaaacagacaatgggatggatgtccgcggggcgacacctgcaaatggcaaaacgccaaaggcatcaggggcgtatctagaaacatttttcgggggggggggggggagacccgacctgaagaccttttttttttgctatttaa

SEQ ID NO: 19833 - DNA, 1225 bp, Heterodera glycines
  misc_feature (25)..(25): n is a, c, g, or t
aatttttgcgtttcgaattcatttntggaattaagaaaaataaaaattgataatcatttgatcatttttagcgcactttaagcaccgccgttaggcagcgcagttccaaaatttattccatgccacagatattatgggcaggacacgccaagtacctcaaacttgggtaattaaaccgaagaaagaagtgcagtggggaagaatgacgcccaaaatgaaggaaatattcgatgctgtgcgaactctttgtgacccctctctgactctgccaatgcagcagttgaccatttttaccactatttttctctcactcatcgtctgctcgtctctcctttattataagctattttcctaagccaacgcccttttctccctcttttctgttagtcatttctcattggtgttgacgatccaacattcagtgtacaaatttgttaaacctctcaacattttaaatcaaaatcctaataaaaatttcgttgaatttcttcgcctcttatttgtgcaaaattttcgaaaaagtaattttctatttaaaattaaaaaattcagaagcaaattcaagaattttttttatttttaaatgcattttttaccacatgaattatgattaaatttttgcgtttcgaattcattttggaattaagaaaaataaaaattgataatcatttgatcatttttagcgcactttaagcaccgccgttaggcagcgcagttccaaaatttattccatgccacagatattatgggcaggacacgccaagtacctcaaacttgggtaattaaaccgaagaaagaagtgcagtggggaagaatgacgcccaaaatgaaggaaatattcgatgctgtgcgaactctttgtgacccctctctgactctgccaatgcagcagttgaccatttttaccactatttttctctcactcatcgtctgctcgtctctcctttattataagctattttcctaagccaacgcccttttctccctcttttctgttagtcatttctcattggtgttgacgatccaacattcagtgtacaaatttgttaaacctctcaacattttaaatcaaaatcctaataaaaatttcgttgaatttcttcgcctcttatttgtgcaaattttcgaaaaagtaattttctatttaaaattaaaaaatcagaagcaaattcaagaattttttatttttaatgcatttttacacatgaaatatgattaaattttt

SEQ ID NO: 19834 - DNA, 2909 bp, Heterodera glycines
  misc_feature (2023)..(2023): n is a, c, g, or t
aaaatttctattttttcccggaaatagaaaaaattcttggcctgagcgggacatttgagtcccgggcccataactcgtcaggggatggttttatcaaaaaaacgccttagggcataattgtagagctttttaagctctatcgaatggtgtgccatatggccggaaactttcaaaatttttcgagctaggccccctagaaattttcggaaattttttttcggacgaaaatgggggtgaaaaatatttttctggggtaaaataaggtgctgagtacgaatatgatgtctattttaagtttcataatttttggaatattttaaaaattctttattttttggcaattttttggccctcgggattttggcctaatatttgaaaattcataacaaatcgaagggtggatcaattttcgtgcaactatattattaaaatagagaaagatcaggagagtatacatagggctatcaaatgatatcatcaatgttggatttggatgccaaagaaaaaaagttatagtccaaaaacatgtgttcgtacgaaaacggcctggcccctaactttccatatacaaatcgtagaaccaccattccaaaagcaattcggtagcaaattctgtgctctttccagtgagcttgtccattttctctagaaaaaattttccagccccatagggatttcgaaaattccccgattttcagtgtattttgggtgtcccggtcactaggaaggagtgatctgatcaagttggtgtaagagacttttttgatcagcaccaaaagttgtgcgagcatgaattatttcaagtttttaaatgaactataagatagtttttcaggtttgagtcaagacttttttggggcactgtatttctctcacaaaaatgtaatttgtttgggaaatatttaaataataaatttatataataattatggtcagcaaataaaattaataaattaaaatagttatattattaattaattaaaatcattattcggtactgaaatgacccgccccttctgatcccccctcacccatacttttgacacttcgcccacacccataccaaaagtattcaaaatctgttttcatgaaaatatcaattagagcttccataaaaccccaatttcttgtaggcgtcaatttatttgttagaggaaataaataaataaatgcaagatttcaaaggttttttcaaattaatttttttaaattattaagaaaaataattatgagttcccagtttttaggggtacattaaaaaaaattcggtcggttcttatggtgtgttttttcgtagttattgcatatattcatagaagaaaaagcatatgtctcgaaatccgcactaatgatgatattgtttcatttatttatactatttacacctttgcctgttatgaaaacaattttaaaaactttaattaagcaaaactatttttgaaattagcttttgatgaataagatattataaattcacgtgaaagcaattttttaaataaaattttcattttattttgttgccttttacacataaaaaatggccattcacaaaaaggaaacaaaaaatgccggaaataaatttgcgcacaaaaaaatattacgtacagacaaattattttcattgattgatatggattatattaatgtatatttcatttatgtttttataaattaatattttttctaatatatttccccataaaatgcttttatttaaaattatgctaataaacaaatgcattattacggtttttatcattgtcataatattaatgactcaaaatgttgcggggggacaaaagaataaaaataaggcaaaaacagcgcaaaaaaataaatataattttgataataaaaataataatggaaataatcataaagagaatgggaagggacaaacggaattggaagaaaaggagcaaaaaaacagagaatgcccagaaaaagtgacgaacaaagaatggctaatcaaaggtttgaaatttcaaaaagatgaattaatttaaaatttaaaatttttaanaatgaaaaatacggtaaacaattcgaaattctattgtaagtgattaaaaattgaaacaattttagattattccaacaatgaaaatgaggagttggcagaaatgctcatgacctttttgaagggtgttgctttgaatggctttatctcatcagattttgaacggacttttagaataaattcgacaatttgctttttgaaaagatttattcaagaaatgatcaatttggagtctagccaaaacagaaaaatcagcaaagaaaataccaaattgatcaacaattactgggcagttatggtgaaaaaagagacggaggacgaaaaaagggaacaaatctgtaaactgtggcaatttggggcgcaaatgtaccgaaatttggcacaaattatggcacaaaatgaaatttttgagaaattttcattcgaaaatcgaattgataaaatatttggcgaggttattttcgcaatttatttttattatcatctttttgaattaattatttttctataaaatttagttaaataattcttatgaaaatgactgtggcacggccgggcaaaaacagcaaatattcaacagattatgcgaacccgatttaattttcattatcaatggtctaaatttggcaaaacttctggaaattaacgaaaatttgcgttactttttctgccacgaaattgaaatgggaaacgcaaaaatgtttttgggtaatttcatcgaagacgaagcgatgacgaggctggatgaccaattcccacaaataatgcgactaggcatggattttaatttaaaaaaagggataggtaaatcaaatgggtcccacccaataagctccaattaacccacaaaaaagtaaaaacttagagacgctgtcttccttttctcact

SEQ ID NO: 19835 - DNA, 1747 bp, Heterodera glycines
  misc_feature (196)..(196): n is a, c, g, or t
gagcttccaaaacaaggtccattctcggggttcccccgagaaattgggcaatgttatcggcggaagcgtcacatcatgacgctgatgcaccactggtgcctgctgcacaacttgtgctggctgatttggctggggaattgcatcccccaagctccgagaggcctaaagctccttcaatggtgtcgacaagccctcngggcttggtcgacccccaatgcatgaaggccttgccttctggtttgaagtctctgtaattttgctcttcatcttgaagagcttgtcccttcactctcaggaaaatggcttcccattttccgttgtatttctccaaaagagaaattgttttgcagagattttgtctctccgcgattagatctgcacggacactttggtccgccagctctttgcccaagttttcttgggctgtctcaatgtacatcttgagacgcaccaccattggtgcaatggagatgcgcaagagctcactcattgctcttacgcttaatgaaaacacaataaacccctttgggttgtgtgtttgatccaagcgctaaggccgcgctttggattggtttggttggagggtaggcttacgactggaagccgacccctacggggctccaattttgtgggcaaaaggccacaaaaatttgcacttcccggcagaaggggaagcagactctcccggcagaaggggggagtcttttaagcaaagcgaatttctgtccaaaagacagaaattcactgaatgtccaaagggacaaattaaaggaggaaattcctctcctttaaacgaagggacaatttggaaggagaaatccttctcctttcctttgataagccttttgtgacccaacgggggtcaacggcttaatggtctgtattaaagggctcctgggtgtcccttttacagaaaatgataagactaagactctttcttaatctttattcaattcaattgcacaattacaatttaatgcaaatgcttggacagaaaactgtcccgacttaatgctgatcaagcagaagtgcttgtagaaatctcacaagatgaagtgaatcaagaagtgagaagtaagaagcaagaagcaagaagtgaggaaaatggagaatgggccgggcttttataccctcacaaatcaatgggggcggggccaggcacgtgaaaaatgtgcacaaacaaatggaaaaaaatccataaaaatatgaggaagagagaagatgactcataattaacgagcgagcgaatgcaaaattgatcgatgaaaaggattaaaaaataaatgaaaatttccaagaaatttgtgtcgcttttggcgacacagtgtcgcatattcatttgtcacatattccgcttcacgaagtttcgcctaaccttacaaattagtctcgacttaagaaatgtttcagtcattggttttggtttcaagttattgtctcggtctggcttctcatgatctttgatcaaagaatggaatttttgataaaccatagcccagttcggcggcttttttacttgttaatttaaaataatatttcctaaataagaaattttcccacctcaaaattctaaaaattaagggttttttgattttttacatttttgtctctgacagaaaatgttcttttcgcacgaaaattgctgcctgaaatgccaatattctgctgcaaaatgccctgatagcaaatccaaagcctaaaatttgttaaattttttaatttctcaaattttttatccacccgtcgt

SEQ ID NO: 19836 - DNA, 2062 bp, Heterodera glycines
ccattccctcccttttcgccttcgatgggccaccgaccgcgtggcattggcatttgaccatttcgttttaaaaattcaatgtgtttggatgaagacagaatttgcacgtcaaataaatattgcacagaaagtacggataataattaatgccctcgggggttgtttaaaaatttcattaaatttcagaaacaattgctgataattgccaagagggaactgtcgaaagtgaccaagaaattgttggatgatgaactgtcactcatatccgcgtccattggatgtagcttttacgttggctctaatcacggagtcacgggaacggactttctcggcctgacgtctctggaagtgttcaacaaaaaattggaaaaagtccttgccgaacgtgtcgattacgaagacccaaatgagattgaacgcgcggtgagaagtgagttttggcatattctttaacaaattgcgttcaaattttactggatcatcataaccccatcaattctctctctctctctttccatttcccaactaatattataaagttgcgaccccgacttcggggttggaaaagtcggggtttggggagaaaattccccgactaaatttgtcggggtggcaggagaaatctaaaaaatgtcgggggcaaaattttcataaaaagtcggaaaaagataaagaaaaatttccagaacaaaaatgtcttaaaaactcatttaaggacttttccattttatttgaagtgcaattgacgactttcgtaaaaccccgacatttcgggggcccaaccctagattaaagtgaaacgaaaaaaagtcgaattttaaataaactgacattcgataaacagtgaaatttatgagaaaattttcgataaatttacctccttcgccaattgccactggccatttttatctcttctgtataaagacaaaattttgcaacaaaaattgaattaaattaatgataattattttaattttcaaattccagttcttgtctgtcaagtcaatattgggattggttttctcgacattcggactgagacggattttgtcaatggacctgagcatatttttttacattatccgtcgtttttgtatcttccattttcaatctacaaaaaattcacaagattataattatctgaacacccgaactatataaaacaatatgaaattctgaaatgttcagttttatctagggttgcgaccccgaaccctgactttaacttttgagtgtactgtatgcttcgcaaactgtatgtaaatcactaacatttaaataatgataatacttttacgaaaagtttgatatgttttaatttgcaatgtcattgtttttgttttatcacaataaatgattgggatttctatgcatttgcttttgagtcaacggatggataattcacacaaacggcaaaattaatcaaatttttgtagaattaataatgtcgtgaatagggatgtcaattttatgtaaatacatatttttttcctggcttctccatgctctaaatagtaggaaaaacactttcttttttatgtttgcaaacaaaaatcgggacttttatttacatatttttacatatttcgggattttatacatatttggtacatattttggactttttcttacatattttgattttttttagataatttgcgggttttttacggaaatttttggaaatcctcaaaaaaaaatccaaaattttggcaaattttttattttttatacatattttgagaatttttgaaaatttttagaaatttctagtgaaaaaatttaaaaaaaaaaacttttttaaatgtacccctccaaaaataatttttttaaatgttacaaggtgattctaaacatatttaggtcatttttatgccattttacgcctatttaacactttacgaagaaggttttcccaaaaaataaccatttaaaaaaattttatttacatattttcgtacatattttgggtttttatacatatttcttacatatttggggatttttttacatatttatgtacatattttgaccaatttttgtacatatttttgacatccct

SEQ ID NO: 19837 - DNA, 2497 bp, Heterodera glycines
  misc_feature (58)..(58): n is a, c, g, or t
  misc_feature (61)..(61): n is a, c, g, or t
  misc_feature (65)..(65): n is a, c, g, or t
  misc_feature (70)..(70): n is a, c, g, or t
  misc_feature (75)..(75): n is a, c, g, or t
agtgtcaatgcctattggcgaattgtgccaaaaacatctccttctaagccacaaatgncgntggntttgntgttnaaatttgtgcacatcggcaccaaacggaggcgacgaatgagctcattgttgaatcgttcatcaacttttcgttcactaatgagccgtttgctaattaaataataattattcttataaattttattaattaaggttccaaaaaacgcaaaatttgccgatttcaatggacaaaatttgggacacaaaaaataaaatgccatattttctcatcgaatttggccaaaacgagcaaaaaagtgcaatccgagaaaagggcgacggagaaaattttggtggcaaatggaacaatgaggcaaaaagtaatgttaattaattttaatggcatgccatttagaatgatggcatcggctccattctcaaagacattgcgccgcaaatggtcaacggcactttggcaaaaatgattcattttgtgccaccatcgaatgatgacaaaatgctcccatttttccaaattgaaaaacccaaatattcaaaattcataaccaaccgtacaaaattgttaccctaccaagatgatccgaacaaattcagtcagtaaaaataaatttaattttttaaaaattaattttggcactttttaagacagacctgacccatgtgatgaatacggcgcagattgcgtgccgatcagaaatttgttgttgaaaattgaggaattggaaaactgtggaaagaacgaaagcgaaaacgatgcggtaaaataaaaataaaaatttaaaaatatatttaaaaattattttagatgttcgaaatgccagaatgggccccaccacttccgccaccgatgaccatgaaaaagccatccgaaacattaatatgtgaaggggatttgttttgtgacaaacaaacgctgcgagaacagtacaaccgattgagggagagtgagttaaatttaaaaattcaattaattaatttaaaattaaaaataaataaaattaaaaaatcgaaaattaaaattcacagtttgtggaatgaagcccgaagaggtggaaagtcagcgcgaaaaacgacaatacaacccatacgaaaaatggaccgaatcaccgatcaaaatcgcattcgacgaaagagctcgtaataattaattttaccattatagttgtagtttaacagatgttttaagtgcctgattattagggctataattttgcatattttttctacgcatatgctatgtatgaagaaaggagctcaaaatagaattttacattaaaatttttggtttggtgaaggtttttagtgcatataaaagcatatttcggtcatttttggcaaattttcataagaaaaatgcaataaaaacgaaaaatacacccctaatttgtaaggatcgactttttgggaattaaaaaaatacacccttgaaaatcgaaaaaaaatttttgtaagaaattttggaaaaaaaattttgatacaaaagacaaaaaaataataattttgtctgacaatggaacattccgaactgtaaccactcagatcacttaaaaaccacttctatcctgtagagcatggtcgatttactattgccaattttcggcttttttggctacggcgccaaaaatgatcaaaaaaaaaaatcgatcaaactttcgaaagaccgataaaaatgacccaatttttaaaaattcataaaaaattttgaaaaaatgctagaaccatatacttcttttaataatgatcagcaaacaattctctatcaaatagcatcataaaacaaatttaaataactgcataaaaacatgctaggtggagtaagactttgataaaaattcaaaaaaattcatcatctgtcgagcgaatccgaacccacgacgggtcggggtcgttttggcgccgacgttttagcgccagcgagagttttttgattataacttttgttattgttaaccaaatttacatttcttgttatgattctaaagcttaacacgataacaggctataccccattcataaattcgtcaattaaaataataataagcttgtactaccatactaatcagaatttttagaatgtgtgctgatatatgccatactgctgtgaaaaattgttataactccattcagagaagagatagaaaaaaaaaaataaaaataggtttagagagcccatgaacagctgaatcggatgcaagtaccgccgttgctgtacgcctaacagttggtgagcaatgacggaaaattgcttaaaaaagaaaccaaacaaactcatcaattgtttgctcccgttgacaaaccgaagggtacattggggcaatggatgttgggctaccgtatcagttattaaaatttttgtttttcaaaaaggatactaaaactgggataaccccattcagagacaagtcaaaaaaaataataataggcttggactaccatactaattagaatttttagaatgtgtctgttaaatgcaaaactgttg

SEQ ID NO: 19838 - DNA, 2290 bp, Heterodera glycines
  misc_feature (2098)..(2098): n is a, c, g, or t
  misc_feature (2228)..(2228): n is a, c, g, or t
ttcaattttacaaaaattaaaaatgcaaataccattttaacattagtcaaaaatgttttcatgaacccaacaaataaggcggaatgcaaaattcccacgtgttggcattgccaatgcaattgacccgccgtaaaatggcagaatgtcaaggtttctcatagacaccggcacggacaattttttgttttcctcaaaacagtctcaatggcaaaaccaactctgtttttttttaataaataaatttaaattatttttggcatttttttatattttttacaatataaagaaacattttttgaaattattttgactttattttaaaattttaaaataattaaaaaacaatttaacataaatttaaaaatcttaatcaatgaatattgattaaataaatacagttgttttttatttcttccaaatagcattgaaattttttctctaaatttccttataatatttaaataaataaatattttcccgcgattttttttgtatattttatttttgccaaaaaattcttcacttttttttttgcccaactcatcatgagatgatacaccacatcccgaacaaaacttgtacattttttgttgtgcatgtatgtatgtgttttgttgttttcttgctgctgccaatcatccacatggttaccacccatttggccacaaccatctgcccaaaccccgaaattcccccgaggggattttcgctttcggcggcaaaccattcctttggcaaaagccccccaccctccttccatttagtccccaaaaatcgggaagaagatgaagccttggctgggggggggagtggagaagtcgaaaaaggccccacgggtttgccgatgggatgaataattcagtgtccccatcccttggcccctcaacaagtacttcaaaatgtttatatgctttgcacagttgaggagcgtataatatgtcactgtaatttgaactaatatttttttgatataattaattaggctttttgaatgttaattaatgttggaaatatttaaataaatatttttaagtttttatttaaatattaagttaaatagtttaatttttcaacattaaattaggcttttttaagtatgtaaataaagtataaaatatttttgagttttcaaaattcattaaataattttatttttcaacattattatgcttttccaatattaattaatgctatgaataatcaaataaatatttttgaattttcattaaatattcgttatttgatccttaaaaattaaaggataatctataagtaaatttacaatatttttaataaaattttattctggtaaaaattaaatttttatcaatataattaatagtaaaattttttaaataaataaaaattcttaaattgaaaaaatattccattttaaattatagcacatgacatgcccttgcttatttatccttgtctgaaatccgttaattccccaattattattattattattgtaattattactcaaatgtgccgagctcttatcctttcggggtcccctgattcatttgccaggttataatgaatatttacaaatttgaaaataaaccgttccaatttttaaaatatgcattttaggtacccaaaatgggcacaaaccttcgaaaatgaacttagttttgaattcaaaacgcgcatgcccaatgcattactgctgtatacagatgatggcaagtttaaatgataaaacaaacagaaatttatacaataatttttgataaatatttttatcaatttttaataaataaactttatttgcaaagttcgtttaattttcaaaaagccttataaagttaaaaaatatataagaaaaaaattggaaaattttgtagtgaaaatgaaattttcttatttaaatgttctaagatttttttgaaaattggaatatttttcaaaaaattttaatgatattttgttattaaaaaatgttctgatattttttttttgcacatttttaagttggaatttttttaattttcatttttcaaaaaattggggtgaaaaactgaaaatttggcaaggatacaatttttcccaactgatttttttccactattttcaccagcccctctaatgnggtgacacaaaaaaaaatatttcaaaaataaaaattaatttttaaattttcttctatctcaggcactgttcaacaaaattttttcacaatttcattgcttgacgggcatatccaagtcgaatttcgtctnggcgagcagcagttccgaatgccgggacgacgtccggttatccaaatcggatttgtcaatgc

SEQ ID NO: 19839 - DNA, 1030 bp, Heterodera glycines
atattaatattaaaaatcagtacataaaaagtgttacaaaatgtcaattcttttttattacaaaattttcatgcggaaagattgaattgaaggttggcccgaaattcgcatcaattgtatcatcggagtcacgcaaagaaacgcatggaaaaagcaaaatggaagaacagaaggctaatttggcggtgtctgaatttttatataaaaattacttcactatgataattaaataatcccaatcagtctaattggcttaatcaattggtaagtgatttgtctgtttaatttacaattattccaacccaatcgttggccatttttcgtgaaaataaagcgccgagtggtcaaacaaatgccacatccgatgacatcatctcgcgaaaatgctgggagcatattccctctataggaagcattggtccaaaaatatccatctcctgtataggaaaagctgcccggaaagccaccaacaaaacaatccaatggcatttctttgggggcgaatccgatggcgacacggcttaaaagttggggcgtaattaaatgggcattcaaaattaataattatttcgtttcaatttaccttttgacgcttaaaatcgtaacttcgtaataaaaaaatccgcaattgccattcaaaatgggaaattctgcgaaggccgagagatattctgaagaaaaggcacaaaaaattattaaattccaaatgaatctcaaaataaattttaattttataaattaattgtgtttttactgtttccatctgcggctgctttataagtgatcgtttcgcagttgggcccactgatttccaattctttgtgacacgctttgacgtcccaacaattcggcggcggcggtgggggcgacggatttggggggatcggcgatgacgtcaattcacttttctggagcaaaagatgggcgactgaaatgaaaataaaacggtaaataaattgttaaatgcttttttagtcgattcattccttataaaaaacattaatttttaaaatttctttacaaattcatt

SEQ ID NO: 19840 - DNA, 823 bp, Heterodera glycines
tttcgaacgagtccaataatgttccatttgctggacaaagaaaaaagttatagccagaaacgtgctggcgcccaactgagcgagtccgtctcttcgtaccccccccctaacaaataagggactgttaagcttataaattaggcatagcattggttgcattttaaattgatatatacccaagtgtcgaataaagcaaaacataaaaatattcaaatttaatttatttttccacaattttgctgacccttttctgctcaatggatgacgatgattcgttgttgccaacattttgtgggtggtcagcagccgaaaaagcgaatgggtcattagtttctgaaatataaaaaaagtgaaaaaattttcataaattatgtaatattttttaattttctaccttttccattttgtaccaaatttgtgtgaacatttgaaagtgacatgttttgataaatattaaaataacaattaaacaataaatattaataatctaatttaattggtagaatgtaaaaggggattgttgtgttatcatagaaaagacaaatatttgtagaaattaaatgattgtgtagaggtggagggaggggggggggataattccttttgggaaaacacataaataaaaggagtaattaactggttaatattagagtacggaaatttcacatgtgcaatcccgcagcgggattgaaattcaaaatttttgcaggacggaatgccgtcgaagacacttggggctatccatgcaaaagaactaaaaatttggttgctttcgagcaaagttatatccaaaaatattctgatttgtgattttttgagtaca

SEQ ID NO: 19841 - DNA, 2902 bp, Heterodera glycines
  misc_feature (2522)..(2522): n is a, c, g, or t
  misc_feature (2833)..(2833): n is a, c, g, or t
  misc_feature (2839)..(2839): n is a, c, g, or t
agaacttcaaagggtggctgtgattcgccgacgccggcggttgtccctgtgaaaactgcaaaggtggaaatcttaaagaaatgaggaggagggagggtaccatccgtaccataaccgagtggggttttttaaattttctacttaaaaatttttcacattttttaaaattaattttcatttttcagcacttataaagtgcaaatccgctaagggaagtgaggaagggatgattgaaggaagtgaatatcagtgctatgatgattcaaaatgcggtgccattttctgttcagccgataaaaatgaatttcgaagaatttttttattaactttcgggaaaaatgggggccaaccgaagaaaaaaaaaactagacgattgagtcgaatgggtaacgccaaatgggcgccaaatggaaaaatctttcgttttttagattcttatttattttttttttttcgcatttttcgctcatttttaggcaatattttggggaacgaatggagttgctacattggttactacggtgaacaatactatatcggactcagaacggtcgaatttaaattgcggccccgtgccaacaatgattagtggaagtgcacagtccactttggagcgatcggtgtgaacatgagcaatgcattgtttgtgccgccgttggtcaaaagtgtgtaaacagtagaggtgtgccgtgactgaaaaaacccgtgaaccgtgaccgtaaattggtcccgtaaatcatgaccgtgaccgtgatccaaaaaacccgtgaattcacggtaaccgtgaccgtgaccgtgaattttttgagtttattttttctcggtcggtaaattttttgctttttacaccgtctttttttctggtatgattttacaaaaaaaaaatttaaaaaagggggtccaggggagctgatagacgctgccgcaaaaaattttgaaaattagactctaattgtgcgcaatttttgtccaaaaaatgaccaaattttgcgaatttgagccaattttttatgaaataatatgttttgggggcccggcggtgccgatatgcgccgccgggggtaaaatttaaaatttgagtgcggcacacctctagtaaacagcgtggaaaattataaaattaaataaattatttaattaattgtctaatgagcttttaattggataaatctgacaaggatgagtctattttaaaaaatgtgcgagagtttagcataattttgaaactcaatttaagcatttttggaggaaaatgggcccctttttaagcagtttttttaacctttttagatgtttttttgtgcaaaaacctaaaaaaaaattttctgaaggaattgaatttgttgaaactgtaaaaaaataacaaaaaagaattttaggggttttttctataaaaccctataataaagtgagaaactaaaaaatttcagttttaaaaaaatatttcgggggaaaacaatggctggagggggtgagctgctccctaataaaagtattatttcatccgatttgaaaaatgtctaacaatgatcagggggtgataaaaacgatttgacactttatttaaaatttaattaattcactcatcacagcaatgaagtgcaaaaaagccaagcaaagtgaggaagggatgctggtaaaagataatgaggaacaaatcagcagcagcaacatttgctacagttacaatggaaaatgcggcgtcattttctgttcagcggaaaatggtacaataaataaatttatttaatttatattttagtcggaaagcgaaaaaacggtggaaatttactcgcaattaaagcacaaaaattgggcactcatcgattaaaaacgtggcttttgtgaaaaagtgttaaattttcttaattatgccaaaaaattaaaataaaaaatataccaaaaaaaatatttccaaattggcgacgccaaaacggttcgtcaggctggaatgtccccgaccgaaggttccaattaaaaaaaggattggaattgggagggaggtcagtcagctaatgccagtgttgaatttttataaagttttataagaaacccgtccagaattggtcaattgagttttttgaaacgtttaagagctttaaaaaaatctcaaaattacaaaaaattcgtaaaaattacacattactgtaattggcttattgagatttttaaattattaaaattaaattgttattttttaatttgttgtttaattgtagaatgcgaatgcgcgggcattcgcaacagtgttgaaagtgcattgatgatgatgatgatcgggctgatcactagtataaattaatattttttaaattaaattataaataattgtcttttttaatgctttttggcgctgttcaatgccaccaatttggatcagcttaatccgacactgaactgaagtggacgattaagaaatgaattgaatttgtgcaaaagacgctaagaaaagaggaaacccttcagcctcaattcgatcagttgaacagtttatgactatgatcagagatggacaaaattanaacatttactttttaaattttaaattgtgttaaaatcttaaatttcttcaaaagttagccgaaatttaccattcaaagaaaaaaatataagtgattttattactttaaatccattgcaaaattaaagaacagggctcctatttgtccttggatgctaaggacgtccttggatttggctttgggttttggaaagttgaaagtgtccttggttccaaggatgtcgttggaaatctgcattagaaaaaaaaatcaaaaacaatatttttgaattttataccaatattttgattatattatggcattatgtcatncacttntgtaaataatagtattttctaatggtagcttttggataggtttctaattccaaatctgaccta

SEQ ID NO: 19842 - DNA, 2106 bp, Heterodera glycines
atttttaacccttttcataggaaatgtttattattttcctattaaatgattaattaataataaatgacataaaataaaataatttcctgactggacagggggaaatggtcaatgaatttcaaaggcttctatttggaccacttttggtatttatcctacaaaatccggcccacatttaacgggcgggggagggcggagggagtagggacatagcctcaatccactgaaatgaaaaaatatttcaggcaatgtgaaaatttaatgtggtgcttgctgaccctcctcttattagtgaaatgcaaaaaaaaagaagtgtaatggcataatgttagactgggcttccagctgaaaattttcaaatctatcattttgcatgccgaaaagcttaattccggttcaaagaattttatcaagagtttaacaattgcattttaaatagttcaaaaattaaaaaaaatatatttacaaagaaaaacttatcaaacaaacaaaacgcaaaattacatttaaatcaaacagttgaaatcaatgttaacgaatttctcataaataaaggcaattacatttggatccaccacatgtgctcttgtggcgcaatcggttagcgcgttcggctgttaaccgaaaggttggtggttcgaatccacccaggagcggtttactttttatttcttttttaatcgacgtttaaggaaaacggagagggattttacattttaaatcattaaaaggaaaaaaatctatttattatgcatatcaaaactaatcatttttgaggagaattaatttttaagacggcttaaatcagtgcttatgacggtggaaacgatttttcgagtacacattttaaatagtcaagaaaagcaccaaaaattacaaaacggtgacacaaaagtccgaaaaagtaaagaaacaggtgacaaaattgtgagccaaaagcactcaaaaatataatttacagagaaataacaaatgaaaaattagcgagttttaatgttctcaattttcttaaaagaaaacttttttgaaagattctacgaaatttttttcatagatttccaaattctctcttccgccggaattaaaaattgattttttgaaaaggattttttccttttatagaaaaatgccaaaaaatgagtgtttggtttcgtataatttccttcgaaagtcgcaaaaaatagttgaatcatcaaaaaggccatcccaatcttaatattttaaacgctatgaaattccgactgttttgaaaatttcacgttcaaatctcaaaagaaggatttatctttgaaattttagaagctttgcccctgtgccaacgtattttgctgcaaaatttcagttcctttgcgatgttttgccctgctgaatcaattctaatgaagcaacaatttttgcattttttgataacaaatatttatttctgaaatcataatgcattaattgacttgcattctataataagaataattaaaaataatatttgtaatgaattacatttacaatattttcctcttaactttttaaataaaattagataaaattctgcttacaaaggaaggtccccaggtgtccgtgggatttccgaatgaaactttgtgggtgcatagagcacccatgggttcttaagaaaaatggtttcaatttctgccaaataagtacgagtgccgagttatgacgtgccaaactttttttatcccaataaattgaataatctattgcactgttttgtgctgtttagtggtgcagaggttgtgctctcacctttactttttccccccacaagttcgaatccctcttaagtaaattaatttttttttaattttgcccttgaatacccttttagaaatgtaattattttcattttttttttaatttaaaaattaaaatttaaatttatgcattttcgcacatgtgataatcatgaaaaaaatgagcaaagaataagaaaatctcacaataaccgcaacgaagtaaaatagtattttcacaatttattttttggcaagatctttatcttttggaacttcaaaaaaaaatttgaccggaagacaaaactctgaatgggaagccttgatcaaaggaaccggcttttctccccgaaaa

SEQ ID NO: 19843 - DNA, 2370 bp, Heterodera glycines
aaatttaaaaagccatattaatgcacttcagtatcatcctgtcctgaaaggcttcgaaaaaagaatttaattctcattttaaaatataactagattagtttaaaataaaaatatatattttgtgtcggcacactccaaatgacatggcaattcattagtccgttaattactcaccgcgtcattaagttcgcttccggcgctgaactggtccagcaactgtttgttcatcagttcgtacaggtaaagggcgctgatctggtggattatgtccgtgtacgtcttgtcgccctcgtcacattcgtattgcgccgccatttggtaaatttcctcccattccgtccccaattgtccgcgcactgagtccacaacacttttcagcatttccgcctcacttttgtttcgttcgctcactttgtccaattgttccagcagtttgccgtagcccattgaccacaaaagtgccgcaaagttttggcccatcagttcgaatatctgaaaaatagggccattttaaatattcccttttttcgctttacttcaaaattgctgttgtaaaatgactcttgcaaattttcaaagattcccaagaattcttcggtgatgattttgtcgagttcgtattgaattcttggcgacagactcaacccaatggttttctcgatgtttgcgagcccttaaaaatgtacataaaatgtgtgtgcttcgcaagactgggcgtaactggattttcaattaccgaaatccgtatatacgggagtccaaaaagccgtaatttaagtaattacgccctgccctggtgcccctcccatttccctccattcactgtctttccagcgcgcgctttgcgttttggcacttcgcgcattcgttgcccgcggcgtcgtgtcccctccgttcttccgctggttgtgccgttggctgttcatcgctttgtttgtcgttgtgtcgcatggcttttccctctgcttctctcccggcacccattctttggcatttgccaaccttagcagtgttttcaattcctccatctgttttttcagcaattctttgctgcttgacccatcagattccttcgactcttttttgagcaaaatctttcgcttccgcaaatgcattttgaattggtccaatgttagccatgggagaagcctcggcgcattttgcattgactcgaagcggcatttcccgtccaaaaaatccaaaatgccattagccgttggccttcgctcgggatcgtacaccaaaacggcctgaaacatgcaaaaaaacaagctcaatcatatagaaataaaatagctttaaaaaactaaaaaatatgtaaattaaacaataattactgtaacgatatgaaaaaggcgcggaaaatgcgctcggatgcttaggagcacggagaaattggcatagaattcgtcccaattcttttccattcgttcgtctatgtcatttgtattttgaatgtaaattcgccacaatacttcgatcactccgtaaacttttggcacctacaaacaaattataattaaaaataaaattttgatttaattaaatttaattattttaatagcttagtcataattccattttttgttttcgccttacaatttctttggcatccttctccggctcttcgtcgtgcgtccctttgaattccgtcccaattgccgccatttcgatggcgataatgccaatggcccaaatgtccgactttgagctcagttccatcgaatgttcattcattgggttgtatttccaattgcattggttgtaatgttcgggactcttgaggtaataaaaagcatttgccaaatcgaaaatgataaaagattaaccaatcgaatcaaaagcattttgaatggcaaattacgcaaattaaggaattggacggaccgatgggtgaatatttcatttaattatgcaaaattacgcataaaaataacaccaaatggcaaattatgcatgaaaaacttgggtatagaagcttcaaaccaagtcaaaaatgtattttcatactttccttatttgttagctcaaccaatgtaagcaaaatttttttaaacattttgagattatttagacacgaacgaatgctaacaaaaatatatccaagactaattagactcaaattaacttttaattgacccccaatgtcttcactttcccattgtgtcggctaatttattgagcattttcggcactgtcacttgcctggtaccattccgtggtcaacgggtcgttgctgacgaaccatttgcacgcgttcgcctgcttttccgtgctgttcagctgctccccgtactcgtcgatgaactgagaagcgccgaagtcgatgaaagcgatcagcgattgagtgccctcgcggacgaacaccaa

SEQ ID NO: 19844 - DNA, 2120 bp, Heterodera glycines
gatgcgactttggccacaaagcaagatgcgattattaggcagggggatgaaaaattgatgcggtgggaaaaattaaaatataggctcaactaaactccacagtgaacttaaattcgggactataatttcaggaaaaaggacgtaacattcgtgatcagcgaactagaacccccgaaggttgagacttaagattttttgttattattatttgggatactattttaaaaagttagataagatgcatttctctaattttaaaattttgttgactaatagtaagtataactaaatgatagcatgaatgcttattcaaagaaattatagtaaattgggctctcaagtgcctgggaggcagagagtttctaatttccaccatccacaaaattacaaaatgcgaatttaaataattttttcagaaacgaaatttaaaataagcacctgtttaaatatttagaaatgattgggaaaaaatgtagggtgcaatggaaaagatcaacaaaaaagttattttgaatcaaacaattattattattgtcaagaaaaccttaacacaaaaaaagggttgggtaatttcacaaaagaacggggatgatgggctactgtggggaggaaattttttttggtttttcttaatggaaaaataaattccaattaaatttttcagataatgttttaacctgcatattattaaataagttgtggaaataaaagattaaattatttaaaggaaaagaagcgaaagataaggattgtagatgtgtaggtaaaaaaaaagctttattgaagatatgatatagatgtatttgtagttaggggctgagctaaatttataactcaattaatccttcgtacaaacacgacgctctaaaggtctgagctatttaataataactcagattatcttagagaaataaaagacaaataaaatttaaaaataatttacctaattgggggtagtgcgctcccaaaaaacgtaaatgacaaaaagttaactttccgttcaaggtcgaaaatgacgaaaaaattaagtcgaattgtaaataatctatgaacaacaatctttaaacttttattttttaagcgaaaggtgttttttccaaggtaagaaacggataagaaagggccatgaaaaaaataaatggcaaaatgtctgaagaaaaaattctaaatatatttgttaagcatattttaaaatattaaatttctttatcaaaacaaaaaatattgttaggaaatgtttcagtttacagcaaaataaacaaaaaaaatttttgggaataaacacattaaaaacttttatattttgaaatgatacaaattcaaaaaaatgaataggttaaattttaattaaaacgtcattaaggaaaaacgaaagaaatatttggacgagaaaaattaattaacgattaaaaattaatcgctgtttaaaaaatttgcataactttacgcagaaggacagccaggatttggatgagaaaaattaattaacgattaaaaattagatggaaatttgagtagggcgggggggggtcaaatagtaaagctaatctgcagggagatgaaggttatcattgatagattttgttgtagaaataattaaattaaaaatctaagttgacaaggcacttaaattttaacatatttaatctttaaatatttttgagcattcattccgctgaagcgcggaaggagggaattgaaaattggaatcgattatgcgactcgggggaacggaaagtgagggaccaaagaaaggctgcaaaagagcggggagggagatattatcaacaaccaaatgcgtagctgtatattggcaaaaatgcactaaaattgggatctgtaatttgaacaacaacaaaaagcaacaattaatttatttgaatgagaaacccccctaaaaataaattagcagtatttaatttacggaaataatttgtcagaataaataaattcaattttaaaagtaaagggaattttggtgacaatttttttgtcataggtaatatttgcaaaaaaacgaaattttatggtaaagatgaaaaacctttaaaggggtacaaagaaaacatgaaaatattcaattttgtacatctttaatcaatttgcgcaatcgttgcaca

SEQ ID NO: 19845 - DNA, 2385 bp, Heterodera glycines
aaaggtggcaaagattagtaacgaggaaatggacgatgaagagggaaaattggcgcctgaatctgaattggactatgacgaactaaaccgaggggatttctacctaatcggaggcgtccatggtaagtttcgaacttttttgtgaattggtaaacatataaaatcttgaaagttgtgaaagactgaattactaaaaacatataaattcaattttagacccgatcagtcttcgttttgaagctgcgatccgtgaccaaaatgccgtcgaacataaaagtgccgaacgctactactggtacaaaatggcggaatgctttggcgacgaggaagccatgaagaacattctgcacgcgcagaatgtccaacaggccgaagaggccatgaaaaacatcaaaggcttcgacgttgccgaatgggacaaagtcagttggaatgagaaacattggtggaaaggaaaagggttttcaggtcaaacttaaacattgggaggacggacagcgactgaagcttgagcaagtccgttggatcgaaaatttgctggtgctgaccaaaaccacctacttggccattgcctctgaagacaaagtctcccctcccccatcggtccactttttactgtccatttttgcagtttttcggcactggatggcgcaagaatcgcgacgaggccaacaaaccgatcttttgggatgggaagaatgagggcgggaaagtgatgatgcacattcgccatgagctgaggccaaacactcatggactggtccacaggaggaagaggtccagcaaatgcacttctgccgtcttaatagtcaagaccatttccaggagtccaatacgaagttgcgcgagatgatgcggaacgtgtggcgccgcattgacccttcgaaacgtgccatgttcggcggtggccgttcggccggggtgccttcgcacggcggaggggcgcgtggcgggcgcggcggtggaaactttcattatcgcaaccattagacgaaacatttggcattccaaagaagagctttttattattggacattttcacattattcaacgaaaggatgagccaattttcaccacattatgttattttctggtcaaagactgactgttcaaaacgaaaactgttgaataaactgtgccaggggtttggtcaactgtctgggctaattgaattcgtttaaaaggatcaatttttcaattgatttgtccatctcagggtattagaaattatataaaattcggatatattttttctcccccgttttgtcttcagttttccgtgattctgttgctattgcttagataaaaaatggcgcccatttctccagttggcggcattctgctgaacatttccattgctcccatccctcggctttccgttgtgccgtcatttgttctctccgtcggtgccattttcatcgcttttgtgcaaaagccgtgccgaatgacgccagtgccattttctccgcttcccgcgatcctttcgatgtctgtcggtgcttttctctccaacatttcttctcccgatgggcacgtcctttgcaactgtgccattgtccctttgagcaatgcttctccgaaaatgtcgtcattttgttgcgattgtttcatcgtcctaactgaaccaatgaattgggagggaaaggaaaggccaccaaaattattttcagcgaatcctttcctctatctcaaattgcgccgttgtaagatatttcattgatcacttttcatcctttctctaattggtcagtccttttccgaatcactcttacctaattgacctgtttccttaattcccctttccctaattgacttctttccccaagtgatccgtccatttccctcccctccctaattgtccaattccctctcactttgtgcctctgccgttgtgttattgctgttgcttgtccccccacccgcttctccgtttgtctctgtcctgctgttgttgttgtggttgtgctgttgttgttgctgcatcgcttgcattgccgcggctgccaaagttgcggccgcggcggaactgtccaacggattggccattaaatgctgcgcgttccctcctccgctgccacaaagcgttggttgctgctgctgattcgttttggcacttacgctggcagcgattggggcggaagggcccccagcgccgacgccattccgacagtggcggaactgatttctgtcccggaaacggtgaaacaaaaacaattttattaacatcatatcccggtttgctctggagtccgtccgccctccccttctgctgcctctcataatttacccctgtgctcatgagcagtcactgatcacttccacttgtgattaatcccttccctcaaaggccccgttgatcactccccttctgatcgttccccttct

SEQ ID NO: 19846 - DNA, 1860 bp, Heterodera glycines
atggaaaaggaagccgtcacattatttcactgctgcgcctccccgttggctggcaccaatttttttggttggcacgggcgcaaaatgccgcttttgaaatatgattgggaaaaactgaccattaaatcacataataacacaacaatacctgtcaccccataccaattacattacgaaacatttttcaccattttcacctgttttgacatattttttcatatgtttcacacctgttatggaatattttgcacctcttttcaccacttattcctggacatttcacatatttccttggttttcacctcttttcaccaggacatttcacctatttcctattgttttcacctcttttcaccgcctatcacgggacgtttcccctatttcctattgttttcacctcttttcaacacttatcatgtggtattccacatgttgcatattatttttcacctgttctgcccttttttcaccggctatgacaatatttttcacctgttctgccttttcatctgctatgacaatatttttcacctgttctgcctttttcatctgctatgacaatatttttcacctgttctgccctttttatctgctatgacaatatttttcacctgttctgtccttttttcatctgctatgacaatatttttcacctgttccgcccttttttcatctgctatgacaatatttttcacctgttctgcccttttttcatctactatgacaatatttttcacctgttccgcccttttttcatctgctatgacaatatgtttcacctgttctgcccttttttcatctgctatgaaaaatattacggctaacaggagtgggccttcactttagaccgttccacccccgctagtcataatatcactttaattatttattcaactttatttaacaaaaaaaacacaataaaatacaaaaaaattaacaaaatccaaatggcatcacattaagttcttcatcgattatccccttctggcagaccggcttgtacattttgtgcttctccctcgtcaccagttttgaatccctcgtcggcctaaatattggtattaattttggaaatattttttaaaaactaacccaaaatcattcttgtagacaaagaaagccgggtccacctccccttttccataattcagaaccatctccttgaatgtatcgtagtgcaaagtcttcttattatccacatcgaacgtaatccctctaatcttcataacgtattcaatctcccccgtctgtttgcttctcatcttcaaggcatactgcttcgcccctccacagcaatattcttcaatctcatagccaccgtattcctcgctcatttctcccaaatatttccccgtcgtgatcggctccacatcccgatcgtgcctaacaaaaatactgtccgtgtccgtgtacaaaatctccccgccatggctctccgcttctctcatgaattccaataattttaacctcgccatactcgtcgtcctgaaaaattttaaataaaaataaaatttattttttctcaccataaactaatgattatgttgctcgacttgtgctccatcacaaagtcctccttgtccctgtatatcaatctaatcgcctcttccgaatattcaacaatatcacataattcaattttatgatcacacgcaattttataaaattccgacgccctatcaatcaccgcattcttgttcaaacaattctcatcgaaaactttccttaaaattttaagctaaaactctttcggaaaacccttaaatcttacccataagctatttagcatctactaggttatgcaccgcaaatcctggatttctctttcactttagcccattcactgtcgactccatattt

SEQ ID NO: 19847 - DNA, 1023 bp, Heterodera glycines
ttttcgacgtttccccgcccgcgcccgcacaattcgctcaaagtccgcaaattcgggtgcgttcagcattccgtcattgttgtcgtcaacgctggcttaagcaaaagagaaacgataggagaaacacagctttagaactgatcggatggtttaaatcttaatccatttttaataattatttttatcattatattttattattaaattaacattccctcctctctctgtctctctctgtctctctcacttttgtcacatatttcatccctccatgtttcctccctctctcccaatttcccctcaactcacccaacatttccaccacttcgcccggtccgatgccctcttgctcaaatgctgaattaacggcatgcttcaattggtcattgtgagtccctccattataaaatgataccgatcagttgcgcctccctcagattgacttggccatcctcgtctcgatcggccccctaaatttggccatttcccttagcccaccgttcctcaacacaacggatcaccttcaagatttgtctggccaagcgaatgctcatgccgcgaatgcgcctcctcagcttgctgaacagcacggcatccatcttgagcgcatttatcacagtttaatcagtttatctctctttctcttccctctctcccctccctctgctctcccttcctcctcctcctgttgtgcccttcccacctcgtccccactgctcggcaccaccaatcgccagatgcgttccacgtccctgttgctgatcccgtactccttcagaatgtaattctgcgcttccgtcagactcagctgtccgttgtggtccgtgtccacattttgcaaatatcgcagcgccgcgttctccgctttggccagcacaagcggacgaatgtcgttgaattctgtgggaaaattggaaaacaaattccgaatttcagcaattgtttattctcatccaacccagcgagttgagataggtgtccttgttttggtcgatttcattgaaaagactgaaaaagtgacga

SEQ ID NO: 19848 - DNA, 1211 bp, Heterodera glycines
ctgaaaaagtgacgaggaaaagaaatggaaaagtacgaacggtataaaaataaaatcgtaaaataaattccccctaaattttctcacttttccacaaccgacgagcttaagccatgatgaacaaactgaaagttaatggacagatttcaattcgaaaatgccgtttttatccctaaaatcattaattgaaaccaaccgcggcgtattggacctgaaaaacggaggataaagaaacattgccatttggggactgatcacaacagatgatcggtcactgactgatcagcaaatgatcactgccactgatcagctgctacaaacttcgcccagtgacaatgccccgtccccgtccaaatcgacgcttttgtccactggcgccgagaggggcgaagttggcaaagtgtcagtggttgaagccgactcatcgggcggagaaggcggcacttctgacggggggacaccgtcgatcggaggtggagacgaagatgcattttgatcagatactaaggcaatccaataaaatgatcgggaattcgtttcttttaccattatttgacgctgaaatttgggaggcgatttgttgttggatttggccattagaaaaggcagcaagatgttgttggggaagaatctgaggaagaatttgagcgaagaacgaacaaaagtcaacacaaagagagggggggggggaggaggacggcatttggtcgaaaacatttgagcgatcagaaaataaatttgatctgataagcccattcggacaaagcaaaagctatgagaatttcgtccagaaaataaaaatcaactgcgaattgaataatttcctataaagcccaaaaagttactgactgacgccaaaacaaattgtccgtcgggtgcgcggatcagcggaccattgttggccacaaattggggcggcggcggaggacgacgagggaattggccattaactgaaggcggacaataaaaagcagaaaaaaggggagagaaatcaccgtcgacggaagggggcgccaatttggaggccaaagcggcacgggagaagttggccccatttgaaggccagaagccattttggggagcggaagacgcagtgggaggagagggaggcggagacggggggacaacccgtagggggagggagatttataatttggaaaatcaaataggtaggtggagggggtaggggagtagtggggaaacccttgggg

SEQ ID NO: 19849 - DNA, 309 bp, Heterodera glycines
caccattaaaaagttcctcaatttccgctccgcattttccgcgatcattgctttttcagttgatatatcgtctagcaattggtcactaatacattgtgtatatattattattatgcatcaattcgttgaacaaataaagcgagatgggctgcaaattgctattgaaaacggtcacgcgcacgcgaaagaaactgcggggggtgggagagggttgggctgatgagggagtgcatagagagaggccgtggtggttagagagagtggtgagggcgagttggggcgaatgttctgtccgagaccgaccctccc

SEQ ID NO: 19850 - DNA, 1556 bp, Heterodera glycines
  misc_feature (70)..(70): n is a, c, g, or t
  misc_feature (92)..(92): n is a, c, g, or t
  misc_feature (172)..(172): n is a, c, g, or t
gtcccccgcctatcatgggtgatcattttgctgtgtctgttcgtcctttttgtgttcatctcctcttggnccatgttcgtgctgtactggancaatcggagaagagagcggcgactgatgcggcgtcggatgttcggcagtgagaaatgtttttccgtgctcagctcaccgnccgaaggcaattacgtgacttcgtcggtgttcaccgccgatgccattggccccattcgaccgttgcaacgggtcggtcgcctttttaggcatttaatggattttttaaaatttaaataagattttcttccatttgatccttttagcccctcagtcccaagttttggcacttcttcaatcagcagcccccgccgactcccaacgcgccaaatttgcttcggtttggtcagaaccatcagctcaaccacaaccaccaccacagcaattttcggcacaacaattaccagcaacaacaacatcactcccattcgccctcttcttcggcatcttctgcttaccacgccccagtggaaatgttttttcgatcggcattataaatcagtgacatgaaaaatattgtacaaaattgtaaataaaatcataaaccgtgttaattgtaagaaaggaatgaatggaatttggtctcaatggcctctgaaacatcgaaatgacaataggtatttatttataaatttaaatcttaaaaacattgaaaaatataaattcgatgaaattatttggatggtaattgtttgtttttcttttctttttcactctttcattttccgctttgaaattggcattggcttccggtaaagccgatattgcaaaaacaagaagcaatgccgattgtgccgatgcaaaagccacggctgttgcaatttacactcggatcacacggcgctaaaaaggggggggggggggactttcaacgcttttcacaaaaagaccatcttggcatcgggtgccggccgagccgccattgcacagacacacggggaatgttttcgtgccaatgcaagtaccacgaccactgcaatcatcggccgaacaagtcttaagtatcaacatgttgaaagtgtgaattatggggggttcaaatatcctaatcagtgaggtcatcatagattagaaaaggtctgagtcaatcactgatggatgtaagggatggatcaactataacgcaaaggttgtcactgatcagtaaagggggaataaatcactgatcaagtgaacggttggctccttggttaatcataacgaaaaacgggatcaatcactgatcagaaatggggataaataaatcaatgctcaaacagagtcatattgttgttatacgattatttctccgcttcttttcgatacgaaaaatacccttttttcttacttgagcttcaaatacaagcggtgaattcccaaaattgttgcttgggacttgtgaaacaacggccgccttctgctgaagctgctaaaatgggttttggcacattttgaaatttgtttagactgaaccgaccacttgcggtgtcggcacggagaggggattcggcgcactgtctaaagct

SEQ ID NO: 19851 - DNA, 949 bp, Heterodera glycines
  misc_feature (922)..(922): n is a, c, g, or t
tgttgctgcctcatcagaagcagttgaagaaattgtgaaatcattgtcgtttgccgctagtgccttcatcaccattggcggcatcgatggactttgatggaggcccattctgcttaacatttaaagccataatttatatggcaatgggaaaggggcacccccccccccttccatttcatcgaaatttggtattttacatgaaatcggcggtcggtgctgtacgatcggtcgctggttttggagaaaccaattggccaagttcttccctgtgtccaatttgtgttgcttcgcacaattcaatggacgttctttttttggtcatcgttggaattgctggcgcttccccatgttgcgacgtcgtcttcgttgccatcgaccagaatttgtcgctgccgttgtcgtcatcctttgccgattcaccgcccatcggctcctcctttattgatggctctcgtggggcgtgagaaatgcttttttgcatcactgaacatgttgatatcaaattggcctgcccggaattcatctgatgtgtggctttagccactaattttgcagagattggatttggagcgattggtgtctgaagttgctggttaaaaaatgttggcggaggagcgcctctcgctgatgatgagcccccgttgggtttcctatgtaatacatgctataattttatgacaacttaacaatgtttactcgctgcttccacttccaggaactgacggtgcataacgataactgactcccggttgatttattccatgccgaaggccgagattcggtagaggaacccgtcctgctggcgccgaccctttgcgccctcccgaagatgccgaagatgtggcggtgatattgcgcacattggcactttggatctgatgaatatatgctggagtaaaagaaacaaaaaatataccataanttatagtttctgataattcagtcgttt

SEQ ID NO: 19852 - DNA, 1160 bp, Heterodera glycines
cttgtggttgaacgctgagagtcggttggcgactggtttttgtgccgttctgaacgtcacttgtcccggagcagtttgtctttgacgagaaggaatcgcttgtggagttgccgaaatttgttggatgggagcagccgactgttggtttattacgctgtgagatgttatggcatgttgctgtggttggatttgttcggcatttgaagaagagcgtctgctgttcttcgtatttgacaccgttggcttaataaatttgatttatcacatggaaagccaagaccactggccaccccatgcgattgtggcacggtcggccccatcgattgattaaacggcgattcggccgtcgcatttggtccactccctcccaacgattggccttgcgcgtcgtgcttttttgcctctttcatcagcaaatacgtgccgaaaatttcgtcgaacctttctctttccaacgactcgtgtatttgctggagagtgtagccaaatgcttgcaacttcaaaatgcgcctttcatcccgaacgtcttttgtcggttcggtgtaaggctttaattcgtcctcctcatagcccatattcatccatttatcccgcattatcatctccaaagttcctctccttatcgggtttaaaacgagaaacttcttcaggagattctcgcagtctaaaattagatataatattcttcaatgaattgcacagtttcggacctgttgacatgtaaaaagggactctgtacttccctctgagaacccgctcacgaagttcctaacaaaaagttcaatttgaatttaattgtgtgtttaagtgtaccttaaggttttggccatcaaacggaagactgccggaaacaagtgtgtaaaggataacaccaagactccaaacatccacttcaggaccgtcatattttttgccttgaaacaattcgggtgctgcatagggcggactgccacagaatgtgtcgagtttgttgcccggtgaaaatgtgttgctgaacccaaagtcggcaattttgatgttcatgtcggcatcgagcaacaaattctctgccttaaccacaaaatttgttccaataagaattagtttagaaaccttcaaatctctatgaataacattcttcgagtgaaggtattggacggcagaaacaattgacggaactt

SEQ ID NO: 19853 - DNA, 1913 bp, Heterodera glycines
  misc_feature (116)..(116): n is a, c, g, or t
  misc_feature (1850)..(1850): n is a, c, g, or t
attgtggattattccagcagtgccgtcaaggtgcgcggaagaattttcaattaaatttatatgaaaaaatgacgaaaatttttaaatcaatttactcgggttgcacggaaaatggnggtggaccaccccgactgaaaagtgtaaaatttttaatgaagcttcatgaaagaaattttgacttaaaaattttcttagagaaaattagaattttctaaagagaaattctagaaattggaatttaaaaaaataaaaattcttaacttttttaaagtcttctctaaattttgccaaaaaatttttttactgtatttttaaaaatttttctgagttatagaacttagggtttgcagtttttaagaaacgcactagcacacttacatatcaatttttcgaaaatttcttaacattcatatagaccaataaatcaaaaaacacctgggattcgttatgtgccaacgaatcgtagttgtggaaattgaagcggtcaatcaactttttgcagaaatggaccccgcggcacgaattgcccatacggtccaacgggggcgaccacagcgcaatgcccatcagatttggcaccacaacaatggtcacgccggacacgcccgacttggccggcagccccacatggaacgcgaattggcccgagtagtcgtacatgccgcacgagttcatcagcgacagcacatcgcggcacgggcgggagccaatgcaacgctcgccggtcaacggacagacgcctaattaaataattttgggaatttaattagtaaaaatttaaatttggaaatttcatccggattaaatcttgttttctggacttctagtctgggtgcatttttcaaaaaaaaatacccggattgggatcctgagaaaaccctgacaagacccgagtctcctaacacgctcttgaagttagtctctcattgtatctctttacaatttatattatattttaataattttgacataagaataaaaatacagtatccttaactagaacagtattcaaaaaatagtcggtagctacaagtattttaaataatttcttcgtaaaatttattcatggtattatttatagaaaaagacttttctttacagagccaacaaattaatgttaaagttttaattgacctacaagcttcattaaatattattttgaatttcaattaatgccaattaaataattttgggcacctccgtttgccaatgttgcagcaatcactgccgccccctcacaattgacttccaatgaacacaattgaaaatagaaatccaatgtttccttgaggcttgtgtgttttgactcctccggaaaacagccattttcctgaaaatttgtcaaaaatttttacaaatctatacagcagtagtgcggaattctctatttcaattttccggaattcgatttccgataaatatttgggagttgattagcgatttccactttcaaaattaggactattaaaaattttagaaaatttttatatagttttttgtaaatttagaaatttctacacgtcttggatgccatttacagtaactaaccttcataaaataggcaagcgcaaaattgcgatcagcagtagcagcttcggatagaaaatcggcattgttgaagccaacatattcacctcctgccatcttcttgtactcgttgatcatctgtgtttcaataaatcttatccaggatacttttggcatttgagcaaaaagattattagttttttttacggcaaaaaaatacattttttagaattaattagtatttaaaaattattccaacgtattcaaatcgatcacccatgttcacctgtgcacggatctataaaaggcccttcctcgccccnctgttcgccgtcggaccctttattgtatctgagtgaagaagtaaaatgaaataatagaagtga

SEQ ID NO: 19854 - DNA, 2092 bp, Heterodera glycines
  misc_feature (61)..(61): n is a, c, g, or t
  misc_feature (68)..(68): n is a, c, g, or t
tcgtatccgccatcgctgatcacaatgtcaaatgggttctgtcgagctttgaatgcatcgntcatatnttcccactttcttccatcccatccaattggacaacgggtgagccaaaagtcatttgctgattgcagaagatacaatttctctccagtcacttcgttgatccgatcaattggcacaacggagtcaagcggagaaggcggaaagtgaaaacaaatgcgaaaagtaaccggagaagaagcattggaaaatgcctgaaaatgggacaaaaaaatcatagaaaatccaattaaatagggataatcaccgctttaaactgttccatcgttgacgaccattgattcaccggtgaattcacagagtatctgagccacttgggcagaccatccggacgaggcgtgaacaaccatttggtcaccgcttgtccatccgacgcattggcactttcatcgggcggaaattcggggagaatgacgtcaccgaaagaaacatagtgaagggatggacaatcgttgagaagtgacggggccaattggcgcaaacggcgaaaagcgatggtattcaaaaacatcatcagatgcatagaatggcgaagcattggccaaatgttgagcaaaataaattccaaaatgcggtcattgccagtggtaatgtacaaatccgttgaacaaatggcgaaaaaacggtgaaaacggcgaagaaatgcgatgacattttgatcgatgtagctgaaaaaaagagaatgtagatgaaaaattccaaattaatcaattttttacgcgatcgaaatgcctcggaatccgatgactttgttcgacaacggattttgcaggattggcaatggatttccatcggaattgacaatttgcatttgtttggtgccattctctccaatttcgtggtaaatttgcattccgcccaatttccatttgcgtgttttgaagtgttcgtcgacgatgcagttaaaacggcggttgaccagcgcaatttcaaggccgagctgagaaggcgcaagaaaatcgaacaccaaaagccaacagtcgccgcagataaagctgaaaaattgaagaatttctatgaaatttccaaaattttcaattttatttacatttctttgtgagggcgtagtcgttttttgacattgcttgtgaataagaattaaaatttctgcagaaaatttttcgaataaaaaaaaattccagctttaattattttttaataaattttaaaaatattcattttttgcgtttggatatgcattggtggggaatgaattaaattgcaaaattggtaactctgtttcaagcgatgctcaccaacacaactaaatgttatccgtttctcatcggttaattggcgtcactttccaaagcgatgcctattttcttgatctttaaatttaatgatattaaagcaaatttaaattaaaatgctttttcatcgttgtattcctattcacaaaaaatagaaattctttgaactggccgaacggggcaaccaaagctctcacccgctactgacattagaaattattaatttcatagttttataattgatattaattttaggtaattaaaaataaatgttcttaattaggaagactgtttgattcatgttaagagattttctatctttaaatcattttaagaattataacctattaagaaataaaatttattaatattatttaagttttggaatgtttgaccaatttgttcttgtttattcgtcgacatgtcaatatcccattagtttttaatttgaaaaaattatacataatactggttgtgccacatttgcgccccaatgaaaaagaaaaaaaatttgtctgctttggccagagttaaaatgcctcacttaaatgataggaaattaactctgtttccagactcaaccacgaggaggtagcagacattgagtccacccaaaccacatcacaaattctaatgaaaaagctatttatataaaataatttaaatactaaaaactattcattataatacattcaagttgtacaaaccacaaaacatttattttttttgttttcattttatttttttatattttctttgttttttattattttctt

SEQ ID NO: 19855 - DNA, 2842 bp, Heterodera glycines
cttgattgtttaaacaattttattattatttccaatgcctccccaaacggcaccgtcggaccccaatcttaccatttttcgtaaatttgatcacaaaatgccaaaaaattagttattttttggcgaaaaatggctacaaattcctgttttttttttctcccggcgctgaaaattttaaaatacactggagaaaactttttttaggaactttatttttgacccgaagggcaaaaaaaaagtcttcaggacttctccgtccgaaatttttccatccgatttaagaccaccatcatttggatcccaacccttgccacgttcgcgttcgccttcatgctgatcatgcgcgattcgggcaccgcgccgtgggatgatcaggactttgggaacaccagctccgtgctcatggcactgtttcagtcgttcaccaaaacatcggcaatggtcggtcgggtcggcatgattatgatcatcatccgggggatttgaccacattttctgatcatacagaactcgcaaatttgggtcagaaagtgacaaactgaaaaaaaaccatagttttttggttccgatcaaatccaacaccacgtaaatgtttggttctgatcattctctgatcaaataaattagccaatcaaattttgttcttattagataataaatttattgcttctgaaaactttctgatcagtgaaatcccaaaattttttttactctgatcactttttgatcagaataaacttccaagctgatccgagaaccattacattcccaatttatagctccaatcattttataattagcaatcctccatcgatcagagaaccccccccccccaattccccactttacttttttaaaattctcatcatttttctgatcactttttcccaaccattttctgatcactgttttgccgcctttccctttgaagatgatcggtgaggttgaggccaacgacattttgggccgtaaggcgtgggtggccaactttttgctgattctgttcgaaattatcaccgtcattctgctgatgaatttgatggtgtcgctggcggtcggcgacgtcaacgaattgcgaatgaacgcggaggagcgaatgttgcgaatcaaagtgggacaaatagcaatgaaaaaaaaggaaaattttggaaaattgggaaaaatttatttgggagaatttgattttcaaggttagcctaactaagtgaaaattatgatttattttcctaaattccattgaaaaatgctaattttcgtccaaatttttggtattaattttaaaaaataaaagcaaaatttgaaaaaatggctagaatacgatttcggagccagctaaatgaaaatttcaaaatccaattgcttttaattattactcattaaagttttttttaatttttgccaaaattcgtagtatatttctatttttttaaataaagtaataaaaaaataaaacaaattctttgcattttaattcaaaaataaattaatgaattttttcaatttaaaatccaattaattctatgtgttgtaaataattttgagaaaaatatttttaaaaattttggaactcaatgcttaaaacatactttcaaaaatgaatagtaaaatccaaaatttatttaaatttaaaatccatttaatttttacgttcgaaatatcaaattttaattgttttggaaaaataattaggaaattttggaatcaatgcttaaaattaattctttaatgcaatttatttaattatgctttaaaatatgtttttgttactataatttttttttgaattttagacttaaaatccgtttaattcttttgctcaaaatactaaatttaattagttttagggaaataatattatgaaaataaatatttttgggtgctgtaattttaatttaaaattttttgaatttaaaatccaattaattccgggaactaaattttttaattgatttgggaaataatgttaaaaatcttagagttcaatgctaaagattaattactttaaaaggaaatttgtttaattatactgtaaaattttgggttactgtaataattttttgaattttaaattttttgaaggttaacttttgcatcgaagctcttcatttgtccgaacaaatctcatttctgaatggctttgtgcaagtgcttcatcggagccaaaccaacaacattttggtcatttacaaggccgaaaacattgtgcactctcggctgatgccaaacattcgtaagaaatgccaaaaaaaattgcctatcaaagaaatccgacggaattttgcaaaattttgtgtgttaaaattcggatttttacaaaattttcaattctacagaatttatggtttctgaaacctaaatttaacgaattttccctaaatttacacattttcaaaaaagaatttactaattttagataaaaattgaccacttttttgtaccataggcgacaaattttttggcggtgccgacggaagcggcacaaaaatgatggcatccgcgacagcgccgacggtacgccgtgagcgtgtgtacgacgtggtgatcaacagcaccagcgggctcaagctgcgcaaggagatgtcaacgaatcgagcaacactaatgagcatcaacgggtgcacgtgagttggacaattttggcatttgttcgagactctcgggctcatattaccaacttgaattttcgtagtcaaatattgatttgtcgctctcagctcagggccaattagtggtgttaaatttgtactcacttctccattcttttatcggtctcaattaagggtcaattaacggtatcgagtattgcagtcattctcgctctctctgggttaattatcgattc

SEQ ID NO: 19856 - DNA, 2289 bp, Heterodera glycines
  misc_feature (2160)..(2160): n is a, c, g, or t
tgctagtgttaatgactcaccatttccctcctccgtgccctacaatccaattgaccggcaaaattgtcttcgccgtcaaccttctgctgctgctgttggttcgcctcgtctatttcctgctgctgctgctcattgtcaacatcgccttcgttctgttgttggtcatcaccctccgcatcgccatgttcttcatcagcatgttcatccgctgccgtgggttttgccttgtcaccagcctcatcttgggcagctgtccagtccgctttatccgccccttccacttgtgattgatccatctgttgctgatcagcgttggtgtcgtcattcttggcacatgcatcatcatcgtccaacatctgtcgctgatcacctaaatttagcgaaaaaatcattcaaaatgccctttttgtgcccaattactgaccctttgcgtgatccattgtctcattgttgtcatgttgctcccgctcctccgcttgctgttcgtcgttctgctcatcttcccacaattttgggtccaactgcgtctcttccggctcctcaacctcaccaaaattccaatcagcgcgatcatcaatgtcttcccgttgctgctggtcatcatcattgtcttcaccatctgcgttgggaaattgcttgtttatttattcactattccttttcgctaaattccttagttttttaagtctagtaaaaaaaaaataataaaaattttgaaaaacaaattttttttaaattcatcattaaattacaaaaaaaaaaaaattgcttgaaaatttttagaaattttttttcttagttttctaagaattctaagtttaaaaaattttaaaaatttattcccggctgtgttttggggtgcaccgcggcgaggagggggaaaatgagttgcccccgttattataacccaccaattccctgctcgtcgtcttcccctgcgtccaatgcctccaaacagccggcaaagtcatcatccacatcaattggttggtccgtttcgtccattttctgctgctgttgttgttgttgctgatcagcatcagcattgttttgctcgtcattcatttgttgctgttgttgttgatcatttccgtcattctgttgcaaatttgagaatggatcagtcagaaatacgaaaaaaaaagcatgcaagttcgagtcctctccatgacattaatttttttgtatgttttttttcttctttgaaaattatgaaaactatgcaaattccttacaatttttgatattgtgatcaaaccgtaatgtacagccttggtaaaaaagaaaaatttttaagcctaacaataagcctatttttcctacaataaacaaaattatttattttttatctccatgcctaacttttgactcaataatgtgtcaataaaataataaaaacagaaattgggattaaattatataatccaggtaccttaagcccctcaatttgttccatgttctccacttgggaagacacatcggtggcattcggtgccaaatcgccatcgccaaaaccatcgccagcttccgttcgtttagcatccgcttcatcgccacccttttgtctgtccgcaattggaattggattgacaaagccgttggtcaacagatggcagccgaccgcgctccaatgggcatggaatgaggccaattgggcaacaaaagtgccaatgtgatggtggagatggcacaacgccgaactgagtccatgtgccagtgtgtacgccttggcgagacggtccgccaccattggcgatgaaattgtggtgttaacggagcaattggaaaggaaccagtcgtacaattgagtaagcacctgcaaaaacaaacaaacaaaatttttaaaatatatgacaccagagatgaatagaattacgattttcaaaattttgagagcatcggaattctagtgcatgagtaacacgataaatcgagtttatccatgatctttcataaaatttgattttgaaaaaaaaatctatttttgatttactttttcttttgaattttttggtggtccagggtaaaatacaatcaacgacaacaacgacaatccacaataaacaaaatgttgcctcaacaactccataaacctcaaccttttcgctgttcaatttgttgacaaactcgagcacacgctttacacagtccaagagtggngggaggtgccgacgagccaatgccatcatcgttagcattgttgctgctgttgtactgctcgacctctttgtaaatggactgcagataaagcaacacggcactttccacacattcaaattccgtctggat

SEQ ID NO: 19857 - DNA, 2245 bp, Heterodera glycines
  misc_feature (2210)..(2210): n is a, c, g, or t
aaaaaatgcaatgatgtaaacatgcaaataacaaattcctcaccaatattttgttgcggatgcgaatggaagtctggccttcttggaattggaggttcatgcgttccatcaaacgcttttataaacaaattagctgaaatggaggacatctaagcagggctcgaagaattctttccttttttcaaggaactcattttaagaaccaaaagtcatttacaaacaaaaaaaaaacatacgaaaacccaaaaatccacaaatgttttccagcattcacccagagttacactcataaaaatttaaattttctaggatcggctcgggtacggattaccattgaaaattttttaaaaaatattttttttttttgccttttttgaatgatatttaagaaattgccataactcatttcaaaagaaccaaaaattccaaaaatgagactaattcttcacacatgcgagccctgctgctgctgctaatggtcggtcatctgttgctggcctaccaattattttgtatttaccgtatttcttgaaatagagcctccgggggttctatttttcaacccccctcaaaaggggggggaaggctttatttcagcgggggtaaattcagggcggagctgtattatatgaaatacggtatgtacatattgtccttgttgtttttatttttcacacttttttgtatgtgtataaaggcattttttgcgtttttaaaattttgtttttggcatgggtaattaaaacataagtgcataaatctataaatgttagacaatttatcaaatgcttaaaaatatgaattggatgcttcatttttgtgtgactcttaggaatccgggtccaactttatgttattttaacccaatttttttaatgttctattgtactttatgaatccaatcgacttttataaatccaatgggattttataagtccaatttaagcaatgtcgaaaactgtacgattgattattagagaccgggtttttagggttttacccattttttgggtagtacttgatgagagaagcacgaaaatcacattttcaaataatttttgatttagagcgactttttagaacttaaaaacacctaaaacgggggttagcaccagggatgtgcctaggtcagggttcggatctgtcctgatttatcagatttgtcctgatttgaagggtccaaatctgataaaattaaaatgtcctgatttgtcagatttgtcctgattttgaggtagcgaccaaattttgtcctgatttgttgattctccgaaaaatctgtcaaatttctttataaatttggattggcgtaatgtttaagcaaatattttttaattttggtattatatttcttttttttgttgttaattttggctaattattttgttatttattgctttattgtttttctcttttgtttttaatttagcacctgcactagtactaacaaatggcaccgcctaagcgcacaaatgcttttaaaagtgaatatgccaatgaatttcaggggatcacaaaaagcaaggcaggagatgaatttgcgcattgcatcccatgcaattttgacatttctttgttgtccactggaaaaacggccattcctcatcatctgaagacggaaaaacacaagaaagcagcgaaagctgcaaattccgcaaaggcaattacggcattcatgccaagcaaatcggcaccaacgaatttggaccgtcaaacagcagcagcgaaggttgaattacaaattaaatcagaaataacttttatttgtttaggtgcttgggcatatcacaccgcgcgccatgcgcaaagctttaaatcggccgattgtgtctcagatttgttgtcaaaaatttttcctgattcaaaaattgcggcaaattacggatcaaaacaaaataaatgcgcagcaattattacaagttttcataaaattaaaggataaataaatcgagaataatttaggagtacttgctccgcattctgtctccattacgttgcaggaaatgactgggcttccgttttcactttcgattgactcatcaaatcataaaaccaccaaactttttcctttggtggttcgttacttcaatccaaaaaaaggaattgccgtcaaattgatcgacttagaggaattgagtggagagacttcggccgaagtttgaatcatactttattttttggctattactttgatttatagatttataatntggataattcaaattttggagcggcacaaattgga

SEQ ID NO: 19858 - DNA, 1914 bp, Heterodera glycines
accctggccaattgttattattatttgaaacttctactgaggatatatttatgcattttcgctgctttctgtcaaggtcatatgtgctcagcgggaggaagagttgcgccaccacacgaaactgaactcaactaacataaacattttggtgttgtgttgcaaattccatttgccctcctatggatttgtttggcgttttgttttatcccgctgtgatcaattaaatttgggtgtgccattgtttgggttgatgatgtgttggataaatatggatgtacatatatatccaccaaataaaacatccctggcgggggttatgttcttccaaacagagtcccaaacattgactttttctttgtttttcaagaacatcacccattttaatgagttttggacaggtgtcatccatccagtcccaatagctgtcggtgccttgaggggattttcgatgggatttggaggccagatcccctccaaattgccccatagggagcgcaaatttggcacttaatctgctgggaagaaaaaaaaatatgaggaaaggtgtgatgattgggggtaccaaatgtacattggtttttttggttttagcgctccccgccgccggggacagcaggtgtacctggaaatgaactccctaatgatgcttttgccttggcttaattgtctaatttgaaattttaataaattttaaatcaatcgccgagtgaacccattataattgtctggcgtaatgtcgaattctgaaatattttctttaattttttaggaaactatttttaaatatctttcttttccaagaaatcacaatttcaaaatgtttgtttccaagttccaacccacttgaacatagaacgccaatctaagaattcaattcaaatgcttggcggtatataaagtggattcgccccctccacccacaatttctcaaattgttttgccaaccaaccgacaacaaccacttctgttgctcatttggccagcagttgggcctcaaattgcgtgccaatctcggccccaaagctttagcccttactgacctcccaccctaggtccacagatttgagcgctgctcaattctccggatatccccccccacccaaacccgcgaggggatcattagcccagcagtaaggggacaactgcggcggcggcgcggacggtcacaacacagacagagagggcaggggcactcatttacggggccaaagccgttggttggccacaaattgggaattgagccgtgtggcccccgccggcgggcgatgatgccgccgccgttggcacggacggcgggagggggttaattatttatttatttatttgtgtgcacagagggcgaacacatgggaaaattaatcagagagaaaggcaacggcatcataatataccccacgagagtggtaataatgtttgagcaaaaattggtggtggtgatgaagcgcgcaagactcttctcgaccagtccagtcttgtgccttttattcactcgaggagaaaaaataaaaatggcagcccttatttttgagcctttctaattgattttcattttaaaataagttgaataccttggtaataaaaccgacatttcagacttgtgaaatttaaccccatatttcaactaaaaaacaaattgtgcccagtgaataaatgcaaatttttgaaacaaaaatttcccattttccgacaatttcacatcattcagcgtctctccattaattaggccatctcgatttgtttccactttgtcgagataagcgccgagggaggctctcgagcaaacaattaagctctcttgaatccgatgaaatgccctgctggctttgcgcgcatcatttatccatccccatgagataatcaccttaggcaggtgagcatcccactcgaccccggaggcattgaactgcccattaa

SEQ ID NO: 19859 - DNA, 1978 bp, Heterodera glycines
cttttaccgtatttattattagccattttatcaacgattaattcattcacaatgaatttcacatacaaataaaatacaatggaaatggacgcatttgcgagcaagcaaaggtcaaatacaaacagacaaattggtcataatacaatattgaaatggcaaagtgcccacatcatttaggttacataatcgcaccaattaaccatcaattaattcatttctgcttctgttgctgatcagtgatcactcggcccgggagaagcggcgtcgggaagactgaaaaaaaacgatgattctattgaactttaagccaattcaacaactattataagtccaaccaactaactacttaaccatccctttttttctaccataattctgtccattaaccgtacattttttggtaacatttgaaagcacaaagtctaattgtaagcaaaaatggtgattggactcatatgtaaaatcattttaaaattgttcacccgtcgtcgtatccgccatcttcgatccaaatgtcaattgggttcgtttcgttcaatacatcccatttcttatcatcccatccaattggacaacgctcgagccaaaaaccaccttcatattcttcaagtgtcaattgctccccagtcgcttggttgatcagatcaaattccacaacgaagtcaagcggagaagacgacggaaagtgaatgcgaaaagtagccggagaagaagcattggaaaatgcctaaaaaatgggacaaaaaatcatcgaaaacccaattaaatagggataatccaccgttttgaattgttccatcgttgacgtccattgctcctcctccattgaattaacagagcatttgaaccgcttcggcacaccgttcggatggggcgtcaacaaccatttggccaccgcttgaccatccgacgccatggcactgtcatcgggcggaaaagcgggcacaatgtcgttatttgacacggcaacaccgaagagagatggacaatcgctgagcattgacggggccaattgacggaaacggcgaaaaatgaaggcgttcaaaaacagaaaacgaatggaatcgcggaacattggccaaatgtggagcaaaaagtagtccaaaatgcgaacattttcagtggtaatgtccaagaatattgagcaaatggggaaaagacggtgaaaacggtggagaaattcgatgacattttgatcgatgtagctgaaaagtgcagaaaattatgaaaaatttcaatctaatcagtttttacttgatctgaatgcatttgctgaatccgatcactttgttcggcaacggattttgcgggattggcaatggatttccatcggcatcgtcaatttgcatttgcttggggccatttccgacaattttccatgtaattagcaattttttgttcaacatccatttgcgcgttttgaaatgttcgtccacgtagaagtcaaatcgacggctgatcagtgcaatttcgaggccaagttgagaaggcgcaagaaagtcgaacaccaaaagccaacaatcggcgcagataaagctgaaaaattcgaagaatattttcaaaattttcaaaaattttttgctttaattttatttacatttcttttttgggagggcgccgtcgttttttgacatgctcaaaaaagaaccaaagaatgctggcacagacgaccaacagcagaagaagacacacgtcaccccaactgaaaaatgaattgaatggaaagggagggaagccaaaagtgaaattttattttaaatccaatgaagctaattgtaagcctctgaattttgaaaatttaaaatttaagcaaaagaagaaatgtgaaccattagaaaaaagggaaataattaacgtacagaagtcctgaagacatttttgtagcaacaaaatgaccggaaaatccaggaagaatgaatgaatgaatggaatgtggtagagaggaagaaaaaaagcactttttatattaatatattag

SEQ ID NO: 19860 - DNA, 1199 bp, Heterodera glycines
  misc_feature (1085)..(1085): n is a, c, g, or t
cgctcctccctgtttcttaataattttgtatttctgtccccccgcgggcgttgatgctattacctaatcattttttgttcctcgtcgaatcataggcgtctggcgatcacgtatggaagcgacctttaccttttcgaatgtgttacgagtagctgattttcgcgtagcccagatgacggaaagtgggcacgtgaaaagcacaaataaaaatggattcggcattgcaacaatttgagaaatcttatagaggactttgcaaatcgtgactcgtttaaatatttacgggcctgttcttatggctcgaatttttgaatttttttaatcaatcaatcaatcatttatacgcaaaagcgtgacgccgaaaaataaagaaataataatatcaaaacaatcaattggtcacttttggagttggggtggcaaagaaatcaacaaattaagatcagatctttcaagaagtttggcaaactcattaggatttagtaatctcgtctctttaggtaaaagtctatagagacgagaggttcgaataaagaacgagttgtatctaacattggttgagcaataagctattcttatagtgaattcgttttttacagggtttttggaaaaagaaaaggattcgttattttgtaaatttattttacctaaaattatttcatgaaaaagttttaagtctatttttaacctacgactttcaagcgacttttgatcataaatgtttaacaattcagcataattaggtaaatcaacagtataattgttacgtctaaatattactctcaaaaaagtttttagctaggtgtacgcttttttcaattttttttaaaaaaatatttaaaaaatctgacaataaattataattttagcaattagttttagttttttagccttaaatatataaccataagcggtggaaaatgaaaacgacaccttgttaggataggctactattgcagcatggttattttttaaattaatttttataaaattagaatattaggtataaatattgtggtgaaatgattgtggaccattacattgttagggaggatgagcgcgaacaaattggcggtgtaaataanatttgttcattggacgagagcaagtttggcaaaggaaaatacatagaggacgctgcatagaaggccactgataaaccatttttttatcatagaaaagcgaaaaagatcacctct

SEQ ID NO: 19861 - DNA, 460 bp, Heterodera glycines
cccttcgggcccccgcattcaaccgcctgtggcactcgtcagactgcttcccccgccctccgtctcgccccactacttgctccgtcttcgcatgctcccttttgcgaagttaaaaataaggttaccattaattataaaactaaaataatggttttcgtgttaaggaatgatcgaagacggattagaggattttcgccttgtggattgccctgaaatgttaaatgaggtatttattttgtgtaaattgtagctgaggatggcactcatacccaacgcatcgaggcgagttggaggcctgcgaaggactggtttcgcgagagacgcatccctgggttccaatttgcagaaacgctggtggagtatcagtggggccgggaactcaaaaagaatgaatggatcctttttcacatctcctccaagcggttcaccattattacaataaaaatttgtgaaaaactaa

SEQ ID NO: 19862 - DNA, 1548 bp, Heterodera glycines
ttcttcaaaaatgatttttaatacatatctagccattcttgaaagttttactttgcatttagcgaattgaagaaattttgagaaattttaccctaaatttggaaaaatttatgtccatattttgagattttagcaattttatgtccatattttgcgatttgttgtccatattttatggccatatttcgtggttttatatccatataattacacgccctaatgatgatatggtggaaaaaacagagaagacaggcccatgtcaattagttaatgaggcgttcgagattgttttgtacttaaccatccgagaaacaaatcatttcaagagtctcgaacgccaaccaacaaaatttggataggaattagaaatgttgaacacccagcccagaaggaataaagaatacaacgatttaaaacaattttaacaacggttgatggatggatggcctgcattttttggccaaaaattttagatcggtaaatcaaatttacggagaactattggcccaaaaattttgttcatgacaggttataacgcgggattaatcccgaaattttgcatcccgtaaaatcctcaaattataattccgtcgtcaaaattaaaaaaaatcgaacgggaaattttgaattgacagtgaggaaaacagcctggtaaaatactttctgtaaacaacgaaggcacttctatacaacggaggggtcaatgatacaaaaaaaaaacttgcaaaaaagcgactcgaaccatcgaaagccgaaaaattaaaaaaacaaactgaaaattttcgataaaattttcctacatgcccatagggaattgatgtttgtttttgcatgttcttcttggtcctattacaccagtcaggagttcaaatttttgtaaaataagacaattaacaaaactttggactccgcctaaatcgtagaagtgccggaaaaaagaaataattaaatttctgttggcgatttgttaggaaattgtgaaacaaatggatggaaatgaatggacagagagaacgaaagagtagaagttaaagggaagtcaaccaattatcggtcatcatcatcatttgttcatttaaatgtgtgtgtatccagtccgaatttcccgccaaacaatgcgccaatgacaacaccaagaaaaaaaagaaacactcgtccgtccgtcagtcaaatgccaagcgcacacacacaatcacactgtgatcagaagcccaacttcacgtatcggatgatctgagatgaatggggagatttagagggattatggaaatgattttttaaaatggatttttgtggatttattgcacctttaggcgtccaatctgctgaccagcctcaattttttaggccataacttttttcttatttgaacaatgtccatattcttggtatcaaatgaaagctttaagcctcggaagtttaaaaacttacatcaagaaaaaatacagtggagaaaaaaataaattcagttttttcggcgattaaattcaagcatttttttatttgtaaagacccatttgttttagcttagaatttatcatatagatt

SEQ ID NO: 19863 - DNA, 1369 bp, Heterodera glycines
atcaaactcgcccagaaagaaattcggaaaaattagggtcggcgctatcattccgaaaatgtggtggaattcttcagactgatgatcagaaaaagagataggcgtttttccaaaattttcgacatcaaactcgcccagaaaaaaattcggaaaaaattagggtcggcgctatcattccgaaaatgtggttggaattcttcagactgatgatcagaaaaagagataggcgtttttccaaaattttcaacatcaaactcgcccagaaagaaattcggaaaaaattagggtcggcgctatcattcggaaaatgtggttggaattcttcagactgatgatcagaaaaagagataggcgtttttccaaaattttcgacatcaaactcgcccagaaagaaattcggaaaaaactagggtcggcgctatcattccgaaaatgtcgttggaattcttcagactgatgatcagaaaaagagataggcgtttttccaaaattttcgacatcaaactcgcccagaaaaaaattcggaaaaaattagggtcggcgctatcattcggaaaatgtggttggaattcttcagactgatgatcagaaaaagagataggcgtttttccaaaattttcgacatcaaactcgcccagaaaaaaattcggaaaaaattagggtcggcgctatcattccgaaaatgtggttggaattcttcagactgatgatcagaaaaagagataggcgtttttccaaaattttcaacatcaaactcgcccagaaagaaattcggaaaaaattagggtcggcgctatcattcggaaaatgtggttggtgtcccgacttgctctggggtcgggccaaatgaattccacggtgcggggttcaggggcaggcagggacgagacacggaattaataaaaaatttattccgggaaatgacctcaaacttgggtaattaaacaaaaattttgaaatggtgaacgaattatcacaaattgatcacagaaatgccatcaccggggaattatcacaaatggaattgggcaccgggatgggacagaaatttcagaaatggggcaaatggaaaaatcacaaaattcaatgatagggaccgggtgaatgacagaaatggaacggacaattgggccgggggaaaaggacaatgaaatgagggggactgagagagggacggaagaggcattgcttgcctttgctggtgcttctgattgtaagaattggtggggatttgtccctttaaatacgagcaaaattgaaaaaaaagtggcgaaattgagcagaacgaaaatgggcccgaaattgggcatgaattgaaaagagggcacaaaaatgaccgaatgaacaaattgggaggaaaacgggaaat

SEQ ID NO: 19864 - DNA, 2073 bp, Heterodera glycines
tttttgagggtgccttctccacaattgtgggcattatggtgttggcacttgtggacgcccatatcattctgatctttttcaaagtgccctcatttgttggccatttgtccttatttcccccatttgtcagacggtgtttctcgtcatcactttttcactgctccacggaatggtctttctgcccattttgttgaccgtggcaatgccaaacgaacgaaaagtgccaacagaagcagcagacagagaagagagggaaaagcaaaaaaacgatgaaaggggagagaatgaatgaattttgatggagcagagaaaagaggggaagagatagagagaatgtgaaaagtggggaagagagcgagagagagagagaaaagagagagagaggaaagggagagagatagagagaggaaagggggagagagatagaggggaaagggggagagagagagagagaaaaaagggagagagatagagagaggaaagggggagagagtgaaaacgggagagagatgagagaaggagggagaaacagcaacgcaaagattcattttaaatttaaatcaatttttttgttattatgtatattgatttttgctggcagtgctaaaatgatcagttccgacgagtaattgagtctcattcctcccaaccgattaaatctgtcaaattttattagtaaggaaaaataaccaaaaacagtgaacatcgaagtgagatacagtaagaatcaaaacaatatgccattgtcacaacaaacataatatgattattatgtcaacaagaaaaaatgcttgcaaattcgtacctctcacaacttcaagtccttttgtatgccgagaagtttcgcggcagaaatgtgcaactgttccaattcgttttcctttaggttctgtttgatgatgaaattgatgccattggcccctacgacgacgggcagcgaaaggaaaacgtcgtcctcaatgccatgggtacccttaggggaataattaaataatttatgggttatcaggagctcattaagacaccaccttaacatttgtacttagtgcaaaaacattgcgactgtttgccattacgcactgcacaattatcgcaacagaaagtccgattgcccaacttaaagaatatttaacaaatgaaataaactcggtttttttgttaaagttcaaaaaagagatggaatgagacggtggacttgcctcgtgtaccccttcaacttgatgatgtcgtaggcgctgtccaccactttctgatggacttccttctcccaatttgtcgcttcgttttgaccgtccaacagagacaaactgacgcccgccacattcactccgctccacacggcaactgaaagtcgtcattttgttccaatatgatgtacccctagcaaaataaaaaaaaaggaatatgtcttaataattccaagtgaccgctcgagtctccgtgctccccaataacataggcatggcaattgaaaggggcgatgttgagacgctcagacagcaaagagcggaaacgagccgagtcgagattagtgccggaaccgaacacacgctcactgagccaaggggggagggcattggaaaagggaaaacagaaaaactaccgaggcagcccagagagtttccaagtgacgtaagtgagcacatcaactaaaggggggggggaaaccgcattattgaatagttttgggagtaaatcgggaatgactgactgacccggattagaaacgaccaaaatgatagtgtcgggagagtaacggacgagttccggcacaatgcctgaaattgatttgcaatgacccagcactttggcacctgccgcagcagtacccttgaagatctccacgttgcgtttgatcagattgagccgcgattcgccctcacgctgacgacacccggcggtgatcacacacactttagagccgacagtgcccgaataaccatctaaaaatggcaaaaatcaactgatttcggcaccgttaaagggacagtccagacgaacaacgtaccaatgctggcattcactacgaccccttggcgagtgaacgcaacgccgtgctgcaagtccatcact

SEQ ID NO: 19865 - DNA, 918 bp, Heterodera glycines
  misc_feature (26)..(26): n is a, c, g, or t
attcggcaaagtttttgatcaccccnttaacagttcgttgttccgatgccatttatcacttattgttactggagaattctccgcaaagtgcacaaggatatgatcggtaagaaaaataacggcgaaaaaaaatataaaaataattaagtgcaaaatgtccaattctcaaagtctctgtcgaattcacagcgcacagacgcattgaacagaaaaaaacgggtcaattacattctgattggcatggtaatcgcattcatcggctgcaatactccgatcaccgccgttaatttggccaaggatttcagttaatagcattaatcattgcttttgaccctcccaacatttctcgtttagagcaagagccgaattggctgaagaagcaggtatttctctcccccctctctctcccactctctctctctctctctctatctccctctctcactctctcctctctctctctctctctctctctctctctcactctctcctctctctctatctctctccactctctctcactctctctccctctttttccttctctctctcgcccccgccctctttctctttcttctctccatttttaattgaatttccaaatgcattaagccctatctttggccattagttgcccatgtgatcgcaatgtccaccatcgttttcaatccctttttgtttttttggctaaccgccaaagacaaaggtcaaaagggtaatttgaccggaatcggcacgacaacaagcgaaataatcacgtcattgatgtcgagaatgcacagtttgagaagcacagggggaaacgaagagagcaggtagagaaagaaagcaggggaaatagtgggaaaggagagtacacagatagatagagagagagagagagagggggagaaagaagggatgaggaataaagagaga

SEQ ID NO: 19866 - DNA, 1201 bp, Heterodera glycines
ttctcacaaccgttaattgcgcacgaaaacggccaaacaaaaaactcggcaaggaataatccgcgaggaatggcagagggacgaaggtcaccgctggccaaaatgcattccctcagggctaattccgtcctttagcattcgcaaccattaattattaattaactaattgctcatttgtattcaaagggattgtgcaacgactgaatgtgctttataattaccactcttttgccatcttaagctaaaagaccctctctgagtggtgcaatcccaaaagaaatattgtaaatatttataattcagacaaataataaaaatgcattaataaaaaagaacaattaattaattatacataactttaaaatgtaaggtagaaacattttaaaaataaaaatgaggaaagaatgcctaaagaattttctaaagaattatgataaaattaagtagtgacagatcatttgtggctgattaaggcaaattaggaaaaaaaacgagcgaaataaaaggaaaaattgggggaagggaagagaagggaatggaaggggaagagaagtaagagaagggggaggggagggaagggaagggaaaggaagagaagggaatggaaggggaagagaagtaagagaagggggaggggagggaatgatggcaaatggaaaaggaaagaaaggcaaaaaggagaggaggaaatggtgagcaaataggaaaacgttctgaagtcaggcgtaagtgctcagttcacgttggccctcccttccattcgcttggccatccgaaatttcgtcccttttcctttggcatccctccgacgccgccgttctctcatcgatttgctcggcgatcgaccgactcggacggggcacttcaaagtcagtcggatagcgagaacggaatttccatgtcgggtaaaggctgaggtaattcctcgggactaaagagagagcaaaagccatgcgcattttgccgctagctgtggtcatcccacccaatcctttgtcctctgaggcgcaatgctcacaaaaccaccaaaagtgtgtcggggcggtgccgtcggcgtcagcgtcccccgcggggcgctctccgccgccttcggtcccttcctcctcactcttccgcagcacgcgaagttcgtccccctccagaaaggacagttcgtcctctttctccgcttcatacgaataagcagcgtacacctgccaaa

SEQ ID NO: 19867 - DNA, 898 bp, Heterodera glycines
atgtatccagtaaaaaatattaaaaatcataataatgatgcaataagtgaatttctatagaaactttaagacagcccacagttaatcccaaagagcgggcacataacaagttgaagttaaatgattttaaaattataataagtgaaataatttaatttaaataatttttacagaaaacacagattaattttgatgaattctaatcgaagggcaataataacatggaagtgattataacaattattaaaatcattaaactttcacaaaattaaaaattagcaaaatccagagatacataggaattaaaaatatttacttaattgaaaaaaaactcaaatttgttttttaattttataatgaaattttatttaaaaattttatttttttaattttataaaataatctatttaaaattaaaaaaccgtgccctacgtgagcaatttaatatttaaatcctaacgtatcattgcatttatatttgtataacaattatgtaaataatattgttaactaggatttcttttatttataatttccattttttcctgtttattgaactatttgtcgttttttaatgatataacatgccaatttttctcatcaacgatggtctttaaaaatatgtcaaattttaacaatgatcttttttagaattaaccagaaaattaatatttaattaattttattaagaaaagttgaaatcgtttaaattagggttaagccccgagccctcggggggcgacatgtcgggggtcgggtcgggggggagctcaattgtcgggggtcggggaccccgatcgggtagtgatcaacaaaattttttatcgacaaactccattttttggtcgcaaatcttccttttttcactttaatcatatgattgcgtttttttttccgt

SEQ ID NO: 19868 - DNA, 1342 bp, Heterodera glycines
caaagaaaacattcaatgtccaattaattaattaaggtacactgctatgtgatgttcagagccattgtggtggcaaagttcgaggaggaatttgtgaggacgggtgccacgccatcaagtgggaacagaaacggaggagggggccaaaacaaccgattgctcagacgcatttaggacaaagcgaacaatggcataaataaaccgaaaattgttttgtcagaattctcaaaaatggaaacgcaaattccaattgtacaaatacgaggagaaaatctcaatagattatgacaaatcaacaaacgaatcaatcaacaacactgcttcactttaaaacgaacaaacgattttagaaatgataatagccgggcaaaaatgttaaaaaaatatttggtcgggttgggaaagaagtgatcagtctcgcaatcagtctgatcggtcctcgtccattcactcattaagcttggataatagttccaaaaggggcattgggtcgggtcgggggtctcggggtaggggctttaccctctagtttaaatatatgttttattacaaatataatttgttcgacaataattatcaatttaaaaaattaatgccacttaaattcaatttgataaaatttatttgtattaaactttttataaaaatgaattatattttttagaataaatatatacctaatataccttcaactctaaatttatttatttaatcttatatttggtgccttatcacgaatttaacgtgaccttttgtaacaccttgcagttaccattttattatagccttgatattttgccacattttattgtttcctatcctgttactaaatgatgtttactttgaccctttgtcttataatattttttaaatttcaagttataaataattttttcattataatcaataataatttttattgaataaaccaaattaaaacattataaaatatattttttgacttttatttatcaaaataattgttattataataattgctcttaatagttgaatttaattttattatctaattttctttttaaatatttgaatgaaaattttttgattttttattagattatttatttagatatttagcatttactatattcttttttttcacgtattcccaagctatactgattatcttttattatagatagttaaaactgatttattgttttaatatatatttataaattgaagaatatttttgcctcaggcattttttctcgctttcccgccatcatttctttttgtattcaacattttagtgaaaccgtttttaagcacggcattcaggaaactttatttgtaaaaataacatcaacttttaagagca

SEQ ID NO: 19869 - DNA, 2026 bp, Heterodera glycines
  misc_feature (101)..(101): n is a, c, g, or t
  misc_feature (139)..(139): n is a, c, g, or t
agagtcatttatgacgggtcacatattttgacaaatacacattcgtttttgcattacaattaaatggatgaagccattgatcgcaaaaggggaattctctntagtccccaagaagacaacgcgttaatctcggcttatnttgctcgaaaatccataatcgaaggaagtttttcggcaactttaacaacaaaggaaaagaaaaatgcgtgggatgaagtcacacaagcagtgaatgccgttgtaagaaaaaaagagctaaacttaagcaatattctatgggtaaatttaggacgctcgatcagtgcgtgatcaagagcaaattaagcaacgctacagaaacaagctgaagcaatacaaaaacttcattgctgaaacaaaaatgccaccaactggtggtgggagaccgactgagcggaagcctttttttgatcaatttatggcggaggacacgcgaattgttggcatcattggcgaaaaccctattgaactaggttaaatctcaatcaattgacatttttctaatttataaattggcataggggaacgccccaaatcatctcctgcaattatcgactcaagcttttgctccggatcggagacttattctgctgctgctgttccgccatcatttacagatttgacaccgattcgtcatcaatcgggcggcgtgatcagtagcaaaaaacgaaaattttctactgcttctgctgattacatgtctgccgaaagaaaagaaattgtggaaatatttccagcagcatcatcaacagcaactgcacgcgatttacagattaaagtgcttgaaaaagaaagtgccaaactggatttggaaatggagaagcttaagcttgaaatagagcttttgaagctgaaaaaggatcgagaaatgcgccatcacttgggatataatattgaggagctttaatatatcaatgttcattgattttggatatattattccaattacaatttcgttatttcgttaatgaaataatttttaattccgtaataatttatatcatagacaaaaataaaagtcagattctttttctgcatgtaaaattaccctagaaaaaatttatttatttattttactatttaaattattaaataaatttacgttaaccacaactcgagttgtggttaagattccttaagaaagattaaaccacggttagatgagcataccggttggaaataaaccacggttaacgcaagttaaccgtggttaagcagtcagtaaaccacggttaactcaaccgtggtttagccttaaccacggttaaaaagggaaggacgagcataccggttaaggattcttaaccatggttaacgccgttaaccgtggtttaactctaaaccgcgagacgagcataaggcccctgaattgagttatgagtttccaaaaattatttcccgggctcaaaaaatgttccaaattttctgaaacgtaaaacaaggttcattccgttcaatattttaaggattttgtcaatgtctggtaaatatttaggcatttttctaacttttcatgaaaaattcagaaattttttaacaaaaatgcaataaaaaatgattttttttgaagcgataacatttttaggcgaaatgttcaaaatttttctgtaaataatcggtcgaaaaataagggactgggtcgttttggcgccgacgttttggcgccagcctcagtttttttattataactttttttcttgttgaccaaatctaacaatcttggtatcattcgaaagcccttcagaagctctattagccttacaaaaaacaaacaaaaattttagcttctaaaaaagttattaagaaaaaaactcaaaaatttcgacttttttggaatttcatgttataacttttttggtaattgtctaatcgcgaagcaatagcttagaaatagcttctaaacatgttcagctttcgaatgataccaagattgttagatttgatcgacaacaaaaaaagttatagtccaaaaacaagggctggcgccgaaacggcggcgccgaaacga

SEQ ID NO: 19870 - DNA, 2293 bp, Heterodera glycines
ttttccgtgtattttgtcgcaccatccagcaaagtatcgccacacatcgatgctcatgccgacgtgcgttttaagtgccaaagtgtaaacggcgccgctgtcgatggattcgatggtggccaactcagtccgatgttgatccattagatcagcgagtctgacagttttcctcggtcaacctgtccttttcttgtcgtttcacctgtaaaggattttcccacgttctcgtgccgaaatgcgtgaccattcgccgtggtaaaatgcctcttcggcacatcgcactgcaaagtcaacatcgccggcatctccctgaacggcatttttaaattttaagtttggcgctgttcgccaacttttggcactgtgcatattgacttttcgttgctcgggtcgatggtttgcattcgtcgtgccgaattgctctcacagaatttgccattgatgtacatttgcgtgggcacgcatatttttgtgccgttaaactccgattcaaactgaattttgatttgaatagcattgagttgcttcatttgttttgctttaccttttcaaattccaatctctccaaatcttctcccctaattttgcgtattattgcgattagaaagtcaccgaattgggagttcatgaaaatctaaaaaaataaaaataaatttggtaatttcaattccgagatgacttcgccgtttcgcatctcaacgccacaaactgtgcgaacttcttccacaagtcgcgtcacgtcggcgctggtcgccccggcgtcgaaaaaattcatttggtcgtcgatttgatcggacgccgagaaattcaaaatgcctcgccaaatattcttaatttatttgttagtttttatttaactaaataatcagtgccttcaacgatggcaccatttccttctcctctttgctcatttccaatttttcctccgcaatttcttccaccattccataatttgctgctttaattgtccgaccgtcattcattcgcattgtgtctacgtttacctattagtttttttgtatttttataattattttatttttttacaaattttccatccgccgttctcaacagaatgccccgggggtgtgcccaaagtttgcccccgggcacttcttccgccggcacttcgcgcgccgtcgccggtggttcgattcttttccacaatgacgagccgaacaaggtgactttttctccattaagacgagtccacgcctaactcaaaatcagaatatttgctaaattcgaacaaacccccggcacggaatcattccctctgataaaattgtgcaattggcgttgagtgccaattttggaccacacaatttctgccaattcgggctttgccgtaatgaacggttcataggaagcgccttccgtcggttgagggatttttggcgctttttcggcagcgattaaattcactgattcgacctcaaattatgtgaataaaatgcaaaattattcattttacaggaaaacacaatacagtatgcagcactaaattaactttttgttttgttatgcaaatgcaaattatgtgttaaatgccaattcgaaaaatgccgaccatcgctttgaccccctcggggaacaaaaagcgtttgtaaagagtgttcaaagtgtcggtctcttccacggcacacttccgctgcagcagaattggccccgtgtccaatccttcgtccgcccaaaacaccgttagccccgcctcttcgtctccttcgatcaaagtccaattgatggccgaagcacctctgaacaattccaaattcaaaaaaggaaaacgggtaaattaaattaaataaattgcctatgctttggcagaatcgacggatggtaaatgatggttttgtgcctgggaaagtccatcacttcctgcggaatgaattgggtacaaaaagcgacgacattcacttcggccgcgtactttttatactcgttgaaaagctaaaccattcaatgattcttttccatttgtgcttttcctcccaattttcacctcattttccaactcaaatttgcccgtttttttgttttttcttcgccaactttttgttttcagaattggctttttgtgtttctcggcctccagggcttaaaatttaattaaattctttttactttaaaatatttttgttttttcttacctagtaaatcagcccggccatttttgtccaattccgtgcacaccaaaacaatgtcatgccccgaactgatcaattgacggcacacttccgccccaaatgcttgttttccgatcagacagattttcatttcaaattcaaaatgg

SEQ ID NO: 19871 - DNA, 1600 bp, Heterodera glycines
agtgggctcgtctcggcaacaaatgatgaagcaatggtcgcccgctttctcttcccttgaggggatgttttgctgttttatctgtgtcactctttttctctcccttcaaaaacccacacactctttccttttgttacgcttctctgttccggtgagtgttgccttatgtatgcctgttctcgctgtctcactttctttcgcttctctctcgctctctctcctctgagttgggtcgtttcagtgccggtgtttcagtcccgttttggatagtcattttttcttgtcgaccaaatccaaacaatcttggtataatacgaaatcttagcatttctaagctgttcttggcgaaggtaaagtgtcgggttccaaatgccggtaccgaaacgaccgcaactcttccctcatttaggggtataaaataacaaaatttttgaggaaatttttcatttctcaggggtgtatttttgaaaattagacgaaatttatgtaaattaatctttatattcgggttcggggtccaaaatgggtgccggattcgctgcaaacaaagtgctggacacattaaggctgctaaatttcccgacacgaggaccaagactgagaatcccgagcagaattactggacatttgcaatgttaaattcatttcaaaaaatttttattttcgaatatacttttaattaaccacaacttttaaaaaaccaggtatatttaggctgcgtaggctgcgaagtaaaagaatttttacttttttttctaaattagttattgattttaaaaaatttgagtccaaaaatatttgagacggaaccggccctttgagtactaagacggaactggccagacggaactggccagacggaactgacccctactggtatatgaaacgaataaaatatttcatctttatttttattttaaattggcacaatgtcaatatttttcataaaaaattcttattcataagtagggctgggatttttatgtgctaaaaatcctgaaatatgtaataaaatatgtgctaaaaaccaaaaaaaggcctaaatatgtgttaaaaaatgcaaaaatatgtgctaaaaattggaaaaaccaatggtatttttgcataagaattccaaaaaactcattctttatcattttcgcccgcacaattgcaaataaaaaacatttggaggtgtttgggggtaaaattagtccttttttgataaattgtttttaaagataatttttccatcagttgagtaagtgccagcaagaaacttcgatatccagtaacgaattaatgaagaattcgattttcggtacacgaaataaataaagaaaattttgaaagagcctataaaaatggcaagaaagatgattttttggggtgcatttttgaattttttgtgtttttcttagatatttttttcaaaaatgccaaaatatgtgcaaaatatgtgccaaaccccgaaatatttgcgatatgtttttatgtgcgaaaacgccaaaatatgtgtttttatgtttttataagtcgctctaaatcaaaaattgttcggagaaaatgctatttttgggcttctctcgccataactaagccgcaaaaaaaatatgttaaa

SEQ ID NO: 19872 - DNA, 2486 bp, Heterodera glycines
taattactgttttttcattttttccagaaactttttgcaaagtcttcccccgggtctccaggcgcagatcaacgcggaaaaggaccccgagcggaagaagcaaataattcacttagttcattcccaaagacagcaacaggtgggagaggggtggggaggacaacgaatgtccgacatttcttggcgattatttcagcagcaaatgtttgagcaacagcagcagcagcatatggcgatgatgggtgcacagggcggaacagtgcacaatcagccggggccaatggcaatgcgaccgatgagtaagcgctttttaaatcgtcaatatttgataattccttaaatttgattggttgtacatttttaaattaccgttgtttaagctgcgcaacggatgcccatggttcaacccgcgaatggcaccacatcaattatattcgcaaccacaacaaatgcacagccaatgccgcaacagtcgacccaaaatgtccattttcagtcagtgatttttcaattttccatgctttttcccagaatattcacgcatttttaaaagctttaatagccaacttcgtcagaaatgcatttggaatggaaaaattttttgatttccttttaaattttccgtttacccaccccccccccccccgcttcagacgcatccccagccaaagttcattcgtcacccattcgtcctcccccactccgatggccactgccaataattatcagccgcgcgtttcctctgcctcgtcccatgctccacaaatgtttatgtccggtcagcagcagcaaatgccgggcggtggcgcacaaattcgcgccgtgacaacgacggcaccggggacagtgaaccaatcgcagcaatttgtacagcaacaacaacaagtcagttgtaaaatgaaaaaagcattgaatggtttggcaatttttaccatggaattgctgggctgacaaaagaatgtccatgagaaatttggacccacaaaaatcgttcccccttttgagatgagtcagcaacaattccatcggcaacaacaacaacagtttgagcaaatgtccgttcacatggcggcacaacaacagataaagtctgacaacggcatggtcggcagttaccaaattgggacccctacggcaccttccgccggggacagtggcgccgcctctcaaaatcgcatgacaacgtcgacgattgttgtgaagacggaaagcgggcttacaacagcgatggggtcgacgagtgttcgaactccggccggaggtctttatttgttgttatataatgcccaagcttttctcaaaattttgagaaaattaacaaaaaaaaatagagggatgggagcgaattttagggttgtttatgacaattcaaatacgtaaaatcgggcaattttctctccgctcgaatttgatatttgcaatacaatctgataggttgttccctttttaattgactttccgaatttcaatttctgtcctccattctcttcatttttgcatttttctctaactctcgcttttttccagccatcgatggtccgccttcggccgactcccatccgccttcggtgggcactgccaatggcatggcgacgggtcgtccgggctctgttcagcaacagttcggcaccgccgcttcgcaagtggacacggaggagcccgagtacaaaatgttgctgaaaaagttgtgcaaataccacgcggatgtaaagcgactgttgggccgtttcgagttggacacattgcccggggtggagatgaaaatcaaagcgtcactggtcaacgtcatccaagtgatggaaggcacgcggaagggcgggtgcgtttttgaggggaccggggagggtaattccccctttcaaaaatgaaatttttattaaattttcggaaatgaaaacctcataaacaaattttataaaattacaaaatttactttttcagtccggtgacaaagactctgctgcaaaaattgctatcaaatgtgcagacagtgctcgaacgtcaccacatttcccgtcatctgttcagcatagcgaagaaactgagcacattggcacctccacacaacggcacaagcgcaaacggtggcggagggacgacaccaacgacggcaccaaaggaagagccatttgagacggacccgtggcgaaatgttcgacacatggccataaagtatgaattctcatcgattaaacatttatcggaattaagaaaaggttacaagagtgactagtccaattgtttctcacttttcagattgcccgatgccgtgctgaccattttggaggacgagaagaagagcacggcagcagagaaacaacagaaaaaggccgacgacggtgggcaagaaacggccgattctgagagtggcgggaatgagtggacgggtcggaagcgaattcgacaacaaaacgagcaaaaggaggacgagaagggcgaaggaccaccgaccaaaaagagcctttggaaagagggccgaatgtaat

SEQ ID NO: 19873 - DNA, 2469 bp, Heterodera glycines
tcatagaccaaggcgagaaagaggtgattattcctcgccaatttcaccgaaattactacaatacgggccaaattgcgtgccatgatggcggtgcaattgcacttttggcatgccgaaaaattccgcataatttgtggccaaattgcctatgtggcctatctggtccaaaagaagagcatcccattcacattttggcgatcgcccacagaatgttttttaatggatcgcgaggatattttgtcctcaatgcgtacactactcaaaccttcccatttgaactttgtgatgagccgagtgatcggcacagtatgggatactatatcggatacggtacggcaaaagcgtggcgcgcttgcattgctggagaagctaattgggggtacagcactggttaaactgtgggagaacaaagaagccagggcgaagttaatggaggcaaattgtaagtgaaacaatgatggaacatacagacaaaatcaatgcacactgtcttcaacagtagattaggaaatagaatgctattagtacctcaacaggaagaattttggtttgagcttaaagtctgtattactgtaccggatcttttgtatttaaaaaaattattattggatattaaagtattggttctggtaataacaacccaatcctgtacagtaacaataaatttgattttcccatccgtaaaatttttaggccttttcaaattcctgtaaaaaatgacatataaaaaatgccatttaaatacttttttctccattttagttttcttcgacaaaaaccgactcgttgatcattatgtcagcattttgttgaacgccaacattgtgcctgattccgttgatcggatgcgccgcgatataaaatcggctgatctgatcgtttgggcccaatggttccaatcactcattgagcagcagcacaagggaaaatctcggtattccttacaccgggactacgtttggatgtatttacgcattgcgtacgacatgtacgacctcggaacggagaaaagcgaatttgaacacacttttaccaagatggaaacaatgatgagaagtaattagcggggatttgattgattgggatttatggaatgaatgaactaatgagagaagtaattagtggggattcgattgataggaattatggaacgaatgaaagaaatgatgataagtaattgttgatcaagttggtccctgattttagtcgtgaaatagcgattgataaggtgacccgaaaattgagcaccggaaaattttcttgggtgtctaatgttccggtatccaatgtgagggggatgtatctttaaatgggtatccgtgattttgtctaaaaaagcctttgtttaccttagaacaaaaaagtcctaaatgattcaataaatttgaagaggctaatcagaacggaaaattaataacatttaaaacttgatatagaggtgtagcaatacatccaaacatgataggtcatacaatacttgaacataacggaaaaaagtttagaaatcaccaaattactcatttcttcttctgctggtagtcgaggttcgctgatgggaaaattgcgcgaaaaatgggatgaaataattatggaagtttttcctgggagcaatttggaattggaagaatccgtggaacaagaaatggatataacggaatttatgcaacagcttcaccacagtatgatcagagaactttggcaaaatattcataagtccgatgcaattgttcagagaaaatttgaaaatataataaaaggtaaacaaaaactgggccaatttcgaaattttttggaaatacggaagcaacaacttatgtgaaaaaatgaaacaaaaaattactatttttcaaattaaatttatgttaaaagtgacaaaatttgcttcgctccaaagtgacattgacccaaataaataggatttgttggcatttatatagaaaaagccaatttggggggtgcacatgatttttgagtggaaaattttttctcacaaaaatcttccaaaaatatgtaattaggggttatttgggccgctgatcacgaatacgtgatcagattttacttttgacatcgtttaaacctcagaatccctgtgtgattggggattctgagacatcattttgaggggggggggggggaagttcggatccggacggtgtaacattatttttctgtgcatttttacgttattttcaatgattttaattaatttaaaatattttgttgagttaataaataaaaaattatatttaatttaatttttttttgataaataaattttataagtttaaattaattatttttttaattgatagaatttcatgtattttttaaattaaatttgttaaaaatattttcattttaatttaatgaatttactaatcactgttgtatcaatttatatttaaagatttgttgtaaattaataataaaagaatttatttaaaaaataacaattatcttttaata

SEQ ID NO: 19874 - DNA, 1940 bp, Heterodera glycines
agacggaagagaaagagtgaaaaaggaaaaattcgaagcaagaaggacggggagaaagaggaggaagagagaatgaagcagaaaagagggaggaacagcagcaaatcgacactttttgattttgccggtgctaatattgctaatggatgtcgtaaatccccgtcaaaatcctgaaaactacacaattttcgaaagaaaaatgcattcattcgattacacataggcaaaaaatttatgttgtggcgtgggttttgcaggagcacagcttgttccccaaatcccattaacgattttaaaaaaatcattaaatttctcagggaatttccggcaaattcaaacaatttattacaaatagagattcttagaccccctaagaatcggtcggggccgttttcgcgtgagtagctgtttaggactgaaattggtcggatttgtgcaaaacatccatgtttcgaatccgaacccgcattcggacaaatttattaactttttaatttttttatttcttgcggctaatatcttctacagtaatttgtcagtttggtcggatgtgcgtcaaacggaaaaaatatttaaaattttataaaaatataacaaaaaataacaaatttcagaacaaactaaggtcgcatttcatagtttcgggaaacaccagtgagaaaattgataatgttttcgggattcacattggcattggcataattgtgatcattttgggggaggtgaatgttattgatgtcgttatagagtgcgccgtcatgttctaacttaactttgtttcgttttgttttaattttttgctgctggtccatattatataatttaaatgggtcggggtcacttcggcgcggaccatttcggcgccgcaaattttgaaatgctataacttttttatttgtcagttaactttagccaatctggcatcatttgaaagctctatgtgtgctctatattcacatgtcaaaatagaaataaatgattcaaaaataaaaaagttatggcacacggcgccgaaaaagccaagaaaaagtcaatttttgaggttttttggccacaacttttttgtaaactgactaaattttttgaaattttgcaatctaatagagaatctcaagagctatcgaatcaaaaatatttaatttggttgataatgaaaaaagttgttagcaacggcgccgaaaaaggccggcgccgaagtgggcggttcccatttaaatagccttaatttagtttataaatagggcccggatttttatgtttttacatattttttttgcggcttagttatggcgagagaagcccaaaaatagcattatctccgaacaatttttgatttagagcgacttataaaaacataaaaacacatattttggcgttttgtcacataaaatatgttagcacatattttggggtttggcacatattttgcacatattttggcatttttgagaaaaattgcaataaaaatacaagaaaattgaaaaatacaccccctaaaaatcgacttttttcctaattattaacataattttcaaattaaaaaattttttcttcgattgtagaaactaatgaaatctcgaattcattaattcgtcattggatttcgaagttctctgctggaactttcaatttatagaaatgatttatcaaaaaaagacaattttaccccaaacacttcgaaatgtatttgatttgcgttgtatgggctaaaaatgataaagaatgagatttttgggaatttttatgcaaaaacacacttattttttcaatttttaacacatattttagcacatattttggcattttttgggggtttttagcacatatttcagcattttttagcacatattttattacatatttcaggatttttagcacataaaaaatccggggccctatttataaactcattaattataaaataaaaactcgttcaaaaa

SEQ ID NO: 19875 - DNA, 1933 bp, Heterodera glycines
tataacttttttgtgtaattgtctaatcgctaagcaatagcttagaaaaagcctctaaacatattaagctttcgaatgataccaaaaatgttggatttggatgacatagaaaaaagttacagaaagttatagttgaaaaacatgctggcgcccaaacggccgcgcccaaacgcagtggacccaaatttaggggtgtaaaatatgaaaaattattcaaataattgttgcaagaggccaaaatatttttcaaaaaattttttaagtgctaaaaacaaaaacaaaaaaatgcaccatacatataaatagggcttcgatttttaggtttttacatatttttttcctgagctccccgtggcctgaaacgcacgaaaaacatgtttttttgggctgttgttaagctacttttcgagttattagcacctattttctaggtttttatttttagcacctaaaaaacctaaaaaaattttaaaaaacttattttcacctattttggcattttgcccaaaatttgttaacaaaaatgaaataaaaaggaaaaacagacccctaagaatcgaccgaaaatttttttcaaaaaatatacccctaagaatcgactcgaaaattttcaaaaatatacctatgaaaaaagaaaaatttctcaaaaatcatctccaaaatttatttgtttattttcttggcgagaattttttattttgaaaattatctatctcattaatgatttggcataatatttttgctttttgaagaaaattttcgattttacaccccaaattcggaactttttggcacctattttcccatttttagcacctattttgggggttttttagaacctaaaacctacttattttggcagtttttagcacctaaaaatcgaagccctacatataaaacatttctgacataaaacgagagcatcaaatcaaattcctattggtgagatcgcgtcgatcatttctcaaatataattttcgttgctttcatccgtttcttcgtcttcttcttccgctggtggcgacaatggactaaaattaattaattttttcattttttgacaaaatcaaacattgcttttactgcccacccaatgtaatcactgccagcccacaaatttaattcgacattgttcaaattttcgtcgtcttcccatttaaccgccgccgccttttcactaattggacatcgctccaacagccaataaatgttatcaccctctttcagtgtcagcttttctttggtccgttcattctccaattcaaatggcacgatttgtgttgttggccacaaaactccaaaacgaattgtgtaactaacagaagtggtggtggtggcacggagaaatatctaaacaaaaaggaagcgcaataaaaaagcaattaattaattagtcagatcgtttaatgaaaatatggccgacaacacacccctttgaaattgttgacccattcaaaatttgaaatttgatgctcacagcaacgcaatcgcttcggttgtccatttgttgtcggagtgtgcaaccattttgacaacgcttggccagccgaagaagcagttgcagtatttggttgcccatcatcaaactgatcagcaacaattacaccggggcacagctgatcggaaaacacagaatgcagtcgagtgcaatcagtgagaaatgtcggcgaaatgtggcgacacaaagtgtcaaaatggttgtgacagagaaaacccaaatggtgaatgtttgtcgcaaaaatgggccaaatttggcggacaaaaacatcccaaattggctggacgttggtttctgaattaaacaccgcatataaatccaatttggtgccacttctgtcccaaatatgcttgttggaacgaagaaaagtgagcacagaatgatcaatgtacctgaagaaaagaaaaatgctttaacataaacaaaaattaaaaa

SEQ ID NO: 19876 - DNA, 1083 bp, Heterodera glycines
  misc_feature (933)..(933): n is a, c, g, or t
  misc_feature (976)..(976): n is a, c, g, or t
  misc_feature (1004)..(1004): n is a, c, g, or t
  misc_feature (1028)..(1029): n is a, c, g, or t
ccgagcggttggcgccgcgaagcggcgccaagcgttctttaaattactaatatgcaatatgaatgaatgcgaattgtggaaatgtcttacaaaaaaaacataaaatgaaaacagatcgtcaaataatattttaaatggcgtcagcggtaacaataaaacaaacaacaaacaacttgtttttaaaggcaccttctgactgattatttggaacaatactatgaatcggctaaacatttgaccatgttcgctataagagcgtcaatcagggagtaaaccgttttttgctgttttttcaattttcgtgcctttaatcccttagtttttgcttttttcaattttttgtgtttttcctgcttattttggaaaaatttggtgttttttacagtgctaatcggtgatttttaggctgaaaaataagcactctaataatttcttaattgttagcccaaccaaccatttgaattctaatttatgggtatgtaaacccaaaataggaaaaaattttgagtgagatgagaaaataaattgtaaaatggctaaattttaagctgaatagatgaaaatgaatatatcgtctcaaatatagtacaaaatgaaagggaaattatgattagggatgcaatttatagttcctaaaaagtgccaaaataattattttttactttctaaaaaacccccaaaatggttgctaaaaataagtaaatagttgctaaaaacttccagatttaggggtgtaaaattgaaaattttcttcaaaaagcaaaaatattatgccagaccattaatgagatacacaattttcaaatccaaaattatcgtcaataaaataaagtagtgcatttttaaaaattttcgggttgattcttaagggtgtttttttcctttttattgcatttttgttaacaaattttgggcaaaacgccaaaatagttngaaaaagtttttatcaaaaattttatagttttttagttgctanaaataaaaaactggaaaatagttgctanaactcgaaaagtagcttacaattnnaacacggtcgaaaaaaacatgttttcgtgcatttcaggccacggggcgctcagg

SEQ ID NO: 19877 - DNA, 880 bp, Heterodera glycines
  misc_feature (835)..(835): n is a, c, g, or t
  misc_feature (850)..(850): n is a, c, g, or t
ttttataattaatttatttaattgttattaagcaaattaaacaaataaaattattttataattaattttttttttaattattaagcaaatttatctcaaataataaaacatttgtataacattcatagattaattttttttgacaaataactagagaaatctcgactgtaaaatatttactcaaattatataaatatatataattttattcatattttaagcaaaaaagcatggatggcggtttttatgcaccaacatctttgcagaaacagaatttgctctttccgatatgattgaaactattggaattttttattaaaaaaatttacgacgattgttcaaaattaatagattttttagtacccaagaagtaaaactcgcaaaaaatttactcagaagaaattctttggcgtgccataaagccgcagtccaaatggtaggtcgttaatcctatagaatgactaaaatatggattatgactcttaacataaataaatgtgatggaatttttgattataatcctactgctgatgaaccagcattttaaattattagctttattatttaatattataataagttatgttaagtattaactagatttggataatcctactgcattgattgaattaaatgcttgattatagattatatttattagggatttactttaaataaattaattataaaataattttatttgattgatttgcttaaaaacatttaaataaattaattataaaatttttgcggttttcgcgcaatgacgcggcaccatttggttgagaaagaaaaaagttatggtccaaaaattcggggctaggtcgtttcctanaaccgcaacaattgngcgtttcctaaaccgccaagtggtaggaaa

SEQ ID NO: 19878 - DNA, 1410 bp, Heterodera glycines
  misc_feature (51)..(51): n is a, c, g, or t
  misc_feature (127)..(127): n is a, c, g, or t
cgtgtgcggaatataaaaattgcatttttagtcaagttttaacgcgtttgncatgcatgatttaataaaattaataatttgttttattttactagctgtgcaccacaaagttttggtatgtatgagnaataataaaaatttaaattctttataagtttataagacctttcattttcatgtaaataagtgatacattattttatcagcaaataattgaccaaagacaatgatagtcatatttttgatccgaaaaatgattaatatcataaatataaaattatttcaagaaattctggttgctaaattcggaaacaaaataaataaaagtaataggcaattttactttataaatgtaacattatttaaaactgctaaaatcgcaagaatagatacgaatattagcttttttcgtgtgcggaatataaaaattgcattttaagtcaagttttaacgcgttttgcatgcatgaatttaataaaattaataattggttttattttactagctgtgcaccaacaagttttggtatgtattgagaataataaaaattttaagtctttataagtttataagacctttcattttcatgtaaataagtgatacattattttatcagcaaataattggaccaaagacaatgatagtcatatttttgatccgaaaaatgattaatatcataaatataaaattatttcaagaaattctggttgctaaattcggaaacaaaataaataaaagtaataggcaattttactttataaatgtaacattatttaaaactgctaaaatcgcaagaatagatacgaatattagcttttttcgtgtgcggaatataaaaattgcattttaagtcaagttttaacgcgttttgcatgcatgaatttaataaaattaataattggttttattttactagctgtgcaccaacaagttttggtatgtattgagaataataaaaattttaattctttataagtttataagacctttcattttaatgtaaataagtgatacattattttatcagcaaataattggaccaaagacaatgatagtcatatttttgatccgaaaaatgattaatatcataaatataaaattatttcaagaaattctggttgctaaattcggaaacaaaataaataaaagtaataggcaattttactttataaatgtaacattatttaaaactgctaaaatcgcaagaatagatacgaatattagcttttttcgtgtgcggaatattaaaattgcattttaagtcaagttttaacgcgttttgcatgcatgattttaataaaattaataattggaattattttacttgctgtgcaccaacaaagttttggtatgtattgggaataatacaaattttcatctcttataaaggtataagacctttccttttaa

SEQ ID NO: 19879 - DNA, 2457 bp, Heterodera glycines
atttttcgtcgctggaagttgcggccgtagtgatctgcatggtttttttgatgaacttgagaaagcggccggttgagtcacgccagcctgttgataccttggtagaattgaataatccaatttttataattttttgtaagaccaagacggacaagtcatgatgttgctcagaacgagtagtatggaagtgatcagaagccgagctacgactataaataggcagacttattttaattgtgatgttgcatgcttgctatttaaatatagttgtataatatttggcttttttgcacatgaattataagacgatattggattcggctaaacttggtatagtcagcccccgggaaaagtcgattggcacttgcaaatttaatgtttttcatagtgttgcgaagtggataggttttgggaatcattagaatgaacacggcgagtcaattgtgggctccaagtacacaaatatatgtattataaatagattgttattcaattatcaattgattatttaatttaattatttaaataaattttccgtactgaaataacccgcctcttccgatcatccctcatcaatacttttgacacttcgccacatcgatacttttgacacttcgactcaccacgaactcaagggcttcagaatctgggctggacgtaattacggattacggaaattacggactttttggagttacggattacgggttacggatttttgggattattccgtaattttgatccgtttccatgcattttctctcattttttatttatataatttaatatcaattgttaattgcaaaataaaatattatttattctgttttcatgtttaatacagcgaaaagttttcgttgcatcttatatccttttctgttagcctaccaatggtaactttacagacttaaattttggaataaccggaatgttgtgacctaaaaatacggtacttggactgggactgactgggaatgtttttaagaaaaattcaaaaaattaattaataaatgaaagattttcttttttgtcttcattatccaccattctataacaattttaagacattttccttcatttgtgcgacatccaaaatttactttttttttcttcatatttacaaaaaagaattaaatgttaaatatatggtattttaaatactttgattttaagttctattgttaagaaacttaaagatatttttatttaaaaaatgtttaagaattactatttttattacaaattttaataaatagaacttataaatatttactttaaaattataagcaaaaagcttttaaataaaatattagtaaatttcttcctttatttaatttgtaattctcggttttttttcatttacttcactttaattcaaaaactcgatattttctcaatttaggttttaatgattttgcattttttttattcgccttttttatttacattttttacatttccttgtaaattattgtatttagtgaattatccggttttagtcaaaattaccaaaaatggtttgaaattttgttatattaatattattataattatttcgtattcaacttgcaaatttttaaaattatacatttctattatatttagattttctcctattaaataaatatgtttttagttaaattggaatataattaattgttgcttaactcttgtttttaagtcaatctcacacaaatttttaatatcttaaaataaattttttaattatcatttgtaaatgtttagatatagggcgcggatttttagggacgaaaaagttcaaaatagggccctaaacatgggcaaaaataagggcgaaaataggggcgaaacgccaatataggcacaaaaacttattttaggggcgaacactcaaaatagggatttctagggtcggataggggcgttaaaacgaaaattttcgaacaaaaaatgtgtttttcgtgcatttctcgtcgagttaaagccgcagaaaaaataagatgaaaaactatcacaaatatcgtgcaaattttatttgaaaagccgatattattttcgttaagcttttacatttaaaaaatttccttatataatttgaaatatttttaaattaccaaaatataaaaataaatatttttgggatcattcgccttctaatttcttactcgagttgttgcataccgtcactacatcataattaattattaatgctacggttccatttttggtttaaattagagtgtctaaaccgggacttttcgggttgaaaatccgggacttttcgggttaaaaaaccgggacttttcgggttgaaaaaccgggactttttgctgggaaaactgggaaaaaagcgggtatttcccggtcaaagctggtcaaaaccgagacctaggtactcagttgtcgcgctattttcagtaccagtctcggtccagtaacactctagtttaaattactattatgtacattatagct

SEQ ID NO: 19880 - DNA, 1397 bp, Heterodera glycines
cccaactgagcggttccggttttttgtttaccattttcttcatttatttttttgggataaatcgttgcatatatatcagtattcgagaaaatttaaaattaatgccaaaggacaaaaatgtaaatttagtggcaacagaaaatctataaaaaaataaaataaaattctaaaagccaatttatttttttaaagatttacaaaaaaatgccagggcttcttggatcaaaaatttaatacattgaactaattggttggaaaattttttgcgccgcgcccgatctttagcagaaaaaactgatgttttcgaagcaaaagtttcgcacgtccctagcggcatgctgaaaacgcgaagcgattctgaacgaacgtttaacatatttgtgtaataaaaatatatttagctgttagtaattcttggcatttttctctttttttcaaaataaggaaattgattatgtgttgtggtggcgatgaacaaagtgcgaaggaatgaatgaattggatgatggaaaatacaggcacaaaagggctgattctcaacagaacaatgctgacaaaaatgaatggaaaaaggccacaattattcaattgatggggaaaaaacaataatagtaatgataatgacaggtgtcaacttcacaaataatgaggacagagtcaacgttcacaaagaatgcgctttaacttatcgataactatatagtatatgtataaggcatatgcgaatttaagtgagcagatttacgaaaagttcggaaatcaaatacatatttaattaacccattattattaaattaaaaaatccccttttgtgggaaagacggattgatcacttaaacactggcaaattacaatgaaaaagatgcatttgtatgtagcttgtttacaatagcttatatagtgtgtgtgcttttcactgtttctgaacaatcatttttgggctaaaattgatgcgaaaatgtgacacaaaaccaatggaaacaaaggaaggaatgatgcgtcaaaataatgtgataataaaaataataaggcaataatttctgcaggaatttttttcttttttttgccatcattaatccatcaaaagtgccgttgatgactgcctccgctaagggaaaactgctgatgttgcggcacggccgggggacaaatgccgccaccgccgttggacgacgacgaagtggaggtagatgaactcattgctgccgcagccgctgtcgtgccgccgtccgcgccgtagaagcgctcctgggtggccaattcgtccgcaaattttgtctcaagtgtctgaaattggcgtcaaacaaattttactaattccattttcatcattgaatatatgatgaatgtttggcgcctggaaaaatagataaaaaacttttcaatttttttttggt

SEQ ID NO: 19881 - DNA, 1190 bp, Heterodera glycines
  misc_feature (1111)..(1111): n is a, c, g, or t
  misc_feature (1133)..(1133): n is a, c, g, or t
catcatcgtccgcgttcttcgcctcgttgcgcaacactttggggcaacgccttgcggtcggcggtgagcgcgcgcaacagctgttcctccttggactggttgatgcggcgcacgtgctcctgttccttggcatgccgggccaacatgtgcgtccgctgtaagtggaacacgtcctgcggggagaaatgatttttaaaaatgaaaagttggagaaattttttgataaaatccaaaaaaacataaattcatgtaaccgcatttcttgtatttataatctgctgtacttattgttattataaattttttgtttttaaaaactgaaaaattttcctagcggccggcgcctgttggcagcgccggccttaaaattcttatttctattaaaaaaaattggctcaaaatcgcaaaatttgattaatttttggtgaatctgctaaaaatagtaaaaaatttcaaatttttcccagcggcgcctgctccaaaaggaaaaaggatcttttgaaaagaagccgagtgagttacctgataaaaaaacaaattgacaccattcgcataatttgacccatcgcctcttttttcatgtaagaggggactgttcccgatgcttgtctcgttgtctccttgttgaacaactcttggtatctgcttgactcaactcacccgaaactgttgggtgagcagcgcgtgtttctccgccaattgcgcctcctccaactcccacagcgccgtctccatgctgcgctccagctggtgcttctgctccaggaactgcttctccagcaggcacagcttctcccggtgccggtcccgcgcccgaagcagaaacacttcctgagagcgcatctgttgctcaacaaagtcggattcctggggaacaaagtgaaataatggacgaacggacggaaaaaaatacaaaaaaggttagccatgtttttcaaaaaaacaattttttaaaattcacactttttcgcagtggcgcctctccaactgatccttgcgctgcctgaacacggttttgcgctgcgcctttggcaacatgtccacttcctgcttcataattttctgctcttggcgtaaccgttcgcggaaaacgcccaagtcacgctcctgngcaaaatgcattagaaacatgnggcaaaatgcaggagaaaaaggggacttaattttataaaaaccataccatatcttcc

SEQ ID NO: 19882 - DNA, 1231 bp, Heterodera glycines
  misc_feature (1196)..(1196): n is a, c, g, or t
ttaaaaactgataaccaaaagaattcaaaaaacctccgctattcgaactaataaaaatttcaaaagacaataaaattttcattgacgcaatcttgaaaatcaaattttctccaaacaaatttcgattcagagcgactttttagcacctaaaaacacccaaaacaggtattttcgaattttttgcaactattttagcctttttccagcaactcaaagcaaaagtacaataaaaacaaaaaatacaccccctaagaatcaataccaaaatttatgaaaatgttaaaataaaccactaagaaatgaaaaatttctcaaaaatacacttacaaaaattattatttattttcttgacaagatgcaacaattatgcagccgaaattgataaaaattagtcacttttggaattttggtacataaagacactgaatttttccaatttttaaatgaattgtcgcacttttttggattctagtgcagaatacgcgtcccatcgacttttacgcgtcccatggacttttacgcgtaccatcgacttttacgcgtcccatggacttttacgcgtcccatgattttttacgcgtcccattgaatttttacgcgtcccataatttaataattaaaaaaaaatcgattaatttttaaattcaatttaaaattttttatttttatatgttatcacattaaatcatatattttagttacgatcacatcacacatttttttgtcagacagggtagttatggcgcatttcttccaaaatatgctgaaatatttttgtgttttgttgatatcgacgaaatgcgtactgaaacaaataagtaggtaaaagttcgggggtggtcccatgtaaatgtttcagactgcttgaaagccctccaggtagcctcaattccctgtgtatgtattttagggttggcgggatctacgaagtaaatttgatgatttatccactcgtggttgtattgctgctgcatattatttatccctccgtatgccgcccaaccatccgctactatcgtgctttccacctcaatattttcagcgataatgggcagaagagtgtctgcagaccggtcgggcacagggaagaaccggaccttattagaccctctttgaatcatgccaaagacccattcgtatgggcgatttaacattcgaccccgatggtattttgccctatacaccttggtctcatncatctcgaccaccgtaccaacaaacccctcctaat

SEQ ID NO: 19883 - DNA, 804 bp, Heterodera glycines
aaaatccatgggacgcgtaaaagattatgggacgcgtaaaaattcaatgggacgcgtaaaaaatcatgggtccatgggacgcgtaaaagattatgggacgcgtaaaaattcaatgggacgcgtaaaaaatcatgggacgcgtaaacgtccatgggacgcgtaaaaacgaaaaatactaaaatttaaaccctgtttaatattctattaaaattgttaaaggaaatctaaagatatttattgtgaaataaaaaactttcaggtaataaagcggcttaaagaaacaataaactaatataataaaaataaaataaatattttgattgataaaattcgaatccatttacagaagaaaaggtgtaaacccaaaaaataaatgtaaatgaaaatttaattacaatcgaaataaaaaattattaaatctttctatttaaaaaataatcaaagccttttgttaatataatttactacaaattatggtaattataagaacttaattttataattaacaaaaccgttaagtgatttattaagttagtttaccaaaaacaattaattaaaaacataaaaaaacaaagtatcaaaaaaaaaagaatttattatatatcggagttatttgtcataaatctcaaaaaatgtaattttctggatccaggcctgtttagaatttttagatgttcctatgcaattaattgttttttccaaaaattttatttagctgctcagcggccgcttcgcgccttcaatgaaatctaaaagattttattaattaaaaaattaattagaataaatcttaatcatcttttt

SEQ ID NO: 19884 - DNA, 1667 bp, Heterodera glycines
tatcaattttaaagtcaaaagaaattggacggcacaaaacaataaaaattaccagataataaaaattggaatgaaagatggaaaaaaaagaatacaattttaagtgagaaaaacgcgaaaaaagacattatgccaaatttaattaacactaatgagtcattataattaaaattctacaacacctttcaggctacggggagctcaggaaaaaaatagtgaaaaactataaatcgtagaaccctatttattacatatttcgagatttttagcacaccaaaatcccgtccctacttataacgttagatataactagggctgggaatttaagtcactaaaaatcttcaaaaagtcgactaaaaaagttataaaaaatcaccaatatgtaacaaaaagattcaaaaaagcacgataaaatgcaaaaaagtcctgaaattagacgaaagataaaaaatcccattaatatggtttatagaataacattttgatcagatttttggatatttaattttttaaaagctacctaaaataggcataaaaaagtgattcatccaataattacgaaaaatttcatccaggtttcattgcctttacaccgattaaaagagaaaaacccattaaaaaagaaagaattcattgaacgatctgatgaatttagaagtttaaataaaggcaaactgaaagaatttttaaatctgcctgttttcaaaaataccattacataatgaaaatttaaataacttataaaatcatctgcatatattttttcgcgttaagataatttgcgttagatttgttaagaaattttttttttggtaaattgtcagttttaaacatttaaacgtaagttagctcgaattatcttcaaaatttaaacggcgccacagtcggttggatgccgatggacaatttggccgagaactggcacgtggacacattatgttggcatgttgttgagcctttccaggtcgtgggatgcgggctttcgtccaatgaacaaatgaacacatttgctgtacattgaacagaaaatgcgccgtattcgctacgtacaacgtccgattcctgaatcattttatgaacaataagattcatttgagtcaatttttgcacgaaaccatggatttgttatgcgtagggatgtcaattttatgcaaatgcatatttttttcctggattctccatgctctaattagtaggaaaaacacttatctgaatagaaaattattatatgcttaaaaagaaaaacccttacttttatgatcatttggcagcatttgttttttccacttccaaaatgtgtcattggaaatgcccaattccttcgcaaattctatctgtttgccatgggcatataaacttttaaatcttcaaatcgttcaatgaatttgcgctttttctcatcataaaaattcttttttattttgtttttatttaaatttaattcatttttccatttttgtattaattgccgatttgttcctaataattttgcaatttttctctcaattttgctttgatctttgcttcggaattttcctttttctctcaatttttctttaattgcatcaaattttttaattgtttctcttttttgttgattaattggaccatttcccatttcttcacccaggtgatcaactcctgatgtgttttcattttgctcgttt

SEQ ID NO: 19885 - DNA, 1783 bp, Heterodera glycines
taaacatgaccaaacaaattttatttttttctttcagaaaaatatttttcgtggcttttcttgttaagcacattgaattttataaactgactaaatttcaagtcattacgacaattatgactgaagttatagactttggtataaaaaggtgaacaaatttagttgatcttgctgatttgaaaacccttaattttttgtaaacataacatagttaagattttaagagctcattctaatgaaaacattcagatgaacagaataacaatgaaaaatatcattaaaaacttattttcgcaaatttattttaacatattaactgggggtcattttttatgcaacgacctagtaaatgcctacaactttacctgttttttgagttttcctgaaaaattagcagcggtgcgtggacggcgataagtgttgaatgttgacggacgagagagtggctgaaggatctcgaaaaggagaaagccattagaaatcaacatatgttcatttttacattttgttgctgtgtaagcagcggcggcggaggcccaaacgccggctgataattctgtggcggccatgcgtacgccgtgggaccgctgttggcgtcgaagttggtgtaattcgacaaaccgtacgggcgttcagcactcacatcggtagagaaatcctcccctctgcgctcacggaaattctgttgattcaatgaaattgttaggtttcattattatacttctgcaaataaaaaagtttgactttttttgagtttctccatatcacccactaaaacagaaccatatattgtaaaagtacagcacaaccaaagtaagaatatttgtgaacttcttttgccgaattgattagggcgatgttcgacaaataaaccagaaaaaaaaacttccaacccccatttgtttattgcttggattagtttaattttgtaaaaaccgaataattgccgcttaatggtcgcaaatcgatgtgccgtggcggtgctccctccaccggttcggtgcgcaccaaaaggtgggaggaaggcgcgtccgactgctcactcagcgacaaaagttgggcccccgcgtttccgttgctgccgtccttttgctgcatttgcttacgttgctgtgccaacagctttttttcttcaagcttaaatgctaattgttgacaactttttgttgtttcattttacttttttgattgttgcgggtgtcgccatatgcaagagaaataaattcaaatagtttaactattttctgaaaagagaaataaaagatcaacctcaacctcaacatttaaaatttatatttattagagattgcatttttaagcaaatgcctaatctgtggacttaatacgctcacagaacaaacccaactgtgagtgttcaaatcactttaaaatcagttttatatgtgtagagaattagtggatttgctattcatggcaagtcaattttggcttccagtgtaaataaatttattttttattctaatcagaacgccaaaactttgcataattttaaacctcataaattacaataaaaaaatgtctttctctcattttggcgtaaacaaattttcactttatgttggaattctgtgcgggttcgaaatagatgaaaatggatatcggggtactaaaggtgttttttaaccctttaaaattttaattttttgaaaagggagataaattgcattatgtatctaaattacaaggggttctaattaactttaattacatgtaaatttataaagttcaatatttacctatattaatttgaaatatacaagtg

SEQ ID NO: 19886 - DNA, 2147 bp, Heterodera glycines
tcaccttcacttgtttaatgtttattcgcagcaattctcacgcaatatttgcatagaaatttttgaatttttgaaaaactatcgccatattttcatattatttttaggtcatgaaccgttgtaattataatcagaaaattaaaacatcgaatccattgtacggacgtggatattttatcgagcagaaggaatacagtaattctaacggttgcggatttcgtaaggcgaatagaccgcttgttccgagtaatgcggccgacattgagagttgggagccaaaggtaggtcaaatacggtagttttaagaaatgtttatttttttacaggtaatgagcacccaagaaattagcaaattgactgctcgttgcgtgggtgtcactgatgcgtttatcaaacttgacaattacgtggacagtgtgaagaagtacaacccgtcgaatcatgatttgcttcgggttgtgtgtccttttcactgaccatttgatcaaagcattccaagttcagatgcaacgaatgcagcaccagtcaaagacattgacggaagacccggacaaatacgccgaacttattgtccaatgtgttgcaaatccaaacaagtttaatgggactcgccactgtttggagcttgtcattggcagacgagcacttgaggaatttattagtcgcaacgaatggacggaggaaagactgaaggactacgacattaagtgcgtttggccatccgatggatttgtttagttcgtttctaacagactatcttaaaataacttttttttctaatttagtgcaaattggaagttcgagcccaatgagttgactgtcccgccgattcccatttacaccgggtcactttcttctgcttgatatatttgaccggttaatgtgactattgaatatattttcaatatttgttttcactttttgacgctcataataaatactttaaacgaattagcgatgttttttttttgttggtgttttgcggtaattttttcttctaatccatatcatttgcatttaatgacccctccctccttccccccccttccccttttttatcgtatcgggctgatgacagtcctttcgcactgtcgtcggacagtaaatacatatttcaccattgtttatttgtgctgatgacgcggagagtgggcgggagaaaggcaacggcagactttgttttgaagggccttttaaaagcgatggaagcgcagcgagcgaagggatgaagcgaaatggagccgatttcttttgtttgctgggcaatgaatgcaaaagaaaatcggccgccggggttttgggattagagaagtgctgcaaattgcaaatcaccaccagcagaagtcagaagatcgtcgcataagtcagccgacgagaggaaagggaactgacggaaagggctaatcctttatcatcgtcgagagtcattcccgaaaatattttctgcaaattcatttcgccgtccgttcgcccccggggggggggggggggttagtccaaatacttttgtgttctctgcgaccttctctctttctctgcactccctttcttccttcactttgcttttgatcagcggcggaggatgtcagttgttttctctgttttcgccgccgtcgtctgtctcggcctcccgcgaaaacgaaaaccacacattcatttacagcagcgcactgctgctggtccaaatcccctcactctctcgccgcattttttgtcaaaatcggctgaatattctcccctccctcccccattttttcgacgcattctctcgtctctctgatcacttttcccgtctgtttttgtcattccgatcagtgtctgtctgctttccctccaacatttctctccccctttctcgctctctctctctctccccctttctttctcccccctccctatccgttgctctctctctctctccctttctttctcccccctccctatccgttgctctctctctctccccctttctttctcccccctccctatccgttgctctctctctcctcccccaccccattccaaccactcatcatcacccacccccaggaaaatgatgatgacttctccacccccttcccctcctttcccatgcatttgctaaatgcttttgttttgccatactgctgaaataatgcggacacttt

SEQ ID NO: 19887 - DNA, 2431 bp, Heterodera glycines
  misc_feature (63)..(63): n is a, c, g, or t
  misc_feature (805)..(805): n is a, c, g, or t
tttaatttaaaaaaaataaatttaaataatttaaaacatcttttaaaattaattaaaaacagngaaaataacccataaatgcatagaaaaataatgtacaccgtccgggtccgaacctgcctctcccctcctcataagggtgccttgaatccccaatcacacagggattctgaggtcttaactatgtcaaaagtaaaatctgattacgtattcgtgatcaggggcccaaataacccctaaagacatattttttgaagatttttggtgaaaaaatttttcaactcaaaaatcctatgctcacccctttggtcccgaatcccaaaatcggttttatttttgtaacaattcgtaagaaagtgataaaaatgtaaaataaaatttatattataaagaaaaaaattgcggatttttgtagtattttaattttcaaaaattttttttcagaagggggttatgaatttttttctgaaaaatcgaaaattttcagaaattctggaataactttttttctttttaagatagaaatcccaaataaatcccataaaattctcctgatttttctctatttttataatataattgcatgaaaatttatccacccttcgatttgttatgaattttcgaaaattaacccaaaatcccgaaggccaaaaaattgacgaattttcaaaaatttttaaaaaattccaaaaaatctgaaacgaaaaacaaaggtcatattcgtgctcagcacctcaaaataccccagaaaaatattttacacccccttttcaacccaaaaaaaaaactccgaaaatttctaggnggcctagctcgaaaaattttgaaattttccagacttatagtacaccattcgatagagcttaaaaagttctacaattttgccctaaggcgttttttcgctaaaatcaacccctgacgagttatgggcctgggactgaaatgtcccgctcaggtcaaaaattttttctatttccgggaaaaaattgaaattttttcaaaaatattaccaatcgatagagcatcaaaaacggttgcttgaaagttgtctccgtttctctgggaaaaatcgttaaaaaatcataaaattcaaaaaccaaaaaaacgttttttaggcctaactcgaaaatttttgaaaattttcgaaattttaaaatttgcaaaaatcgagctcattgagctctacaaaaagtccgctggcgccccctggctcagatcaaacctgggcgtgctattcgcctggtactgaagtgtccaaaaaaagtgattcttacgttgcctaacctacaggtcaggcctttgatctgatcaaaaaatttttgctggcaaagttgtaggccacagttggggggtgtgccttttggggttcactaagccctaagagcaaaagcaaaaattttcgtaacactgagactgtcagcaaagtcagtttttgcgcccctggtactcagttggacgtcggacaaaaaaacctatagttttcccagatgccccgtcccaagatgcatacgtatgcaaaatttcaactccctacctattctcgatcccgagaaattggttttagcaacgaaaccccttaccgatataacatatatataactagcgggtgcgtgaaccgtcggctctgggctgggaaaaagcgcttcgcgctttgggagcttcgctacctagactgtgaagcgattcaaattgatcgaattggttggagatttcttttgaatttttaaaaaattattaggggtttttagtccacatcgaggctcaagacgggcgcttcgcgcccgttttttaaatttgttgaactcatacgggcgcttcgcgcccattttttagcttgtatggccgcttcgcggcctcagtcgggcgcttcgcgcccgtttttcaatttttgttggactcggacgggcgcttcgcgccagtttttttgatcgaattggttggagagaagctgactaaaagaggtacaaaagtgataaaagaggtacaaatctgatcagaagaggtacaacattattagaaggggtataaatctgattagaagaggtacaacagtgattagaagaggtaaaagaagaggtacaacagtgattaaaaaaggtacaaactgtgattagaagaggtacaacagtgattaaaaaagtacaaactgtgattagaagaggtacaacagtgattaaaagaggtacaacagtgattagaagaggtacaacagtgattaaaaaagtacaaactgtgattagaagagggacaacagtgattagaagaggtgcaaccacggaagggaaaggcacaacagtgaatttagctgggataaagcgcttcgcgcttcttgagcttcgctacctagattagctatcgggttgtgaaaagatttggaatttttaaaaaattatcagcgatttttaggccgcttcgcagcctcagacgggcg

SEQ ID NO: 19888 - DNA, 1274 bp, Heterodera glycines
cgctaatcacgaatatgaactcggatttgcccaattccgaaccccggacccgaattcgaacaaaaacttgaatttttttttcaaaagtatacgttaaaatcgatcaaattttggcgtaaaccgcggatttttatccaattaacaatttgaagcattattttaatcaaaaaataatagttgttgcatgaattagagttttttatcccaaaaaatgcattcttgaaattttttttcaatttttgttcgaactcgggtcaggagttcggatttgggccaatccaagttcagattcgtaatcagcacccttgaaaacccttaaaatatgaattttaaataaaaaatttttttcgggaccacaattccgaaagattgccttccgtgccatccctaactaagaggaaacctattttttgtcgtgtatttagtaaattttcaactaaaaatttcgttactaaaccaaagtatcatgtcaactcatacacaggggacgcgtaaaaccgactagaacctaattgtttgcaaaaaaacgcaaagaaaagttgtcaaaaattacaaagacaaaaggacacaccaaactaaaagcaaagggaccccctaaaataatgaaaaagagattttgaatcatcagcaaacattaaaatcataatttgaaaaagtgatttcattgtcaattttcgttgccttttatatgttttttcacaaaaaagggcctctcattttcaccttttaaccataaaatgcaaatgttttaaaggaaaggaaaggaaaatttaaattttgtttagcaattaattaattaattgttctaaaatcgcagcttttacccgtcaaatgacacggggaaggagaagcggcggaagctttgctcgccgcttccttcttcgaacagagcaaacaatgctaattcattaaaattcaatcataaattggccctgtttttcttctccccttacgccttgctcgtcgaatgatccgccgccgttgcgcaaaagaaacgaaacggcggcaacgccactgcgagtgcttcggagtgaggcggagcgggggcgaacgacgccgatagcggagggcacactcagccgaacggcgccaaaatgagcggacggagaggaaacggacagaaaatggcgatgagtcattggggggggggggggggaatgaggaaaagcctaaaagggtaaaaacactgacaaatgggagaagagagagagagagaggacgaaaagcaaagcgaaatggaggatcagcagcagaaacagcacccaatgggaatt

SEQ ID NO: 19889 - DNA, 2978 bp, Heterodera glycines
  misc_feature (13)..(13): n is a, c, g, or t
ttgttttatattntaggcgcaaatcagttttagagggtactgatgacgaatctgaattcgtacatattttgtctaattcctaaccccggatccgaatttaacagaaatattttaaattaggtactaagttattatgtcgcctaaattgtttgcttaatagccaattttacggggtcatattccatttgaatccggtgactttgcgtggcgtttgaatttgcggaattggcatttcttttccatccaaattgacaattttcatttccttgctgccattttcttcaattttgcgtagaatttgaataaatttcagtgcccatttgcgcgtcttgaaattcgggagttttgtgcggaacaacgcattaacaaaatgaaagaacaattttaatttactttagaagaaatatggaggggctcaaaaattcaatgtgctttttttcttttaaaaattcatataaattaaattttatttgacatacataaaaaaattcgcgagctaaatacctaaaaagctagaaaaatcctcaaataggcacaaaaaaggcaaataaaacaattttttatggctttttagtctgaaatcacttaaaacttaaatacatcaaaatacgaatgattattaaatcctgtaaaaattagtataaaagcggttgctcttccaccgactgggcacacttgcaattaaaaaaaaatttttttttcttgagaatgttttacttaatgtcgcctctttttattttgttaaaatttaataaatttttgaggaaaaaagccaattgaactgaaaagtgtcaaaaactttctttaacaatttgcgccaacaaaatgtcagaccgccgaagagaagcggaggaaaaaatggcaaaagcaatgtaaaattaaaatgccaatttcaatttagaatttcctttttttcagcttcatctccgccgactgttggctttgtgtcttcgatttgcttccgacttctcaacttggcctcggaattgcgatgatcagccaccgatttgacttttacgtcgatgaacacttcaaaacgcgcaaatggacgctgaaacctattcaaattcgacgcaaaaatggagaaaatggcaccaaagaaatggaaattgtcaattacaatcgaaaagcattgccaattcctcaaattcaaatgccacggaaagtcatcggattcaaaagcatcagcatctagtaatttcgattatgaaaaatttagacaacacttcccatcattttcagtttcatcgaccaaaatgccatcgcttttctccgccattttcgcccacttttcgccgtctgtcaaattaatttggacatttatgcgcacagtgaccgcatttcggagttcattttgcgcaacatttggccaatgctcaacaaaaacattcatggcttgcgattgcccgccacattttttcaccgtttgcgtcaattccccccgtcaattctcaacgattgtccatcacttcgtgttgtcttctgtgtatgagggtttcttcagcgaatttccatgtgatgacagtgccatggcatcggataaacaagcggtgactaaatggcttttcactccacgtccggacaatgtgccaaaggtgttcaactgctacctgggcaaggatgatgcgagtttgacgtcgaaagttgaagcattcaaagcggcgtttatttaattgattcatttgccacttttacgggctttgggattctctgacaaaagcatttgcctaattaaacattgtgtggacaaaaatggtctctttctaagcgaaaagtgccacatttctcatttctttctcaatttttaatatttcaggcttttgcctcggcttcatctcctgccaatttcatcatttacgtttggtttccttcgtcttttgctgactccgatgtgccatttgaactgatcaacgaattgactcgtgaacaattgacattggaaaggattaacaatagcaaccgttttctgctgatccgttgtccaattgagcgagacgaaagcaaatggacaaaatgggaagaggaagcgattgattggcgaatttataatcagtgtaaccttcacattggaatttataatgatgataacatcggcaaaaggttaagcgaatgctttttcaaaaatccgattttatttggttttatttttaggcttctcaacgcaactcttgaaccaagtgatcagcagcagaagtgaatgtttgttaagaagtgatcgatcaatatgaattgcgttgttggataattatttttgttgcggtgattcaattgtattatatatatgtgtgggtatatgcctttaggataaattagagatttcctgaaatcccaggctcattcttttgatctaatgataaagtcggtagtcactgttccttcaataactgggtcgtcttaagtaccatttattaaacgatgttgacccgtttcgtttcattgtgccccccccctcgattttttagcaaagtcagacaaattaggacagttggctggatcagagaaatgtggacgattggcctactaataaaaattgagacaattgatcaactcataaaaattggtcggttagcgtactcagtaaaaagcccatcgtacggtagcggaaaaatcgcaaatgatgcaaatggaatgaagatttctttcatttccattgctttcccagtcgtccgtcgttcacactttccatgaaatgcggccaaatccgtcctgtgcccttccccttggccattccttccacgtcaacccttcgttttcccatccaaaacattttccgcttttcccttttagccaaacggccatttctttttttacacaaaagtatttatgcaacagtttaagcaaaagcaaatggaaaaggggagaataatatgttttgatagattttatctgtacacatattcgcgacatccttaacattgaaaaaagcgcaaaaattgcctcgactttgactacaaaagggatgtgaaaagtatgccaaa

SEQ ID NO: 19890 - DNA, 2936 bp, Heterodera glycines
gaaaattttctaaattttcggatgatagaccacgtgaaagatgagaaatttaaattattaaataaaaatttttaatttttttagttctctggcgccaagtcaccaaatggtaaagcgccaatgctcctgtggtggcagttggggcggttggggtggcggcggtggagcatgtaaaacaaattttgttataaatttaaattcagattttgggtctggaacagactcagagccggcgttgggtttgcgaaattttaggatttcgtactgtctaattccaagggcataaaaattgaaacggctgaattgggctaaatcttatgaaatgttttttgcggcataaattaatctgggggttttttccaaggacgcgctcggcactagaattcatggacactaagcatgttgagggggtagtgataatttcagactgtgaatcagattttgatctggaatagactgtctgaaatatgccagccctgaattttcgatatttaggggctttgtagatatccaattccattgacctaaaattttaaacggctcaaactaaattgcatcaaatctccgtgatttccaaggacgtccttggcactcacaatttaaggacatcaagcatgccgagtgttgctacaatttcaggctgttcctgtggccaatgcggccatacgggcggttacagcagtggcggatgttacggttgcatgtccggcacgagcggctgttactgtggaaagaaaaaatgaaaaaaaaatttttcaataaattagaggaaaaaaaatcggagaattattttaaagaaaataaataaattgttctaatgcattttattgtaatgttatttttatgaataaaaacaaattgattgtcatttttgggattttaatgatgataattattaattaattgattaatagtgctttttaaataaattaattgccattatgtattaatatatagattctattttaatttaaatacaaattatttttttaaatttttcttttcgaatgatgtcatgtgcttttttaataatatatttgtacaaaaactcgacaacatttttttaaggtgtaatttttttaattcccaaaaagtcgatctttattctcgaaaacccccaaaatatgacttatattcactaaaaattttagaaatgctatttttgagtccctttcttcatagaataagcgccgagattacattagcttagataataaaagaatacattttttaatttttatttaaaaaaaaaatttaaataactatctcttattttaaatattttttacgaatttttctttcgtccccaaaacctaagtcttaatgagatgattaattggttaattaatttgatccatattttggcagttcatgactttgtcatgagacataaattaccccctccccccaatatttggctagatttaattgaaaaagagcggaaaatgtttaaagtctcgacctaaacttgttttaaattgagcccaattcaacgcattcgtctcaaatttttgtgtctatttaatgtttgattttgtgttgaatcccatcatttttatttaaaaaaaataataatttaaattaataattatttttatatttgaagacgatttttttcaaatggccaccttcaaaacagctcctctcatcgctgttgctcttctgatccattttggatgcttaatgtttttgatggaagtgaacggtgaagtccatgttcaaaggtgcggcaaatttgtgaattcaattttttgccaaataccgaaaattttctaaattttcggatgatagaccacgtgaaagatgaaaaatttaatttttaattaaaaattttgaatttttttttagctctctggcaccaagtcatcaagtggtaaagcgtcattgctcttgtggtggcagttggggcggttggggtggcggcggtggagcatgtaaaacaaattttttataaaactaaaactcaaattatggtctggaacagaccgggccgggattggatttgagaaatttagggtttcacacaatccaattctaagggaataaaaaattgaaatggctaaattaggacgaaatctcattgtttttctacggcataaattattccggggtttttttccaaggatgcacttggcactcacaatttaaggacaccgagcatatgggttgttgctataatttcaggcggtgaattcggttctggaatagaccgtctgaagtatgcgagcctgaattttcaaaatttgtggctttggagatgcccaatcccctttggtatataaattgaaacggctcagatggctaaattttttgaaatccccgtgattcccaaggacgtccttggcactcacaatttaagggcgccaagcatgtcgagtgttgctacaatttcaggctgttcctgtggccaatgcggcaacatgggcggttacagcagtggcggatgttacggttgcatgtccggcatgggaggctgttactgtggaaagaaaaaatgaaaaatattttttttcattaaattagaagaaaaaaatcggaaaatatttttaccagaacgattaataatttgttataatgcatttcaatgtacttataatattctttctatggatacaaataaagaggtgtaatttttgaaatctaaatgattattattaattaattaattgggcataattgctattttgtatattcaaaattaatatataaattatattttaatttgaagacaaattattttttaaacatttttctatttttctttatcgagtgatgtcatgtgcttgtttaataatatttatacaaaaaacacgacaaattttttaaaattatttaagttttttaaaatatataattttgtaaagtcaataatgccaataatattattataataataaagcaattaaactgaatttccattgattgcttttctatat

SEQ ID NO: 19891 - DNA, 2361 bp, Heterodera glycines
gactgtccatctgtgccgaaaattggaacagaaactgtgcggcgaatcaggcgaaaaaaaagtgcaggaaatggacattttgaaagaggtgggacttcacgggaggatggcgcagtgggttaggacgaagttacccatgaggcattctcgggttcaattccgctcaatgatggacaaaatttaccaaaaaactgagaaaaaatgcggaataacgacgacgaggcatttgtctgagagcaacgaataggccgcgcttttttaatgtttaaaaattaaattattttaaatctaaggacatggaagccgaattgcttttgtgccacgaacgaatgaacgcgttggagacgacatgcaataatttggcacttttgttgggcggtcatttgggcggtagcgaatcgaacaaaagttgcgcattggaagaaaacgaaaagggcgattatttggcacaatttgccaatgaatgcagccgaattcggaaggaattgcagaaactgaagaaaaggtggagagaaaggaaataaaggaattttaacaaaaaaggaagtgaagaaagaaaagagagagaaaaaaagagaaggggcgaaaaagagcagtgagaaataaagaaagggtagtgaggaagagagagagagacagagaaagagagggggagagagaggggaggggagggagagaaagagagacggaaataatgaagaaagagaaaaaggaggagataaaggaatttgtaaagagagaaacaaagaatgggaagaggtacagagagtaaaaaaaatatgttaagattcgatcggaaagttgtgttctgttgtttaaacaaagtgccattcgtggaggataaggaaaattcaggcggaaaatggaaaaaccgaacagcagaatcagcagatcaaattggttaataattatcgatcacttgctctatttagcagctctgcccatttcattatcccattcgcttcagttgaatgtgccattcaaagttcggcactcatttccgtccgccctgtcccctcccctttctggcgttcgtatttgctgctttgtctgttcggtctgatagcctcttttggcgcccttttgtttgccacttcccgcgacggcaccgattggcgttggacatttgggccgcaattaaattacgagcgcggggcgccgcctttttaagcggagcatttgggagcaaatgagcagaagagagccttcccttaattgcttaattaattcattgactgttcactctttccgcattttattctcaaacatttaaagagtgcctctcgccttttcacctcttttattttcaattttattttttatttattttatttttattcattttcttttttctgaagcaatatctctcggctcgcgcggccacccatagacataaaaaagcctgcaatcccatgacattcaaaacgatgccatcatttatccccccccccccccataaatcatccacttaatttgctgaatcattatcattatcacaatattctgttaaatttaatcaccgatcatttctaccactcatcagcacatattttatttaattgtataatattatctttttactcattacgcaacaaaaacaaaaacaataaaaaggtctcaaaaataaagagaagataataaataatctaattcctcaaaaaaacgatgtaaaacgaattatcaacaaaatttattttcactttgttttaattcgattgaataaaatgaaaaagacaaatcgcaaatttaagcataaattgaaacaaactcatttgtcgcagaaaaagattctcttgcataactcttagattaagaaaatcgcatggatttgctttaaaattaatttttattttatgaattgactaaaatatttttaataaccttaagaaaggatattttttgtgtagaattaatgtgaaaatattatttatcaaagaaatggaaaacgaaaaaaagtgattttatttaatatttatttttaaaagcaataaaataagtttttagcttccggcttagctcaattgaaaatcgttgttcagttttttctgtccccagaaagtcccgcgcagttttcctcaaagtccatcccctgaataaataatttaaagaaaattaattattttaattttttgcttcatttaatttgtgttgcttaaattagcttttgtcgtttcttttcttcgttgagattagtcacagcgaagtttcgctttcacaaacagaaaaatattaagaagaaaaacagtttttggtctggttttgtgaaattccgaaacaataaaagaaaaacgaaaaaagaaatccgattcttttccccgcggtcccttcgattcgctcacttttcttttcctttctttttaa

SEQ ID NO: 19892 - DNA, 909 bp, Heterodera glycines
aaacgcaatataaagcgtatatacgtattcggcacctctctttatgccgtaaaaatgcattttggctaatttaggagcaaaaaatttttcatgaaatgcaaaaccatggggtcccccctatggtttttattttcaaaattcatttttattttataactttttttaaactaatgataaagagatgagataaagcacattatatagagtttaaaatgctctacaaaaaagctcttggacgatttttcgctaaaatcaactcctgacgagttatgggcctgggactgaaatgtcccgctcaaaccaaaaattttttctatttccgggaaaaaatcgaaattttttcaaaaataccaccaatcgatagagcttgaaaaactatgttttggaagtggtcttcatttctctgggaaaattcgttaaaaaatcaaaaaattcaaaaacgaaaaattttcgagggggcctagttcgaaaaattttgaaaattttcaaaatttaaaaaccccatcttatagagctcatcgagctgtacaaatagtttgctggcgctgacccgctcagctcaaaccccagcgagttattccgggagtaaaaaaaaacggaaaaaaacgaccaatttttagagttttccagaacgcacgtttgttctgatcaaaaaatgtttgctggcaaaattgtttggcacatccatctccagggcctttaattagccgattttcaaattaggcttttaaaaaatatttatagcccaaaaaaggcaaaaaaattttgaaaaaagccgtttcagcgccgctggcgctgaactgtccgtcggatcgaaaagtctatagttttctgcgcggcttccataatcgatgcgtgtaccacaacatgcgtgggtccccacccttccccccacgcttcccccctgcc

SEQ ID NO: 19893 - DNA, 2087 bp, Heterodera glycines
agcgttcagacctgtgctacgcggcatttccggactcaattcgtcggcaccgtcaacttatggtcacagtcctttgcggaatatgaatcacacggggcttaacccagggtaaatgagaaaattgagctatccgggaaaaaagttgttctttgtattaaaaatttataatattacgatttaattaaacacaacttttaaaaatcctcacacagctgatttatgaggtttagttattttcaggaaatatggtatataatttgccaaaaaataaattttttttccataaagaaaccctaaatttttagcttttttgtccttattaggtaaaaaatgtttggaaatattgtttttaacctatttattcattcgtttattggttttccggtttttggcaccctatgtttgaattccattgttttttgttgtccaataaatgtgtattcgttcagttctgactcttccgattctatgcaccattttcgtattcggagagcatcttttaatgagcaaaacaagtaaaatgcatttttaaaaagggaaaaaacaataaaacatttgttgctttgacagcgtttccaaattggaagaaattgtgcctgcctcgctatggcctgacccacggtttttccacggcttttccttttttcgacgtcaacgcgacccgatgttgcccagaggctattttcagaaagtaattgttttttttatcaatcacaatattctgccatatccctctcccaagagcattgttctcgtcagtgttctaccattggttacactttttcaacgtgttctttacgaggtggcattggcatttttcacaagtggcgaaactgcaattgaaacaggtctcttctatctctctctctttttgtgatcagcccgtgtaacataaaaaaacaaaaaattagagcgggaacccgaaggcatttttctaatcttcggccctttaaaacctgtatccgtgactaccgataaaggccgcctcgaagaagtttttttgtgttggaaatttatccaaatttccaaaaaatgcaattcctactccgctccctaaataagacgggcgtctgtgattaatacatttttgtcaaaattaattcattaatttaaatatttctgtcacagtgtgtttcaaattgaccggcattggcctccgcctacaaaagttggatgtccactttcattgccgttgtttgatctccattttcattatacaattcctgacattaggaattccgacggtcatggatttttgtctaaggtccgaaatacgaaaagaataccgtagcaggggcttttcaaccagagaaaatttttttaaaagttttcatggtttttaaacagttattacttgctccgttatgggtaaagaatggctgttcgttcgatcattttactttatttaaaggtcgaacatttgcaattgactaccaatggtacaacttcaaagtgcgaaaaagtttttcttatcgataatgacgaaagatacaatagccaaccggacgaactcacggaagaagtgagccattggaatttttaacaaaaatctacaaaaaaaaacaaagaaattgagattgacgggttgtggccaaaaaaaaattactcgaacaattttttttttgttgaaaacttacaggctataggacttgtaaatcgcctttaatcatacaataaacttttatttaatttgagtgaaaaattgaaaaagttattgcgtttgactgacgccaatgtgacctgggcccgaaatttgctctcaccattttgtagtttgagtttgtcgatcactgcaataacaacaacaactccaatacgctcaacaatttgtgtgaacgtcggatgattgtgagctctgagattaaagcggatcatcactttaacgagtcagtgtccattttcccattgtctgatcgagagcatagtctagttgctgttgtaaattttgggcctttttggcaccggcatcaaaagtgatcagaaaaaatcgatcaactttaacaccttggtaggagccacaaactttttttttcaaatgaacagaaagaaatctcttttttggattttatgaatattaaaaaaattta

SEQ ID NO: 19894 - DNA, 2428 bp, Heterodera glycines
tttatacacatcaaaagtttgccccttatacctattcttctttaatttgtataaaagtaattcatggggcactgagtcaaatgctttttgaaaatcaatataaatacagtcaacattttttccatttataattgcctcgtaccaatcttccacaactgttattagttgacttgtcgtagacctatttctaacaaaaccaaattggtattccgaaattttattgttttttaggaggaagttgtaaatattttggctaagaattctttccataaccctgcaaagtgagcaggttataggatgttaaagtctatatctgatataaagcattgattaacaaaagtattgcccagatttcctatgacaaaaaacaaagttatagttttcaagtatccatgggctaaagaggattgggttttcctcctttgtccatgtttcagttaacagaaaaatgtctatgtttttatttaccaaatttaaagctatttcatcaattttgttgtaaagtgatctaatattaactaagcatgctttaacttcccctattttcgttttggggttattgggcttaacatgcttaagaccggaaaagtgcgaatttataaatgttttttgagtgtgatttggtaaaatagcaagtcaattggtgttatttttaaatgccgcaatgtctgacctcagcatcactttgtcagcgtaaaccacccactcgccgccatcttcctttctttttctgctgcactcttcctgcagcacacgacgggccgggccttgagttcctcttggctgagtgaagggcgaattttgatgttgctcatccccagtttttgattgatttgagcgcgcagtttgttccattgtgccaaggtttgtctctgatgttttgagcagccgaaaattactttcatcaaccgcgggcggttttgacctgtccttgcttggtccggggaacccattctgtaaacagtgatcgggctctcgatgccaagctcatcgagaacgcctgagatggccgttcggtccgcagcgactcgctcggatggcttttgtttctgcgattcgggtagacccattacgacaacgcttcgccgccgctcatgatcttgcacagcttcgtccgcaatttgccgctgtttgagagtgaaaagttcactctgttggctttggacctgttgtagaagcgtcaagcagatttggaacaattggcgtgaaatagaacagtcggtgttgttgccgtcatcttcgttttcgtccataagcctaccaatgttagctagcttttctcccaagatgttgtatgagttgtcaatggcgagtctttttgtgttgtctgtggggggagagaggtgggaggaagaacgcttttcggtctgaggcatcgattggaatttaaggcgaattgaaattatcagtcatcacatagtcatttcaagagagagagagagagaaatagagatggagagagaagagaataaaggatatgggagagagaaagaaagaaaaacaaatagagagaggagagaaagactgagagaggagagtgaatgagagagaaagaaagaaaggcagagagagagagaaaaaagagatatggagaaagaagagaaggaaggatagaagaggagatggagagggggatagtaagagagagagagagagagaaagaaaggcagagagagagagagaggggtagaaagaaagaaagagagaattagtgatgagggaaagaaagaaaaagagaaggattgaatagaagagaaacaaaaaaaatacagagagagaaagagaagaaaggatataaaagaaaatggagagggagtgagtaagagagtgagagaaagaaagaaagacaaagagggaaaggaagagaaagacagagagaggagagtgaattagagagaaaaagaaagaaaaaaaaagagtgggtgagagagagagagataaaatatagagagtgaggagagagaagagaagaaaggatagaagagaagatggagagggagtgagtgagttagagagagaaagaaagagtgggagaaaaaaagggagaaggagggagagagagtggaaagagagaaaataagaataggagagaataaaatggaaggcgcgatggaaaggagttatttttaagtacaatacttacaaataagtacattttaaatttgtaagttttgcaccctccaaataagtacaaagggtaaccctgcaataaacaatattcatggaacgggaggaaactacaacaaatcgatggatgttgctcaattgtacaattgaatgggagtaattagttgaaaaacaaaaagatgttaaaataaaaactaatttctgaattgagaaaaaatgtaggggaaacgtgaaaaaagaatacctattatttccttataatgaataaatgtgatgataaaacacattcaatttgcattaa

SEQ ID NO: 19895 - DNA, 2285 bp, Heterodera glycines
  misc_feature (781)..(781): n is a, c, g, or t
  misc_feature (2237)..(2237): n is a, c, g, or t
  misc_feature (2253)..(2253): n is a, c, g, or t
  misc_feature (2260)..(2261): n is a, c, g, or t
cgaaggaacttatgtttccaaattcttcgaaaattaccaattcggtgccaatgaagcatcagaaaatgccgccagtcaatttcaaaaattttggtaaatttcaacagaaacaccaaaatatggaacggcaattcaacaacaaatacggcgctaagcccatcactttccaaaatggagagccagttttcatttggaatttgaaaggcaataaggcaaattggttgccggcgacgattatcgagagagggcaactctccgacttatcgagttgacgttccgacgctccgttgcgcagtccaccgccttgtcaaccaaattcgccgccgtttcccagtagaaatggagaaaccgcaacttggccaagaaaatggaaatgatttggctggggaccaaacgaatcggacccccattaaggagattgaaaaagccaaatctccaattggctgaagtcaaaatgcgctgtgaacatcagcacgtgccaagagggcacctcagcgattggacatggacacgtcgaagccgaagtacgacatcgtccggccatgacatctcgcgcaggagggacttttccaaagaagggaggtgttggataagggaccacactgattattgattatattttccctttcactccctctcttattgtctctctcccgccccttgaccagccccataaatatgtctccctttccctcactcggggcattctcccattcattccaccatttcattattttatttatttattccctgctgtcctccatatttatttgtttaatanattatttatttatttatttgacaacatttgttttggtcgaagaccaaacatttttattgttgtagtaaatacacaacacttacataaaaaatgaagccctgataatcaatccaaagcaataaattctcattttttcatttatcaaataatttcacaattcctgtcatcaaattaaattaattaacagaattattgtcaattgaaaatgcaatttcccctgttcttcattttaattatatttttataatcgatccaagcaataaattctcatttcttcatttaataaataattcataaagataaaatttcctttttttagaattgtaaattattactaaatttattgccaattgaaaatgaaattctgtattttattatttttatttttgattgccctaattattccaattgaatcagaaaagaaaaaacttcagcagaaatcatttgatgcaatatttggagaaaaatgggaagaaaaagaagataaaagggaaataattgaaaaatattataaaataaaagagaaaataaagcaaaagggaagaaaatattcaacaaaagaatgggataaaattaatttgaaaattgcattaatttttctaaaatctctttacattgtgaatttattttatttttattgaaaatatgtttattattttcgaatgagctccagtagaaagtaataaaattttatttaatcattaatttaccaattggcaattattttgtcattaagataaaattattattattatttctttgcaattaaacaggatttccttattttattaagtaaaataatgatttattcagttttttaatcagaaaaaaaatcatttaaatgcctcaaaaatgaattgccatttaattgaagaaaaataaaatcttgaaaatgaaattctgtattttattatttttatttttgattgccctaattatgccaattgaatcagctaatgaaaaattacaacagaaatcatttgacgaaatatttggagaaaaatggcaagaaaaagaagaagaaagacgaaatgaactcaaaaaacgagaaataattggaaaattttataaaataaaagagaaaataaagcaaaaaggaagaaaatattcagcaaaagaatggaataaaattggagaaaaaatagcgaaaaaaatggggacaaatcgaaagaaaatttataaatggattaaagaatttggtcttcaaaaacgcaaatcttacaaatcaaaaactgatgaagaaaaaattgaaattgtactaaaattcattgaaatgacaaaagaatataagcaaaaaagtaaatattcacaaaaggaatggaaccaaaattatgccgaaatttgtaagaaaattggagttagcaaaactacaataataaaatggaagaaacaatttggaattagcaagaaaagaataacggaggaagcaaaaatggaaaaaatgaaaatttattgngaaattaaaaaagaanatccgannatgagtgacacggaaattgcaaaa

SEQ ID NO: 19896 - DNA, 602 bp, Heterodera glycines
atcattaattaagtcaaattaaatttacaaaaaataatatctaacattgtgccggtcctccatatccatatttcaaaaattggtcataattaattttataagtttattagttgttttttttgaaatttcgttttggcacttacttccacaatctgataaattttctcgtatcacatcaaaaaatgtcgtaacttttgtgtggatttggaattggttgaaatagatgtcaaattcctaattaacgacccgaatattcccgtcaacaagttttcatacttatggcaaaatttttcgggggcgccatactgtgaagaacaaattattttaacaaatttgtggcagatggaatgggacaatattgaaaaggatgtcaaaaaataatactccaaacattaattacttcattaattatttataaaatcttttcgtcgctaattgaaaaaaattgcttattaattgaaaggcgttggttgatcaatgaactatgatggatgaattacgtcattttactttcgtaaaagctaccctcaaaataattaatgagtctgtctggtggtgccgatggagaaaattaggaaaatttagttactatttattaaaga

SEQ ID NO: 19897 - DNA, 1512 bp, Heterodera glycines
gattagttgttgttttttctgccaaacaagcgccatggggaacgaatcggctgaacaaatacggagcgatttataaaaaaaaaaaattaaattttattaaataattcgaaatatccggcaatttttgtcccagcggtcaagcgattataaataaacccgatttaaaaaacaaagacatgaatttttcattttcaaaaattcatacaaaatttaatatagttttttaaaggaaggaagtatttttcaaatttaaagaaaattttttttattcatatgacactcttttcttttccttcttattatgaatttgtttttaaaaattatttccataatttcatttttaaaaattaaatttgggttggagtgaagttttttgcgggagttccgtgcgtgttttttctgcaaatttttgatgtttgtcccagtggcacttcagcaagcaacggaaaagagagaagcggacgaaacggcagcggagagcgaattcttttttttggcattttaccgcaatggcatttcgtccatttgccctctaattgggttcattaacactctttaatcgttcctcttttacactttcaattttattctctttttgttcatttcatttagtacattttctattaatgaatattatttttgttcgtttatttttataaaattaatttattcattcgctttttttatctctttttccatcagtggaatttgcacagtttttacaatttgtcatcgctaacacttttccgcttctatcaaaaaagcatccggcaaaaatgggctctgattttgctaatgagtcatttttcgtccattataatgaataaaataatggatgcaaaaaaataattatgttaattcaatactaaattatcgaaaataatgataaataaataaataatattggaattgaaaaatgaagaatttaaaaaatatacagtaatcacgataaatgcagatagtttggattacggtatgaattttccgtaatttaatccatcactccaatttaagttgatttccattaatcattggaaaagttaattacggacggagtgagaaattgattttgcaggtcgaagccatgactattaaagcatgtaaatgaaggaaattaattgttaattcgtgacatttgtaacacagttttcagagagtctctgcctttttatgccaaacatttgacagtaaaatattctgataaaatttttctcagttcaataaaaattttcgcgaaactcgaaccatgtgaacgaaattaaacttgagtagaaaaaacaaaactgatcgagaagtgattaccacatcatttttttttactcaagattgcgtatgaactttgacttaatcaaaccaaaattgaacttagtttgacttgataatttcactaagtactgtctttttatacttaagaaaattaaattcataatatttcgctttcatcccaaatgtgaggctttatcctcattttgtggtttttgtgaagccaatggggctaaattctcaaaagaa

SEQ ID NO: 19898 - DNA, 1305 bp, Heterodera glycines
  misc_feature (26)..(26): n is a, c, g, or t
tttaattactattttaaaaatataantcatttttaaaataccgtgggccatggaactgcgttatttcggcaacctatcgaattgtgtcagaaaagaccgaagcggagaattccattgggacattgtgtgactgggttatcaacagatcaaacatcagccggggatttggattttcattacttttgctgtgagtaataatttaacatatttacttaattgatataattacggttaatcaaggaactgatggacccgagcaatggattgtatgacaaaaaagagaacaaagtgacattggccattgatgtcataactgttgatgagccaaaaatggagaaattcatttccgatcccaacaaatccaacggcacactttcaatggaaattgaaaaagtgtcggaatttgcgcgagaaatctttgagagtgaacgtaaaagcgaaactgtgcacatcaaaggattgccatgggtgaaaattactaataattaatatatattaacaacaattaattaattgatattgagcagaaaattggagttgcaaatgttcttcaacttttcgaattgtttcgcaaaagagcggcgtaaaggatttaaggagagaattaaatgacgatgtttttgacaataaaaacagaggctggggatatgccaatttcatttcatttgctgtgagtgacaattcaaataaatagtgcccaattaaattttaacataattaaggaactgatggacccgagcaatggattgtatgaccaaagcgaggacaaagtgacattggccattgatctcagtgtgaaagaagcgaatattgaggagaattcataaatacccaatatgatctggcaaaaatctcatcattgaattatcatcctatgggcctgctgtgtttagcttctttcttattgtttatcttttgggttttacaatattgatctatggattattaaagcggctttttttaagcattgaaatgaaattggcatatcccctgctgtgctttctattcaaataaatttattaattaaaggttgttaatttttattaataaatatttaatttgatttaatttccacatcattgtaagcggaacccaaaaggaaaatgcccaaaaatttcgcattgtcagtgcttccatttttcggatttatttgtgccacaatttttccacggcaatctttactcaaaatcgtgcaaattccgacgatttttcaatgtccataaaaagtgttccattggatttgcattgaaccaaaattaatttgtccttttttggtccatcaacagttgtgatatcaatggtcaa

SEQ ID NO: 19899 - DNA, 3305 bp, Heterodera glycines
cgctcatccgctggtgcagcgcgaacactcgtgccaacccttggggctcgcgttcgccttgcgccgcgtgaatgaacgcaagcagcacgcgctgagcgccgaccaccgagcggagtagggcggcatgggatgccaccaaatggtcaaggcaggagaacagcaaaagacggtcacgctgaaaatgaacggataagggtggcaattgaactgctcgagattctcggtttcggctctcgagtagccaaggtgaaattgaattattggtgtgtggaaacggatgatatcacagtctcagtttactcagaaaaagtcaaatctcggttccgacattggatcccggcggattcgggattcccgattacatccacctccaatttcaagactggccaatcagttgctgttccctcttcacctgtccataactttgcactgagccgccgccgtcgaacagagcaacgattgtctgctccaagcactcattcggcagcacatgttcagtgccgtcgtacagtttaatctgggcaaaaaaaaggaatattcaaagcaaaaaacacatcggaagaagcactgaagagagaagtagcggcaatgatttgggcggggggagggatctcatttttaatggccgactcgggaaaaactcgtacagagatcgagctttttaatatccccggagaggattacggatgaaaattcattttcgaaatcatccggactagaaacatgggaaaactctgtacaggatgctgtactcgaatgtccgacctctacagtagtgataatctcgtccgaattttcggggccctcggcctgaatctcgatttgtaaatttaaatggcccaaggattcgaaaagtgatcattcaattcaggggtcacaactgggctatcaagtaactaaaggtggaatattcttgcccatccgcgtgtaccaattggtgcagcgtggtgatcagaatgttggacagatggccacaatcttcgacctgaaaaacggagagaacttgtcgtcgtgtccatctcaatctccagcgttttgcctcactttggacagcaaaaagggaagcaactgatcaatttggggtcgagtgatcggcacattttcccacgccacaattttgacgtgcccttcggccttttgcttccctccagcggcggcggaaggtagcatttgcaaaacgacggcacacagttcgttcagtgcggcactgcgctcctccgcgtcgcgcgaggtcaatcgagcgctgacaaaatgatttgttccgttattagttaggtaattaatattattcgtttacacaaaattgttttgaaatttcgaaattagcattttaaaacagtccaaaaaaccggaatttggcttgaaaataaaaaacagttggcatttttcacggcacaccgttcgctctccacgtggccgagcagtgtttgctgtccgtcgctcagtgcggccacaattcgctgcacattctccgcttggcactcggtgagcagtgatttggccaaatccatcggcagaatttaatttgcaaaaccgaaaaattgttttatttttaaaaaattattaaatatttaaacagtaagaaataagaatatttgaatttgttagttaccattttatatttaaggaaagaaaaatttaggcacacaaaaaaaattcgcatttattcgcccataaaataaataaatatattttcaattctcaatttatgcgtacaaaaacagaagagaatattatattagttgagtgatattttgaaaaggtaggacaattaaatatcttcataaattaaatttatatatttttttaaaataatgcgactatttgaattttgtgaatgcacagtaatccatcggatgaacaaaataccataatcctatctgaaaatacaacaaaaaaaacagaaacaacaacagctttttgtataggaaaaagaaagggaaaaattgaaagtttgagcggcgggaaggaaaattctgtgaaaatgtgacacaaaaaagtgcacgattatacaaaaagaaaaaaggattttctcattttttaaaaaaattataggaattaaatgcgaaaatttaaaaatttaaataattagcaaagcgtagaaagaacagaaaaagcattgcgaggtaaaggcgaaaagaagcaaaaaaaagtatataggaaaagcgtcagacagtgattttgtgctcgaaaaatcggacaaagagtggtgatcggacttttcagggaatcactgatcaatctcgagtggtggtccgtcgagaaaagtctcgaccaaacggaatgccggccgatggaaatgccctatttctgcactccattctacagtaatattgcaaatacaaaatacatactgtcaagacaaaagttgaaatttaagtataaaggcaggcaaaacaaaaaaagggatttcacattttggttgtttcttaaaattgaaataaatgccacggggaaaaagcagagaattattgttacagaaattctgtgtgtattttttataaataaggaaaatagcgcaccaaaagaggagagattttgacgaaaaagaaaatgcgtaagcaaacaacaaatagaaaatgccaattgctgaagaaaaacaatgccgagaatgaattgcgatccccgcttttggaacaaagagaatttgtagtaaatttggggaccaaaaagccaacaaaatacgaatttgcgcaaatgaggacaactttttgagtataaataagacaaatgcttcaaaaagggaaaaaatcgaaaaaaaacaaataaattcaataaaaaaaaatattggaaatggcagcccaaagagtgaatgaatgatgtgacagaagaagatagttcggcacaaattcctcgggggatgggcttaaaaaaaggtttggtgcttctcgaatttttattttttaaaggaaaagccatccaaaattagtaaaattatcatcacccaattagtattgatttgccaggagaatatagacatccataaatccgatttgttgtcggtgatacgaaatttattcctccaattggccccaaccccttggacatatgtgaagaatgagttgaacaacaaaaaacaaaatgattgatgatgaaaagatagaggagagagagaagggaaacaaaagagagcgacagagacggaaatgctaaaaaaatataataaaagctttggcgatacgtataaattaattgttttggtgattggtggcggcgatgggcgtcgttttcgcctgccgcgctaaacatccgacagactccacgcccaaaccatttgcaacgatttgagacgctgaaaatcggaa

SEQ ID NO: 19900 - DNA, 2511 bp, Heterodera glycines
aattccacaagtatcttttcgggagacacttcgttctccttttcggaccacaagccgttgttgtccatttttcgcaacaacaagggaataaaggcttgcacagcgaatcgattgcagagatgggcaatcactttgctcggctatgacttcgaactcgaataccaaaatactgtgattttggtcaagcggaagttttgtcgcgcctaatcgcgaagacaccagtgccggacaacaaagtgatcattgcaaacattcgtgaaagcaatgaaacgggagtgttgaattttgttgcgaaaactctcccactggatcacagtgatttggctaacgccgcgaaaagtgatcaggtgatcaaaaatgtgaagaaatttgtctgctcacattggccaacaaagaacaaaatgaccgcagacattgttccgttccatcgacgacgagacgctttgaccatcgaggatgaatgtctgctttatgcggacagagttttgattccggcatcgcttcaaaaagatgtcttacaacttctgcaccgaggccatcccggaatgaagtgaatgaaaggtctccccaggcagtacgtttactggcctgggatggacgaacaaattgaaaattttgtcaaaatgtgcaacgaatgcacaatggaggcaaaaatgccggtgaagactgagcttcagtcgtggccgaaagctgacggaccgtggaaacgcgtacatttggattacgccggaccgttttatgggaaaaatgtttctaataattgttgacgcgtactcgaagtggcccgaggtcttcaaaatgcgttcatcgaattccgcggctacaatcgacaaattgcggtcactctgtgccagttatggccttcccgaaattttggtcacggacaacggcacacaattcgcttcaaaagaattgaaggaatttgtgaccgaaaatggcatcaaccatctgttctccgctccgtacaatcctatgtcgaacggacaagctgagcgttttgtcgatacgttcaagaggacatgccggaagatcaagggagaaggagcctcggaaatgttgaccacatttatggcaacataccggaccacgccttgtgaggctttgccggagtgcaaaagtccggacgaattgttcctgggaaggaaaccgcgcacgactttggacttgttgaggccaaaggcaaaggcaccgataattcgagacgaggccatagagaagcaatttaataggcgccatggagccaaaccgagatcttttgccgtgggcgataaggttctcgctcggcattgtctttcgcagccttggcgccccggaaaagtcaccaaatgtaaaggtgtcatttacgacgtcgaattttttgacggaaaattcggacggttccatgccaatcagttgcttgtgagaagcattgacgaaaacggcacaaacgcattgaacgtgttcaatgatgcgtttgatttgctattggcaccaccgctggttcagcatggtggacaagcgcaattgcctgtagtggcacccgctgctgtcatcgcaccagccgtggccgaagaacccgtcgtggaggaagctcatcgagcgcccgaagtgcctgctcaacgacgatcacagcgaaatcggcgaccgcctgatcgctacactccatcctgaacggacggatcagacggacgaatcgaacggacgtgtaagacggacggatcattggaagaaccgaggaaaagatttttttaagggggaagatgttgggaccggtactctattgtccgcccatattattttcattgtgtcttctaaacttgaataaaccctttatttattcacttcgccggtttggggtttgacggcacaacacgtccaaaaatctttttttttccattttgatggttttttgactaacgtcccgtcaccgtgcgattctccattcaaaatctattggccgttgtccatcgctctttcattttgaacgtcttttgtgaccacgagtcgctgcagtgtgaattttggtgaaaaataaattttcgatttttgttcgaatttgggtccggggttcgaaaagggtcgaaacggatgccggattcgtgaacagtggccccaaaaagcccaggagagatgttttaagcgatttaaaatttttttttattttgttaaggaatttcctaaaaatgtcgaaatagtaaatattcactatcgagaccgaaaatttcccgagactcgagaccaattttttatggctctaattttttgactcattttacgaacaaaatctgtgcacaaaaataaaaaaggcttcttcgtgatcgtttcgtccatctttcaccattcaaaatttcaatttttatccatattggaagcaaaaaaatgacacatttttgccattttggggtcaattctcagaagttgtttaacagaaatgcaatagaaataatttattttgacgcgatgacatttttggtgacatgttcaacaagggaagcaaaaattttccactaaataaatcagctgaaaaataat

SEQ ID NO: 19901 - DNA, 2094 bp, Heterodera glycines
gattaaaaggctcttttgaaatttgtcattcagcttttcctttcttttaaaatatacaaattttcaaagacaaaatataaatcaaaaccgcataaagctggtgcactccaaaacttcgccggccgaaatagaaaatggaaccaatcgcagataaatactgcagaaaaatcggccctagacgactaaaacaattaaatttagggaagtttggaatgggtaaattagcggcgacataacaaaaagttcgcatctctttatcatggttcacagatccgactgttcgtgcatcggctaattaacatattttacatcaattaaatacaattatgattatatatttccccctttaattgataccagacaaaatattaacgtaaaataagaaattaaaacctgcaaaattttggttggtagcaattttttgtcggttttcaatgatgatatcataataaaataatttcgtttcttctattagaacggcctccgtaattaaatagcctttggatcccttaggtccaaaaaagtcaatttttaggaatatttctcatgaataaaaatatttaatagcatgttagcactttttgattttttttttacatttcaaagatttgaaaaaacctagaatttatccctaaaattttgaaaaatttatatacttattttttcaatttttatgtgtgtcataattagcgattgtttttttttatgtaaatacatgttttttttcctggattctccatagtctaattagtaggaaaaaacactttttttttgtgtttgcgaacaaaagttgggacttttatttacatatttttacatatttgcgcaatttttcgtacatattttcattttttttttgcatattttgaggatttttgagaatttatagaaattttttgtgaaaaattataaattttttttttttgaaaatgtatcccaaaaaattgaatttttaaatcagatatcaaaaattaattgctaaaatactaaaagttggtttctaagcctatttagttgcctatttcaccctttatgaagaattttttccccaaaaaataaccattaaaaaaattttatttacatatttggtacatattttagcattttttatacatattttatttacatctttgcgatttttcttacataaaaaacaaacactactcatattttatctaagtgcttcaacctaccactaccccaacaaccctgaaccccatggtaaaaacccaattcgttttttgcggattcgtttttataacgattcgtttttgacccaattcgttcttattatcccgattcgtttttattatcccgattcgtttttttggttaaaaacttcattttcaatgaaaatttttatgtattacacgctactgctcaataaacaagactcagcgctaataaattgcagtctaaatgattctgacccaattttcatgtattttaataacaatgtaaaatttaagcatcttcaaatataaaagttaaataaaaattcatatgaattaattcatgatatccacttctccatcctctgaattaacatcaggcgagttttcatcttgcacttcattcaaacccatttcttcaaagtattgatcaacaagcagcccattttcatccaaactttgttcaagcaaaagccttgcatcttcttcaattatcatttcttcagcttcattacggtttgacggcggattgaagccaaccaaatgtccaattcttccataataattagacatggcttcaacaaattcatcattgcagtaatccgtgttcaaaaaagccaaaatatccgcctcgctgaggcaattcctctgtccaattcaagagtaattcaagcgggcgagctggcaattgtcttccttcatcaacggccactgcggtttcttcttcagcatgacttagttcctatcatttacgatacaaaagttagagacaaacaaactcaagtccatttggttcttttgagctgtacaattgcataaatcccattgattgaattcggcgatttatcgcttgcttcacatgaaacgcgcacatttttggtctgacagttggaaaaacatcgcaaaatgcattcactgacgc

SEQ ID NO: 19902 - DNA, 1123 bp, Heterodera glycines
agttggatttgcagtgacgtttggatggacattttccctctttttgaccatgcccaacttggcctcaaattggcacttatttcgtcgcgtttcgacggtttagtggacacgcattttgatggcaaatcagaattgaaatttggaggccaatcacaattggcaagggccgtcgtgtcacatcggcagcatttatgtgcggttacaagtctatgccgtttctgtcgcccgacagtccgctgaaactatttgttaagggcaaatctgagggatttccattgcccgaccgtccgctgtccaacaaaattcgcattaaatgccttcaaattaagtaaatcatcaatgaacagttcattacttacaattagctgataaaagcgggtgcaccccaaaacgttgccgaaaaagcttttggaccataactttgttcaatgtcaatcaatttaagcattgttggtgttgttcgatagctctatgtttttattattaatttgaaatttaaaaaatttatgttagaactcaaaaacctagcttttcgaacttttttttgccctgatttttttgtacatggataaaattttttgacaattatcagcttaatagagttttttaaatgctttcgaacaataccaagcatgtttaatttggttgagaaagaaaaatctggtccaaacgtccggcgacgtttcggctggcgccgttttgtcctgctgctcgtgacaaaagcagcccccccccccccgcttttcaggcacattgatcattccgtgatcgcttttctccatgccaacaagcaaatttgggacaaaagggccaccaatttgcgcattttcactttttactctaacaccaacatccaaccctttatggatgtgttggtccgagaaattttgcccatttttgcgccaaccattcaacgtttgcaatttctcgacgttgatctcttgatcaaatgccacagtgcttggcccacaattttgccggatctcactcggctgaactcaatcgatgctcatctgattttgcccagtttgggcgatgaccatttggatgcgccaactgcaacttcttcggctggccaagcgttgttcaaatggttgcacactccgagaaaagatggccaacc

SEQ ID NO: 19903 - DNA, 1255 bp, Heterodera glycines
  misc_feature (8)..(8): n is a, c, g, or t
gcgatgcncaattagtgaaaaggcggcggatcaatgggaagacgaaaatttggacgatttgaatgccgtgagcattgatttgaatgatcacaatttcattgggtgagcaacgacggcatttgctgctactttgtcaaatccaatacaaattgtggcactcattttaggccattgtctccaccaccagcagcagaagaagaagaagcgggtcaaagcaactgaaaggtcggcgggagacaacagccaacctgaacagcagggcccagcagatggatgcactacgtttccagcagggttgccacgggtccaaaaaatatcaggtcggacgaaaaatcatcgggtcggatttcgggactagaaaaatgtcgggattcgggcggcaacccttgtttcccccctaacttagaaatttctaagaaaaaaatcttagaaagttttttataagacaattctaagaaaaattttcaaaaatttttatgatgaattactaaaatttttcaaaaaaattgatgaaaatctcatttgaaaaatctccgaaaacaatttttttttatgttattaaaatttattaaaaacatcaagccgcttaaactgggaaatgccagtccatattttgacattggagccctctgtctgggtcacggatgcgcaattccgatttcagggtttcaggcccaacaagtttcggaagtcggaattcctttacatccctggtccgggttcagtttcctatttcctgtttctgatttttcaattttccaaaattcccttaggtcgtctgatgaattaagggccgcccattgatcagcggaaaagaagtgattatttgagaaaagtccgatcatttgaatcactattgatcgatgtgaattgatttgtgttcttctttctcgttgaaatgattacttttatcgatttaaaaaccatgaaaaattattcaaaattcattgaaaatatttttaataaattaacaaattttcataatttcagttgcgtgggcaacgtcattttgatggacattttcccttattttgaccatgcccaactcggtctcaaattggcactggtttcgccccgttttgatggtttagtggacacgcattttgatcgcagggaattcacaatttggaggacaatcagaattcacaaggacgttggaccaacacctaaattacttgtcggtgttgaacgtgctgaatttctgttgcctgaccgtccgctgcccaacaaaattcgctttaattgccttcggatt

SEQ ID NO: 19904 - DNA, 2294 bp, Heterodera glycines
ctgtcgcgtccaatttctccgagttggacgcggtcatccatttcttggaggagttgcggccagacacggcaagtgaaccgaacagtgatttaatggcatttacccgtgacgagagtgatcagactgtgttacggtgctgatcagcccttaaataatcctaaaaaaaccggtagaaacccgagagaaattccgaaatctcgagacttgagcagcacttttttgttcaaaaggcaatttccctattggcccttctcattccgattattttgctggccacaactttgaacccgctttaccagcacatccatccctacctcaaatagtcagtttcaacagtttaatattaaattcgaaagataaaccaaaatttaaaatcggaatttcggcttctttttgttgtcggcttatttcatcccgccaattaacgctaattgttttcaaatggatttaaatttaaatgttcattcagtccgctgctgcacaccggcaactcgtcgcccagtcacgacgcgttcgccaccgacatttacgcgatggtcggctcgcagcagcacaacagtaccatttgctgccaacgcagcagctcaaccacaacaggaacaagcagtacacgacacaacaacaacagcagcaacagttcacctcgccgtacgccacctccaactacggttaccacgagctgacccatccaccggcctacagtatgagcatggtcggcggcggaggcacggggcaacgacgatagacaatggagatgaaccaacaaagaatggaagccagaatgaacaaccatgatcacacagttattttcatgtagatatgaggagttggagcctatctcttgccggaaaattgcaaattcattgtctggagcaaacaattttccagagtgaggaactttgaaaaagcacgggttaggtccgggtttccgagatgaaccggaacagaattccggattaaagattctgttttaacatgatctcctctagtccaaagcgtcttttaaaacatacataactctgagccaggaccctaaaacactaaatctttcggttattttctgacagatattttccgattggagccgaaaacccaataaattgaatttttgatctaaccgtcccaaagaaatttcaacacaatgctttaccgttctccgactttttgtgtagggcagtttctggagatttaaaaaatgtccgtcctattccttttaaacgaaatgccatttaaatttctttatgtttttatcatgggttggggtcatttccctaccgccacttccctaccagccatttccctaccggccacttccctaccagccatttccctaccgccatttccctactaaggcatttgggccatttccctaccaaaaatttttttgaaattttttggcaaaatttcaaaaatagaaagggtattttcaacattttgatgtttctcgtgaattataagacaataagttttttgtttaagttatagattagaaaatgcaggcaattctaacacaaaagaaccgtacaaagcttcaacacaacgggcattcatacatttttcacaagctgagtgctgacggtgaacttcgcttttggtcgtgtgaacatcatcacgcaaaagacatccgttgcaaagggcgccttcacactgacctcaacaacaacgctttacgtgaagttggcagccaccaatgtgaaccaagcacgatgtgtcactcgctcgcgtttctcccaattggagatttgacccctggaatcattgctctggacatggctcttcccgtaatcccgtccttgactggtaaattgacaatctcacaaattgtttactatttactgttctttatttattaggttcatcatgaactacacgggtcgtcttaagcatgatggaagccgaacacgcccgcgatttgacccaaattggagcgtttagactcgaacaatgcaaggcgatgaccggacgaataaccattcagaagccgcgaacagacgcctgcagtgctcatttgcctgttcacatccatcgatttggcgtttcagcaaagaaatatcgcgaagcagaccgccgaattctcacgatggttcaaaattatttgccacttaacaacggagacaccaacattttcccaattcatcagcctttcaatcacattttatcattacctttttgatcggaatttctcgaaattatgaaatgagaccgtgatttgaaacgagataaaaatgtttgttaattttcttgcttgttttaattaactgtttataatattcatactttggtagggaaatggc

SEQ ID NO: 19905 - DNA, 1850 bp, Heterodera glycines
cttccttctcgttggagaaaggttgttagggtccagggctttattttgttgagtgatattgtatttacagttgttatgattgttatttttgaaaatgaagtgccgatatcagatataacagtttttgcaatatcgattttgacaaaattccggtaataaatttatagctcctcttaattaatcttacgcacttttctgtttttggttcggctttaaatttgggaaaatcagcaaagggcccatttaattgcaaaaaaaaaaaacattcgtttccattctacatataaattaaggaaaaggcatttgaataaatcttatagttagctcaaattgttgcatttatgcctccgaaataattggcgtcttttcttgcaaatgcccttttttgttgttgttttttttttaatttcaaatccgggccccaaaacagaagagtaactaatcttacaaaaatgagtttagttttcctaaaaattcatgtgaattttccccccacccctccaaatttacgtttttacttccataatttatacaaaacatacaaactgatgcatccatccattaattaataataattaattaattaccctttttccgcttttcccattgcttttgaatgaatcggtccgtctctttttcgtatcattcattctttgcacaaataatattttctttctgctgaaccaattatttacatccaccagcatcatgtgttaaatactgcgtattttcacaaaagatttaacggctaacaaaattaacagtgaatgctttaaatgaaaagctgtccacactttcaattcaaataaaatttagaaattaagggccaacggcaaaaataggaaaatttttaatgaaaggtgttgtattctgctggatggcccaataaacagattcgccttttttcaaaatgcatctctctctctccccctccccccccccctctctctctcttctctctcttctctctccctctcctcctctctctttcgctttcccctctctctttccccctccccctctctctctccccctctttccttcctcctaccttctctttctgcccacccctccctttatcgtcgggtccatcctttcccccaacttacgatatatttgataggaatttttgtcgcgaaaatggggccaattcgtactttgctgggggcgggaattgctgacagccgctgacaattcaaaaagaccggcaacacaaaaacatttgcccaatgggaaaaaaaggaagcaatgagagagagaaacagagagagagaaagaggagagagagagaggagagagagagagaggagttagagaggagacagagagagagagaggagagagagaagagagagagagagagaggagagagagagagaggagacaaagagaggagagagagagaggagagagagagaggggagagagagagagaggagagagagaggagacagagagagataaagagagttagagagagagagaggagagcgagagaagagagagagaggagagagagaggagaggcaaggcataagagatagagagagagagagagaggagagagagaggagaggcaaggcataagagataaagagagtgagagagagagagaggagagcgagagaagagagagagaggagagagagaggagaggcaaggcataagagataaagagagtgagagagagagagaggagagcgagagaagagagagagaggagagagagaggagaggcaaggcataagagataaagagagtgagagagagagagaggagagcgagagaagagagagagaggagagagagaggagaggcaaggcataagagataaagagagtgagagagag

SEQ ID NO: 19906 - DNA, 1905 bp, Heterodera glycines
agatacgcccttgtcacgaataacaaagatagttgattaaattaaattgaactttaaaagcctttgtttaatttattattaaataaacaattaataataaattaattaatgtgcttaatggagaaagcttataagacacatgtttgaatttattttcattttgaatatgagggatagctcgattgattcgtttgcatttttcttcttaggctcatgtgcttagtgtatattaaatcgacagatgtccaaaaaaaatagcatacacaccgaaagttttaacgaatgtacaagccaatttaaatggtaaaagatgaagaaggcagataatggcatagagaaatgtgtacaagccaatgagggctagaaagtgaaaaaaagaaagtttacaaaataaggagtgaaggaacagattatagtgtacaagcaaaagagtttggaaaggagataaagagaagaagaaataaaatgatggatagtgcattattatgtagatagacggcttaagagaaaatggaggtcaaacaaattgatcatgttaagtcatttttgaaaatttattaaatcacaatcaaaagttttaatgaatgtgcaagccaatttaaatggtaaaaggatgaataagatggagaatggcataaagaaatagtgtacaagccaatgagggcagaaagaggaaaaagaaagttgacaaatcaaggagtaaaggcaaagattaagtgtacaagttgaagactttggtaagcagctataaagagaggaagaaataaagtaatggatgatagccctatattgtgtatatagacggattaagagaaattgaggtcaaacaattgaccatctgaagtcatttttgcaaattgtaaattccatttttgtttaatttaaattggtaattttaattaatttttagtaaaacatggagcttggaagccaaaaatataaattaaataaaaattcatcatcattatcaccatcaccgttgtcgaaaaagcggtggcttcctgttgaacttcaatttgaaattgcgcattggctgccgattaccgaaagcattgaacgcccattaatacaagcagcaaaatttccacttgttatagccaaatgtgttctgagtcggattgaaaagcgcaatattttattattccctgaagtttatttaaaaaggattcaaacacaaatttttaaaattcagcaagacactttttaccaaatcgagggcattgaaacatccagaaaaattggcaaaaaaagagaattatttataaaatgggtcggctatccttattcacaaaatagttgggaagacgaagaggaaattaaaaaggtttaatgaatgcgaaataagaatagaaaattagcaatttaatttagacagctccatttttgcactcaaaatggtgcaaaaaacactatgaaacaaattggttctcgggtatgcgacgcccgagaacctacctacaccttccaaaagaagcatagatatgacatgtgccatgttggaaagcgatgaggatggcgcagatgaggactttttgttaatgacccgtaaaaaaaagccaaaggtttagaattagttggggaggtcaattttatgtaaatacatttttcctatgttgtccttctccgagtattaagaaaacaaatataaaatcgggattcttcgatacaaaaaattcgaattttttataatgattcgtatatattttatttttaaatatataattagcttttttgaaaattttaaagacattttattacatatttcgggattttttttagatttatatataatttttgaaaacgggtagaaaaaaatatacatttacaggcgaaaaggaaagttaaaattgatgacgaaaattcaagtgtaaaaaatgcacataaaaagagtctgattgacgatga

SEQ ID NO: 19907 - DNA, 908 bp, Heterodera glycines
ttcgatgccaagttcgtttacgaatacaccaatgtccaattggcgtttctccgtttcggatgggttttggagaaatgcgtaaattttctcgtttaaaaacggatcagatgtaaagtctaaaacaaaatcatttttcaacttctaatcagtgaaatgatcaatatcaattagtgttggttgattggtctctcccaattactcaccgattaattttgtgttttccatcgctttttgccattctttttcgaataatatttcgcttttctcttcctttccctcctcttctctcgtttgcttattttcaaatgttctattttttcttcctttttgcgcattttttggcgttatgataaaatcctccgctaaattcgaactctttccttcactctgactctcttcgctcatttctctgtcttcactttttcgattcttctcgtctttgtcgtcgtctctttgcttttcgttgtcttttttgggctctctatctttgtttctctgcaactgtcgttgtctcaactttctatctcttttctctctctgtatctcttccattcttttcttcagttcttcttttcttttctcctcttctatcacttgttccattgtctcatccgcatgttttctctctcttttctttctctcccttttctcttctttctctgttaatttttctttctctctcattactttaacaaattttctgcactcttccccgtttaagccaaacaacaaattagctgtagcaatgttttcagcaccaataaattcttttaaacgatcttccgtatcgttaacatccgttaacactaaaacattttacttattttattaccctgttttggtaaattaagccaattagggaaaggtgccctcgccggaggggcggggcggggggggggggggggggg

SEQ ID NO: 19908 - DNA, 773 bp, Heterodera glycines
ttcgctgtccatccagcggtccaacacggagatgaagcaggacaattttgcaaccactttgtctgtttcatcagtgctgattaatgcaataaaataattggctttaagcgatgaatcataaaaaactaaaaataacaaaaaatattaaaattattttatttgattttattatataataattcatttaatcttttttcattaatttatgctttattctgtgctccaaatgattaccttctttgtttctcattttttctccatgctcaacactaatgagtgctaattgcttttccccaattaatttcttcagtcgggtccgcgccccacgcttttccgcgatgaattctttgacttcgtacaaatcgattttcattaaactgtccaaatgtttatggtgaatagccatgagcataaagtgttgttcctattaacaatacagataaattatttagccctaaaaatgtctcgaatctctaaaattttctgattttttagatagggtaaactaagtacttgaaaaacaatgggcggaccggacttgaaccggcgtctcttctggctttccggtccagtgttctaccggctcaactcccgccctctaattacccatataaatattaattaataagccatttattcattcattcgcacattgaatgcccgcatttgctcattaacatcggcacatttttcttctccgtcccaccgctggattttatactatatcattttgatcacttcttcattttttatttccctaataaaatttataa

SEQ ID NO: 19909 - DNA, 2497 bp, Heterodera glycines
  misc_feature (2265)..(2265): n is a, c, g, or t
atttcgacagtggctgatttcgacagtggccgatttcgacagtggctgatttcgacagtgacagatttcgacagaattaaattattattttattattattcacataaaaaaggaaatgttattttttaaaatttactgtttactgtactaatgaaattaaatttgaatttttattttaattgtgcattcgaatattattgtatctggtttagttaactttgccatttggaacggtttcgagaatacgacaaaattagataacaaagggacaattaagctaatcttattaatgtttaaaaaatgccgtcagccggtgcaatctgataatctgcaacacgaattctccacatttcatcttcctcgatcattttccgagcaaatgaactcggccgttggttccccctaaggtgcacattccaaattgaatgccaaccctgaataaaggacatgaaaaaatggccacatcccaccacacttcaagcgaattgtttgttcttccaagcccttctgctactctgtccactacattcccgaatccaattatcagctgctccgcctgcatcgcgaaccaaaacttcttcgttttgtatgattcggcgaggtccaatccacgtgttaatgaaatagatgatcagctcttgaagctcaggagtcggctcaagaattgacatgacaatgcaaaaatagttgtaaacaaagtccgtgggaacaaaagccagcgcttgtagagaccgcaaagatgttctgacaagttcatcgtcccgatatcgcgtgagcaaatttggcaatcgctgaattctccgccaaattgcttgtccaaagtgaaacaagcatccggttcttatggaatttggaaagacgttcccggccgcagcgatcgctcccgactcaaaatcgctcataatacgatacgggaaccaattattgccaacagactgacgaattgtttcgaagaatcttgtgtatgtggcaagagttttgctgggcagtaaaccataaactgccggaactgcacaatgatcgatgacaactgccattgtgtagacttgagtaaatccccgtgggcatgtctttaagatataattgtaattacaattttacttaactttgtggtgcataggtagcggcatattttatatggctctcgcaatacccgcgaaaagagccttttaagcattcacgtcaaaagtgccatcgattggcacttcattctgataattcaccaaaagatcgaggtcaaaacgagaacaaaaaatgatcatttgttccccattaactgtttgatcataaattgtacgatcacgcaatctgtccggtatgatgtgatttgcgatgcgggtagacatccaatccaacatcgccgacctaaccaattatttttaaatattattttgttttaatttattttttaaattatcattttgcctcttcctgatgcttccgtttctgataattatatgttcgcctcatgtcggctgcagatggtgcactgattgcccgaacctcatcactaaggttcgaccgaacttctctgatgatgttacggcttgttgtcggaaattcgcttttcgcctcttgtcggagacgttcagatgcttctctcacctaattagctacttaacgcactttacattttaaatttctaccatatgaccacccaaaacgggtggatgattatgctgcccggtaattcgtccaattttatattgcgacccatcgtcatcgacttcccagcggcattgtacacaagcacgccctgggcaataaggtggacggttagggcaacgccaatactccattccgtcttcagtttttgaaaccgcctttagaacttgccgtttaacattttcaccaaattaaattagctttttaacctcaaaagtgtagtcatatccaccacgagatagaagaattttcccgcgatttgttttagtctctgcgaatcggagaagagccatgaaccaatgaatttggaaaaggaatagagggaaaaacagcaaatgatgaacaccagcaattacaactcgagaatgaccatcagcattcgggaatgccaaaacaattcctctccaaattctcttatcaaaatgacctcccaagaaaattgaccacccgagatgaactgaacgaccggccttatcactatccaacggccaaagtaccactgaattttaccacattgaaaataagagaaagatgcgttatttttactacacacatatatcaattttcattaagcagtgattttttaaataaaaatgactnttttgggtcagtttgaccctgaggcagtttgcttcgggcaaaccgtggattccggctggttcatgtgaatacataataataataaaataataatttaattctctgtcgaaatcagccactgtcgggaatgtcggaaaacagtaaaataaatgaaaatagttcactgtcgaaatcagtcactgtcgaaatcagccattgtcgaaatcagcgactgtcgaaatgttacagcacc

SEQ ID NO: 19910 - DNA, 988 bp, Heterodera glycines
  misc_feature (7)..(8): n is a, c, g, or t
  misc_feature (16)..(17): n is a, c, g, or t
ttgcatnngcctgcannggtctgctcgagaaatgggctgcgcgcaaatttatattgaatcggcaggacgagagacgagagaattgataaaaaatcataaaaataaaattaatttgtattggtattaattaattttgttttttttaaattttataatcaatatgcaaaaaatgaaaacttgaaatatacaagaaaattgacgatggatgttagttttaattaaagcagaagatgaaagcgaattaatgagaagaaatgaaagtgcgatctgtgatggaattttgaggccacataaaccggattaaaatttgaaaattcatcccagccataacttgagcttggcattctgtcttacactgtgatgcttattatgtagcaagaattaagcatcgggtctcgctcgactcaacaacaaaaatcataggggttggaaggtgttcgttgaaaaaatgaaaatttttaaaaataattactcattaaaaaaaattagttttttgttgtggaaaatattttaatttgtctttttctctttattggtaaataataaattttggtttgatttttaatccaataaactagaacggctcagagggtatcgtgccgagtttagtttgccgggcctagccggcagagggaataggtaaaccgacacggcacacgtacaaacaatcaaaaatactcagcagcacgtcgaacagttcagcgcttacacacaattaaattttgatagaaaattggggaaatggacaaatgacataattaaaaaaagatatgaaaataattaaattaatattgaaaagcttgagaagaaaatatataaaaaatatcattaatttaaagtaactttgagggggaggaaggcgagattaaaatggaaaaatctggcaatttgaattataaaataaaaaatgtcttcgaaaattttcaatttattgccaggcctgccatcgtcccagggtcggcttccaaggaggaggagggggggggga

SEQ ID NO: 19911 - DNA, 1227 bp, Heterodera glycines
  misc_feature (1197)..(1197): n is a, c, g, or t
atgcttaaaagctttttctaatttctaagctattagttagtgataaacctaactttgaaatgctgaaatttctgaatagttttcttactgattttttatatattggcgaatttttgaacttctgtggtctaatagaacctttgaaacttttgaacactaatatttgttgaatttattcgagtttaaaataattgtgtcttaaaattgactgggactgagctcaaaggttccaatccaccgttgtttttgctttgttaaaaagaagagatagtacataaaattaggagaaattagagttgctcgtgaccggaacgggaatttccggttttttcatgtcccggtcctgatttttggaaaaattgaaatccccgtccaggttatgccagtcccagtcctggcgggactaaataagcactggtaagtatggggtcagggtgagaaaagagaagagaattgttgaaggagaatttttgagaaaaaatttaatatatttcatttatagcatttagcatttgttcttattcaaatgtagtcaagtgtctaaaccttcctattcattatgtttcgcttgggttcaattccccactgggatttatcatattttttttcagttttttactgtaccgtaattaaaattttaattaaaaaaatattatttggtaattttttgtttttgctaattctgttaacaaatctcactcgaaatttcaaaatttttacggctgcgcctatcggcaccggcggacatttaaaaaatttaagagattgttaatttattaaaaaaaggaaaattttgggactcagaaaattccaaggtcccccccccccccccggaacgggccaactgcgtctggccaactgcgtctcgccaactgcgtctggccaactgcgtcttggggccaactgcgtctgagccaagtgcgtctcgccaactgcgtctgatccaactgcgtctcgccaactacgtctggccaactgcgtctggccaactgcgtctaagccaactgcgtcttggggccaactgcgtctgagccaactgcgtctcgccaactgcgtctggccaactgcgtctgagccaactgcgtcttggggccaactgcttctgagctaaatgcgtcttggggccaactgcgtctgagccaactgcgtctcgccaactgcgtctggccaactgcgtctgagccaactgcgtcttgnggccaactgcgtctgagccaactgcgtctc

SEQ ID NO: 19912 - DNA, 2757 bp, Heterodera glycines
  misc_feature (555)..(555): n is a, c, g, or t
gaaccctttttgttgtgcctttgagtaactgcctttttaccccctaatttcaattgtatttctcctttaggcaatggagaaccattggagcctccgcaggcatttgccaccgcgtcgaccagcgaagattcatttgaggaggaccaggagtttttggagctgcaagagagggaacaaattgtggacaaatacgaaagggtcagaaaaatgaaatgaaaagtgtgagaaagagaaaataatatagtacataggttggaggaaataacaaaacgagttccgtcggtgacgtcccagggttttgtggtgtcattcattacccattttttattttatgtagaaaagggcatattgagttgtgggtttttgaatatgcatttaccatcaaaaaagtcccatttttaaattaaaatttcattcagcataaagtgatgaaggtttccgataacttcttttttttgtgctcgtcggtgataaaaaaaaagtgcagtgcaatgcttcttttttgacaaatgaatccggccatttcggaggggggggggggtgggtgattccgangatctttttttctgctcttcggattgccagtcttaatttttaaaatcttcagcgcgggaactggaaataatattgtacactatgcttttctgcattttcagggaccagatcaaaatgacgtggacccgtgggagaacccggactttgagctgtacaaaatcacggaccgatatggctttatgcagttaattgactgtctataatataagccaatttcccaataattctcacaatcagtaaaaaaacaccagagcaaacagaagagcagaagagggtacaaaaagagttgaagcgagagcagaaatggttaaggatgctcaaggaatgggagcagcggtaagtgcaaattgatggacaattctgctagatgcaaacatttttgaaaataagtaactgattatacaggcatccaactaaacttgctgagcgaatgtggaagggtgtgccggataggcttcgattggtggtgagccattgatacttacaattaggaattcgttttaaattgattatacaaactcaatactagtacatttacctaaacaaaacttaatatcgtgtctcttttataggattcaaaaacgaattttagattttattatttgttatataatctttcagatatggaagcgtttgactggtgctgacacaatgaaggccaattcgagagaaaaactttacaaggaattgttagcacgggctcgacttgtctccagggacatcaaacaaatcgatttggacattaaccgtacataccgggacaacttggcattccggaggcgctatgatgtgaagttggtgatttatttaaaagatttattgtgtgtatgttttcagattgttttaatacctacctattcttacatttaatttaatagttaaccttcttcttatctttgttgcaacttcatgggcttttccaattttcttttcattttctttctttcaattcgtcttttttccaaatacttacaacatgaaaccgcaaaaaaatttctgattttttgcagttccgttcttattttaataaattctgttaagagctttcggttaatattttggtcacaaaaaagttattacgctctaaacttgggtgggacggaactgtcggagggaacttattgttagtcttgagggtggttgattcgctccaaatattttcccgctaaaaatttaccaattttaagatgctccaatatggaatatttttagcttaatcaattcatttttagacaacagtcccttttcaatgtgctgactgcctacgcgatgcttaacacggaagtgggttattgtcaaggtaaaatgggtttttaaacgatttaatatcataagacaattactgtgatttcaggaatgagtcagattgccgcactttttctgatgtacatggatgaggaggaggcattttggtctttacacggactattggttaatcgaaaatacggaatgcatggtacatttacttctttctttcttttcaaattttattaaaatattttaggatttttcgtgcccggcttcccaaaactccatcgttttcagaatcattacgataaagtgcttctcaaatatttgccacgagtgaagagccatttggtaataagagcagaccgaataagatttaggaattgggcagggtgtgccttattttaattaaacaaaagggggagttactttcgtttttcaaaattttcttaaaccaacacaaactttgagttttattatttaggacaacattggcatcccaccgatttacctaaccaaatggtaagagtgatttatataatttaattccttaattaatttcttgcgattgcttttggagctcctatctatgaatgatacaaaatgaacatttcataatttatcttatgatgaattaaagcccaagtcaataagaaatttctttaaaaacttactgaatttgcaaatattaaatatttaaacggtcttttccgaattttttgttttccatttataaatctgaattatgagccaaatgtattggttgacctcttgcctgaaaatattcgaaaaattatgtcgtttgtttttgcctccgagtgtccattgcttaaattaggtggttcggctgctttctcgaccgggtgccctttacactggcacttcgtctttgggatgcttttctctattcgggtgggaggcattctcatcgcgatggcatacaatatcatgaaa

SEQ ID NO: 19913 - DNA, 1891 bp, Heterodera glycines
atttccttttcttaccatgtaacagttaccatgtattaccatcatggaaagcaatgaatttttgaaaagaatttaaggggttgtaggcagctttacgccctaagatgggcgcttcgctcccatttctaaatttgtggggctcgtaagaacacttcgtggcctcggcgcttcgcgcccgcttcaaaatatgttacatgttacatgaaaacggagggagttcatgaatttcctctcttagcatgtaacatgtaacatgtattaacataatgaaagcaatgaatttttgaaaaagttattaaggttgtaggcagctttacgccctaagatgggcgcttcgcgcccatttctaaatttgtggggctcgtaagaacacttcgtagcctcagtgcttcgcgcccgcttcaaaatatgttacatgttacatgaaaacggagggagttcatgaatttcctctattagcatgtaacatgtaacatgtattaacataatgaaagcaatgaatttttgaaaagttattaaggggttgtaggcagctttacgccctaagatgggcgcttcgcgcccatttctaaatttgtggggctagtaagaacacttcgtggcctcggtgcttcgcgccctcttcaaaatatgttacatgttacatgaaaacggagggagtttatgaatttcctctcttagcatgtaacatatagtgaaatatgtttcatcatattgaaaatttaaaggaattttgaaaaattaattcttcaaaaagttttttattttaaaagataataattttttattattaactgtaattttttaaacatgtaaaaataagcaaaaaatacataaaaaataatgtataccgcccggattcgaacttcccccctcccccaaaaaatgatggctcagaatcaccaagcacacagggattctgaggccttaacgatgtctaaagtaaaacctgatcacgtattcgtgatcagcggcccaaataagccctaatgacatgtttttgaaagatttttaatgaaaaaaatttttcactcaaaaatcatgtgcacccacccccctttgatctggaatcccaaaatcacttttatttttataacttttttctaataaattataaaaatgccaaataaaatttataaaatagagaaaaaaactgcggaaaataatacgtaaaatttccttaagtttaacatataacacatttaaatattaaaataattgaaattttaaaaaaagtggtagagtaattattgggaggaagcggtggttgttgcaaccttagatgtaacataacatgtaacatgtaacatattaaattagaaaataaataaacaataaataaaaatttgtgggttatttatattgaggggacagttgaagtaacatgtaacatataataaaacataaaaagcattaacttcatcttatttttctctatttttgttgttttattgcatataaaatgaccaattctattatgagttatgaattttcaaatttaaacccaaatacccaagggcaaaaaatagcaaatttttgcaaaatttttttaaaaattccaaaaattctgagacgcaaaacaaacatcgtattcgtgctcaaaatactccagaaaaatatttttcaccccccttgtggcccaaaaaaaaattccgaaaattttgggtgttaaaagaatgactttcacacataaaaataatttatttaaaatattaatttttttagttaataatttaaatgtattaattttttattattaacttgaaattattaaaaacgtaaaaataagcaaaaaaatacataaaaaataagtataccgcccggattcgacttcccccccctcaaaatgatgccccagaatccccaatcacacggggattctgaggtctta

SEQ ID NO: 19914 - DNA, 1671 bp, Heterodera glycines
attttaataatttgaaattttagtcgccatccgattttgcaaagggatgccctgcgaattttgtccgaaattttcaaggcattttccatgaaaattccacttgtccaacgcattggtgacacagaaggccaaaaaatcggacgaattgacgggaaaagggtgcaggaaaagaaaatgaatgaaatggacaattattttgaaatgttgacgaagcaatggtgaagcataaaaaagacgaaaagcacccaaaaatttattaatttttattgtatttgaactgatccaaaacaaattgcatttaactgcaaaatgttgtaaaatttatgaaaaataaaaaattatagaatttttaaaattggcatggttattttcttccaattttattttgcaaaaagaacacagtgagccctttccctcataaattcactcattagtctgtacaaatatggacacttttgaccattataaaaaaaactcaattagcgaacatcgcccaaaattgtgccagggcaaagcatgaaaaaagaagaaagaactcatcgtcagtgggaagcacctgctgctattatgccactgttttgggattgggagaaggatttggcaccaaaaaagttgcgacgaatgccaatgccaactgacacacatttaagctgctaataagcatattaccgagtcaattgtgctgaggaaagggacggacgaagagaaaatgttcatctgccaatgaaatgccatttaaacgtggacttttttgttcaaaaatttgaatttatattcaatataattaaatttatatatttttcttaaatttcaattttatatttcttcagaaataaatgcaaataaattattttatgacagcgcagtacattttacattttaataacccacccccgttataatgagggttttcttgccccccccccctcctcttttcttccgttctcatttcaattttaattatttttcctttcctcgtcatttctttctttatatttgcgctctattaattattataatttttttttgatttttaaaaattatattaatttacccatcaaatttttaatttgcatttcctccgccgaaacaattttcccataaaagaatttatttgctttggtctgaagaatccgtcttttctgctgctcctcagctgactgatgtgaatttgagtgtggagttccttctgcttacaattaactgttttctgctgctggttgcttttccgcgtttattcaaatttgcccaatggctttggcggaagggaattaatttgggggaagtgcccacctctcccaaagtgctcaaatttacggggaatttgacggggagtttgtccccgcttggcctcaatccccggtctgatgagaggacatggcaaaggcaattaatgggccgaagaacacacgcagaacaacaacaacaacaaaaacaaaagagatgagtttgtctaattccccgttttttgcccccgttcgctagccgtgcagcgtttttttgacggtccccttgtccccccgcttatctgcttgctgtcaatcagtcattccccgtttaaaataatcactccttcccccgtttgctcacccaaatcctgtcctttttaagtaagtttattttccagattccccgttactttttgactggtcatccccgtctccgtccccg

SEQ ID NO: 19915 - DNA, 1872 bp, Heterodera glycines
ttcgtgttgggacgcctcttaaatccgccaagtaaaataataaaagttagccaaattaacatcttcgtatcatttgggtagttttaaatattgagttattagaagttgttgcccattagttatctaatttaatagcatctgctgatttttttctgtaaaatgttgaaaacgtcctttttggactgggaaatgattgaagggcacaaattgcaataaaattgagcattgccatttgagtcctgctgaccaattagtgcactcggaactcttttcgctttcatttgacttcgatttcgtactcaattgtccgttcttctccgtctccaatgtaaactttggaactgtgaatgccgcggtcccttcggctgactttttctttctgaatttatgcgataataaataatgcttaagtttaaatacagtgctgattttcaagtactattttcttatattcaaaagacaattttgatttgtccttgggcataacagattttcctgtccttgaaactcgcttaatcactccttgaaaatagaggtcgaccgaaaattacaattaaatttaaattcggtggtccttttttaaatcattttgttttgcacatttttgtttaataatgaaccgctttatcacctctcttttgttgtgccatttccaaattgtgatgtcaaactcgctgttcaaacagctttcattttgcgagaaaaccatcgtcgagcattttaaatcgcaaaacatttcgccataataaaaacgcaccgaattttcgtggcaaatgacgtcgacctcgtaaaatgcttcgtcctcttcaagcattggatcgacttggaggacgaagtatttgccaaagtcaattgggagatcggcgttatgcgattggtcggcgtcgattagcccatcgtaaattaatggcttaatttgtacttattaatctccccttttaattttataaaggcaattacgagcgttaattggtctattaattccaaatcgtaggacaacgttccctttgctttgacattccattttagagtttttattgaaacgacaaagtgacggcattttgtgtgattgaattcaaaaatgactctttccgtcacttttttgctggcattgtcaatgaattcgtgcgatttcaaattgccccaaattgaactgtacaaaaggctaccgccgatgaggccatctccgttttcaatacattggacagagacaaaataactgcgaattttaaatggcaattaaccacttgttctttaattgttgtcggatagcattaattaatttacataatttaaattataagattttgcctgaatgagtgatggccaaccaaagtcggcgctatttgaagtgtcaatttgcttccattgctaattgaaaggttgaaaatgaaaaagaatgtaaataaataggacattttaacaacaaattttaaaatcatttcattaatgaatggtcgcacaaattaaaaaagttaattagcaaaaatttacatttggcagcggcagaaataaataggaaaagccattttaattatttatatgattacataattccacccaattatttttataaagtcaataatatccacgtaaaatcgaataagctgtgaaacggcggcatcaattcgttaatttttttttttcttgaagtgatttatttgtcctttattatcatatttaatggacatttcaagtaaaatttaatttttaacgaatctatttcaaagaccagtctttttaaaattttctgtcgacggcgcccatcggcattctgcggcgcctgtcgacaacatcgaaaccctcttcaaccaatattttaggaaaacctcacccaaatacaaaatatactcttaacctttggtaaaatct

SEQ ID NO: 19916 - DNA, 1170 bp, Heterodera glycines
  misc_feature (6)..(6): n is a, c, g, or t
ctcacngggtgccacgcatgcccattcgccaagccctcgcctttccaactgttcacgggtgccacgcatgcccattcgccaagcctcgggttccaactgttcacgggtgcacgcatgcccattccaactgctcacgggtgccacgcatgcccattccaactgctcacgggtgccacgcatgcccattcgccaagccctcgggttccaactgttcacgggtgccacgcatgccattcgccaagcctcgggttccaactgttcacgggtgccacgcatgcccattcgccaagccctcgggttccaactgttcacgggtgcacgcatgcccattccaactgctcacgggtgccacgcatgcccattccaactgagcacgggtgccacgcatgcccattccaactgctcacgggtgccacgcatgcccataagccaagccctcgggttccaactgctcacgggtgccacgcatgcccattccaactgctcacgggtgccacgcatgcccattccaactgagcacgggtgccacgcatgcccattcgccaagccctcgggttccaactgagcacgggtgccacgcatgcccattccaactgagcacgggtgccacgcatgcccattccaactgctcacgggtgccacgcatgcccataaaccaagccctcgggttccaactgctcacaggtgccacgcatgcccattccaactgctcacgggtgccacgcatgcccattcgccaagccctcgggttccaactgttcacgggtgccacgcatgcccattcgccaagcctcgggttccaactgttcacgggtgccacgcatgcccattccaactgctcacgggtgccacgcatgcccataagccaagccctcgggttccaactgctcacgggtgccacgcatgcccattccaactgctcacgggtgccacgcatgcccattcgccaagccctcgggttccaactgagcacgggtgccacgcatgcccattccaactgagcacgggtgccacgcatgcccattcgccaagccctcgggttccaactgttcacgggtgccacgcatgccattcgccaatcctcgagttccaactgtacacggatgccacgaatgcccattcgacaagccctcgagttccaactgttcacgggtgcacgcatgcccattc

SEQ ID NO: 19917 - DNA, 2437 bp, Heterodera glycines
ctacgtccctcgtgaagttatgcctcggaggacaacatctacacgaaactatgaacactagacaagcctcagagggtcattgtctaggctctctaatttgcttttcccttcacctgtgtcaccgggattcgttgagttaatccgtggttcacagatccacccaggagcgccaatttgtcccgattgcgttcgagccaaaggccgggcactggggtcggggcaagtagggacgagacacagaataaataaaaaatttattccgggaaggacctcaaacttgggtaattaaacaaaatatttgaaatggtgaaaaatatcttcgtcctgtgcgtttggtgacgcacaatcaattgcaaacgaaaacctgtcaaaccattcggaaattctgctcttttcttcatatggttcgaagattccgatgtccggcaaatgcggaattgtcgcatttgcttgcttgttttgtcgtggttgtcactgtcctccgacgaattgagcatgatcacaattgggggccatcacagttaaaggcaaatggagggcggaagagaaacggcaaaattgccaaatgaatttgggttgtgaattttgggggcatttggccgtttaaataacaataaaattagataaaaagtggcaaaaatgagcagaacgaaatggggccgaaaattgtgcatgaaatgaaaaacagtgcacaaaatgaacgaatgaacaaaattggcgataaacgggaaatttgggcgttcatcgttctttggagtcgcattcgccaaattggggacgggggcgaaaagttgcggtttaattaattgttgattaatttgtgcgcggggcggaggaggaacacagaaaaacaattaacaatttgaagggaagagggacagagggatggaacggttaaaacccgtcgcgcggcggggggagttggtgaaggggcgccctccctcttaattcgccgatcattgattggcgatcggaatggaaattccgacaatattattcgataagctaatgtcattatttaatttattgatgatttcatttttattaaatctttttataattaattaaaatacctttcgaaaagacacaaattttgctctttttgccgtaaaatgccaaaccggcccagtgaataaatattcaacttaatacaaataaaattttgttggaaggggacgaactgctgatattcggttattggccaaaattttgtagattgatttcattttatatgtgtattttttttaaatttaggagcgatacttagggatatttttttgaaaaatttttagtcgattctttggggtgtattgtgggaattttatagctattggttgaaaataaactgaattagaaaatgtttgtacttgtagtttttagcattgattcattttggctttatttgagttctacaacaaatattatcttcgatttttttaaattagcttattaagacttgttaaaaaataatttatatgattttcttttaagtttttgtttaggtgtttgcttaaattattcatttaatttgttttataataagttactataattcttgaatataattctttttattgtctgatatccaatagatttaattttaaattcgttcatttatttaaatggctttttatgtgactaaatatgtaaaaatttctttattaattaaatttacctttgttaattaaatatttttttaatttttaaatttcaatatccttacaaatcggtcactgcggtaaataagtatgctcattatattctcaacgcctgttcggttttttattgtatcttaatcttattatttaattgattctttatggaacactttgtttttaagagttcaactaaataaatgttaatattgagttaattatttaaatttcataaattaaatacagcaaataatatcaaaatatttaattagatgagcttattgagatttcttccaataataacaaaatattatttatttatttaattatatttttacaaaaaacaatattttatttttgtatttattatttttcggcttaggttttccgtttttgaatatagctaattaaaatatacaaaattagtagattaaaataaattaaacatatttatttaagtatcaccttgataatggggtaacaattatttttgaataaaagtgaaaaatcatatacaaaattataaataatattttatgtaaattaattttccgaaaattatgataaaattttttattcatactaatttgatgaatgtaaatttattcaatttataaattgaggaaatcataaatactgaaaattttcctgttggcctctttcggtatctttagcacgtgagatttaaaaataaatacagttagtcaaactaatcattaattttaattatcgaatcataatcgtctctgatgctacatatttgactttttcttaatcttcat

SEQ ID NO: 19918 - DNA, 2075 bp, Heterodera glycines
  misc_feature (1030)..(1030): n is a, c, g, or t
aaaatttccccctgggcgcctccggcatcgcctgaacatttatttattaggatattctatattttttttttaagtgaaattgattttaattcgttttaattaagctcaagtttcgggattgaagtcttaaggagccaaaagtcgagaaaattacacgaaaaattgggcattttttaagtattcaaaaaaataatttttgataatttttttcgagggtcttaaggtgccaaatttcgagaaaatatcacgaaaattcggattttttgtcataggcatgactatgtgccaggcaatcgttgtgagaaggagcagaccatcacggaagacattctgactgtgttggcaatgttcgacaaggaattggaatcgcacgggacgggcaacaaaagcggcacgaaacatttggccaagttgttgccggaggcaacaactgtcagagacgagaccttacccagaatcggattaccaagcttggtaaaccggccaaataaggtgttcattgccaggcttagtaaaacaaaaacatgttaaaaccgaggattggtataaaatggtatccggacaatcatcagtgtgaaggacaattcaacaataaattgtttttttttgggcaatgattaaatttggcgatagtatttgttagaataaaattcgatttcacaatatttatatgaaatttcgcgtttcaaaagtcctgtttttacagtaacccgggtcttgttggatacaaaaacttacagtaggaccctggaaagcctgtacaggaaagattgacctctctctaatcaattcataattgttacttaattggtgctttaaggatgcaaattcgattccaagggggcctttgcgttcgctttttgtcaatgattcgcttacaaatgaccatgaagcatcatcagtccaagaatcaccaaccaaagatgaacttaatacccaaatgtgtggcatttggtggcttaccgtatttcttctaatagggcctcggggttatttttaggtatttttgccgactccccccctccccccncccccctcactcaaaggggactttatttttcaactttccacgggatgggcttttattagagggggtgttttaaggggtttttcaaccccctagaaggggggagagaggattgtaatagaagaaatacaaattcaaattaaatatatttttataaattaaatttaaattttgtaattttttaaagttcattctccgatgataagccacaacgattgcggaaatatccttcattgcattctgttgattatgactatgaatatttggaagaggcaaaaattcccgaaaaatttcggtttgtcctgaaaattttttcaaaaaaaaaaaaactaatttaaggtctaatattgatgatgtacaaaatgatcagaaacataaaattgtaaaagattatgaggccagcagcatagaacaaggtcatcaacaaactcaaggaaaggtgtgggggcgaaaatttgaagattgaccccttaaaggcgaaaacttaaatttttcaattaaaattggcaaaaaaaaattttcaattttccatttaaaacaggcaaaagatgccggcggccaaattgaatttgtcaaacggcttccttttcttcaagaatcgagcccagaagttgtggaggtgggtcggaaaataaaaattttaaaatttacgattctctcaaaaaatctcattgtttcacagaaagtgctaacttaacaaattttaaagaaaatttcaagtaaactgaaattttttttgaataaaataacaattcatttagaaaaaaaaactcaaaaattcttgaaattttctagtaaaaaggcgggggggggggggattgtgcatccgttaatcacacgctataatcattatttgacatgataaaggtgttcatggaagtgatggatgacccggacattcccagcgagggcagacgcatggaagaagtgagggagggacagcgaaatttaaaattaagtaattattaattaattagctccatctgttagctgtctcatatttgaatgcccgccaattggacgcatttaatcgatggtcaacaattcg

SEQ ID NO: 19919 - DNA, 2361 bp, Heterodera glycines
cgacgccagccaagataccgcgtgggagacagggtgcgcattgaaaagtacaagcacgtgttccaaaagggctatctcccacgcttcaccaatgaactcttcacggtggcagaggtacactcggagcgttcgtctgttgtttatcggttgcgtgatgaccataatgaaataattagtggttggttttacgcaaatgatttatgcaaatcactagaagacaaacaacaaaaaatgtataaaaagaaaagattttgaagaaaaagaggcagaatggtgtggattatgcacttgtgaaatggaaagggtatagcgctcgcttcaatagttggattcccgcaaagtcaattaccgataaagatatataaaaaacactatttgtcaaaatttaacaaaaatgccttcaaattctttttatgttgtcgttccgtcgaacaccaatattgaaggaaataggacaaattcgttcctagtgcgtttaccgcgcaaactacaattcaattcggaatgggaggtgggtttggcggtgattgtgtatcccccccccattcatggccttccataggcaccgtggagcaacaatttgttcagattgagtggcagacggggaataaggtgcggattgagcttccaccatcaaatgtcaccaacccccatgagcttagcaaaaatttgtacagactcctgggagatggaagtgatccgttggcaaaaaaggtacgctcaacacagaattctttcatgcttacgataaacaaggctcgccgctgggccagagaagagtacattaagcgaaagaccaaagaaaaacggggtgttcgtgacgaagagctgctcctacaggccctgttgacagatactggaacattggttgaactcaacacccgcaaggacttctggcacgcgaaaagcatgctgaaacgagcaatatcgcgttgagaatcccagctgacgataacgagtcgtatcagcataaattggatgaatacttttcaaaattaagtgacaaaaatttgagtattattgatgaattgggcatgacaaaattgaacgccgaaatcaaaaatttgacaaaagaggaacgtgcaatccttaatgccacaaaggaaatggggacggaagcatggattcaggcctatcgtgaaatacgtcttgtctgccaattcaactatgacatccatagaaatcgttttgtcctgaacaccgacccacggtacgttaaaaaggttgaagtctcgcctacattcttggtttcaacaacacggaatttatgcaggccgaaaacgaggcgaggtttatgccggacatgagtgggggtgtgtcatcattccatgtttacacgccagatcttattgaaccaatgataattggcgatgtcacggccccagtgttgcgtattgtgaccatacgcggaaaccccgaccaagtgattgaagaacaattttttgccatacaatatcacaaaattttattaaaggaagtttctgaaattttgattgagatccgtacgaatagcggcatcttgatgccattccaatacggaacatgtacattaacattacactttagaaaaatgtcctatttttaaataatgaacacgttggaaattgacaaaacattgtcatgaaacagcgtgactcgccactactatattggttgttttgcggcagaccaaataccagccgtggcaattgccaaatttccacatgtatggtggtgaatcttgaccccagcacatctcatggttctcattgggtgtgcatttattgcgcttctcctttgcatttggagtattatgactcattggggatgtggccaccgcccagtgctcacattgttgaccatttgtcacactacaaacaaattcaatatagtactcttccacttcagtctcccaactcaagtgcgtgtggtcgacatgtcattttctttttgtactgtcgatgtgttggaatgacctttgaaaaaattgtcagctttttgcactttggaaagcagcaacgtgatacgctcgtaaacaactttgtaaaaagcataattttcaaagaatataaataatgcaaaaacgtcaaatttcaaaaaaaatgcatgttgattttgatcctctacaagtggattggtccgcattctcgtccgagtgtgtgcaagtcagggaatggagagcggaaatcgagtactcaccaatgtgctggagggaaaagacctcaaagagtcgctcgttagtgagagtaaggcgggactaaagaatcttcttgaaaaagcagccaacaacataaacactcagaagggtcaaggatttgattttaagcgatacaaaaaagactcagctcccaaaatggaaaaattcggcgaaaaaatataaat

SEQ ID NO: 19920 - DNA, 2391 bp, Heterodera glycines
gttgtgtgcttttgatagaccaaagttatcaacaaaatgtgccaacaatgtcgcccagcggttaaattgcaaaaacattattatataatcggtttatttgatttcaaaaattctgtttatagcataatcaaataaattctttaaaaacattttttgaattaattcctttagattcgatcaaaatggcaaatcagctgttggtttcggcaccaagagtaatcgatggcataaaaagcgggacctttgaccaccgatggttccatcagaatgtgtccgtcattttatgcaataccagttttggggttgaaaaatgcgaaaaaaataaaatccgtaaatttttatgtgaaaaattaaaatcggaaaattgggaggatttttcggatgtggaagcagaaaaaatgcgagaaacaggaatgagtttaagagcaagcagtgactggaagaaaatgagagaaatcctagagaaaaagaaaaaaatgggagaaaaaggagaaaaagaaaagctttttgaaaatatgcttttgactttttgttcattgtttgctgtacaaaaggtgagaaaaggagcacagagattgactttaaattaaatgaatggctacaacttctaagcttttcctaaggacggggatttaaattatgagaaattccaaattttaaatgcttttaggaaaaaaagtcaaaatatttgcgaaaatattaacaaaatgaaaatttgcagtacaaaaacaatacagtagcaaaagaccacacatttttcgaagtttttgaatgtatttttctaaaaggaggtaaaattttaaaactcaaaaatttggccaagaaataataaaattaatggaatttttcggtgaaaatatttaccaaaagttttatttatggatattacgtgaaatcgaagaaagactattaaaaaaaaattaaaaccctcactgttttatcatatcattaagttagtattcgttttcgtttctcaatttttttttaatttaaaaaaattctctgtgtttttttattttttttgggctttctctcggttctctcaaccccttaaacgctgctctatttttaatattttcagcatttggatgcttattttgctgcccgttcaacccgcatacgcccaaaacgcatggcccctccgccgccggagggaagacgcggtggcactgacagtgaaagtgccgatgacattggcactttcgatgtcgaaagtcaggcggcacggagcagcacatccgcggggaatggtggtgataggtttaaacaattaggccgttccctatttgtggtagaaattgcggtctttttgatgattggctcctgttttttcgcgcttattacccctaatttaaatcctacagcggtcatcccttttattgtcatcaatagcatttttatactcattatcattagtcattcattatgtattttttttaaacgaagacattaatttttcggggaaaacagtaatttaagtaaaaaagaaaccctctggcgactcctctgatcagctctataagaccaaaattgtttgttgctctattattccttatctgttcatctgtcttacacattctgaacaccccccactgaagcagatactgtttaggtacggtagccaatgcgaaccaaattttaaaaattgttctttcaagcttcgtatttatgcataaattgattggccctagatttgttcaatttatgatattttatgactatttttggtgatcatttttacttgcgggactaattacataagcgtcagcaacatttgctgaaaagaaactcgaaatcagaaaatgcatttgttattccaaaagggtttttttgaatattcctaacaaaattaaatcagagaccttaattttgaaatggcagagaccgggacttggaaaaaggagttctttgtccagtctgcatattttttaataattattatatcttcaattcccagtaaaaaactgacccacggactccgtcagttgggccctcacgtttgggctccagcatgtttttggttaaacttttttatttatcatccaaatccaacaaacgttttctatgggttctattttttctagactaatctactcaacacggttcagaattctataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcgataaaaataacattcacggtgcgaaaaatggggtttgaaaagtttattggggaaaaaaagactttacaaaataatacccctgggagaaagggagtgggaaacatgatttcaaaattt

SEQ ID NO: 19921 - DNA, 2215 bp, Heterodera glycines
  misc_feature (83)..(83): n is a, c, g, or t
  misc_feature (109)..(109): n is a, c, g, or t
cttgctggatttgctgagctttgctcaccagctggaaaaacctatacccacaatggctgtgattgcaaaatgaatgctcaatntgacaactggtggcgaagccgaacanatgctatgagttaacaactgcataaagctccgtagcaccacggaagttcattttggcatactgagctggctcatcgattccgattttgttgcctgactcttctttgcactcgacataacaatgtccaggccctttgaaagggtacttaagcgcatattttatatttgctttgttaccatacgcaaatagtacattgtggtgtactcggtaacgcagcaaaatataagggttgtacggcacgacttgcgagttgtcatatattaagccgttaaccactatattggcaccaccatccactgatgaaggccggtaatacaacgcaggcctgtcgggccgcaaaatcgtacattttgagtacagggctgggaagccctttttgcatcgcccatatgggtcacgtgggccacaccaactgtcactgcatctgtgcagttggaaatgcattaattcgcgcacttcgcgatgcatttgcgcaattggtgtgccatcgcctttgtctggcaaaggtggaatatgagcccaaatgtattgctgaataacatctggaattgcgtccaggtcagtctgggctacaatgtgggcatgcggacctccacggccttggaactccatggactctcctgatccaaggattgttccaaagaacttcttttcataaagctcttcgtggaactcagcaattttgctggaccacacacgcatccacaaatcaaaccggtcagtgaatacttgaccgttgttgtacatgttctctttgaactcaggccattccctgttgttcgtgaatgtgatgaagaggcgcgctttcttagcgtcatgatgccgtgcaaatatggtattgcaatcttcatacattttcttccaatactggagagaattgacattgtgctcggaaaatcgaactacactaccaatgtcatcaacagttttctgttgagcattggggttctgccgtgcctgctgtttattgtattggttgaccaaatactgcagcaaattttttggagtgctgatccgcagattcatgtcaggtctgcgcaaaaatgtggctacttgccaatcgattttagcagcctgatcaagtatccagcgctgaccaagaccacctccacacgaaagaatgtggtggtattgcaactccacattttcgtcccttatggcgagataatacttacagtaatcccgcagggagacaaatcttttcgatttgtcaatgcggccataaagtgaagaaagtggaagcgaccgacccgggcatcagaagatgcaacagactgagtctcgcacgagccattgtcggactcggcctcagagtcgaataggccagccacatcttgatcactttttcgcttacgcgaagacggctttgcatatttaatgccggttatatacccatcatcacccattggctttattaatgggtatgtcaggctgtcagtccaaggactgaaagcggcaatttcattcaattgaccttgcttgttttcaacccatatcccccttggcgggggtgctccactgggatccgcgtgaatagcgaacatcccctcacccgttgaaggggtgattatttggtgaggatggagctttggatcttttagagcagcaggagtcatgcgctcattcaacaaagtcatgcggaaaaagcgaagctcttctggcttttgttttttgaggagctcctggagctgctcacgcgcttgcttatacgcttgcgcagcggggtgatgctcttgaatcattttttccaagagctcgagggtcgcttcattaagctcatgaccctgcacaaactcatcttcgtttgtgattttttccccagtaaatgtggggttgtttcgacgctgttccatagcctggactgggtccagaatgtacagctggccaaagccaggaatctgggttgtcccagcctgcatgctgcttatgcggcgatggaattctccgttaaggataacggccatcggtccgtcgagtctctgcatctgtaactttgctgcactctgaggcccaatgctggccggggcagaacaggcaagacggaacatgtttttcgccagaatttatgacggactgagcaacggagaaaactcgcgcattttcgtg

SEQ ID NO: 19922 - DNA, 2104 bp, Heterodera glycines
ttcgtccgtcgttgcgcgccccttcctggacgccgtcgatgatgaagttcttctcgtggttgctgaccaacacgtccatttggttgttgtcgcaacaattaaaccaccaaatgatagaaaacggcgattgtgagaatgtgaatctattgaatttttatattaattaggtgggtaattaacccaaatgatcatacacactcttttttagtttcaagtttattaaaaaaaaatttaaaaaccaaaaaataaatttccaaatgaaaatatttaaaaaggaacgtggacattgcctaaaggtcattaaaagtgaaacggaatcccaaaacgtatcgaattaagcatttaaataattgattaataagcagaatcaattgaatatattcatattgagcaatcaaaaataattaaatgcaattagggaaaagtaaaagccggaaaattaggcacactcaaaaataaatacacaaaaaaattcgaaataatttatttaattggtgatttctgttgctgctgctcttcactgttttgctgctgcggctgccctttttcaccattttcctccaatttggtcattttttcgctcatttgccacaatttttcggcctcttcattggtgaccatctcatttttgtacggcaccacgcgtccctcgtaatacagcgcaccattttggagttgggccaagtcgcactgggcacagtgcaacatggacgaaatgccctggaaagtgccgtggcaaacaatttgattattttttcttaatttctggagtaagtggcagggttgaggcgcggatagaaaaaatacccgcggatcgggtcgcgcatctggatttaaatgcaagaaacagaaaatttgttttcttgcttttcgaaattttattttgaattactaagttttttcaaaagtcgctgaaaaatttttcaataaatttttaacttgaatttttttataaaagaaatttcctagatttttttaaaaaacttttaattgttaatttgtaaaaaaaaaattgcggggaggaaaacgacggggacgggacataatttcggctggcgaaatttcgccaccgaaattacgccgccgtaatttcgccgggacaaaatttcgccgcaaaaattaaaaaaaaaatttagaaaaaaatttcgccgatttttttgaaatttatgataaattagttagtaagttttttcgaaaatttttccaaaaaatcgctaaaaaattttttcaaaaatttttccttggaatttccatataaaacatttccaaggaatttttttcttgaaaatttccaaataatgaagtgcacccggaaaaaacgccgtgattcgcaaaattgactatgacctggtccaaatccttggcaaccatccaaatcagcgggtaggcgagcattctgagcaaaaaattcgtgtgccgtccaagctcagtgccgcgtacaaagccaggcctattcaaaaaaaacaacaacatcaaataattgagaaaaaaaacactttaataaaacgcacaaatttgtacaaccaaaataataaatttcgtatcgaaaaattgacaaattttattgaccttgctaatttaaaatccatattttttgtaaacataacataaataagagtttgatagctcattttaaagcacaaagttttggttcgtgaatttatggtttcaaaaattttgtaagccgatgtctgtctcaaaaaaaaaaattccgacttttcgttcgagatctgtcagtttcgtggtaagcgaccccgaaaaccttttaagaagctatcaatgatttattatgaaaaaaaaatttgcaaacaaacttttttttatgaaaattcaaattgaccaattttgcaggtatcgcaaaaattaaaatgaattaaacaattaaaaaagcttgtgagatagaggaaattcctggactcacctgatcgcgaccactttgacgtcacggaacgagcacgcgacggcgggggaggcgagccgattggccaacccaacggcatgcaaacagttggccaacttgctgaacgcgtaatattcggcgggcgaacgctttttagcgactgccattggtggtcaacacggccagcagtcagccatggaatga

SEQ ID NO: 19923 - DNA, 2398 bp, Heterodera glycines
ttctctgctgctcttctcgttgttttctctgttgttcttcctgctgctttctctgctgctcttctcgttgttttctctgttgttcttcctgctgctttctctgctgctcttctcgttgttttctctgctgttcttcctgctgctttctctgttgctcctctcgctgttttctcagctgctcctctcgctgttttctcagctgctcttctcgctgctgtcgccgtttatcctcctcctccctctcttttttgtctcgctcatgcttaaagctaagttgagcgagttttgtgcgatttttcaacggatttattggcgcttcttctgtttcttcctcctcaacgatttctatgtcaagaatttctccctcatccgggtactgtattgacctttttcgggtcaggtgtctttccatttccgatatcatgccatggtgcattccgcgttcgagctgctgaggcgaaaggaagctaccccttggcactctgaaccggaacttgcgaccatcgcgcaggtgaaccactacgtattgcctctccagggtccctacagtcgcccaactaaaccgtacaattgcaacgaaaactgtgcaagacaactcacctgttgggatatattatgccagacatgtccaccatccacccgggcccatcaaacactaatttctttggcaagtgcactttgaatttattcgttttatttccgacaaagcccggcgtattgctgggcaaaattacaaagaaagagttgctcattttaacgaaaaatcaaagaatgaatgattagagatcacttttccatcttgaaataggtgttccgtcccccgttcttctgtggcacgtcatccttcttttggtgtttcatgatcaggtcggtgcagtcaaagttcaacttggcacagtcttggcagaatgtttgggtgaactcgagcttctcttggccactgccggtgtttaggaggaagcgcttgtcgcctcgcttgaagttctcgttacggcactccccacataaaggtgaacaccccatactgcaacggaaaaggaatattgcagtgatgactccaattccaacagtacctttatcgggaggaaatgatgagccggagtgggatgatgtcttagttggcacgttatgcataatttgacccacaaaattatgtctgagtgcatttttggccaataatacctgcggcatttggctaaagtcttacggtaattcaaatgaccaccaccaagaagggaagagtggaaggattcaaaaattaagcctctcaacgaaattgggacataaattcgtggttggcatcccgattctttgaaataaaggatgccagagtccaattggaaattaactgtggctacggcaaattcgtccttttctttctcatccaaaccatcagggaatttgccagttttcagaaaatcaatgtaagccgtcgcctcgggatcattcttgagttctttttccaaatttacctcataagagttaccgtccttgtttcgtattgtcagcgtgttgacaaaatggtccaaaaccactcagtcgtattgcgagatggctaaacataccggaaattcgacaatgtcatccaattccggcaagttgcgcaattcagacagaggcttatcttaaacggcgcgagaaagagcatcggccagtgaattttgactcccggcgatgtgcacaattttgattcgataattttgtaactcaattagtcagcgcgccaaatgtggactgttgtccgcttttttgagcagaaaagcgagcggtttgtggtcagtgtgcagttcaatgtctgacataaagataaatggtctgaattcgcgcaatgcatagatgatggcgcccatttccacttcaacagctggccatttgcgttcagcggcagataatgtccggctacagtatgcaatcgctgagaatgtgccagtgatttcattcttttgcatcaaaactccgccgtgtccaactgttgaggcgtctgtgaaatgtgaaatgatttggaataatcaggaaagatgagattcggtgcttcagccaacaattccttaattttgttgaaagctttttgttggtcacatgcccactcaaatttgattccttgtctggtgaggcaaagcaatggttcgacaaccatggcaaaattggcaatgtgacgtcgataaaatccggctttgcctaagacgcgtttgacttccttgatattggtgggaatgggcatgtccttgattatttcaattcgactgagagatggcttaaaacctgaagaagtaagggtaaagcctagaaaattcatttctttcgtcgcaaaagcgcactttttggggcttaattttaagttgtaaagtctgaatcggtatggaacactttcgattgaagacatatggtcatcaaaagt

SEQ ID NO: 19924 - DNA, 2145 bp, Heterodera glycines
ttttttccattacttgggttcagtcctttcgggacgtgaaccgtacagttccatccttttaggacgagaactgtacggttccgtccttttaggacgagaacccatggaacatttttttttgttatccatgaatcaagtggactgcttctgcttggagcctttgtacccagcggcaaatgcagtgccagatgaacggtttcaagccgttcggtttccatgttgcactggcgagtctcattttgcatgcatagctcgccagctccgtgaaaccagtttgaaaaaaatttaaaaaaataattaaaaataataattaaaataacggatcccctatagatataattaatgcaccaaggactccatcgccgccacaaccaccagcagcacatcatcatcatcatcaccatcaacaagttcaagcagtacaacagcagcagtaagttcaaggagtgcaacagcaacaacaagttcaagcagtacagcaaccgagacgacggacggtcagggacgaccgcctttatgaaatcgcagcgatcgtttgttcgcgccgggcggaggatggtcaaacgcgggaattgaggatccattggcagtcttttccttatcgcgatgacacttatgaattggcagtggatatagcaagggtaacatttttttaaatttttgcacaaaaaaataaagcattgaataaaaaataattcagcaagcgcctcaatccacgcggcatggcttcaagtgcacgaccatgggaacacgccaccgcatgacgtcgagatgccaattcggcctgcgacttggatgagcactgttcgcagtggtcggcatctgccagtggtggagtcagtctacccagggcgaaaccctgcgcgccgtcgacttttcggtaaattaattaatcaattaaacattcctttgtaataattaattaattaaagatgcgcaaccagcagcagaaggaaaagaagcacaaaatttgctgagggcaccagcagcagcagaagaagaagaagcagccttaatcgtcgatcaaatgcagccgcaggctgcagcagcagcaatgatggaagatgaggacgacgacgacgacgaaattgtctttatcaatgaagtgcaaagagaagcacgccgccgccaccaccagcagcagcagcagcagatgaagtgattgtggacctgcatgaagcacagatggaaaatggaattcaaggggaagcgccaccacctgtagcaatgcctgtgattgaggacgaaaatttggcggaagcaccacctccagcagcagataatgagatgggcgataatggagatggaggcggtggtggtgatggaccttcggacgccattttgggtaataaggaaataattaagtgctattgaattttattattatatattcatttccagatttggacgatggacacacggacagcctgaacaacccggtcagcctggacaacctggtcagcctggacagcccggacagccgcagtataagaagcataagaggggcaaagtgagtacccatttttccctttgtacaaatataatttatacccattatagaatgtggcaggatctgagcgacgccgaaggcgcatggccaagcaggctcaagatcaataatctttgaaatttttatatgggacttggcaagtcagacacttgcacatgtcatccccaacccacacaattgaacaatcggcgcacacatttggcgtgtgcgcactctttcctcccaaacattgcctcgctgccaaggctgcgaattccgcgcagaccttcgcctcctccaacttctcttccatgaattttttgagtttgacctcaaaaaattcttcttgaaagcattgttgatgtccacctaaaatgaggataatatcagaaatgctaattgataaacaatcaacaacaacaaaaaaaagttaccggaagcagcattgatgttgccggcctttcattctctggtgaatcgtccaataacgctcgtttgcgtgtgtcgggacgcacaaatttcgtttccttgttctaaaacatactgtaatgatttttaaaaaatggtgcgaacagcttacgtcaacagcccatgcctccagctgatctagcctggagagaaagttgacaaaacggtgccgcatgtccttcattttc

SEQ ID NO: 19925 - DNA, 2118 bp, Heterodera glycines
ttttattgttaaaatccaggaacttatggacacaagcaaagggttgtataacaaaaaagaggacaaagtcactttgaccattgatgtcattgtggagggaatgaaaacggacatcgccgacccaccaaaatctaaggggaaaattttgtggacaatccaaaaattgtcggaatttgcgcgagaggttttaatgagtgaacggaacagcgaaacggtgcacttcaaagggattgagtggaaaatttgcgctgaagtggtgaaaaatggcagcaatgaaaaggctttggacatttcacttgcgtgtgtccccaccaaaggtgtgaaattataaaaatagctcttaaaataatacaatatttacaattagacaccatttgtaccggcgaatgtacggcgatacttcgatttgtttcacaaaagaacgaaacgttacaatttgcaacaaaaactgttgaaaaaagtggttttagcactgaatatgactgcgtggcgcttttcccctcgattacttttacggtgagcggaggcaaccaaagcgtaacaattcttacatcggcttaagctaggcctaatatttaatgcttatattaagctttataattttttatgtacgagttgccactgacttatcagaagaacgtctttctttgcttaattaaatggttttaaaacaaaggaattgatggacgccgacaaaggattttacgatgaaaaggatgacaatgtgagtttggccattgattttaacgtgaaagtacagaaagggacgaagtgcaataagttgactgtggaatgagcaaagcaacattttgttatcattattattcgattatcctttacaattttacactttttacttttatttattttttattgaaaatgatgatcaattgttatcactcgttatctcacctttacaaaataaaaaaatcgaaaaaaatttatctgacctcgcaaacaattaaaagagggattataattggcagccttagtgatcacgaatataatattcattttaccaaaacgaggggaaaaagcgtttttttcaagaaagttcgggaattgaccaaaatacagttaaagattggtgaaagcttcccaggttggaatagactagtcttttaaatttaatcaaatttaaattttttggcgctttttttaaatttgaatttaattgactttccttttttgcttgctcccttttaatcttcggttcgcaatagtacacccaagatctacttccagatttattgtgcacatctttgtttttcttcatttaaatgattcgtcgatcaaaatagcgataatatagatcatattttgctttccatttcttattgatttatttgttcgtttaattcgatgttttctttccaatttttgtattaaattatttctatttttttagaatcaaaaaacaataaaaactcacgaatcctcaacaaaatgagcaatcaatccgcggctgaacttgctgacgaatatgagaggtgcgtttttagagaaaaatctctgttggaatttaaaaatgccatattttgtggttggtggcacttatttcgttgttgttattgtaataaatattttagggttgacggtgaagccatcaaaagcaacgaggacagacgcaccgaggccgagcaggtcgggttgttgaacacctttttcagtaatagtttggaaaataggagaatgacaacggacagttcgttgtcagtacgccgtccaaaatggacgaatcggaggacagcggcggagaagtgaccccggagaaggaattggtcgggaatatgaagaaataattctattcttttgtggcatttcccattttcagaatgtcaatgccggtgtcaccccggcaattatcaaactcagacagtcgcgcacggaatttaaggtttttctttttgataaatatgctaatttgtaagcgaaaagccagacctctgggcttatgtgtagacagatcctttttttatttatttgattgttaatggaaaggttacaatgttttttcaatttttcttccggcggcgcctatcggcaccgccggactcaaaaaaaaacctattttttcttaacaaaattagcccaaaatctcaaaatttggtcattttt

SEQ ID NO: 19926 - DNA, 2161 bp, Heterodera glycines
actttgtttattttcgcccgattggctgcggaatcctcggcggatgagctcactgaagaaggaatgtctgaagaggtcggaccccccgggcaatgaattggggaaaggaaatcgaaacgaaaaagaaatgccgaaatgaagagaaaaattggcatttaatgaaatggacaaatggaaaaaggccaaaaaaagaaagaaaatttgaaaagagacgaattattattaataatttatggaaagaaatcatcgatgaaaagggatttgtgtagaataattaattcattgccagcggcggattattcggcgttaattgcttttgtttactgagaaatggaacaaaatgcgcagcaaaattaaatccaaaaaaataattaatgaaaatgaaaacgaagttgaaaaagaaattaaataagtattggctttaaattatttatttaaaaaaattttgtttgtttgtcagacggacaaaaaagcaaaggaaaagcaaaggaaaagcaaaggaaaagcaaaggaaaagcaaaggaaaagtttggattggttttaattttttaaatttgttattttaatggattatccaaaatgttcttcaattttctattttccttctaacaattgacaaaagttaaaagttgacattttttgattcttttaattggcattggacagaaaagggcctttcagtcgccgcttttctcggaagaattcccccccccccctgggggtccgtccgtccatccgttctcctccgtaatcaatccctgcggcgttttgtcccccccgcggcgcaatggacggcaaaagagacggggcaaggcaatttgtctcaagttcagcaactgttttttcaaatgaattttatggaaatgtttattttcccaatgatttgtgttttaatttaaaatttggaaatttttataccaaaaaataataaatattttagttcttttttccatttcaatgtattgccatttgatttattactttttttaacattaaaaggttcaaaataaaaaatgtgagagggacaaaaagccgacaaaaagtcaaagggaaaaagcaaacaatgctaattctaaatcattagtgaattctgaattcaaaattgaaattaaaatactaaaagtaacagtccattttatacaaaaaggccaaaaatatgccaaaacgaccccccagggggaggtgggggtggggtgcaattgcagcgggtgaagtgccctcggcttcaccttgcccccccccttcgcttgttttttgcctttccgtccctttggcttccttttttcggcggaatgccaatgcgaatcccccgaggagtttgtcctccaccactggccaacccaaccaaaaagccacacaaatgttccacatttggacatttggacaacattttgaatgcttataaatagccgccatttaacgccaattaaataaacgatttggaaaaatgaaaaacgcattaacaaaacgccgatggagaagaaagaggtcacaaattatcagttaaataatttggcaaaatataaataattagggaaatttggacaaaggccaattaatagctaataaaaattactgaaacggcaaataagccccgcccctccccaaatagaaatgctgaagagagagagagagagagcatcgaccaattgggaccgaccggctgagtttcctttcggccaaattcatcttccgtcgcccctccacaattttgacggataagccgagcggtacaacaaagggcctttggcggcttcttcgatgtgacagttgctcatctctccccacccccgggcaaattttcttcagaaccctcggccagttcaaaatgcgcttttcatgcgttggcattccgtccctttcgccttttctgctgactgaacgttttcaccgcttctgagttcgtcccgtcattcatcctcaaaacaaaacttcaaattgtttcaggcaaaaaccaaagtcggcaggcggcaatcggacaccccggcggagatgatggagaaggtccggggggattaaagcctcgtacgaaacggaataataatctcttcaccgccccgaggggtggagacggacggacggacagccatcgccggcggcggagccttcgctttgctccctttgatcgtttccgctccgccagtccaaagtcagtggggaa

SEQ ID NO: 19927 - DNA, 1909 bp, Heterodera glycines
  misc_feature (1880)..(1880): n is a, c, g, or t
tctgctgtacaatagagaagttcggtattcggcagaattgagcggattgtgtagaagtaaatgtcgttgtccacttggcatgccaccatattctgcgactcgcgaccctccgccattcgcacgtttcgcatccaattggcttttcgcgagttcgtgtcgatcagtcggatcagttggcctccgctggacgagaaaatctatgggagaaattgacaacaaatgaatgaaaagcatcagaggaaaagcaaaaaaggaaacgaataattaatggaagaaagcctttcgaaattccattcccaaaaatttctcgaatttattttcgtttcattgggagaaagcggagggcggttgaatgaaactgaaacagttaattccgctgggaacgggaaaagccgcttttcgtgttggccaaaagggcgccctttctcccacgacggccaaatttgggccgcaccttccactggctgtgattggccctccgcctcggcgtcgcccggggctctgtcccaatcaccgcccctcccccgcgggctgactcagtcttctcgccgggagtggcgcccgccaccggcattacggtcgcctcctccacggacggagttcgggactcaccgcacaacggaccgaagcgggcgaagcggggaatgaagtcggccgtaaaaatgccaaagtcctgaaaagaaaacgcatggccgcttttcccctgctgggagcagcttctgcttacatcattcgctcctccggcgaccgttttaacgaccaaattcaatggaagtgagctcaatgaccgattgtttggatcctttcaaagaaataaaaaaataattgaaaatattcggccgattttgccacttgcaaatggagaggcttatccggcacatggaacacgcatagattggccaactcgacgtcgttgagccgttcaatttcatcggcggcatcggcgtgcggcgggggaagcgccggcggcgacgaaagtgacggagagacggcgccagcgaaaacactctgctgatgatgatgaccgatcgcatctgttgaagcgagtgattcaattcccaattaatccctgccaattcattttcatttggctttgttttcatttccaattatttggtgaaaatcacacaatttgtaagcccatccattcaccagcaaaggcttatgaggaagggtaaaggtgaaagacattaaatggaaattaaatgtcactttttgctgatgaatcatttattgcggggcattgacagagggagaaaagcgtgggaggggacagaaggaaaaagggggggggcaaagggcggggggaagggagggaacgccaacgggggagggaatgggggggggagaaggtgcttctccgatgaattgcaaaacccaaaatttactttggcctcctaaccaaagggcaccaaaacgacagtcaaaaaacactttctccggccaaagaccatcaaaaggtgcagcagggccatatttagtgatttcggtagtaaaaaaagggggggggaaagagcataaaaagccataattgggattgttatggatgcaaattcactttggctctcttccgcttcacctttggctgccatttgctgctgctgtgccgttttctccgcttctccgcccgtcattccccgcggcgtttcttccattggccttttcctctgctgctcgctgctcgcgacggccatcttccgaagcgcctgagaagctgcagaagcgatgaatccgtgggaagacgaatcgccaagggacgagtcgaggcccatttttggggagacgaaggatcagtgaaatcagacaaagtcgctaatggcttaacgaacaaaagtgaaaatggctgcgaaggggagaggaggatagaagagcgcaaaacngggggagggggagtggggggcatgggcta

SEQ ID NO: 19928 - DNA, 1358 bp, Heterodera glycines
aaagactttacaaaataataccccttctctccacgggagtgggaaattgatttaaaattttaatttttttagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgaaaagtttattggggaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgaaaagtttattggggaaaaaagattttacaaaataatacccctgggagaagggagtgggaaacatgatttcaaaattttcatttttttatagtctaatctactcaaaacggttcagaattcaataaaaataacattcacggggggaaaaatggggtttgaaaagtttattggggaaaaaaaaattttaaaaaataatacccctgggaaaagggagggggaaacatgattttcaaatttttaattttttttagcctaatctactcaaaaaggttaaaaaatttaataaaaataaaattcccggggggcgaaaaaaaggggtttgaaaagttttattttggggaaaaaaaaaattttaaaaaaaaaaaaacccctgggaagaagggagggggaaaaattgattttaaaattttcaatttttttcaatcttatctactcaaaccggttcaaaattcaaataaaaaaaatttcccggggggaaaaaagggggtttgaaaaagttttggggaaaaaaaaaatttaaaaaaaaaacccccggggagaaaggggggggggaaaaatgattttaaaaatttttttattttttttttgtctttttcacccaaaaccgggtttaaaaatttaaaaaaaaaaaaaattctcgggggggaaaaaaggggggtttgtaaaaaatttttgtgggaaaaaaaaaaaattttcaaaaaataaaccccccgggggggaaagggggggggggaaaaaa

SEQ ID NO: 19929 - DNA, 2465 bp, Heterodera glycines
aaattgaccatttcaatggttttttcctctttaattttttataagaaattctgagctgatttcaataattttaatcagttttgctaagccaattcaattccagcgaaaattgtcttaataaattgccttatcaaatgtcagaccgccgtaaagaagcggaggagaaaatggcaaaagcaatgtaaaaaatttaattaaaatgccaattttcaatttcaattttaaatattttctttccttttttttcagtttcatttccgccgactgttggctttgtgtgttcgatttgcttgagccttctcaacttggccttggaatttcaatgatcagccaccgttttgacttttacgtggacgaacattttaaaacccgcaaatgggcgctaaaaattattggaattcgcatcaaaaatggagaaaatggcaccaaggaaatggaaattgtcaatttcagtggaaaacaaataccaattccgcaaaaaccgctgccacgcggagtcatcgggttcgaacgcgtcgatttcgtgtaagattggcgattatgcaaagatttagacaaacttcccatgtttagttatatcgaccacaatgtgatcacttttctcggctattttcgcccacttttcgccgcctgtcaaatcaatttgttcatccacacggacagtgatcgagttttggagttgattttgcgcaacatttggccaatgatcgcgaccaacatttgtgccattcaattgtccaccgaaatttttcgctgtttgcgacaaatggcgccatcaattctcgacgactgtccatcgcttcgcgttgtcaatgcctattctggtcgtttcttcgctgaatttccggccgatgactggcttttcactccgcttcaaaacggtgtgccaaaagtgttcagatgctggatgggcaacgatgaagggacttatccgtcgatcattgaagcccttaaaacggtgcttactaatccatgtatttagattttttgggcatttctataatcagacaaaaagggcgttagtacggacaaaaatggtattttccttcgatttttcattaggcaccaaaaatggaccatctaaaccgaaaaagtgcctgccaatctctggatttttgtcccatccccaatcgtaaaaatgtcattcatttcgtttttcttaaaccacccgcattttagacttttgcctcggtttcttcccccgtcaattttattgtcgtcatttggtttccgtcgtcttttgcttcctccgtcgtgctcttcaatttgaccaacgaattgactcgtgaacaattggcattgaaaagaactgacaatagcgatcgttttctgttggtccgttgtccaattgcgcgagacgaaaacaaatggacaaaatgggaagaagaagcgattgattggcgaatttataatcagtggaatcaaattctcatgctaattaatgagaatgatatcggagatgggtcagtgtgaatgttttttccatgagtcaaatttatttgcgtttatatttttaggcttctcgacgcaacgcccggcccaagtgatcagcagcagaatgaatgaatcaattgttgagaagtgattgatcaatttaattattgaaatcgaaaatgaattgaggctattttaaaatgctcgtaaaattgtttttttgttttgttggaatgatcaatttatttattttctgcttaaattggtatgttcatgcttaatgatgagcattgtgttgaatttagcattttatgcttaattggcatgttttcgaaacttttgactaaaacaccgtcttccagcaataaaaagcaaaaatacaaccctaagaaattggaaaattttttcaaaaattcatctttttttttttgtaaaattttgaaatttattcaattttacttttaatttttggcttggcaccaaacgaccctaccccaaaaaataggcactaagcctcaaaatttattgatttatgaatgaagaaaaatgacatacaacacaccatttcaatagcaaaagtccaacatttagatcacttaattgcatcaatcaaccaatcaattttcatttcttctgctgtttctgatcaccactcggccccggcaaatcgtcgagaagactgaataaaaaaacaaaatgaaaatgagaaaattagcaataaattttttttttaaataagttttgagaaacttattttcaagggaatccaaatgaacattttaattttcgaaaaatgttcgaaatccggatttgggattcgaaattgagttaaataggaccagattcgtgctaagcgcctcgggattacccctgaaaataacttcctagtaattaattaaaaaaaaaaattttccggactaacaatctttacaattgccgatttttgacattgttcacccattgtcgtctccgatgaaaatgccaaatttgttgtccttttgtcctctcttcaattcattcatcatttccct

SEQ ID NO: 19930 - DNA, 2171 bp, Heterodera glycines
tatttttttgttttatttttttgaataaatttgtcaatttgcgcatccctatgaaagtttttagcaactgttttgggggtttttagaaactaaaactaattattttggcagtttttagcaactacatacttatataaataccatccctagatatcacataatctcaaatccatctatttaaattcataaacactaaggatgggtaacaatgctcagattctttgctactaaacctgtaaagattagtctggcaaattctaatggtggacaaaaaatttctcaaaatttgttcgtttttgaaaaaaacaccataaattttagaacactgtccataaaaaatacctatagattcaaaaaaggtcggggaccccgatcgggtagtgatcaacgaaatttatttacgaaaaacccaatctttatttttaaatgctcgtaaatcttcctttttctcactttaatcatctgatttcgttagcgccagcaagagtgagtccaatctggcctttaaaccaggggcttccatttgttcttatttataagaatttctaattttggggtagcgacaaaaattgttctgattttttaaatatatttataatctcggtcagggacgttttcgtaccgccattttcgtaccgccgttttcgtaccgccgttttcgtacgggggacgttttcgtaccgccgttttcgtacgggggacgttttcgtaccgccgttttcgtaccgccgttttcgtacgggggacgttttcgtaccgccgttttcgtacgggggacgttttcgtacgagttcttgtacaagcgtcagattcaattagaaaaacttatgactaactaatcgaaccaaaattttatcattttttaatttcccattcataaatttaatgtaaaaaatgcataaatttaacaataacaaaatgggacaaactagggtcgcatctcatagtttcgggaaataccggcgagaaaattgttaatgttttcgggattcacattgggattggcataattgtgatcattttgggggacaatattgacatcgttataacgttggacgagacgaagaatccgtgaatcggcatcgcgatacttccttttcttttggggtgcggcttctcccatcatgcaacgtgccatatcagcatcaagcgccttctgctcacatctgatcgtgtcaatgaatcgccaaattgttggatgagtgcagctaaattgccgctgaagtttccgatggaatgcctcggcgaagttgttcgtccgatcagcaccatccaaggtgcgctgatgaacactccattcgtgtgggtcaaatagaggcgccgtcattggaacattgaagcgcattctgcccgtgtagttgtccagaaacctagaaaaaaaaattcataaaattcgtcttcggacttaaccaattgaaaacgccattaagttgtggcggaatttgtgcttgaagagcattaagggcattttgaaggtggtgcacaggcaggaaggccaatgatgtgatcatcttagacttctcagcgaaggcaggatcagtgttgtaaaccttaatgagtttgaatgggaatggaataataaaaaattctaaaattacacgagtgaggcccagggcccttatttgcttcttcatgttgcggaccaagtgaaaaaaacgcaagaaaatcgaacaccaaaagccagcaatcgccgcagacaaagttgaaaaacttaagaatttttatgaaaattcaatagttgtttatcactattttcggccaaagtattttatcggagtaaactattaatcgttattattatggcaataaaatctgggcaaaaatataattacagtaaggaatgcaaatagtttttttatcaataattattttaacttgaataacaatttaccccacccatattctggcacacaattaatattaaattaaacatactctgtttagcgtttctctttttctataaagagccgtgtttagcattttaattttcaaaatttccgagacatatatgtaccattaaagttttttaaaagcaaaattttactgtcaaaatcaattttgtcggaatcacaactgtcgaaaagtaacagaatcaagtagttactcaccaagattttgggggttgcatttcagccccgccatttcagtcccactggaaagggacatttcag

SEQ ID NO: 19931 - DNA, 1278 bp, Heterodera glycines
ttaatttgctcgagacaattgccctgggcaaaagtgtggtcactccgctgtgggttgaagcgagcttccgtcaattgggctttttacgtgagttgatttttgtttttcgcctaatattttgttgcattaaaattgcagcggatctcaattttttcgtaagagatagtgagaatgagaagaagtacggttttaacctcaaagcaacaatattacgaacgcgaacccgaagagtatttaaagtatttatttttgttttttgtttattttccaatggatggatttttagggcgtagaatttcatttaagtagcgaagtgcaaccaaaatatgaaattatccgaaggttagttgaagcagccggtggcacagtgcagaaggataagccaaagaaggaataccttttaaagtgtattcaggtgagtaggagcaaaaccagcctagggggaggaaagtgaaaatgaccgttccatgcttatttttggagcttattcttgtgggggtagccgctggaaaatctcacaataagctattttttatcggaaatttttttttacaactttcccctcgttcagaaaaatgtgccattcttcattatttgtgataaaaacacactttgttcctaccaatttcttatggattcgaactttcgtaagtcttccttttgaaaagattaaataaaaaataatttagctattttcaacgaggatttcattctggtggctatccttcgacacaaaatcgacgtttctgaagaatttcatgcgttttcattaaattcaactcaaacttctaaacctaaaaaagccgatgaataaatttttgttttatttttatggataaattttaaataattagcgttagactaaaataactcaaagcgaagttttatcgctttgatatatttaaatcacagatgtattaacaattaaattaattttcatgattaaatgaaccgacaaaagcgccaaaatttaaattcaattttcaaaaagaaggcaattgacttggccctcaatcagtcccctctctcggtacgcttatcattgagctgtttccatctctttctcacagtttgttgttcatatttattccaaccttaaaaaggaatttaggcagaaaaaattaatgagcggaacaaagtgaaagtcactcttttgtcaaaacctcagtgtgatgcgaatggttatgagataattgtggactataagctaattgtgggaaattggaccaaattggtaataaatgtgtggaatggaacaaatgagtttcgtttattaat

SEQ ID NO: 19932 - DNA, 1687 bp, Heterodera glycines
  misc_feature (46)..(46): n is a, c, g, or t
  misc_feature (68)..(68): n is a, c, g, or t
  misc_feature (1626)..(1626): n is a, c, g, or t
  misc_feature (1635)..(1635): n is a, c, g, or t
catggagcacgactcgtgttacattgacacttggaagtgctggccnaatgtgagggaaactttggccncacaaggttggcagggaataaactaacagtaaaaaaacattcatttatactatttgcattcttgggtgtcaaaattctatttaataaaatacgaattttaagacccataaatattaaacttgcaatggttcatttttacagacatcaaaacttcaacaggatttcgcagttttaatatcttggcaagtgtaatagccgacctattgttagaatttgattgaattaagtgttccgacagaagtttttacgtcaacacgacacatttgaatttgttgggtggccgaatgttcaaggaatggtatgaaagagaatgtcaaggtaattaacgaattctaattgagaagggtttataagacaatgcgactattttaggggagaaaaacgctgtcatccaatcgattgacgccaatgaattagaagagttgctccaaacttgttgtgcttacgggtcaactccaacgatacacaggtgaaccattctgtccatttctgtgaaattaccatttggtttaggaaaaactttcggaaaattttggaaatagcggacaaagagaaaatttcagggtttgtgagtttttgtctttttcgttaattgttaaccaaattaagccttttgcgcattgtcgagtcttttatcattgattccgaatgcatccacccaattaggaagcttgaatatgcagcaggtcaaaactgaatctgcagggtccgacaaataactcaaatgttctttcaaaaacagaatatcggatgagccgactcgctgacacagtgcttcgattatttcctactcaaattgaccggctcgattcattattcttatatttagcagaaaatggagagacattggccgatgttcacttggatgtacttaaaatgcttgacattcatgattcatacattgttatgtaaaacaaattcttgctcttgacaagattttatctcttataattcagttttgcttttattttgggacgttttttgttttttcattccaatgtcttctccttcgtcctttctatttgagcagtttttcccatggttggtctccttaattgctctgttctctataattatttggttgcgaagcaaaacaaatcgaactttgtttgtgaatcacgaaaaaggtaaggtttaaagaggaggagaatgttaattaagttgtaacaaaagggagaagactaatggccgtgcttggttctggcggacatacgaccgaaatgctcaaattgcttgctgcccaggacgaccttttccctggaaggctgtacgtaattgccaaatcagataacttgagcatagtaaaggttctaatttgaactgtcattcatttggttggtttatgataatatttgaggttgaggagtttgagcgaacacatggcaataaattctgtgtcagaatcgtcccaagggcacgtgaagttgggcaaaatttgctttcgtaagccatgttccaatgtttttgtcggttcgagtcccaaatctcattttttgctaaatcgtgaataagttgtaactacggctaggcttttaggttctaaaaactgcccaatccnaatttaggngtgtaaaatcgtaaataattgcgaataactcgaaaaacatgtttttcatgca

SEQ ID NO: 19933 - DNA, 1802 bp, Heterodera glycines
  misc_feature (1747)..(1747): n is a, c, g, or t
  misc_feature (1777)..(1777): n is a, c, g, or t
  misc_feature (1787)..(1787): n is a, c, g, or t
ggtttgatgacaaatgaaaaaaacaatagtcaaaaaacatggactggctccgaacgactccgaccgctgtcaacaccgtcggacccccctactttcccaaaacattgttgaaacaccgcaaaaaagtgggtttgaaaagcaataaaaaaaaactcgtcgattcatgctcaaatttctcaccgacgtattgttctcaggatgacgaatctgttggacggcatttgttagctaaaattttaaaaccaattaattgtattatattatgtttctgtaaatggactgacgtgaacgagctgttcatgaagtttttgttgctgttcatgaagtttctgttccgcgtgaacgagttgtttatgaagtttttgttccgaagcgtacatttccactcgtagagctttaatttcccttttcaatttgatatcgaccaatgtttgctgcgctttgttttgctcgtactccaattttgcaaattgctccgcatcgctcgctgtcaaaacattcgccaaaattgcctgttaaaggggtttattttggaaaatttccactttggcatgggccattcctcccatataaaacgggtttttgacgccaatgcttaaaagtagtaaaaatttcagtcaatttttttcatagccaaagtgaccccgaaccattcttttgtgttttttgtcaattcgttcacctttctttgctggtataatatagcagtcgcccttggcataccggtaactgtctccacatcaatagaagctagaataaacaataattagtagggcacggagcgggacggatcccgcgaaggattttgcgagatcccagtttgcatccagcattgtatgtatgcgcattgctcaaactagggttgggcccccgacccttgtaactggcttcacccacgagttgaacagtgtgaaccgccatagagcatttggactattttattgaattctgtgcgcgatggcggcggcatggattcagtgcgcgatggcggcggcatgaattctgtgcgcgatggcggcggcatgaattctgtgcgcgattgcagcaccggcaatggcacttcagcgacaatctgttttaaatgcattcaaataaaacttttactttttgtttcaacccacattttcaagcttttttgtaattttttctaagtcagctattactgcccttatttgcaattgatccacgctcatctgatgtatgtacacaaaaattaggaaaaaaggctcaaaacaaatagaattgatttaaaagaacctaaaaacaaagagaaaaatgcaaattaattgagcgtttttttcatgaaaaatcggtttgaaatgtccactttcaatagggaccaaatcaaacagtccgaaaattgaataacacacgaaacagatttaggtttagattagtttagttgtaatttgtgcttatttagtaccggcaccttgttttttgtgcttagttttccgactttatataaaaattacaaaaaattgtaatttataatttacttatttttagttaaaatctgataacttgggctaggatatttacgtgctaaaaatcgagaaataggtacctaaataggtgctaaaaatgtttgtaaagcattttccaaaaatgcgggattgcggactgggatcccgcaaaacaggaccccgtcccgcaccgggctctagttcttacaacagtttattttaaataaaataaatggcgaaatgaagtttgggcaccatagagaggaattcgaaaaaataanatattatgtagaaatgttagatctaattanaatatagtanattataacaattgct

SEQ ID NO: 19934 - DNA, 3296 bp, Heterodera glycines
taagaaatgggaaatggaaagagaaaaagccaagtgaaaacagcgaggtagcccagagaaagtaaggagagagagaatttagacaaaatggagagcaaaaagagagagagagagagagagaggagagagaaaagaaagaaagaaagaaagagagagagagagcgagagagagagtgagagaggacgtgaaatggggccgcaaaattggcaaatgccctgcgggggaaagcaatcgatgaatatatgtatatttaaaaacgtaaaaatacccgttcttgtttattaaattcggtgaaccagtgatcattaagcactgaaatgaaaagcattttaaaatggtcagtgatcaatgatcaaagcgcatgaattcgagagaggcgaacatggaagaaaggggtgaaaaggaaaggcaatttgcacttttctcctttttagtcattacgaaaaacgaaatgattttggtttcgatttttaaaaaccctaattttaggcttttggttcgttcggttcgcattcctccgaaattttcttcctcctaaagcaccaccaaacatcccccaattctcattcttctgtcccgctttttctttccacgtttcccaaccgccgattcacttgttatttgtttactccataaaacgcaaataaataaggcaccaaacatcgcttacgcctttcatttcgccgtaaacaaaaacataaaaacattgggggggggggggggggggtggagcccccgacttaggccacataaaaagggcagatccgacctcattcactccatctttaactaaaagcatgcattggcttttcctgactgttgtggtgaattcacttttcctgcctacccaattttagcttccctaaaacactgttttccgaataaaagcgctaaggtttgggactgtttagtttggatttcgggtaaaccattaataattgcaaggaaatagataaccagttgattacaaaactaaaaataatttaattcgttgtggcatttcaaaagttgcctttacatttgaatttaggaaataaaacaaaattccggcatttatctcacgatttcataaatatgcttcccaaaatcgtacgggctgatcgcatgctcactgggggtaaggccccagaggatcctcatttaacttagatcagtgaatgccgtggcatttccccttaacacttgggtttttcatttttgggtgttatccgaaagttcatttatcattcgaattttcattttatccttaatatctcttcattgcttcgattaaattttagctaaacaattccgattgattccaacaaacaaagcgagcagaatgactactgaacagggaaagaacgaacaacagcagggaaagggcatttacgagagcaccaaggaaagtctgtcgaacgtggcggaggggacgaaggaatggctgacgagtgccaaggacaaagtgggattttgggataatggagagagagagtgagagagagagagcgagtgaggagagagagtgagagagagagggaggggtgatagagaatgaaatgaaaaaaagttgtgggagtatatgcagatggtcagtggataattgcacttcctgtttatttgttaggtggccgattcgctgacttctacgaaggacactgtgaccggcaagtcggcggagatgcgcgacagggcgtccgacagttacgaggatgctaagcagggggcgcaggaccgttacgagcgtgccaaggagtacggcagtgagaagacggagcaactgaaggactatgccaccgacaagaaggtaaagcccatcggaattggaaatgacaaagcggagaaaaccaaccatgaccaacccaattcaggaggaagcgggcgagaagatggagcagaacagggagaaggctgctgagaagtgggacgagacgaaggaggctggaggtgggggcgaaagggatagcaaacgggaagcatttggggagagggcaaattggcaatcaatgggtttgaaagttaggggcgttaagtagttgaacaatttttcggctaagggcacactgcggtttaagaatgtgggtgatcatgataagaatgaaagtgggtgtaaaaataaaccgaattatttaactagctaattaattctttataggcgagcgtatgcagcgcgccggtgacaaaatcaggggcaaatagaaaggatgtccaacagaatgaagagcaaatttatctgatctgatcggactctgtgagcccaatttaactgctctttttattggaatatttgttgtccatcttctcatataaaattttcgtgaatgaaaacaattcactataatttgtgtcaatgcgttaaatcaagcaaccgggaagaaaaaaacagcttagatgggtaaacagaatctatgaaattaaaaacggggagtttcgaatgcgttagggccaaggcaaagtttgtctaattagacgatttgctcattttatgttcagtttggccaatacgtctttgtccgaattgttcaggagaatgaaggtggcgaatgcattgagcaaatccttttccttttcgaagagacgagaaaccttcagatagacctcgtcgagagtcgatttctgttggaaatgattggcacttaatcagtcaaaaagcagttaagaagctaataaatgggaggatcaaataattatttgcacttaattctttgaaattactattcctccaagggtttcgatctaattgcttcttaatatttgagaattgacccattgatatacatatggtcttatcaagttgctgaattgtctttaccgtactacaattgaacattaaacactacttttgttttgtagtcttttaggtgatgcaaaaactgtgtgtacaaattgggctcactcgcaaatctttccttaaaagaatttatttatggaaatgccttggtatgttaacgagatattttaatcaacgaatggtccgttttatcaattatagaaaaggtaaaaagtaattagcgctcaaatgaactcgcctttactctcttcacaaatctgactgcatcttcctgtgtttgatcagcttttggtatttcataatcggggccctgtttgaattattatttgttttttaatttaacgattcaaaatcaatctaaaaaataaataacatgagtcaagaattctaaaacttattgaaaatatgaaaccgaaaataacctaaattttgttggatttaaaagaataaaattggatttgaaagtaaagtttgaaactcacaagaacattagtgtaaaattaaagttttgtaaatgttaaattt

SEQ ID NO: 19935 - DNA, 585 bp, Heterodera glycines
ttcccgcactaattaatttttcgaagatcaaaagagaaccgagggggtttattccgatcatttttcttaagtttttttcaattcataattctgtgttttaaaaattgttgcgttcacaaatcgataatttccgttgatatcgattaattgggggggggcacaaaaaaatcggctgaacaatcacggggactcaacccactaacatttcaatcaccaggactcaacccaccagcatttcaatcactgggacaacccaccaacatttcaatcactgggactcaacccaacagcattctaatcactgggactcaacccaccagcatttcaatcacggggactcaacccactaacatttcaatcaccaggactcaacccaccagcatttcaatcaccaggactcaacccaccagcatttcaatcactgggactcaacctcagcaaatttctttagcatttttaacattttgtgtgccttgggatgttgaacagttggggagggctcggccgcttcgcggcctcgtacgggggcgttagtccccccataacaattattctgcgccaaaggaactcgctcgcgcgattcaa

SEQ ID NO: 19936 - DNA, 1588 bp, Heterodera glycines
aaaaaaaggggaaacagagataaaagtcaaattttagagggtctcaaagaaaagcgtgatttttcaggtacataacggaccgccgcatgacagcaattttggttattcgtacgccagacgaatgatcggtgggttggcaatgatcagctaaataaattcaaatttccaataaacaaacagatgtactcaaccgcggatatgctcaggagcacaatcgaaagtatcgagaaaaaataaatattttatttttgattaaatattttaaactttctctctccacctctctctctctctccacctctctctctctctccacctctctctctctccacctctctctctgtatttctttattttttttctctctctctccccgatctctctctaataattaatgcgtgagattgccgacatttttgaacgagtgttccaaaggtacacttcggcagtgccgtgcaatgtatttggaccgcgtgacaattacaatttggagaacggtaagagaaaacgcaatggacagaagagcacagacaaatctttacggagagggaaaaactgggcaatgcacgaaaatatgaaaataataataaacccccacaacaattttttgcgccaaaggtactcgctcggccgcttcgcggcctcgtactggggccttcggccccccacaattttctgcgccaatccaccatcatttaatcactgggactcaacccaccagcattccaatcactgggactcaattctcctgcatttcaatcactggcactcaacccaacagcatttaaatcaacaggactcaaccctccagcattcaatcactgggactcaacccaccaacattccaatcaacaggactcaaccctccagcattcaatcactgggactcaacccaccaacattccaatcgccgggactcaacccaacagcattccaatcactgggactcaattctcctgcatttcaatcactggcactcaattctcctgcatttcaatcactggcactcaacccaacagcatttaaatcactggcactcaacccaacagcatttaaatcaacaggactcaaccctccagcattcaatcactgggactcaacccaccaacattccaatcaacaggactcaaccctccagcattcaatcactgggactcaacccaccaacattccaatcgccgggactcaacccaacagcattccaatcactgggactcaattctcctgcatttcaatcactggcactcaattctcctgcatttcaatcactggcactcaacccaacagcatttaaatcactgggacttaacccaacagcattccaatcactgggactcaattctcctgcatttcaattactgggactcaattctcctgcatttcaatcactggcactcaattctcctgcatttcaatcactgggactcaacccaacagcatttcaatcactgggactcaacccaacagcattccaatcactgggactcaacctcagcaaatttctttagcatttttaacattttgtgtgccttgggatgttgaacagttggggagggctcggccgcttcgcggcctcgtacgggggcct

SEQ ID NO: 19937 - DNA, 1368 bp, Heterodera glycines
  misc_feature (1340)..(1340): n is a, c, g, or t
caggacggtcgcttcgcgcttaaaagtcgaatgccttttagtttaaattttttttataataaaatactcgttttattaattaaaaacaacgtcgaaaattaataattgaatatttgtttaatttgaaatgaaattaatttttttgcaaattcaaaaaataaataatgaaaatttttaattaaaaaaaattaatttaaataatttacaacaaaactattttaatttattaaatgcagtgaaaattacccaaaaaatgaacagaaaaataatgtacaccgaccggatccgaacttgccccccgccccctcaaaatgatgcctcagaatccccaatcacacagggattctgaggtcttaacgatgtcaaaagtaaaatctgattgcgtattcgtgatcagcggcccaaataacccataaagacatatttttggatgatttttgattttcaattaataaaaatatgtaaaaacagcaaaaaatacaaagaaaataatttacacagtccggactcgaacttcgccccccccccaaaaaaagatgcctcagaatccccaatcacacagggattctgaggtcttaacgatatcagaagtgaaatctgattacgcattcgtgatcagcggcccaaataacccataaagacatcttttttgaaggtttttgtgagaaaaatttttccactcaaaaatcctggtcacccaacatgatttaaaatttaataaataaggaaattttttttattaaatattaaaaataaaatgcattttaattttaaattattaataaaaaacaacgttgaaaattaataatatttattttatttaaaatgaaattaatttttttacaaattcagaaaaatattaattgaagcaaaatattcgatattttataaactttaattttgaccagaagcagtttcaagcaaatatgaaaagatgtttatcttattatttgttacatgaatttataaaatgaatggtatttttaatattaaaaaaaatgagtacagcagttgattcataaaaaaagtattaattaaaataaaaaatgttttaattattactaaaaaatttaaattaattaaaatcattgaaaataacacaaaaataaatagaaaaataatgtacaccgatcggatccgaacttcgccccccccaaaaaaatgatgcctcagaatccccaatcacacagggattctgaggtcttgacgatgtcaaaagtaaaatctgatcacgtattcgtgatcagcggcccaaataacgactaaagacatgtttttggaagattttgggtgaaaaaatttttacactcaaaaatcctgtccaccaccgttggtcccgnaagcacaaaatccacttttatttttata

SEQ ID NO: 19938 - DNA, 825 bp, Heterodera glycines
tttttaactgatgaatgagcgagcggcggtccatttccgagaatgaaaaagtcgcaaaaaggattgtttgtttgtgccagatcaaaagtgccaaaatcggcacaattcccatgacaatgactaaacatccatcgaatgagtgggaaaatcacaaaatgggaaaggaaaaaaactgttggcctcacttcgaagacaacaaatgaacaagcagatattctgatcataaattaatcttaacaatttttagattggattttttaaatttaaaaattttttaaattaaaaatttttttgaaaattacggattacgccaaattacggcctttttggatctccgtaatgacggatggccgtaactgaaaaaattgccgtaatacggatttccgtaattgaaaatcagttacgtccagccctgccccccccccccccccgcttctgttacattttttgtttgttcctaattttggcgaatgcacgtgaactctctctttatttgaaatgagaaatggagcgaaagatctttgttttggatgcctttggttggcacaaatttattttgagttgtagtgaattggtttcggctgtcagtgaaccacataatttgtcggtacttgtgtggtttaccggagaaattccacatagattcttaaatgcctataaatgtattcattttacattgtttttttaagtatggaaattttaagactgtattcgtgacttattttctctcctgcaaaaacctttactattttttaggtgagttggcgaaatgtccgaatttggcttatttggcgaaatgtccagttggcgaaatgtcgtcgtgcc

SEQ ID NO: 19939 - DNA, 2594 bp, Heterodera glycines
  misc_feature (1803)..(1803): n is a, c, g, or t
aattttagttcaaacaaatttattagcataaggttcaacaaaagattgatcattgattctgacagtttgtgattgatctgagcttcattaaaatactgatcgatcgctttttggattattaataattgttggggtagcggaaactttcgatcattttacctggtcaattttgatcacttactgatcaacaggggtcgatgaatgtttgctggggctgcacgactgtcatccgcttgcgacttgcgtggatttgacggacggatttcgttgcgaatgtttggacggactgatcgacgctgcgtcgtctgctgctggtggtgatcggccgggacgaaattgcacagcaaaaaacacatctgcactttttgaaacgcaaggtaacaaagtgttcagacagtgatggataatgttgtttaaagggagtaagcttatcagtgattgatcgctacaactgatcagacgtaaccgggggaggggggggggacaaaagcccataaagtcgtaaatttaaaaattgtaaaagaaacacttgaggcgataaagtatacaacaactcaggttttcaaatatttttggccataaattttttgaagcttaacgaagaatgatatcaaaattaaaattttagttcgattcgagcaaagttatgggtagttttttgttgaaatttttcattttatgatttttgctcacattcacaagcttaagctgatcagtgcttatcaatgctgatcagccaactaaagaggtcaatggggtgacactgattagccccgctgcgcgggtggcatgccccaattccaattgatcttcaaatttaggttgattggattgaaatattttgtaaaaaatgtacgtaaaaagaaatagaaattctgctgatagaaattgttgaggaataattgataaattaaatgttttttttgccgtatgcttaattaaagtcgaagaaattctttttatgtgcgaattttttctgaaaaattccttcttttaattttcgttaaaagattttttggaattctcaattaatagatgttttgtcataattttaactaacaaataagaaaaatgccttttttcgatattttcgcgactttttttaaactttagcgctaaaaaatgtgttggcattatttttggcttaagtttgtttttcagcggacattggtccctcctccgtcgatcgcttcttccgctgcgactcgtccaactgcgacccgtcctcggcccaatgtgtgccaatctcttcgagccaaccgtcgtcctctgtttgccggtgccgtgccggactcgtgcctttgtcggccaccgacgaccgttcattcccattccgatgcggacgaccgcccaacaaaggcgcgtttgtgagctttatgtaccaaccagggggctgatttttgggtggcattagtttctgttcggattcctcaccgatcaaactcagtcgaacatttgagttgtgccgaattgcgaattgtttagaccaaaattaaaactgaactcttgagatgcctgtttttatcccgaccaatccaattactttctcgagtgagaaatgatcccgatcaaatgttgtcggatttcaaattgattatcaaatagactccaaacactcaaagggttcaattgaaagtgtcggtcaatccagaaacagatattacttcaataatcgaattaagtcgctgtttgcttcactgatcactcactgatcactcactgatcatgtgctctaatgcttccattccaattccgatcagtcccgtctatcgatcagcagaaccatccgtcaatcattatttntaatgataatcatatatcccgttgtggccttgcttcttgtttctgtttccaaatgcaaaagtgcgctccgatcatggctgatcattcaaatgactgggaatgcttaacaccaatcaatcaattcattcattctttgccgacccgacaggtccgatcctgatcatgtccgatcagtagcagcatttcctctttgttcgtcggcttctcctttccgttcatggcagggaacacttcttattttacagccaataaataagaagccgccgcttgcgcctcacacaaagggtcccccgctgctgtgcggcttttcctcccccgcgggcgacgacaataatttatacaaaataattactcactcacacccgccggcggcggtgttgttcttgttgttgctgttgttgttgttgttgttgttgttgttgcacatgcacaccttttccgtgtgaatttccatctgttgctgacgggcggacccgttgcttcttgctgctctgctcattgtcattcattccgtttcgctttaataaatatgcaaagcgcgagagagagtggacaatggggagagtgggtaaagaaggaggggagttgggacaaacaaatagtgagacaggggagagatacgagggatattagagataatagaggaataagatagggaaaccagagaaacaaagaaaagcgagagagatatagaaatatataaattctagagaagactgattgtgagagaagaaaagtgatcagagaatgaaatgaaaaagcgaaaggaatgggcggcggggagaataggg

SEQ ID NO: 19940 - DNA, 1294 bp, Heterodera glycines
aaaaataaattcccatttaggcaatatgaaaaattggttagaaaatatgcaaaaaatattgtggaaaaacaatgaaaagcaatgcagttcacacaaactccgaaatttttgaaaaatttaaaataaaaaataaattatttttaatatttttcgggaaggaaataaactgttcctataaataggtgtctaaaaatcggtgcactacgtttcccgcgccgagaaattgaaaaaattttttactatcttagaaattttcaagaaaaaatcttattgttagaaagttttttttataaaaaacctctaaaaaatgaatttcgaaaatttttttttcttagttttcttaagatttttcttgtcttcgaggggatgccaaatgtgaaaaaacaacacgaagacttacccccgaatagcaaactgttcaagggaagagggactgtaagaagaaaatggaaaagaatttcaaaataaatcgggcagaaatgagaacaccgactttaattgtttgagttttttatattcatgaaaaacttcctaaaaggaaaaaattttttttcaaaaaagcctttaaatttttgagtttttctgtgttcaaagcgtggcttatgcacctccaatttttgcagattttcggtcggctcagccaacaattgggccaatcgttcgtccgttgcgtcaattcgctgctgacgcgccgcaatttggtcggccaacagaacattcgcatgacgaagctgaacatgaagcagaaatgattgacagcctcttaaattggaacagacccacaaaaaaaacgctataaaaatctaacaaatttttcagaaaaaagcatataatttacccatctaattgtaagccaagaaaaaaaaagaattttaatgaagaaaaattctcagaaaattgataaaaacaaaaaattctggaaattctatgaaattcagcgcctttcgggttaggttttgtgaatttttaaagttattttcttgggggacgacagaaagaggggaaatgaagtgaacccctcttaaattgactgacaaagaaaaaagtttattgtttctgtcgtcgaaatgattccggccttatcccgccccgttccccctccaattttctttccaatttttgcattttccaatttaaacattttacttttgccagcattcgccgcttttccaccatttcactgcgttttttggccattttttgtcgtgcccttattgccaatctctttgcttcgtcctcctttttggtttgtgttgcgattgtttcgtccgacggagcattcgatgcatttttt

SEQ ID NO: 19941 - DNA, 1932 bp, Heterodera glycines
cttttggccataaatttgttcaaaattgacgaaattttttggaattatgcaagataatagagcatctgaaggacactcgaatgataccaacaatgttagattttgttgacaaaaaaaaagttatagtccaaagttccttcaaaattgtcattccttcaaaattgtcattacaaatgtgcccgaaagcaaatcggacaaagcgacggagagagcccgggaggaccgtgccgttgtggacgaaattttgaatgccacggacgttgatcaggcaccaattgtcttccgtgtcggcaaacgaatggatggtcgaccgcgccccctcaaaatggaattcccgagcaaacacgcagcgcggcacgtcatccgcatgcgcggaaaggtgcaagcgttgaatggtctacacactgtacgcatccgcgaaagcatgaccaaggaccaactgtcggagaggcggaaactgatcgaagaatgcgggaagaaaaggcagacggacaacggtgattgggtgatttatgccaatcaggttgtgctgagacaggacattgaccatattcgaaaaaatttttaaattgtccaaccaaatcactgcaaattacctataattattacccaaaagtacaaaaatttttccggtctgtaaaaaatttctaccaaaaaattactcatccaaactttttaataaaaaataaagggaatgttaaatgctgcctaataaacattaggtcaataatgaataaaatcgatgaaatagcacttattttagaaactgaaaaaatagacattcttttaattaccgagacctggaccaaagacggggaagaaatcgatttttgcccttgggtaaaagagaattacaactatattttttcatcaaggaaatcgaaaactagtggaggtggttgtggtattctaatcagaaaagaaattggattttttacaaaattttcggattcaaaatttaattctgaaattttagttattcaacttcaaaatttacaatgcatcagatttgttttggtgtatcgaccacccaaaacaacactcaagcaaacagaaaatttgttcaaatttttacaaaaattttttaatgaaaattcagtgactttaggagattttaatttaccgaataaggatttggtatggaaaaatgggcatccctattcaatgagtaaatatggtgaaatattttgtgactttttcaatagattttcttacgttttggccacaaatgagccaacacggattaattcctggctagatttgatttttacggccaatgaaaaaattattactgattgtactgttaaaggaggcatattttcatcggatcatttaacacaatttttcacattaattactcctaaaacaaaaccgaaaacaaagatcgtaaactttcgttggttttgtccatcgaatgtgttacattttaatatagtcatagcatcaaggctaaatgccttgtcatatgaatgctttagcataaatcaaaaatattccgcctttaacagtatgttgttagaaattttaaatgagtgtattccaataaagcgtttaacaaagaaagatttgactcctaaatacccacaacatttattagcatccatcaaagaaaaggctaaattattcaggcaagctaaaactgacccatccaaaaaagcactatacgatagcatttctttacatataaaaatacaaacaaataaataccatagccaaattgagaaaaaggctatttcaaagggaagaaattcaatttataaatatatacaaaaattcaatgtcaatccctttgaaatacctaatctaatctatgaaaataaatgctatcataatagtgctgagaaatctgaattatttgccaccattatttgccaattcatttaataatagtgaaaccgacccaagctatccatgcttgggtaatattataga

SEQ ID NO: 19942 - DNA, 284 bp, Heterodera glycines
ataaaaaaaaccgggaaaaactatagaattgggcccgcaaaaaaaccgcccaaaaagggttccaatcaatctctaatgacctctaatcatcgtaaaaaatattcccgaggtgcggaaaaatcaaaaaacaggtttttgagccggtttaaatcacgaaaaattgcaccaaaaatcagccaaaaccccatttaaattaaaaatttccaaacaaatttagtatcatccgaaagctcttgatgaagtacatctaaaattcaaggaatgaagttgaacggatgccatct

SEQ ID NO: 19943 - DNA, 1240 bp, Heterodera glycines
cgtcatagcccaatggggtccgcctgtacatttcggacatcgttgagcgtgtgacccaacccgtaatagcgctccttcatgtcctccatgctttttcgattccggcacaattcttgatcaaatcggtcctcaatgattggccatcttaaatttggctatgattaaacagtgaaaatttggcaaaattttttaaagaagtggtaaaaacctcaaatcaaactgcttgcaaagctccaacaagtgctgtgtctgttcacgagtccaacgcgggtccaccaaatgttcttcatattcctcatccgtaaaagaaggcacatcaagttgctgaaaatggggaagtgaaatcattttggaaagtattattctccatttttttgggttaaaaatcggattttttttgaaacaaaacctcagattttatttataattacaaatatgagatttttcatatttttgtttataattttcaaaaaaactaaaaatccagattcgtctaaaaattcaaattaatttgagacatagtgcatccaaaaaaattttctccggaatttggtccgacccatgttctaattgataacaatataaacaccttattgaactgcacaaaggagtagggcgttgaatgtttgtcctcacgttcccaatgcttaagcgcaagtccatcctttctcgcctcgttttcaaatggacaccaaagccattttctgacaggacgtttacccagctaaaaaaacgaataacaaatacaattttcaatcaatttaattaatcagaaaatttaaaaagtccctaatttgtttaaaatgaatgaattagattgaaattatttaattttcgccgttgtgggaaaatgggcgctagccagatttttggagtatcttacccgaaatttaacaattttttttgacattttgcaggaaaatagagaaagggctatcgaattattgatatatcaaatctcttcaattcattcggattatactccaaaaagcgagctggcgccaatttgtaccaatccgtttttcataaaatgtataaatcgaaaaattagacaaattcatgtttaaaaatgtcaatttaatgcaaaaaacctgcgcttttgcgagagaaaatcccttcttcgtctgtgttggcatcaacgattcgatcttttctaaaatccaattaaatgttgtgtggatttttttagactgttagttattgctgcacttgcctttgttattgtccttgccctggtgaa

SEQ ID NO: 19944 - DNA, 525 bp, Heterodera glycines
acccgtcatcgaccatgcttcttcacaacaacggcagatccagcagcagcgtaatgccatgccaacttcctccacttccccagcatcggctcgtgtccttcaccaacagcagcagcagtcccaataccaaaatgtgcaaaggcatttgtcggtgatggcttctccgtcgcccactcagcagcaactgttgttgaaccgtcaacaacagtacaacaaccactatctgcatcaggcatacggtggtgcatcactcgcctaccgaaccaaccatcatccgtctttcttggcctcatcctccacttcttccgcttctgtccatccgttttacatggccaaaatgtcggctgccacttccgttgcttatcccatcatttcctatccgtcttcgtcagtttcttgcgcactttcttccattaatagttgctcatcatcacaattatcatcagccaatcattatggtcattaattgaaaatcacttaaaaataaaaaatgaaaatgttgtgccattgaaaatggtttactaa

SEQ ID NO: 19945 - DNA, 790 bp, Heterodera glycines
cagcaaaagacggaggacggagccaagccgacgagggtttgtattttgagaatgaaattggcattggcactcaaatttggattcaaacgcaaaatcttctggcatttcattcgcttttcttatctcaacacagaatgccgcgcctcgccgtgtccgtctgtttttccatcgtgccgacgatgacgatgacgaccattctggcggcggcagtggtggttgttcgcattgcctcaatcgatggcacaccgacaacagaaacagcgtccgctcctgtcgctgtaccggcaccgaccaccacttctctctgctcaaccgtcccgttgggctgcaggacgcacacgcggacgagcgaatggccgcgctggtggagcagtgcctggcgttggccaacattttgcgcggctacgcctttctgccgggccacgagcgaacattggccgcccacggcggactgttgcgtctgctgtccgcactgatgatgctgatggttgacaagaaacaacagaagcgggcaaagccgacaacgaagcgtacggcagaaacggcagcgaagagtggcagggacaacgacgagatcgggacggacacccccgtcccgggggatcaccaccagcagggcatcaagttgaacaccaattgcaatgatacaagcatagcaaccacgttggaggagggagtggagcaggtgaactgctagcgcttgagggaatggtacacgggcaattttgtttcctaatcgaattggccaaaaacaaaaaattttataggtatttttgtcaaatttcaaaaa

SEQ ID NO: 19946 - DNA, 1901 bp, Heterodera glycines
ccaaattaattcggttcattttttaaaattaatttttatattaatgaaatattctaatcttcaataattctattcaattaaatcgtttcttttggtaaatttttgttcgctgttttatctcaaattcaaaataacttcattttccaatgttaatgtaaatcataaatttaatttattgtaactaaatttcaggaaaaaaaactaaatgaggataaataatgtccaaaacaatatttatttttaacataaaagcatgtttttttaggctagccacattcaacacagctgaatttaaaaccttaaaaataaaattcgactgaataaaaaatattgatatgataattatttaaagaaatcattttttatttaaaaataaaaaatgtacgaaacacagctatttttcaaatgtatgtttcttcgtttaattcttggtttgactttttattcttttaaaggattgttattttattctcaaacaaattaaccaaatttttatttttcgtgtaaatttgaaattattatgcaatggtgaatttcaatattaaaattaatttacttttaaacgaagaatataaatcgatttgttcaagcacataattattttaatgagagcgcaaatgtcttttttgttaggcggcgcaaatgtccgcggcgcaaaagtctatttttactggccggcgcaaatctcgcggacgcaagtgtcgaaaaaaatcattttaaatattaatgttaacaaaaaaacaaatagaaaattcgaataaaatcataattttattacctaaccataatgaatttttcattgatgaaaataaaaacaaaaccaatttccaacagaaatgataatttaaaaaagcaagttatatcttctaattaaaatttaaaaatatctttattttagcaagtatattttgtcaattaacaaataaattttaaatccaattttatagtcttgatttaccgccgttgcaattcaagagcagcgacagatgaaagaatattaatttatatttaatttaccaaaatttaaatacaaaaccaagtatatatttatatttttaaatgatttaaaaaatatataaatctcaatccgaaattttagattaataaaaattaaatgaagttataaattattttatttgcattaataaaatattttcactcctaattctaatcttgtgaaaaaataattcaacacatttaaaatagaaaaactgatatccatccatctaaagtacaaattagcaataaacaaaaaagattaaagccaaaaaaacctgcaccaaaaattcgacttgaaagaaaaattggcagaataatgctgcaattagtaaacaaatatgcaaaaaatcagcttatcatatacaaaaaaagttatattttaagtaatataatttaattaaagtataaaaacatataaaattattatgataaccaattttaacgaacggcagaaaacatgaagccgttaaacaacaaaaattatttcgacacatttataaataagttagacataatgttgttaagaaatggattgaagactttcaattaaatataatttatttaaacaacagaaactatataaatataatttatatctaatatgataaatttacaattccacttaaaaataatattaaaaagattaatatttcgttaactgacgggtcagccgcaaaaaaacgcggaagcacgaccatatgacatgaaaataaaaaaaagtttaactttttcatttgcagttcagttccttaagattaagtatataataattaagaaattgatgaaatggataattaacttttaataattgaaaataaatattattatcttttaactcttctcgagaacgaatgaatataaggtaaaaaattttttgaaatttaatttttattaaattaatt

SEQ ID NO: 19947 - DNA, 1405 bp, Heterodera glycines
  misc_feature (1101)..(1101): n is a, c, g, or t
  misc_feature (1114)..(1114): n is a, c, g, or t
  misc_feature (1142)..(1142): n is a, c, g, or t
  misc_feature (1342)..(1342): n is a, c, g, or t
gggggggggggggatccggaaagtgcgaacaggccccgccgaagaaaattttgaaaagcaatttgttaacggatttttgtctcaaaaaagtaaatttattcgaaaattaaaatttttactcttttcccctttcgccggattatcaaaaatatcaaaaaatttggattattctttttttttgatttttataacttactaaaaaattctttttaaagttatcagttttttgaaatatttttggtttgtttcggaaatgactcgctggggggtttcggattaaaattggcaaataatgatataatcacacaaacaaatatgccactcgtaggtgattgtgcacagtgaggaggaggaggggcccgactacttcctgcactccagcgcctatctgttggagagcacgcggtcgctcacctatttggaatgggtccacgagcggcagacgcggcgcatgaagacgcgctccgagtggttcctgtcgccgccctcctccgtgtcgccgtgttcgaccaccgcagcgatgccatgcggcggcggaggcggatgtcccaaaaagcagcagtgctccgggacaggagggggagtaggacgaaagggggtacgattttgccatgcgaccggcatttttgaactatggtaaatgggatgggaccgaaattgtcccattggggacaaaatttgacggggatggggcggaattggctggccgggcccccgccccgcccgccctcccctcgtcataagaggcctggctttcccggcgacgcttataggcatcgtcggcccccaaaattcctgtaagctttttaatttgattcaattatcagtctttggacaaaatctattcctgcaccccttgtgcatgttggtctgaaaccgagacagatcggattgtaacttaaattcacagtccgactttatcgccgacaatttttgtctattttcgttacatccacgcttccccttggccccgtctgcctgctgtctctcagttgtccctttggcccgttttgccttccccggccccttccgccgcgggcggtggctcgggctgtggcggcggtggctgctgctcgcggtccgcggggttgctgcttccgnggctgcggcgtgncgccgcgtcctctggccttggcccccgnttcgggcgcctccgttgccctcctggcgggcggcagccgcagtgcccgtgccgtcgttgttcttctctccgtccgctcgggcttcgtcggcttttgttgcctggccggtccgtggccgcggcggccgcgccgctgctggtggtctgctgttcgggcgcggcggcggtgtgctgctgtggcaggtgttgcacgtcggccgntgccgtgggctgttgcaccagaagcgggtcagttcggccctatcaagttgaaggcattaatta

SEQ ID NO: 19948 - DNA, 1870 bp, Heterodera glycines
aacaaatacatttacatatttgccaatagctaaccaattatgccttatttttgtttgtaattaaaggccacgtgtgtgtcacatccatttttggtgtgttgttaattagcccatttataaaattctctaaatgacaaattaactactggacacccttttaccaattggcactttctcttttcctaatttcattcttttttgttttgtttttgccctttctttcccctttcatttttgcctttttctgatcggcggccgttcgtttattctttgataaatcgcaaaacgacgacgacaaacatttcgccaaatgatgtgctccttttttcacctttgttctattgtggtgccttcgcttaacaaactttgaactttgctcttttgagtgattgaattttttcaaaatttttttcactttttaaaattactttttaaaactgaaaatgattccgcttttgtcttttccccgccgcccccacaataattaaacaaattgacgacagtccgctgatgccccagcccaacccacgcacattatttacaaacatatgcataataaataatacaataaacgacaacaattcatacatatttcaaaaccgcaatcccactcccacccaaccccaaaaattgtgccatgggctgatcaaaccaagcaatttcgaagagggcaccaccagtgggggggggggggggtggcgagtgtgccctcctcctctccccttttttttgtccccgtgcctttgtctttgtccatctgtgtttgcctttgtcatgaaatgtgaaatttcgtgagtaaaaaatcgcaacaaacacttttattatttccatttttctgaaattctgtcgtttgtctgcattccctgatgccctctcacgtttgcctgttccctccccacccctgtcgtcccgttcgagtgctctctcatcccccccccacccccgagttttgcactccctccgtcaaacaacacaattctttgctgtctttggtccggctgtcaaaacagcagccccttcctcccccttttccccctcttcccccagcgttccttccttctcccacccattctttgtttgtcggatttttgccctttccccacccattttccattttaccgcttttcttctgctgtttgcccgcccccattcatcatttggcccgtgagctgcatttttgtttcacttttttttttcttctattttcttctcgagacagtcgccgccacttcgagagtctcgagggaggaagagcgaagcgagagacaacgcgcactgaggagaacacacgccgaggcgagaccaccatgccaaattccgctgcactctctcgccattgtcctctgcgattctctctctctctctctctcaccctctgaaacacttttctcttctttgttcattctatttttagttaattttcagcacttttttaacgtccacttcctcctccttctcttctcttctcttcaccactctctcactctccctctctttatcttccctctgtactatttcttttttcttatttctctcctcagctgaatcttcgccaacttttttgctcttcacattatcatcttcaccatcactcattctcgttttttgtccatccgatttttcttccctctcttttttcccactttttctctgtccattctcgtcgtttttctagccctctccctttcccttttctcttcttccctctcgtcgacccgaccaatctgccagccgtcatttgtgtcccggctgtcatcggcggcggtggaaggaattgggggaagggacttttcccctcaatgggtggagaggaaacctttgtcgtcgtcgcgtattcgtcctttttactatttttaccgccccgattatg

SEQ ID NO: 19949 - DNA, 2006 bp, Heterodera glycines
acaccaaaatcccaatttttcttaaaaaaattagtttaaaatctcgaaatttggtcttttttatacaaaatctgttaacaaatcacatacaaaatttcaaaaattttcccggcggcgcctatcggcaccgccggccccccaattcccaaaagttttttggaaaaagcacgccgcaaaaacattattaatttttaaattttgaataaaatttttcaaaatgctgatttacaaaattttcagttgacaggccttcgtttttatgctaataaaatgttgttttaagtcgttttttcatgtttttattatccttcgcgctactatcagttttagaaaaaatcttatttttggggtccgaatcttagttttagcctcatctgtccttattttgaaaataaaaacttggccgccctgataatgactgaaattaaatttttctcacaaagcagtgccggattaattctccccgatataatcaagttttttgttatttagcaaaaatgtcaaagtctttgaagggttgttaatggtgtcagttaaagaacatggcagccaattcacctatttttgaatcccggacccgaattcgaaccaaaagtcgaaattttgaagaaaaaatttgttgggacattaaagcagaaaagaaccatgaatgaattattactaagttgcaattttcctatcaggtgcgttggtcatctaccttccaaatgcttgatcgtttttgcaaaacaaaacagttgttgggcttctgtatgcagaagacatttcgtttccgaatctaagctatcaaaaaaatatttctcagccccagctacatcgactgaaagcgaacggcttttctccaccgctgggttgattgtgacagatctgagaaaacgcctcagaatgtggacaaacttttatttttgcatcacaatcttaaaatttatgattttgattatgaataaaatttttgggaaaaattattttaaaaaaatcggaatcgtaatcggattttgggccataatcgtaatcggttttaaaaccgtatcggatttttggccataatcggaatcggcgatttaatcggaatcggattttgtctggctcggcacatccctggtggatatgttcacatatattttgggcattccaaagataaaaatttttcggggaactcacatttgtcggcattggattgttaccagtcgaagtgctaaaaattgaatgggtgaaaaaagtcaaagaacaaaaaacgcacgcgacagcggcggtgaaataaaagcagcgaatgtaagcattgccttgggagagggggggggggggaaagaagaagcatttggggaaaaatgaaaaatcgacggaatcatttggcaattagccctaatatgttgcttaattgctcattaataaatttcacctctctccctctctttctcttctatctcgtctctcttaatctctctctccccttctcgttttctgcttaccttcgttgttataaacccatttgttcagataccatttgcctttgtaaaaatagggaatttgtcttaaaattttccatttaaaaaagcaataaaatgtaaaaatggcacccaaaggcttgccacgcactgagcacataataaacgcaactgttgcagtggataatgtagatcatgtagcagaaggtctttgcaattctttgaatgggcattattttatcgcattaattcgtttatttattttttgctccattaattagtgctaattgccattgcccctccgtcgcctaattgcgtggtttctttctctcatttgatcacctgacagcgtatgggttggagaaggcgctgtccaacaggtcgaagaactcccagaaggagtgcaatttaaaaagacggcaaaatcgccacgcggagacggggccggtgaagaagtacagggcatcaagggggagcagggacagcaagtccaacttgaacacgccgctttggaggtaatgggagagcatgtcggacgacgccttctgcaaaagcgacggg

SEQ ID NO: 19950 - DNA, 1388 bp, Heterodera glycines
tgcaattaaatgcaattattaaagaaaattccttcaccattttcaaaaaaaatttgcccaatttcttggtggaaagattgggtcggcagcggtgcgcaaaatgaggccttaaaattttttgaaattttaaaattggggaacccattgtttgggttggtatgtatgcgcatacggcacctgctttaaaaaaaatcaaaattatcagctcacttctcgtgccgccattctgtgccgacctttctacaagtcgacactgtacgaccggctcagcacgcggccctatttgacgggcattgagaagcgatggatcgcatttcaactgctcaaggcattgggtagcaaaactttgcttatgagttctttttacctttttcaaaaaattttttttttgaagctcaattacgcattgcaatggtacgccatggagacataaagtcggtaacaaagactttttttgggtatttttagattttaaattattttacgacataaattgggttgatcgatgtaattaataaatattgattgcctcatatcggatcatttaattttccccctttccgtttttttttaatttcaaaatttgaaattgaaaaacctaaactaagagcaagatgaaaaaacaataatatttttatttattgcgattttcagcgtttttaatgagaaataaggattttaggcaccgtcggagaagtttttagaatttttaatgatatcattaataaatttgtttaaattttaaatcttcccttttcccttcccgattttttaatttcaaaattgcaattaaaaaagccgacgttttttggttttatttgatttttaataaaaaaatttgttttttgaattttaactttttttgccgataaattagctttccgcatcgttttccccagtcaactatttttgtaccatttatcctcccccctctcatttaagacctcaaaatgtgctcgtgtcctcttccctgtggattcagctcaccgattttgcgcccttcaagcccgccctgctcccatttgttgggcaaaaaaatatatatgtttttgttttaattgaacaaaataaatttcaggacaatccgtcggactttacctttttcttcgacaccaaccgacgacggcactgttatttggcgccggaacgcttccgcgacagtgaggagttggaggcgcgggcggcggtggcggccggcatggaattccccaatttctatgaaggtcggtccattttttgtacacattccgcgctgttttttctttttcataaatcattttgcgtatgtttttttacatttatttctttatggttacgattgctttttcccatttggtcattatacggattttttgtcctaattgctttatatggcttgaccttccgca

SEQ ID NO: 19951 - DNA, 1482 bp, Heterodera glycines
  misc_feature (119)..(119): n is a, c, g, or t
aattttttatttcattttcgcaatttttaggcctaaccgaggcgatggacattttcgcgatgggctgtctgttggtggagttgctcagcgacggacgccaaattgcattcaatttgccncaggtttctgccggaaaaaacgaagaatttaccaaaaaaaaatttaaaacaatttccagaaacgaaatttggaattctttcaatttttagagtcatttataactctgttaattccgggcagggatggtctcggaatatgtacttttccaaaaaaacacattccttcccttaggccatcgactacaaaaatgccgacgaacactcggccaaattcttcctgaagcgtttgctcaacgcagtgccggacaccgaatttcggccactgattgccgtcatgttggacagagacccgaagcgccggagggacgaatttctcaaggttaataaaccgggcggggcagcagttgtacagagagtaaattgtgggttttcaaaatttgccgtaaaaaaccctacgaaaaattgcccattatttttagtgacaaaaattggcaaattttttctttcaaaaatgcaattcgcgctattttacggtgcaagtttttaagaagccatcatttcaagcctggtattattcgtatgctctacattttgagattatagaattagtaaaaaaaattgcgacctgaaacctgtaaattttcgagtttgattttagttttctaaaattttcaattattttgaatttatttttcccccattcatttttcagttgtccccctgttcgtccactgtgctgttcccgcagatttttgagcgctatttgtacaactatttcaaggagttgcaaagcttgcgctcggccgacgccctaatcacaaagcaaacacataaattacctaattaaattcaattttaaattttttaattgtatgtttttccacaatttttacgcctcatttgccaggctttttgtggagcgtgacaattacatggcgctgttgcgggacgacgacgccgccagcgcctccgtgctgttcatcaacatcgtttgtgccgcattgcgctcgtgtcgttcactgacggccaaaatggtatttttgtaaatgttgggccaatcaaaatttttaacaatactcttaaggtgttgtttggcaaaaaaaacacgaaaattaattggtttttgtggacaaaaccccaaaatgcgcaacatttttcaggccctggtgatatataatttttcaacaataaaaaatccttgacaaaatcacaaatttcactataatttcaaccaaatgctggacaatctggttgccgaaacggcaaaaatactaatatatttaaaaaaaagacgaaaaaaattcgcttttttaaaggatgctctctcgctgctgcatcagatcagcaaaatttccactccgaccatcatttttgagcgcattgtgccctatttggtgaggaggaattttcagcaaaattaatg

SEQ ID NO: 19952 - DNA, 2393 bp, Heterodera glycines
  misc_feature (15)..(15): n is a, c, g, or t
  misc_feature (35)..(35): n is a, c, g, or t
aataatgcacgaaanatcgtttagcctctgaatantcgagtctttgcgctaaaaaaccgccgcacactcgactttttttgaggtttgaaccggttcaaaaaccggttttttggtatttccgcaactcgagacatattttccatgcttagctccttgagacgaatcgattggtgtatcatttaagtgaccagaaaatattgaccaaatgaaataatttagcaaaaatgactttaatttactgcgtttttcgctcctacattttaatgcccattttttttgtcatgggttcggaaccgctcgacagatgatgaattatttaattttttaaaatgtactatattatttcatctatcgtcttttatttattttttttttatcaatttttctttttttcaaaattttttttaacctttcaacgtgaaaatcttttgaatacatagttttttttggaaaaattcttagggtttgcatcaaactcccatcccgatttaaaaaaaaataatagttttgcaaatttttctttcaaatttttttttaatttcaaacaacaaaattcgggttttctttcagcctctccacctttgaacgcaacgaaaaagcgaaggcggagcgcgcgtccgcgcacaactcgttggagtcggccgtgtacgactacagtgccaagctggaggaggaggcgttctcgcgttttggcaccgaggaagagctgttgttgatccagcagaagttgaaggagatgcgggactggctggaggatgtgccggataacaccaccgttgaccaactgaagcagaagcggcgcgaattggtggcaccgctgcgcaagttgaagagccgaaagcgacagaaggaggtgtgctgcagctagaattgcgtttttgttcaacaaatgcttgtattattacactcatttttgtcaaggaacgccctgcgctgatggacaaattggccaccacgttggaggaggcggacaagaagtggcagctgttcaacctttccaaggagttcttcgcggacggcgaactcagcgcattccaacggaccattgagacagtgaaaaattggtttgagggggccaagaaggaggcggaacagctgaaggacaaccaggacgccacgttcagcacggacgacctgaagacgaaggtgggagagtttggaatgggaaacaagaattttgttttatttttccgaaaatttccactcactagttagtcattccttcctctaattgaaaaaaatggaagaatccagagactttttttttgctaatttatgatttatgccataaaaattactgattttaacagatagcggattgttttatgtcatttttaaacatattttctgtggatttcaatcagctcgtctctccctctctcgaaaaaattttttttcatcttttttaagtacttcgaaagtgtaataattttttttctttttaaaaactctctatgaaatttgagaaaggatttttattttaagatttatgtttttttcgaccggattcgaaggtgctgcctatgaacacttcgaaattaatttttctcaaaaattctcaaaatcccatgacagcaaaatgttttcattgtgtgaaccatttttcgaaaatgtttttaatttaattaataaaaaaacaaattttaaaattttcagacaaattcgatcattggcgaagtgcgtttcctaacgtccaaatattacgcggccgcgctcaaacagcgcgaggaggcggaagcggcagccaaaaaggccaaggaggaggcggaagcggaggcaaagaaggccgaggcggaagcaaaggaagcagaggcggaagcggtggaaaagaaggaagaggaaggagaggtgaaaaaggaggaagtggaggcaaagaaggaggcggacgaggacaaaaaggaagcggaagaggtcaaaaaggaggaagcagcggaagtgaagaaggaggcggaagaggacaaaaaggaagcggaagaggtcaaaaaggaggaagcagcggaagtgaagaaggaggcggaagaggacaaaaaggaagcggaagaggtcaaaaaggaggaagcagcggaagtgaagaaggaggcggaagaggacaaaaaggaagcggaagaggtcaaaaaggaggaagcagcggaagtgaagaaggaggcggaagaggacaaaaaagaggtggaacaagacaaaaaggaggcggagaaagacgaagctgtaaagagtgaactgtaaacagttctgatggatattgtgatgtctagggagggagccatcattagcccctaaatttgtttgttttccgaaactttcttttctgtcttctctcttttttttctggcgctaaaatggctcatggacaatgggggatttgttgcaaattcagtcacagtacggtgcatgca

SEQ ID NO: 19953 - DNA, 2698 bp, Heterodera glycines
cgctttcttctctccgagatgaatgcgcctctcgccaatctttacgatgcttcaacggacaatttcgtcactttgaatgatcatggatttgtcaacaaaatggccaaaaacaacaaaaatttgacaacgcagggcaggccaaatttgcgtgaagaaatcattgaatttgaaagttttgacgatttgaaagaacgcacaaaaatattgggccttgatcagaaagttgctaatacaattttaacaaaaaatttttttgcttttgttatagttgagtgtgatcagccaacttgcgcattttgacgatgtcagtccccttggtcagtttctgaagaaagcggcagctcaaaccgaacgtggcaactcatttggcttcattaaaattgtgccaaaaacggtagaaatcggcactcactttttactctcatgaaacttgtctatgttttgcagacattttcattgaaattgggccaccaaaaagtgcgtgccatcattctgcagcagttgtctatgaacactgccacacattttgtcatgtcggcatgctatgggtcaattgtggcagcgatcgtgactcttaatgagcgcagtgccatcgacaaaaccgacatttcaaacgcgaaaagggtctgttgaaaaaggcatagtatttttaaagctgtaaatttgttcaagattgctcgtaagtttctggctgtgcctggactgagtccttcggacaactcattcatctctcatttgaataaatccatttcgtgcagtgttttcgttggcccttcgattggaaattgcgcgactgatttggttcgttttaagcgaattgtctattttaaaaaaatttcaatcggatttcgttcaggattttgtcaaaggactcaattcttttgccgataagtgggcggctgctaaagacacaaaacatccaactccgatcagtttttcgttggtcccactgtcttctattatcgacaaaacccgcttcaatcccgtctctactcatatgatcggtgatttatttattgttttcggtcaaaattgattatcccaatgatcaaaaggtggacgacagtttgattggttttgtggccatgtgcaaactgtgaatgattgtgaatggcagttgcggaaagtccgtcaatcattcaatgaatgttctcccatgttaacgttagattttgatgctttttcagtttaattccaatttcaaagtttattacaggaatgaccaactggacaacgcccaaaaattttttgaacaatcggagaagggaaaagagattttttacgattcgttgaaagacttcatagtggatttgcgaatgtgcaaagctgatcctcaaaaggagaatatggtgcgaagtgcaggcgagaattacgtgcagttctgccaatgcgtagttggtcattatgaagagctggtgaatgaaaagaaggaaatggtcaacgaattaaagcaaaaaggcaagttttatgggatattctcataaacaattgtttaaggcgtcacttacattggtcgttccactcgccaacaattggactcgcgttttgctcttgatgactccaattcttccgtttttcattttgttctgttgagaaattcgtccgttccgccggttcaaaaccaacaagattttttgttatgccttggcaaactttacgagttagtgtcacgtggaaaatgtacttttgtcgatttggatgttcttcgggatggcgaagaagcgcaggcggacgaaggactgccggagaacattcgctcattggacggatacccaaactttggaatgcgcctgatcaaaatgcgtgggaacaaattgttgtcgaatgattatatggcagaagagggacgaaaaatgcaatttccaattgctcgggttggtttaaatagagtttgcgggggcggcattggctcatggtctaaaattaaaaccaaagagaattcggataatttaatattttcttgtatatggaggaggaaacgattcattctcgtctccataatttttggtttaaaacctgaaatctattaaggaattaaattataaaattcacgttttttaactattttttaaattgaatttcaaaacaaaaatatttaaatgtttttattggtttcatttgcgcagattgagaacattcgacgaacagaagttggagcagtgcctgaagctgattccaaagacatgcaggcctgcagtttgccgtgccctttatgtgaaggctatggtggaaattgcccgaacactgaccatatgtggatgtgcgatgattgttgcgaagcattgacttttgtgcaaatagaaaaagtaattgttgtttggtaatattagaaaaaaataattactcacaggaacaagcacaaattacgcatttcttttgcgcatgtggaaaaacgccggtcgatggattttcttttcgctgttccgaggtggcaaagcatggaactgagttcaagcatttttgctcaaaagtgtcgctggaaaaggaaattggatcggttgaacaacaaaggcatgctgacctttttgctgcttggtgagacgggcgttggcaaatcgactctgatcaacgcactcatcgcttacctgaacatgcgactttgaaagaagcgcttgaggtgactgagttattaaatattgtgtttgtaattggcattatctaaatccaaataggcgaatgaaattgactgggtgatccc

SEQ ID NO: 19954 - DNA, 1451 bp, Heterodera glycines
attaattaatccttttttcattcgacaaaactgatcatcttggggaggagagtgctaccagctaatgattgatatttgaatttgaaaattagcaaaaaatttttttgaaaaattaattttttatttctaaattagtaaattcagtcatttttatgattattcactgcttgcaattgagatgccatgtttcaagtggttgagcaacaactgctgctgggcaatgccgacacaactctggcaacagaaactgctgaactgatgttgctgaaccgaacgctctgatcaatgaaaggattactcattgaattgcgatcattttaaaataattatttacggggggcggcccggagcaatacgggttgttttaaacgggcccaccattaattaacccattaaccgtgttgtagaccaaaaactttttgattggatgcatttttatcaaatttctcgcaaatgttgtcattattttaatggctatctttattttcgagagttagacaattttgttttatcaattcatttatcgcttgtttgtatgccattaatgtatggcatttttatcttaacagattcaacattctaatgtaggggtcgagccccgcccccgtccccggggacgggataggttttttggcctcacccccgcccccgtgactcagacccccgcaaaccccgcccccgtgaccttcgtccccgcggggacgaaaatacacctctaagaatggcatattaatgggataaaagcaaaaatttatacaattttgtaattttttaaccatctttgacaaacttttatgaaataaagtaaatatttgtttttttaatatatttgtggattagttagtggttagtgcttaaattctttttttatttttacgtaaaacttaaaacgcatagcaaaaacattggcaaaaaaagaagtaaattttggataaagatttaatgagaattttggccgaatgcaacttctgccctaaggcaccaccgcttttcgccattaatgtgataaattctagggttgagcggtaccggtaccggtactggccggtaattaccggtttttttggtaccggtaccggtaccggttttttcaaaaatgaaagtaccgttaccggtttgtctagtaccggtaccgccggtaaaaatttgcactggtaggaataggagtttagcacaaaattgatgatgcaaaatttagggaaactggaaattttataaaaatacaacatttcgccaaattttggcattttaaaaacaatctttttttatttcgtcatattaattattggagattaatgatatttggttttaaatttcatattcctaattaatttattgtacaagagaatcatgattttagttttggtaatcaaaatccaataaatgtctgacatttggaaatatttcgacaaatcatcgaatgataaagcattatgtaatgtttgcgggaa

SEQ ID NO: 19955 - DNA, 1992 bp, Heterodera glycines
tttcctttaaatatctctttggcataatgtctttaacctttaatggtcaaaatttctaaattttcacgcggcggcgcctttcggcacagctggacgtccagaacttattttttcttaaaaattggctcaaaattgcaatctggctggcagccagcctttgacagatttctcttactcgaacagaaagtcgaaaattcaaattttttcaatcacctagcctaattcaaaagagcttaatcaagaaaattttaagaaaataaaaaaagacttatttttctttgtttttttggtggaaattcagcaaattttgttttcaataaaacataggttttcagaaataaaaaactctaaaataaacttttttaaatttttcttgaaaatttgtaaaatcttatttttttcggcgacattgtattttcgacggcgacattttctggtgcaccgaatttctacatataatagatgaaattttgcggatttttttcccaaattaacatgtgaaaatttaaatttttaccaatcaggttctggatccggaaatttgaaaaatagggattgaccggattacatagattgaccggattttgagagactggatccggaatccggtcgtttttgaaaataccagcccggtccggcagattcggaaaatccgtctaatattttttacagctggaatataattaattaattgttgttttatgattgcaatattttgaaattgaactgggtcatctttatttttaagatcttcgcttttttggaaattaaacgacaaaaatggttattttttgcaccaaatctgtcagaacaaattctctccacgaaaatttccaatttattctccggttcccatcggcatcgtgccggccctgagaaaattttctcaaaaattgcagaaaaatttaaaaaagcattgaaaaaagacataccaaaaaattcaataattttctcatattctctcgaattttttaaaatttttgaggattttagcaggtgaaatttctttttaaataaatttttgtatgttttcaattttaccttttgccatgaccttccgcagttgtaagaatacaatacaacgaaagtaaattggcacatcgtttgttggatgggaaacgcggcattgaaattggcgcttccatgcacaacccattcggactggacacgctgaacattgattacagcgatgacccattaggacattttcaaatacaccaagtcaatgtttcgggtaaataaattaattaagctaataacttattgatttttagaggtaaaaattcaaaatattttaactaaaaaatgacaaaaaacggtgctacatatgacgttagtcaaaaaccatcaaaaagggcgttagtcaaaaaaccatcaaatcagacatttgacattttcatgtcttttaccgattacttttataaaatggattaagtaataagtttaaatattattaaacaaacttttcagtataataatattttaattagaaaattcatttggttaatataaaacccatatattgattaattataaatttttcctccttttctcatttatattttaaattttattttgtttttgttttataaatttttgtagaaaatttttactaacctctaggaatttttttcgaaaatttccccaattttcagtgtgttttagggtctcagatcaccatgaaggagtgatctgatcaagtaggtgtaaaagacttttttgattagcatcaaaagtaatgttaccatgaattatttcagaatttttggcccataaaatattgactttttcgttgatgaatttaatgggacaacacttatgaccacccaaaaatgatgtatggctcataaaatcgaatagaattctagcaccaaatcttatcttggctaatgatcggtatcgttgaccataaaaagggctatcagaaattttcttataataactttcaagctatagaaggggcacgcatttttgaccatgcctgtatatagt

SEQ ID NO: 19956 - DNA, 1292 bp, Heterodera glycines
  misc_feature (84)..(84): n is a, c, g, or t
ctatcgaccaagcacatgaaccaaatgtctgaacctgcggttcctctcgtactaagcaggattactatcatagcaacaggtctntagtagggtaaaactaacctgtctcacgacggtctaaacccagctcacgttccctattggtgggtgaacaatccaacgcttggcgaattctgcttcgcaatgataggaagagccgacatcgaaggaacaaaaagcgacgtcgctaatgacgcttggccgccacaagccagttatccctgtggtaacttttctgacacctcttgctggaaactttacacattcaaaaggatcgataagccacgctttcgcggtccgtattcgtactgaaaatcaggatcaagtaagcatttgcctttttgctctacgagaggtttccgtcctctctgagctcgccttaggacacctgcgttacgctttgacagatgtaccgccccagtcaaactccccgcctgacactgtcatcggcgcgggtcgccgggccaccgggtggcccgacttaacaccaaaatggacaccctttcgggcgcactcccgttttaccgattaagtaaggaatcgatgaaagtagtggtatttcactggcgccttgcggctcccacttatgctacacctctcatgattcttcacaaagtcagactagagtcaagctcaacagggtcttctttccccgctaaatttgccaagcccgttcccttggctgtggtttcgctagatagtagatagggacagtgggaatctcgttgatccattcgtgcgcgtcggtagttagccgacgaggcatttggctaccttaagagagtcatagttactcccgccgtttacccgcgcttaatcaagtttccttggcttaacattcagagcactgggcagaaatcagacacggtcaacgtccacaaggaccatccgtctcctctgttttaattagacagtcggattccccgagttcgtgccagttctaaactggtcgttcagcgccaaccgaagtgcataccctgacgagcatacacgcagctgaagcgctccacaagcagctctcaccactagtccacgcaccatccccgaaagaacagcacgcagccacgggcaaaagccgcctgtttcacgcaacagcccggctgacccgacctttagagccaattcttttcccgaaggtacgaatctaatttgccgacttccttacctacattattctatcgactagaggctggtcaccttggagacctgctgcggatatcggtacgatcaggcaggagattcaaatagcttcc

SEQ ID NO: 19957 - DNA, 2174 bp, Heterodera glycines
aattcgaaaaggtttgttgtttgtcatttttcgtgctttttgattcaatttttaaaaacgcagccgggggaaatttggaaatgtttgcctgatatttttcactttgaaaattcgtttttaggggtgccttttgagaaagattttgggagtgttcttctttcgaagtcgctttttaattattttttctcacaatcgctttctctcccaactcattaattaattaattaaataattcatttggcaggtacatttggcgtattggcggctgcatttccaccacaattaaattcgccctccgttgcggatttccgagcgacccgcgagtgttttacgcaaagcataagcatctttttgaatacgaagaatttaatgcaaatgcgacaacgacaaacaaaaggcagcgaagaaagcgatgataaaaggaaaggaaacgaattgatcactgagggaaaagagtgacgaatagagaaagaaaagtgagtgatcaatgaggtaaaagaagtgatcagaaaaagtaaaaatggaaagaataggcgtgatcgaattgcgatagaaaagtgaaaaagagggagaagaaaaaccaaaagccgaccagagaattgagaaaaaaattaatattttatcattttcaaacgtaaacaaaaagatttgtctcaaaaggtcagagactgacaataaaaaaagtgaaataaatgcttattttggacaaataagcaaaaatcaaattcaaaatggacagaaaaagcataaataaaaagggaaaaggcgatggattgccaatcatttgaaaattcaaaaggcgcaatatcaaaaaatgaaaagaatggacaatgcgacgccctttttggactagatgaggaggtaaacaaacactcaatcaatcaccactaattaatttgacttattcgctcgttcaatcggccgttgatctttttctttgccttacgccgccagcaccggcgcctctccgcgccgccctttgcccgtctccgcgtccctttccgcttccgttgcgccattttccgctgggtaaaccctcgcggcattttgccgcgttccgtttgccgtcccattccgtttttccatccgttcattgaaatgcttaaacccattttgaatttacgaattcagttccattcatttgcacctgaattgttgcccatggctgcagctccgctttggcgaaacaaacgtagaaaatattacacgcgacgataatggcggcgttcacataaaatgccaatgcccattcttcgcgggtgttatttatggtcaacggattgacaatcaccggcacagtcagcctaaacgaagaagggattgggaaaggtaaagctgaaaggaggacacaaacattgtgacggtcattgcggtggaaatttggcccattacaaaaggcgaatagggcccggcaatcatcgagcctaaattggcacataaattaatggaaagataggcattctcccagaggggaaggaaaggataattttttaaaatttgattccctaccgcttttgtaaaatccgccaatgttaaagccgagagtgaatgccgagaaagtgagcagaaacagcgcgagattgccatagccggaaggcacgaaagagacggccacaatgacagcggacatactcatgaaggcgatggaattgaacagtttggttttgacagtttcgctcattatccgcgcggggattctatcattgatcagcccggcacattctttcatcaccgcctggccaagcggcggaagggcggccataaacccggtcttgaccacttcaaagccttgtacctaaacagagccaaattcatttaataatggatcggaatgggataaagtgatatagtgagaggggagaggagagagaaagggagagagagggacacacacacaaagaggagagagagacagaggaggagagagggaaagagagagagagagagagagagagaggggggagagacacagaggaggagagaggatatgggtaaggggagcagaaacagaagagagaaaccagtttgggtggagagtggggcgacaatgggagaaaaaatgggaaaagaaacacaaacccacaaaacaaaacaattaagtgcatacgacaacaaaacaacttttgtttttttaagatttaataaataaaaggacatatttcaacttttgtttg

SEQ ID NO: 19958 - DNA, 1316 bp, Heterodera glycines
cgcagcaacgatcaggtagaagaagctcatcttggttgatccggagaacaagcgcggtcgaagttgacgtgtgtggaagacgtgtgggttgaaggtgtcgcgcaattatcgtcgttgagattattttattattgggaagtgagcgaaatgcgaatgtccgttccttttatacaatgtcagccacgacaattcttaaacccaacattttgccaaatttcatttgatatataaggggatgcgttttcatccttttcaccttcgctactaccatttacccatttcgaagtgcacccgctgcaacacttttgtgagttttttctttctttttttcgtgttgtttttgtattcattttatatcccctccatttgttcagaaacggcctcgacaaaacaagcaaattcttcaccaacacaccgatgaatagcggcgtcagcccaactccgttcctctcgctccgctgtgtgtgctcagtgctggtgctgctcatctgtgcgttcgatgtgtcactggcagcaaaagacaaggagaagaatggcaaagaagaaccaggaggccaatttaatacgctcagcatcattttgctgattccgctggtcatcgtcaccggcgcgttcgtctacctgctgtttatgaagccaaagagcgaaggaaccggcgatgacgacggagaaggcgaaggggacgcggacgtggagaagggaccaaccgaagagacgaagtaaaacacgggcagagccgatttggctaaacaaccaacaatatttttcgcatttcagaacggagcctcgaattgaatctccagcaactcttttgggcgtgacagtgccgttggagcaagacgaagaagagcagaaaaaggacgacgaggggtaagtgcaaaggcggcggatcattttttactcattaaaatttaccatttttagtggcgaccaaaccgcggagaagaaggaagaggacgcggcggcagcggacgaacaaccgaaagaaggcgctgcggaggcagcggaagcggagaaaagtgcgacaaaggaggagacgaccgaggacacggaggagaccacggaaacgacggaaggatcgaccacagagacttccgacagcggctccgggtcgtcttcagcatcgggctctgactctgaggggagttctgggacttcggacgccacttctgaagccacagaggacgcatcatcttcatcggagggttcttaagtgaattgatgtcgcgaattatgccgtttaatgacaagaaactccaatatgtatttcccatgcacatatattgctgtatttttttttcaactttcaaaaaatc

SEQ ID NO: 19959 - DNA, 1647 bp, Heterodera glycines
aaatgattaattgtttgaaataattgaagaaaatttgtttgaaaattttcattaatttaatttattaaataaaaaaccaaataattttgtattattttcacttgatataaattaaaatttgaatttttttaaatttttaaaatttttttgaatttttaaaatttcccggttggtcccggttcccggtttttcttgcggtcccggtcccggtcccgaaaaaaaatcgaggtcccggtcccggcttctcaggtcccggtcccggttttggcaaaaattcccggtcccgtggcactctacttaacacaatgaaagatcggccccacttcagcacgttttatgcccgagcacgcgagtttatgttgagggacaggcggggcaacaacatcacgcctttaactacattgtgttagtccatgtgaagataaatgtttgtaattttttgttttttaagcatgtcactcgtctgcccgaacattgcgagactgatgtaaagagcaggcggacatttcacaccgggcactgccattcgcgaagcagctcaatgcgcttcattctgctggtttgcgcattgcgatttgattgccgcaaacacggcaatcggttaccaaggaacagaagagcggaaaatatttgtgatcgatttcggctcggcactaaaaatttcacaaaatcaaacaacacacaagaaggatctgacgatgtggtttgaattgatggcaaagatgtacgccgaaagaattccgacggaggtgagttgaaacattttggaaaactcaaaattacgcgataaaaaggaaaacacatttcgcttgaagctgaaaaacattttttgaaaaaaataaatttgactgattttcatagtatgtgtggcaaaaactctcccgatttggcagggagtttctcccttcccgtggctccaattcactcctcaaaacttggtctctctctctctctccgctgccgtttggtccttcccaagggggtggaatggaggaaaggggtgggaggcaaacaagagattgggctgtttatgattaacggcaccaccgatcaaatttgggagagaccggtgctcccaagctcaatcccaagtccgagcccttctgtcagcacttccggcgtgccgacttgttcaatcgttgcgttcgggagttttgctcccgttttcactcttcgttcgagtcgctgtccaatcgccggggggaggggattgggaaggagatgggggttgagttgggcacttctggggtggtaggagtcccgtttgacttgccgcaacactccgcaaatgcccaggcaaaggggccggagaaaacgattcgctacaagggagacggctccctttgatcactgatccgcccgaaaaatgccgaacacaaaatgacagaaaatagtttattgaagaagagctcaaacctgggtaattaaacccttatcgaggggggtggacaaaaatgtgacaaacggcaaaaatggggttaaacatgaatgccgcgattgagtggtgtggtgagattaaggcaaaagaacaattttttctccctggaggggagttaggaataaaagtgaacgaatgaatgatgtgacggacaaaattagtgatgaaaataaggtgggaaaattggtgattggtaaatactttcccag

SEQ ID NO: 19960 - DNA, 1071 bp, Heterodera glycines
caaaggcaaattcaaaattaaatgcaaaagcggggggggcaaaaggggaagaccggacgcagaatggaaaaaaggggggaaaaaggggcaaaattgaaattacggcaaaattggaataaaattccgaatagcaaaatgttgagaaaaaatgggaggaaaaaaggtgaaaaatagagaaaatggggagaaaaaagggcacgttccgatcattttctcgccgcttctcgctcttgtcccccaattgcgacgggagttgctcccgttcgaccacttctttcttttccctctcttctcccggcgggggagtgccaccggatgatcgagcgcaccccctccgaaatagtcctcttcctcccgcgacagctcccggggtttgccatcgtcaactccgaacaccagaaaaccctcccacaaattgctgccccctttggcgggagcagaactcccgctcgttttgggcatctcgtcgcttttagcgacactgcccgggccggccgccattcgtaatcagcgtccctaaaagccccttaaaacatattttcattaatttcaaaaacacatttattggcatctgaaaatgtatgtggagttgttcctctaaacttaaagagtaccttttcatcactatggccgaatttttcccgttccctcattttaagttaaatatttttggtaaatcttacccgggctggcctacatgtccgcccatggcttccaccttgattcaaaatattattggttttattgctggtatttcaaataattatgcgatgagattcgtgaacttaactatttcggtttttgttaattttacataatgtaagaataatagttcgaacagatgtcgaaaaaggctatttaattatattaattcgacaatataattaaaacactatggcattgaaaccgcggcaatgaacccccccccccccaccggtttatccatttattgccaaaaattcttcattttcgtacatttccctttgaaaatatgcctttggcataatgtacggttgaattttttaattccaaggtttgctactttatcgaaatgataagttatggcttttt

SEQ ID NO: 19961 - DNA, 1941 bp, Heterodera glycines
aatcaaactatatgtacatataatacacaattaagacctatatacgtagcaatacgccaccgaaatatgatcgattttcattctacgcgtcagcagcgaaatccaacagcttccacgcgttcaaaacctcccgaatcaactgaagatcagcatccgtttccccggccacttcgtttgtgccaatttcagccatcgcttcgtcgagtgcctaaaattttgcaaacgaattccaaaaaaaaagtcaaaaacaatgactttctgcgcaagctgacgggcttccgccggcaactttaagacttcaaagtggaacacagcgaagttgtgcgccaggcccaggcgagtcggattggacggtttcatctccttggtggcgatttcaaggccatcttggtaggcatgttttgagaggtccatgacagctaaaaaaagcgaatttgtgggagaaaagagagcaaaaaaaccattaccagggcgctcctcccccggcgccacttcgatcatgtagcggtagtaatcgcccttcatcttcaagtagaaagccttcgcctcagcgtcgctcgccttcggaagaagcgtttcattgatggcttcctaaacgggggtaaatgggaaaatggtcaaaatccaagggaaaaaaaacaacaaaaactgaccaaaatatcgtggcaaatggtgagcagttctgactccatcttcatccggtactcttccgccacctgtaaaaaggggaaacgtcaaaaaggaactcgctgctgacacttgtgcccaaactccgcctgtatttgctggtccgtaaggtccaaagcgacgcgttgttccgcgtaacagagcgaacgccacgacgcacgacgcgcattaatcgcacctttgtaggcggtgccgagcaactcgcgctcctcgctgttcaaattggcgtccgcttggatcatctgaaaataaaaaatgaaaacaaatcaaatgcaatgctttcaatcatcgaccacaccttcttcattgcctcggtcatgtcatcgtagcgtcgcgccttcttacacactctggcaaagaacacaatgtcctctttggaatcagtgaccattgcgcaattcgaagaagccaaatattagctgcttgattattccgtaccgcttaaagaacagttttaattaaatgtaaggaatttgaagacaatttagactacataagaatatcaattagattaaatcaaatgctaatttggtacagaacagagtcgatgtgatgaattcagtttgttttcgtgtatttaagccggttttgaactaaaaatgcgatattcgagaatttgaagtttaaactttttgttcgaattgggatccggggtactgaattgttgaaaagttgtcaaattcttgatcactgatcagaaactttgacatccctactaattttaatggaaaaaaatattcaaattttatttatttatttttcagttccgtcatttgagtctaatggtataagaaatttcagttccgtctcgaagattgacttattttttggaattttcatcacaaaaagttaaattttgccttaaaaagtgtaaaaaggctttcgactttttgtttgaatcctggttcgggatccgaattggacaaaaatctttttctcttcctcttcgccttcctctttctctccgtctttttctcttcttttttcacgttcctctttttcttcctccatcatattgttgttcagtttgccacaccccctaaaaacatgttttaagacttgaaaaaaaaagtattagacctaggaaaacaaggcctgaatccacttttatcaattttagcacatgacttttattgttccaactgcaattcgagatgaacttttattcattggcaggcaaatcgatgtgctgttgcgcagattggcgagtggaaacgtggcgaacgaggaacgtcagcgcattaacgaccaaat

SEQ ID NO: 19962 - DNA, 1106 bp, Heterodera glycines
  misc_feature (1064)..(1064): n is a, c, g, or t
agtcagcaatcgttgcttacttgccagatcggacgggtgcgcatgattccactgttccaagcaccccaccaaaagcaaaacgatataaccaaaatataaggaaaaatttttttaaaaaaatttttctccatctccctttttgatagaaaaagcatcagagtgcctaaactaacatgtaaataaaatttggtgcgctttagagcactttctgaaaaaatatttatgaaataaaaaaatcgatttattcaagtgtccgtttggggtactcaaacaattatggggagcaaaaatccaacgcagaattaaagtacagactatagggaagctaatcccgaaggattcggtctccccataaatctgggcgcatcggttcggggggactgccccgaaaacaaaaaaatcgattttttcaagtgtccgtttggggtactcaaacaattatggggagcaaaaatccaacgcagaatcaaagtacaggctatagggaagctattcccgaaggattcggtctccacataaatctgggcgcatcggttcggggggactgccccgaaaacaaaaaaatcgattttttcaagtgtccgtttggggtactcaaacatttatggggagcaaaactccaacgcagaattaaagtacagactatagggaagctattcccgaaggattcggtctccccataaatctgggcgcatcggttcagggtactgccccgaaatccaaaaaaaaattttttttggataaaaattatttaaatgaactgactagataatatttaaaataggttatttctcttcctttcagtatccctgctaagtttggtgcgcttctgatcagtttctgaaaaaaaagttaagcctaaactttttggcctgtttaaaaaggaattaaaaattttttaaaattattcatctccctttttgatagaaaaagcatcagagtgcctaaactaacatgtaaataaaatttggtgcgtttcagagcattttctgaaaaaaaatatttatgaattaataccacacaagtattattttttttaaattatttttttcatttatcacccnaacgttctagactgatcagaagctcaccaaattttgcaggga

SEQ ID NO: 19963 - DNA, 2713 bp, Heterodera glycines
taattgttgcgcgttttggtgtccggcatcaccatttccgtgcgttcctggtagaccaggcgctccaggttcgccaggcgctccaggtagtccttggtggccttcgtggtgctggtgctgtcctggttggccaggctttcctggttggccaggttttccaggttggccaggctttccaggtggtccttgcttgctttcgtggtgctgtccaggttcgccaggcgctccaggttcgccaggcgctccaggtagtccttggtggccttcgtggtgctggtgctgtcctggttggccaggctttcctggttggccaggctttccaggttggccaggctttccaggtggtccttgcttgctttcgtggtgctgtccaggttcgccaggttgtcctggtttgccaggctttccgggtggtccttcctttccttcgtggttctttcctggtcgaccaggcggccctcgcggtccgcgtttgcctgacttgttcgactccttatcctctttttttgcgtgctttttctctccgctctcgttactgtccttgtcctttttccgacgccgataacaaccatcaatttccagaataagcaatgcaaaaatgaagacaaaaacggcaaaacgagtgctgagcattcttctcctaaaggttttttaatttaataatttataattaaaatgattgaataaattgttgaattctgcggacttcttccgctttttatattgctgctcaattaattagtctcattaatttcgccattataatgaattgtgaaaacataaaactgctcgaaaaggattttatgaatgttatttattggaataattatttaattatttatgcttagaaaaaataatcaaacaaaacgaagacggtccaaatcgtgaaaatgattatttgtttgtttaaatattttacaaacgaatgactcaatcgctttaataatgatttaaataatttaaaagattttttgtacatgcaaataaataatatattagctaaaaattgaaattattatttttttaaaagcgccattttttggtcgaaaactacttgaaaattttgcatgaatttgtgccaatgaaatctaaatgaatggaaaaaaccattaataaatcagaattaattattaattaatctgctcgggtttttcgtttcatgcttagtcaagtgctcaattattaacatataaatattaccgaagaaaatggcgaagcatgtttagtcatttgggaaagcacttccggaaagaatcacaaagaatgaaatgccgaaaaacttttgcagcggattaagcctaaaatcaacacagcttttttgaaatgattcttagtgtgttgattcgtttttttcatttcggcatagtgacacgaaaatatgccaaaggatatttagcaacccaatttggtttcccaaaaaaagaaatattaaaaaagaaatatttttactcatttacatttttttcttataaaaaattcaaaatgattataattgctaaaaactttttcttttttttttgctaattttaattttcaaaacatttcacaaaaaccctatcgacatttttttaaatttctccagccattttcgacaaataatttcaatttatcaatttattcaataaattctttaattactttttttgaataattgaaaacattgcaataaatatggaattaaagctgagaattcacacataaattatcagacgagagataaaacagagaaagacagagaaatgttgcagaatgagcgtatcaaataaatttaaattggaaaattaaaaattgttatgtccttataacgtcatccgaaccgtggctttactactgagtccatttgccgaaggatttcgtccaaatttagccgatggattttcacatgtctaaatggtaaaattggatgaatatttacatacaattaaaattttaaattttggaatgccgtacctccgatgtttgtgcccgattttctggtgcactcttcgccattcgtgaagacttctccgatggtgccggtaaagtcggcttccttttctgagggaatagctaaaaagtcattttcatttcatttccatattccttttttggcacctttttctccgatgcggcgctgccaaagtgaattggtcaggtgctatgagagtcagcagaagcaaagttatgacggcgaatttgaagagcaatttcaaattgaagttgccaaatgttgggccaatttccatttttaaaatctatttaattttaaagaaaattttgccaaggctttaatgaaatagacaataatttaatggaggaatactactgactatataattttattttgaaaattgttaaattggtttacaaatgttttaaaaatgcgcgactaattagaccaattaatttgcttttttctctcttcttccaaaaattgaacatgttttatttgaaaatcatgaccagtttattgttcatttttagcctccattttgccatatttgttcggcgttaaaccgcaataaatttcacttaaaagtgaatgccgcccaccataaaaagtgtcattgtaaattggaacaaggaagggaatgaatgaatgagtgagtgactaatgataatgaatgaacgatcgaacgctttgagaaagtgcgcgggtccctttttgggttttgcttcagcttgatttcgtgtagatgacgaaggataaacggacgacgaccaaatgaaagag

SEQ ID NO: 19964 - DNA, 2254 bp, Heterodera glycines
gtccttgactatttgtatggtccttatttatagaaaaaaatatataatttgcggaccaaaagaagtcgtagcccagcggtggctcttcgttgtccacggcaaactcaaagcgtacaacaaacactgtgtaggaggccattgtggcgatgtcgcacaatgcgatgatggccaacagtcggttgaccgcacacttttgcatggcgggccgggacagcacaaaaatgtgcacacagttggccaacgagccgaacacgcagatgaacaggccaagccaacagtgcactttgttgtacaggctgaaaagggcgggcgcaatgaatggcatggcaccaattaaattaaatttagtcggccttttgcattttcatgaaaaatttggagcttttctccctgatcgttcaaggatcagattcaggaaatgggtcaaacatttagggaatcggaccgataattctaatctattatgaattaattaaaaagcgaagaatggcatggcatcaattaaatttagccggcattttacatttttcaaacttagaaaatattatttatatttttcatgaaaaaattgagctttttctccctgctgatcgttcaaggatcaggttcagtaaaggggtcaaaaatttagggaaacgggaccgaacaatgctaatctatcattaaataattaaaaaaactgacttagtaattaattgtctattaattttaaacgtacttcgaaatgccccacaatgcttccaagaatgcaacagttgtattgctgtttaaatcaaacaagctcagttcctcgtcacagatcattaagcgcatttttagttataatgcaaagaatctgcaaaaaaaaattaatcaaaaaaaggtaatagcatttttacataattaaattttcataattgaatttcttcgataaaacttgcggaaagcattcaaaataattttcccccttatgctaatggctttatcatggcaaaaatggtggccggaaaggggcagaagcatgacatataataatatatatgtccatatattgttgatgaaaaaagcctttttggagcgcggcggcggctacaaagacgcgtcaatggcaccggggggcacacacacacggcccaacaaaagcagcagccttaggcgccataatcttggttggatgccatggagttggaatgagtgcgcgagcagttggcctcccccttgggtagagtggaggggcgggggagataaccacaatccgccccgggggcacccctataatccggccataattatcccatacagtggccgagcggcgggtctccccgagggccaattttcatatggctctaatgaggatgatgatgatgatgctgatgaagattggagaagttgtgaggcgcgtaataagtgagtgtcaatggccaaaactaatcagaagccagcgccggcgggggcgggggggggcgcccagcggagtgacagcgccagcccagcgacgaaaatggacagaataaagaaaaagcaaatcccgcccccttcccctggggcacggacgtacaaaagcttgctgtgccgccaaacaatggaaatgcgcgaaaaaggatttattaataaattaataatatcggaactggcgattgaaagctaacaaaataaaagggcggagagcggcggaaggaaattattacaaatgtacaatataataataattgtgcatttattgaatttagcatttttgtcatttattgtaaaatttgctctttagaaatgcatgggattgcattgcatttatatatgccatcggaaaattaattaatgggttattaatttccgagtgcaataaatttttgagtgtcacacattccgattatcaattttgacgacttttaatacaaataattccaaaaacgaaattttttttagcctagtttcagtgtttcggagaatggaaatctacgcatgttttcggttttataatataggtaattaataaattattaatttccgagtgcaataaatttttgagtgtcacccattccgattatcaattatgactgctgtttatacaaataattccaataaaaaaaatttttaactaagtttcagtgtttcggagaatggaagtctacgcatttttttttaatttttaaaatttttgaagcctggaataattttaatttcattttttttattgaaattcgagtttgaatttgcatttgactaggtgccgttttttagcatttatctttttttctgaaactggcgcctgaaaata

SEQ ID NO: 19965 - DNA, 2433 bp, Heterodera glycines
ccataacattttcgcttaagctatgcgccacactcggatcatgttgtcggtgtaaccggcaaacagcgtctgtccgtccgtggaccatgccaatgaaatgcattggggacacgattttttggatacacgcatcggatttgcggcgctggtgctggcaatgtccaacttcagctcgtccaccaccgtcttgttctccaagtcccaaattttcaccaccgggccaaccgcggcgcacagccaatagcgattaggcgaaaacgccaaagcgttgatcacgtcattgccgcccaatgtgtacaagtgtttgccgtcgtttaagtcccacaacattgccgagccgtcctgaaaggcgaaaagaatgcaagtgctgtttagttttagcaagtagaagcaggatccttataagtatgaagaaagtttggtcgaatgtttgtcctgatactttgctgattgtataggtgctcagaaaatcaacaatttgcttatccaacctttcctccggaagcacaaagtgagccgtcgggtgatacggtgaccgagttgatgtagccggtgtgtccgaagtggttggtcttcagtcggcaagtggccaagttccacaccttgacaattttgtcccagccggcggacacaatcactgggttcgcatgagaaggcgaaaagcgcacggtggacacccaatcggaatggcactcctcctaaagcaatttattttgtcacaaaagcccttacccctaatctgggccataaagaatccttgaattcttaccacgattgtgtgtttgcactgggcaagtgtattccacagtttgatcttcttgtcgcgcgagccagacacaatctgacggttgtcggcggagaaagcaacggacagcacatcctgggtgtgggagacgaactgacgagtcgtttgtcctctgaatttatgagtgctttctaacgattaatctcgtcttcagttatcatttttgtcctacgaaatagtaggatataccccagacgaaattccgttaatccaatttttggtatcgccacttttcattatatcatcaaaacggacgtgttcaagtcccacagtcgtaatgttttgtcccaggagccggacagtgcgtactgtccatccgaggacatgacaacatcggagacaaagtgtccatgtccgtgcaatgatttgatcggtttgccgtttagcaccgacccactctcatcaagcatccaaacgatgatggttttgtcttcaaaggaaacagagaaaccattaaatttgcttgtggaaaaaattaacctcttgaggccgacaccaacatattcttatacaatgggttggtggcaatttgcgtgacccatccgttgtggccacggagtgaaccctccaatttcatttgttcgcccatccttcaattattaaatggctaattggctatttccagacaatttgcgctaaattattgaaacaataacaaaaaataaatttttttaatgtgaaaagataattaactaacgatttttcgacattcgaaaaaatcctggacctggatacaggaaaaagctagctacaaaactgcattcttaaaatgcctgtttctcgttttcagcaaaaaatatttttaatttacaacagaacgccaaataataatttaaaaatattttctataacttggtcaaacttctgctgctaattcaatttgcttgcagcttttgttttaaacctttcttcaattttagcactgtgtttttgtaacaatggcaatggctgatgttaagcccaaccatactttgtacatcaacaatttgaatgaaaaagtgaagaaagaaggtgactcactgcttttctaattagtttttcttttttaaccattatttcaaatttgcagagctaaagaaggcactgtacgcaattttctcacagtttggacaaatcatcgacattttggccttcaaacacttaaaaatgcgtggacagtcccatgtcattttcaaggagataaattcggccgccactgccctccgttccatgcagggcttccccttctacgacaagccgatgcgcatccaattctccagggaggactctgatgtgatctccaaagcgaaaggcacttttgtcgaacggttgcgcatttcatattacaattttttctttcaaaaaaatccttgtaaagaaccatagtttgtcgttttcttttttgcaatagcatattgcaatccaaaacggttgctgtctgttttcattgtagctcatttccttgccacttcgcaaaatcggatagtgtgttacaatttaatttctttgagccatttttcaaattcttcgtcagagagtgccaataccaacacttttgaataaatcattaagagtcgattttccggcattctaatgaatcataagatattaccgataattaaaatggaaaaagtttgaaaaatgactca

SEQ ID NO: 19966 - DNA, 2447 bp, Heterodera glycines
acaatggtgaaattgccgacctaaaatcatggaactaaatttgtaaaaaaataaataaaaattgcgctcggcgtacgtacggcggtcaatggaaagtgcaccacggaatgactgagcagtcgtggccaaacctgaaaagcaaagtttcgttttagaacgcctggaaattggttttaaaagttggccataatttgcaaaaaactctcaccaaatgcccttcgaccggcacctccaaatttttgacccggtccgtgtccaggcgcagctgcgttctcaccacccttttctgggcgcccagcgccagccatttctggcgcagccgtgcgtaaaggtagtggtcaatttcggccaaattctgtggcaatttcatgccgtaggcaaaccattggccgtcgctggtgtccaagggaatccctgcaaaacagcgggagggagagacaaattaatgaataataaacatgggagagaaaaattggcattttggggtgaaaattgcatgccccgacaaattgcgccaggacatttcaaccgaacaataagtccaaaatcaggtttcaattatgttcttcatttaaatagcattaaatagatggtatttggtgattttagccgggaatttcattcttacaactagtggatttttgcagacccgtaaacagaaaaaaaattcgaatgaggaatctgaggacatttttttgacttcgtcaaatttttttcaccaccggggagaagaagcatgcgtttgtagacattttcgccaaaacaatgactaattttggcgattttgggcttaaatttcaaaaattttggtaaaatggggtccagcagtgcagatgggcgccgccgagaaaattttggaggttgaatttgttaaaaattgcttaaattttcaataattacccatttttcaaaataaggccccagcaaaaagaacaattccctccccacccacccaaataacagtcgttgtcggcggagggacattttgtgccgggcacaaacgcaacatttgccacagtgagcagtgattttggcggaataatttggtgtattttagcagacgaattcgacttttcggcgttgtgatggtcatggtggaagagctgaaagcgcgggtcgtcgtccgcgtcggcgatggacaaccgatggacgcgcaaatcgtgcggaaatgtgttgaaaaactggccaaaaatataaattcattattttgttaaaggcatcccgctacaacaaaaaaatcaaagaatcgaaaaactctgcgtaaaaaactaatttttcacatactatccattcccaaacccatactttgatcggctgtgtgtggacagtgccaatgaaagtttcgtgaaacacaattttggccggcacactctccagacggaagtcgaccagatcgaacttgagcggaaattcgtaggcgccaaactgtgtctgcagccggaaagtgccggcaccgttgtggggcaccacgttgcgatgctccgactgggcgaacagcgacaggttgaaaagcgcgaaagtgtgcggaggaagcgcaaagtcgagacccttaaaaaacaaaattcaaaatgtgagtcgtccaaatccgcatagcaatttggccaaaatgtccgatttataggaatttaaagtcaacagaaaagtatcgagttatggtcaggtccggtggtagtggtggaagaaagcaaaggtgggaaaattttgataaaataaaatttaagctgtttattttttttggaaattttatcattttaaacaataatagtctttgtattaaaaaatgggatcaggtagaggtagataaaatttctattttgacttcaaatgggagacagaatttttttcgctaaattcgggaagcggaaaaaaactaagaaaatggtcgattgattttaatataaacagaattccgtccacccctgggcaccaatatcggatcagatgataacatcccgacaaaattttataggttatattcgtagagaattgttttgaccgactcgagactctcgaacacagtccccgtaaagcgtcactcacttcactccagccggccgcatcagcagaagctgctgcagaatttgttgaaaatttgtcgaccaattgtccgacatttgcgctccgtgggcggttgtcgtcctcctgctgatgcttctgttgctgctccaacctttgcatacccaaaaaggaaagcgacaaaacggtgggagggaacggcacgcggaggcgaatgagacgcaaagtgaccgggttcgggttggacagggagaactgtgcatttgaattaattatggaaagtgatggacgaaacgattcaaaatttaaatccgatagttgaaaaactttgaaaatttcctattaaaaatagtttaaatttaattaaaaattttaaaaattaaaaaattgaaactatagttttcatcggagattctttatatattttttag

SEQ ID NO: 19967 - DNA, 1054 bp, Heterodera glycines
aaaaccggaaccgttgttacctctatgtgataaaggaaccgatgtcttttaaaaaccggaaccgttgttacctatggttgataacggaaccgatgtcttatttaaaaaccggaactgttgttacctctatgtgataaaggaaccgatgtcttatttaaaaaccggaactgttgttacctgtatgtgataaaggaaccgatgttttatgtaaaaaccggaactgttgttacctctatgtgataaaggaaccgatgtcttatttaaaaaccggaaccgttgttacctatggttgataacgaaaccgaccgttgttacctctgggtgataacggaaccgatgtcttatttaaaaaccggaaccgttgttacctatggttgataacgaaaccgaccgttgttacctctgggtgataacggaaccgatgttttatttaaaaaccggaaccgttgttacctatggttgataacgaaaccgaccgttgttacctctgggtgataacggaagcgatgtttttttaaaaaccggaaccgttgttacctatggttgataacggaaccgatgtcttatttaaaaaccggaaccgttgttacctatggttgataacggaaccgatgtcttatttaaaaaccggaactgttgttacctctatgtgataaaggaaccgatgtcttatttaaaaaccggaaccgttgttacctatgtttgataacggaaccgatgtcttatttaaaaaccggaactgttgttacctctatgtgataaaggaaccgatgtcttatgtaaaaaccggaaccgttgttacctctatttgataacggaaccgatgtcttatttaaaaaccggaaccgttgttacctatggttgataacgaaaccgaccgttgatacctctgggtgataacggaaccgatgtcttatttaaaaaccggaaccgttgttacctatggttgataacgaaaccgaccgttgttacctctgggggaaaacggaacccatgttttatttaaaaaacggaaccgttgttacctatggttgataacgaaaccgagcgttgt

SEQ ID NO: 19968 - DNA, 1354 bp, Heterodera glycines
tgataacggaaccgatgtcttattaaaaaccggaactgttgttacctctatgtgataaaggaaccgatgtcttattaaaaaccggaaccgttgttacctatggttgataacgaaaccgaccgttgttacctctgggtgataacggaaccgatgttttatttaaaaaccggaaccgttgttacctatggttgataacggaaccgatgtcttatttaaaaaccggaaccgttgttacctatgcttgataacggaaccgaccgttgttacctctgggtgataacggaacgatgttttatttaaaaaccggaaccgttgttacctctatgtgataaaggaaccgatgtcttatataaaaaccggaaccgttgttacctatggttgataacggaaccgatgtcttatttaaaaaccggaactgttgttacctctatgtgataaaggaaccgatgtcttatttaaaaaccggaaccgttgttacctatggttgataacggaaccgatgttttatttaaaaaccggaaccgttgttacctctatgtgataaaggaaccgatgtcttatataaaaaccggaaccgttgttacctatgggtgataacggaagcgatgttttatttaaaaaccgatgactttttttaaaaccggaaccgttgttatgtccacaaaaaaaattaaattttgagttgattcacccacactcaattttttgtctgaatacagaattacttactgtatatagcagggctggacgcaattgcggattgcggattacggaaattgcggggtttttggacccccgtaattgcggattgcgggttgcggatttttgggatttatccgcaattttgatccgtaatttgactattggattatttttcgcgacgatttcttgtaagattattttttataaaatgaatttttttctattgttatgtaaacaagaatatatgcgaaagtctgattcatcttcctccataacagtctcctttgagtcactcattagcctttcacctgcgcgcagggcgcgcagcagacttattgtagagctttaaaagctcgatttttcccgattttaaaatttcgaaaattttcaaaatttttcgagctaggcctaaaaaacggttttcgggtttttgaattttaggattttttaacgaattttcccagaaaaacggagaccactttcaagcaaccgtttttcgagctctatcgattggtgatatttttgaaaaaatatcgattttttcccggaaatagaaaaaaattttagcctgagcgggacatttgagtcccgggcccataactcgtcagaagttgataaaatttttttctggggtattttggggtgctgagca

SEQ ID NO: 19969 - DNA, 2311 bp, Heterodera glycines
tactctctttcatcgctctctttctccttcgttctactctttatctattttattctctccctttcctttccccctacccatcgcttctctcgctctctctcgctctctctttctctctttttcactctctactctctctttcttactctcttttatttaaaaaaatcttcaaataaaaccaaccaaaaataatggaaatttttaaccttcaaaaatttttttcagtcaatgatggtggcgtccaggacgaggcaattgtggaaggacagcaacttgtggacttagggaacatcgacgagcttttggccggtaatttgtttttttctctttattgctacagttttttgttagtttgtagcaagtgaaatctctctccgctgttttttctccccccccccgccccacctcctctccctctccttcgctctctttcttttactttcttctgtttttctctctctctcccttattcttctctctctctccctctctccaccttcgttctctttctttagcttaaaatcgcaaaaattggccatatattgtgaaaatctggtaacaaatcacaaccaaagcttcaagaaaattttcccggggacgcctattggcaccgccttattcccgcatttttttggaaaaccgcgccgaaaaaaactatttgggtctttaaaaagcaaaaaaatgtcatcggtggccgacccccccccccccccacttttttaatgtatgattcttttaccactttgcttttttgtctctcattttctctctctcaaacgcggggggtctgttagtgccgttaggcgccgccgggaaggaatttacctttgatttgttaactgattttggggagagtggggggggggcgggacaaaatttcgccgccaaaaatttagaaatttatgttttttgattttaattttttttttgtattcaggaattcgacatactcttgtgaacttacgtgatagcgccaatgcggaaattgaccgaattgatggccgtcttcaaggtgggtatgctgcttctggggtttttgtcgggattcgagaatatggcatccccttttattaatttctggttccggacctggtttgtagtaaattccaatctttaaattacacatttatttgtgtttgaactaataagggaacctcgcgaacttacagttaaaatgggtataaatgtggtataattgaacagagtcgacttgaatattagcgatatgtgaaggaaaataaaaaaatttaggcatcaaaaattgaaattgtgagtgtattttcacttcagcgatggtggcgaagtggggaaattgagcaaaattggtggttcaattggttaaattcgcttttttgcagggtccgggttcaaacccaacatgaaaagaaataaattttattaataaacgatttaaaaaactattgactaagggattaaaattccgatttttgaagccccaaacttttttattgttcttcacacaacggtaatattaaaaattcacaatagaaatctcgaccctgctctatccaattattccacatttatatcccacttttgtaatgattcgcacattttatttgccctaatttttttggttatcattgctcattctttgacgcaagcatgtcaataatcccattcatatgtataaaatgatactgtcgtgcttcttctccctggttcaatcaattcccacttgtttttttttaaatcttcgaaatggatgacatttttctgaaatttttatgaccaattacaaaaaatctttaaaataataaacttattctttacgcctaggacgctttgctgttttggggcgattaattcgccaatgtgatgactacattaactatctcggagtgctcgccaacttgatggacgaattgcgcaggcagggagcaaattcggtgccgggcgcgtccgatgttctgctcatcccgctgaattgcgtgacgatgatccgaatgtgcctcattgttttccgtgcaacgcttagtttggtgatggagccggtgacatttgcgatgctctctttcacctctgtatatgtgtcttattcgtgttttggcatgtgtcaccagatcactatttatttctttatcgtatttttttgtatttcattcttccatctcatgccattgtactatcacttttttggctaatttgtaatgtttgtttgtttttgtgctaggtcaaacctaaattatcaatggagcgaaataaaaaaaagtatcaatggtaataatatttaaattattaatatttaaatataattattattttaattttatttacatattgagctgga

SEQ ID NO: 19970 - DNA, 1993 bp, Heterodera glycines
tttttatatacttaagtaaaaaatttaataaaattatacttctatagaaacacctagagctattgaattataccaagaattattaatttggttgaaaatggaccaagttatgaatttatatgtcttacatttttttgttttcctaccacatggcggtttttaggaaacgacccagcacgtcttagaagcatcaaatgctaaagacacttttacgtgaaaatgtcaaaccaatctaaaaatactatttacataaaatgttcctagtcttcaacgtaatactttgcaattctttgcttctcctgtcaattaatattttttcacatattaaattgaaattaaggcattaaaatcaattaattaagaattatataaaatagttgtggtcttttgtctgtgggtattttttgagtggtttttttgactgtggatcttctgtcattatgcctaatattttgagcccaagaattcccgagtcagtctctttatgtggtattaattgcttaacttcttccctatcgcattcctacaaaattatagagaaaatgaaacaagcaaaaacttcgcccaaaaagataacaacatttcatcgcattatctgagcaagtccatccgtttgatgcctcaaatttgcaatacttttaaatattttctgatcatttttcgatataaaatttgttcatttctcagcttggcttcggctggactaatggcgctgtgttggaccttttggtcaaatatggcgacaaaatgacgctgacacagatgccggatgttaactgcagcaaaatgacgaaggatcccgagcccgaagtattcccaccggaataaatagaatggaagtgatcagagcgaaagtgatcggaattttaaacttggctcccccgccacagaaatatgtccatttattaatccttcattttataaattaaattattttatttttgggataaattcacaaaaactctaatgatttataaatttgactagtttgtgcagaataagtccagaagatgaaaaacggacattaaaattaatttaaaattgagctttttatcaatttattttttaattcactatagaattgaaaagcgtggtcttagcaagttttttcaaaaattctacattacccaatttgactaccgtagtttatcagttgatatgagatgacacggtgcaaaattataattaaacaaaaaatgtacgaattggtgtcgaagtgcagcgctaaaaattttggaatttcctatcaaaattgttaccaaacatagctcatcacgcaagtttcctataacaaaccattgtaggttgaagaagctcttttcaatcaattcatgccataggttcgcgaaaaattttcaatagaaaaacattaattataaaaagtttagtaaaattttgaaaaattacaaaaacgaaagtactgtaatttgattcttgttagtttgtttccatatcaatgacgcttaaaatttttaatcgtcatactatcttctaatatcccaggggtgcgatcaaaaaattttcaaaatcagaacatcgggcgcaaaaaatctgattttggggtcgaaaatcaggacattttgcaaaattgcttcaaatcagttattttactcgtacccgcttcatttcactgttttttatttaatttctactgacaatgagtgtaatttttttttatttaaaatcatacgaacgatggaacagatgaagcatttgttgagcacgggtgagcattcgggtgtacacttttcggtggggaacggaaaagaggcgagtttaatttaaaatttaaaattaatttatttcaattatgtaattaccccatttcacaaatgcatacttcattaccgtaatgtttttccattgagatgagatcttactgtttaaaatgaaaattatatatttaaataaatgttttttcttcatttgaaagctgtattcgtcttgtgtggctaagccattccaattccaattttgtagccacgagaaatgc

SEQ ID NO: 19971 - DNA, 2159 bp, Heterodera glycines
  misc_feature (2145)..(2145): n is a, c, g, or t
tttcgggattttttcaccaatgaatgccaggcacccctccttatttgaacgtcgccaaaccatgggccgtccaacggcctttgaaaagcacaacgagcagaacggagaccaccatgacaataacagacagaaagttgagggtacggtggatctgaaggaatacacttaatgtgtactgtataaactttttttgtcagacaaccaaatttataaactttgcatcattcgaaatagataaaattaaaaaagaaattccttaagggtaaaaatatattttttgattttgacatttaaatgtggaacatatctacattttagcaaatgatggcaattttattaaattgaaaaaagtagttcaacgtttaaaaaatggcggcgccgaaactgtccgcgcccaattgaccccgacccaaaaaacccttacatggaaccaaattttcagtcccattattgttgtgtggggccacgcgctgcgcatgaagcgggccgagtacagcgcaacggaagtgaggcaaagccacgcgatcaccatcattatgcctaaaaaattggaaaaatgatgcaaagattaggtaacttaaatttggaaaaatacgaaaaatttatccaaacgtaatccaatcagcaggttgtatagaatttttcaaatttaattgtggaaaactaaaaatttcgcaaaatttaaatagaagttttttttcaattctatatattctgttgcatagaatttaaaaattattgtgctgaagaaagaaataaaatttaattgaaaataaacttgagaacattttttttcaattaatcaattcaggttcaagaaagaaattaaaaaataggtaattataaaaataaaatttaagataatttatttacaaagaattaaaaaataaatttaatataaaattaaaaaattccgaaatttattttttttaatgtattaattttttcaattcaacattattgaaagtgcaaaatcctattttcaaaatctttttcgtgtagattccaaatttttttttggcctagaaattccatccctctcaccatgtacatcgatcagtgtcagaccaccgccatgtccatgattttgtggtggtgctggttgttgttgctgttgttgtttcggctgcttagtcagcgatgaagcgtccaatggcacaattggacgggcggaaatgtgtgggaacaccgcgtgatcatcgctgtccaacgagtgaattccgatcgctgtaaaacaactattttttatgttcaagtgattaatgatcattcaagccaatcaaaaaaattttatctgaatttttcgcgctcagaattcagcagaataaagagtaaaaactcgcatcactaatgatcggaagcattcttgcgaaaatgattttattttcttttttttttgtaaaaatatataaaaataataaaatattttgagtcataaaattttcgaaattttttaaaaataacataactttcatatttataaaagttttagactcaaaggaaaaggacggtttgcgattgttgacacattactcactgtgtggttcttctgccggtcccttggccaagaacagatagtacgccttgtgcaggttcggccgtgccaaatctttgcccggcccattgtttgagtgttgccgaaactgagaaacgcaaatttatttttaattggcaaaatgccagcaaatatatagacatttcagaaaactctctcactttacagtaaatgccgttgtcatccgcttttccttccaacagctcgagaaagccattctccgcccccttaagcatttttatataccaaaacacaagtgattgacatcccaattaggtatttgtattttaaaattccggttttagttcacaagatcccactcttagtctcgttaacgcgattcttgcaaaataattaccaacatggtaaagaattggtgcctaattatgcttaatttaccaggaattccttttaggcttaccgcaggcgccggcacattgttctttgtgttggccgggttcaccgaaaggcgcgcctccacccgtccgttgccagtcaaaacacagtatgttaccgcatcgtcaccctgtgtacagtatatttagcaacatgattactgtgctaggtcatcatgtatttcgcctattggncttttttctgtcat

SEQ ID NO: 19972 - DNA, 1809 bp, Heterodera glycines
tcggtttgatcccactttacaaattatacggctactcatttgacttttttcatctgaagagagagctgtttatttcgaaaatattttggtactcgtaatttagtcaaatttccttttaaatcaaaaacttcgcagaatttcaaattttgacataaataattgtactatgttaattagttttaatgaaattcctctgacattgattttagttgcatatataaatattcattttgtggcaataattttttttttatacttttgtaaaaaatttactttattattctggtagacaacacttaaagctatttaatgataccattaaattttaatttaggtgagaacaataaaattttgttgagagacggttttaccgttcacaaattcggtcgcgataatcgactgtcaacaaacgaagcgattcgcgattaaatttattttcattaacttttcaatttatttattcaagaaaaattaattgtattattcgggaccagctaaatttttcacaatttttgtattttatgtgacatttgtttttgttaaattaactaacgcattttatttttaattaaaaatctgtttaattgggtttatgtttcggaattctcatatgtataagatacaaatgttataatttttttatttaataaaaaataaaaaagcacttatttattaggtctatcgcatgatataaagaatcataattcggctcctttgagcaaggcatatataataaaaaatttctaaatattttaataggctaaattgtttaattcttaaccaaataaatagtgatttcaaaaatgtttttcgttatttgaatattttgcttgaaaaattattcaaagaaattacaaaattttgcgatttttgagcaaattttgcaagaaaaagtttttttagggtccggggtgccgataggcgccgccgggaaattttaaaaaatttcagttaaatttattaacagaaattgtacaaaaattactaattttttgaaaaaatttttttttaaatttccgaaatttccgacttttaatcaaaaatgtcggaaatcggaagtcggaaattttattcatttttaattttagatcaaataaatttttttcgtaaatatgaattaattgacttcaatttgtactcttcacttgagttgtaaagtaagtaattaattatcaataatttatttaatatatttaaaatatttaagttggtttataatattttatttataaagcaattttactttaattaaataattatttttatttattttttatatttttctttgctttaaatttttcaaaaaactttaaaaattaattatttccttatttattttaatgattctattaatgtttttttaaatattattaaaatctttaattttaattatttagaaataaagcattaaaaattatgtttttttcaatattttatttattgaaaaattaaacaaaattgatatttctttttcagggtatagtaaaaactcagcaaaaaataagcaagtatctctaataaatatttctaatgaataaaaaaatttcgaaataaaaattaaattaataaaaaatataacttcagatttgaatttaaaaaaaattctttattgaaataaaaaactgtaatttttaactaaataaaaataaaataaaaacacacttttacactgtttgaactaaaattaaaaaataaataaactgagtgaccgcaaccaactggctgaaaaatactattttttctgccaataaagaaataatattcactcgatagcccgttatttcatcaatgtaaaataagatgaagtga

SEQ ID NO: 19973 - DNA, 925 bp, Heterodera glycines
tccgtcctgaggccgcgaagcggccgaattccccccacctccaaagacgggcgcgaagcgccagtctgaggccgcgaacctgccgaacgtctcccaaaaaattaaagaacggacgcgaagcgcccgtcctgaggccgcgaagcgcccgtcctgaggccgcgaagcggtcgaacgttcctcacaaaattaaaaaacgggtgcgaagcgctcgtcctgaggccgcgaagcggccgaatgtcccacaaaaaaattacaaaacgggcgcgaagcgcccatcctgagtccgtaaaacggacgaatgttctcaacaaaattaaaagacgggcgcgaagcgcccgtcctgaggccgcgaagcggccgaatgccccccaaaaaattaaaaaacgggcgcgaagcatccgtcctgaggccgcgaagcggccgaattccccccaaaattaaaaaacgggcgcgaagcatccgtcctgaggccgcgaagcggccgaattccccccaaaattaaaaaacgggtgcgaagcgcccgtcttgaggccgcgaagcggccgaattccccccaaaaaattaaaaaacgggtgcgaagcgcccgtcctgaggccgcgaagcggccgaattccccccaaaaaattaaaaaacgggtgcgaagcgcccgtcctgaggccgcgaagcggccgaattccccccaaaattaaaaaacgggcgcgaagcatccgtcctgaggccgcgaagcgggcgaatgttatcaacaaaattaaaaaacgggcgcgaagcatccgtcctgaggccgcgaagcgggcgaatgttatcaacaaaattaaaaaacgggcgcgaagcgcccgtcctgaggccgcgaagcggccgaatgtcccccaaaaaatttaaaaaacgggcgcgaagcatccgtcctgaggccgcgaagcgggcgaat

SEQ ID NO: 19974 - DNA, 751 bp, Heterodera glycines
ggggaagggtgggggtgccatgcattttcccatacacgcatcgattaaggcagccgcgcatgcactagcaacgaagtcttttgcgcgaagcgctcatgtcagcgcccgcccatatctaccaaaagtatactgcccacaacatcccccactgtgcaacacgctagttactatatatgttatattgacaaggagtttcgtttgcaaaaacaaaatctcccggccgaaggccgggagcgccctgaaagtagtggaagggtcttacaactttttgaggcgcatccgggaaaactatagagaaaaattctgcgcggacgactgagtcccagggacggatttctcaatttttcgtgcgtttgacggcccataactttttttctgaaactcggatcaaaaaattcccgctgtgagggcactccgcagaagtgtcctctataatccagtattttttattttttgatcagaccaaatcccggacctgtacagacacggagactcagttaatttttttttcccacttcagtaccaggtgaataccacgtcagggtttggtctgagcgagggggtgccagcagacttattgtagagtttttaaagctgcatttttccaaattttaaaatttcgaaaattttcaaaatttttcgagctaggcctaaaaaacggtttttgggtttttgaattttaggattttttaacgaattttcccagaaaaacggagaccacttccaaaacatagtttttcgagctctatcg

SEQ ID NO: 19975 - DNA, 2063 bp, Heterodera glycines
tgaaaaatgacattttggtaaagcggggacggtccaagccttatttctgcttggaatgggtgccatccccggacgacatttttttttgctcttcagagcagccaaaaattttttgctctattttccatcaaaattttgaggaagagggggtcccgcagtgccaataggctgcagtgagagaattttttgaaaatttggtgttgcgttttgttaaaaaaattttcaaaaatcaatttttcataaaattaattaaagtgtgtcttgtcttgaaggggctaccatcatgaaaaagtcaaaattttcaatacgaatgccttttttcattaaataaatttttattttatgcggtgtctaagcaaaagaaaatgaaattttgtataacttttattatcattattttgatttacttattttcattttcttatctgatcaggttggaaagtctgcacttgtcaaccaatttctgtgggagggctttctgcacgactaccgtcctacggtggaggagttcaactgggtggagtacggtagcgacgagccgaacagtccgcaactgttacttcaactgatcgattcgtcagggagccgagactttttggccatgcgccacctctattaccgtataggcgatgcgtttatggtaatttgttgattaaataggtatttggttaatggatttaaataatttcatttttaggtcgtttattcggtcaatgacccgaacagttttgccgaggcacagataatgcttcgcgaaattgagcaattaaattccaaaaaagtgggatcaattttgttaattaattaattatttttgcaaaattaattattaggctccggttttgctggtggccaacaagagtgacttagtgccggtcacccattcgacgtcaaatttgtctgattcaaacggcgccgtttccgccggtgcctgtgaagcggcgacgcccaaatcggtggcattggcgacgagcattggccaaacagaggcagaagcggagcagcacaggttgttgaacagtgtacgacggatgcgaatttcggcaaaaaaccttgaccaggtaaaagaaggagaaggcactgggaaaacagaaaaaatgtgccaggttcatagcttatttctaataaatgcaagcacattgagcagttcgatctgagttgccttttttaaccgacttcgtttttaagtattttttcggcattttattgattggtcttatttttttaaatttaattgacgattgtttaatttactttttgttttgattgaaaatttcttatttttttctatttaattttaaatgccctcctctttttaggtaaaaggggccttcacttggctgatcgatgcccttgtccgtcgctcccaaatcactttattgccgcttcgcgatggtcgctcatcggacagcaatttgtgctcggccgccgcattgcgtaaggcgctgacgcgtcggcgccaatcgcttccgtcgcgacgcacggcgaggtgaataaattgaacaaaattaattacttttttttattattcaactttttcaagtgaacttggcattgacgaggagacgctgcgccgattggtgcgccggcatgacaagcggcaacggcacgccgcttgcgtaatacaatgaaaggcgacagcgggcgaaaggggggcggaaaactcgtgccaaaaaccttttaaattttaattttcattgtcatttttttattgggccaacgtttatgtaaaaactcagcaaaaataagtaaaaaaaaaacatgcaaaatgttggcccaattcaattcaaatatacactcccagacaaatatattactgaattcaaaaatatttttaaagaattttagttttaaaatatgatttagtaatatctttcaaaaatatttagagagtcattagctcattcgtcactcattaattacgacgagactcgtttttgagtacatactataatgttcaataaatattttataattatttgcaagttttgaataaatcactttcaaagttcatatgtaatcaaatgcccataaaattattttttagaaaaataaaagaatta

SEQ ID NO: 19976 - DNA, 926 bp, Heterodera glycines
cgaacatcgttcagcatggccgatgatgatgggcttgacagcagtgggcattcctgcgcgagtgccggcttcacaccgaaggtccaacatggcggcggtggtggcaccgtcggcactgctgccgctgctgcacaggcgtcggcctcgtccaccggggtggcaccggtccatcggctgaccatcaccgacctgaaagcgccgtggactattgaaaaccgccggtgggtgtgaatgtggaattggaattgcaaaaatataggcatttcatcccctcgtgtcatccccatttcgttaaaaattcttcaattttttaatttttatctttaaacagtttttttcctaattccaattttttttaaataaaaaatttttgcgcggggggaaatatagtgtaccccggaaaatgaatatattttttgtttcagtgacaattgtttggtgattgcgaaaggtgttcaaaaggcgcacattggcttttcatcgtccacatgcatgagcctgttggcgtacatcgtcggtgcgtttagcctttttcttttgctgaatttctagaaaaaaggccaaaaaactcgaagatttttttgtttcttgaattaaaatttttttgaattagatcaggaaagattttgttgtttttttttctaaaatagattaaaaaaatttgcctaacgttttggccagcggcgttttgtcctaccccttatttgcgggtgcacttcgtttccccccccccacgtcatttcccccccgaaaaattttttaaaaaaaattttcaaacctagaaatttttcataaaaaaattcttaggaacttacttagttcgaaaatttcaaggaaaaaatttttgagaaatttttcagcgattttttagaaatcttagttttgatcaccaacaaattttctgatttaaatgcccaatttcaaaa

SEQ ID NO: 19977 - DNA, 3251 bp, Heterodera glycines
tagggtttgtcacgacgtctctttggcacatacgctcctccgtacagttgtggcggcattccctgctcaaaaagcgcgtgcggtggtggctgtaaataatgtgtctcataaggaaagttatgttactacaacctgccaccaactccctccttcaaacattttgaacttctccagccgccatttttgacggtcatcgccttgtaaaattgtgtaaagacgccatcggtagtagacatgagtagggtgatgattatcgaacagaaaactaaagaagcgacaattgttttttgccatctttttggtaaaaaaaaaaaagacattaccgatacattgggttttgacgttctctggccatcaaaattgcctcaaaaagagggccactccgtacaagaaattccacaacacggtgaataagtgtcaataaaggcctgaatcagaaagagggctgaatttaaaaatggccgcatgttccctaaacctctctgtgggaatgacaacgcgcacagtggcattctcaatcatctgctagttgaacgtgacgaattaatcggatcagatcagatttggtggagtgaaaaggcgccagaaaaggtgtggccccaacctttttgtagtcctccagcatttgtgtgtctctttcgccctcttcctcagttagcggtactcccaactttggcaaatctccatagttctgcagaaatgaacgcagctcctccgtcacaggtcgagcgttgaacggcaaacccgaaggtgggtcgggcatggcaagctcacgaagaggcagcgggacgaaaaagggctataattggccgattgcttttgctttcagggtttttgattatctgaccagcggtggcatgttcacggaacgagcccaagacacacgaagttcacaatttcggattgtttcttggtgcattgcacatttagaacgttcagcatccgtccggctctgagtgtgtcaaaatacaaattttttttttaaatgcctttcaccataaaagcaacaaatccgctgagcgtttcacgataacggcgttcgtcttctggacgtgggtagagaattcgtgcggatgctaatggtccaaaggtgccaaatgtgtcgaaaaaatcttccaattttgcctgacaataagccagagttgtaatgaacatttgttagtgttttacatctgctggaaggttgcagacgtacaaattggtcgtgttcgggtcatcctccccgtaggggtcggagatgctcggcccgtatggttggtctaaagatggtgcgattcggtccaattcctcttctggcatattcaaccgctccttcaaatgctgtctcagtcctttgcgctcatctctcatcgcctgcatcctaaaaagcttttcgaataataccctttacaaataacaaaaggcctctatgaataaacttcatttttcacgtactgtttcaattcttccttgaacatctccaaattgctcagacggggcttttctaccacctttttaatgcccaattttggcggtttgccaattgatggaacagtcgcatccggcaccggtgtttgaagtattagtgggtcaggcttttggctatttttatcggcagcttccttaaatcgaattgctctctgaatagaaaggtggtattcattcctttttgtcttaccatcattattttcttggcagtttcttctgcaatttttttcgcagcttctaacggtgggggtttcgacagcgttttgagattaatgggcgatggcttataaacaacggaggaggaagaaactaaaccaatgtattaaacacaagtttttttttgctttttaacctgatttgtggcattaacaacgtctcctctgatgaaagtctttacaatttttttggtcccactggtctcctcaaatgtttcacgaaattcttcaaacgcttcttcaagtcgctctttctcttccttttcctaaaaatcgactaaatacaataataaaagaaaatgaaaaacacacccttttccttttcagcttaggatccatcgttgaaagcattagagaagcttaataacttttaatgatcagttgccaaaagtattggacctataaagaatagggatgttttttgttgcgctaattgtacataattttaacttaaacagaattaaaattagagaccggaaatttcaaatttgcgggtcctgttgcacacggcgagtcaattttgggctcccagtgcaaataagtttattatttatttagtaatcagaacgccaaaactttgcaaaacttaaaatttattggggattttcccttgtaaaaatggaagagccgatctcgagatagaaaagaaacttttaaaaaacaaaagagaattcgatagagggggtcgaaatatgggcctatgcaaaatttgaagaaattttaaaagctagaaattttttttgaaagggacgaacatttcaataattttaattcttttttagccaagtccacaatttaaggccaaaccaaataaaatttacaatattctccagaattttcccttcaaaatgagcataaaatggttttatttgctctagtattcaccaagttataagctaaaaaaatttcataaaattgtcgatgttatgacacgaaaacttttattaatgaaaaaataattctgccttcttctttaaaagaagaaattgaaattaacacacaacataaggaggacttgaacctgagacccctttttgttgactaactcacagaccactaagacgaaaaaaccaacttaattgtacttggagcccaaaattgattcgccgtgtgcaggattggaattcaaaatttttacaggacaggatccggcaggattaatcttgcaaatcctgtattttccaaaatatgcaggattgcggactgggatcctgcaaaatcctgcgcaggatcctgtcctgcgccgttctctaattaaaatcattccataatacacagcggcccaattttgggctctcatttgtcagtgcaaataggtttattatttcactataggtacgccccactgtgcagagaaaagcctagtactatctcgtcgtttctctttttctttgtaatttctctcactttggtgtactatcttttcattttaatgatgtaaaaagcaacattcacttcgctacgtttaactttttttctatacgttaaatctataccaaattttgcatatcgatagagaaaaaaattctgcattattctatgctcaattattattgtctgtgctcaaac

SEQ ID NO: 19978 - DNA, 1552 bp, Heterodera glycines
  misc_feature (1527)..(1527): n is a, c, g, or t
aaaacatcccagataatttccaaaccataaatgttttttccgaccattggccaaatgttgcgcaaaaatggcttccaaaatgcggtccatttgtagtacgggtcgaatggtcaaaattaattggacaatgggtgaaaagctggcaaaaaacggcggagaaaagtgatggcatttcgggtcaatgaaactgaaaataaatagggaaaatttgtataattttttagcatattcgccaattttacaagatgctgatccgttgaaatccgacgactttcttttggcagcggattttgcggaattggcaacgcttttccaccgtaattgacaatatccatttccttggtgccattctttccaattttgctgtgaatttgaataaatttcagcgcccatttgcgagttttgaagtgttcgtccacgtaaatgtcaaaacggtgactgatcatcgcaattccgtggccaagttgtgaaggcgtaagcaaatcgaacacacaaagccaacagtcggcggagatgaaactgaaaaattaaatctgacgttttgaaatttgtttatttttttacattttcttttttagttttttgaagcggtcccaataaagccaaagaatggcacaacatccgacaaacccgacaaacaatggcacaacgaacagactaaaacaaaaaagagaaggaaaaggataaatgttgagaagaaatgtgaaaaacgtacagaatcatttttgaaggaactttgaaggtattgtcagagagaaacagtcgaagagagagagagacgaaaacaaataaatggcgaatgaataataatggaaggtggaggatgaggagcaaccacttttatactaatttttatgttcatttgtacgcttttgcattttccaattttttctcgactataaaagccctccctccctcccccatttttttcattcactcactttttttaacagtgtatgaagacaactttaataaagcataatttttttgttcgtaaaaagcaaaataacctttgtgtctccgaatactctaaagtttcaaagatatttaataggtatgtcttttttctaagcacctaattaacccataaagatgggcttgaaaactgcagaaaagtcagaatttagccttttttggctctattgcactttatgagtccaatcaaatatttaggagtccaatggcactccatgagtccaatcattcaaaaaaggaaaaggagtgatcaaatgaggaaaatgaatggagtttaatggcattctgagtaaaatgacattctgatcgggggggggggggggggagatatcacactaattattgatcagaaatgatcaggctaaacaagaaaggaattccaactttgtgtcaaaaatgacacaattttttttcaatttttggtgtctaatttccgtaaagccgaaaaataatggtaaaatggagtccgactgtgccgacgcttaaataacaaatttaatcatttatccttaagacatacaaaacacaaatatacgatgattagtgttcganagttgtatgcactaaaaaatgccaa

SEQ ID NO: 19979 - DNA, 1237 bp, Heterodera glycines
  misc_feature (93)..(93): n is a, c, g, or t
  misc_feature (107)..(107): n is a, c, g, or t
  misc_feature (117)..(117): n is a, c, g, or t
  misc_feature (121)..(121): n is a, c, g, or t
  misc_feature (124)..(124): n is a, c, g, or t
  misc_feature (126)..(126): n is a, c, g, or t
  misc_feature (128)..(128): n is a, c, g, or t
  misc_feature (133)..(133): n is a, c, g, or t
  misc_feature (142)..(142): n is a, c, g, or t
  misc_feature (147)..(148): n is a, c, g, or t
  misc_feature (154)..(155): n is a, c, g, or t
  misc_feature (160)..(161): n is a, c, g, or t
  misc_feature (163)..(164): n is a, c, g, or t
  misc_feature (174)..(174): n is a, c, g, or t
  misc_feature (179)..(183): n is a, c, g, or t
  misc_feature (188)..(188): n is a, c, g, or t
  misc_feature (191)..(192): n is a, c, g, or t
  misc_feature (194)..(195): n is a, c, g, or t
  misc_feature (203)..(203): n is a, c, g, or t
  misc_feature (212)..(212): n is a, c, g, or t
  misc_feature (217)..(217): n is a, c, g, or t
  misc_feature (227)..(227): n is a, c, g, or t
  misc_feature (230)..(230): n is a, c, g, or t
  misc_feature (235)..(236): n is a, c, g, or t
  misc_feature (239)..(240): n is a, c, g, or t
  misc_feature (242)..(242): n is a, c, g, or t
  misc_feature (245)..(246): n is a, c, g, or t
  misc_feature (248)..(248): n is a, c, g, or t
  misc_feature (257)..(259): n is a, c, g, or t
  misc_feature (267)..(267): n is a, c, g, or t
  misc_feature (276)..(276): n is a, c, g, or t
  misc_feature (279)..(279): n is a, c, g, or t
  misc_feature (281)..(281): n is a, c, g, or t
  misc_feature (288)..(288): n is a, c, g, or t
  misc_feature (293)..(293): n is a, c, g, or t
  misc_feature (296)..(296): n is a, c, g, or t
  misc_feature (304)..(304): n is a, c, g, or t
  misc_feature (307)..(308): n is a, c, g, or t
  misc_feature (315)..(315): n is a, c, g, or t
  misc_feature (324)..(325): n is a, c, g, or t
  misc_feature (329)..(329): n is a, c, g, or t
  misc_feature (337)..(337): n is a, c, g, or t
  misc_feature (340)..(340): n is a, c, g, or t
  misc_feature (345)..(345): n is a, c, g, or t
  misc_feature (347)..(347): n is a, c, g, or t
  misc_feature (359)..(359): n is a, c, g, or t
  misc_feature (373)..(373): n is a, c, g, or t
  misc_feature (388)..(388): n is a, c, g, or t
  misc_feature (398)..(398): n is a, c, g, or t
  misc_feature (409)..(409): n is a, c, g, or t
  misc_feature (411)..(412): n is a, c, g, or t
  misc_feature (435)..(435): n is a, c, g, or t
  misc_feature (443)..(445): n is a, c, g, or t
  misc_feature (450)..(452): n is a, c, g, or t
  misc_feature (460)..(460): n is a, c, g, or t
  misc_feature (472)..(473): n is a, c, g, or t
  misc_feature (477)..(477): n is a, c, g, or t
  misc_feature (481)..(483): n is a, c, g, or t
gagcccatccgttgggagtgctttcgattagctttctctcctgaggcacatcctaaaatattatttataaatattactcttttaagaatttgnaaataaatggttanatgaagaagnatgnagntnantgggntaaagtaanagttnngtggtnnatttnntnngaatttgttnagtannnnngtggnagnngnntttttggngatgggtgnaaaanggggaaagtnggnatttnnttnngnaanntnttttgaagnnnaatttggntgagtgttnaananattttgnatgtnttnaagttgtnttnngtttagnatgatgaanntganaaaaaggnaanggtantnaaagaaaggtgnggaaatggtggganaatgataataaatanagtatgtaanaaaattatagngnnagggtttttttgggttgtttttnagttattnnnatggnnntataaagntgaaaattttannaagnatannntctcttaacaaatattaagaattgtacaaaaattcaagaaaattttatgaatttaaatttaaaacacacccttccgcacaatttgaagcaaaaaaaatgcttaaaattgttgtgcacaaaaatgtcatccagcagcaacggcacccggcggatttacacgaaagccgaaaattgttgccgttgaaaagcactgccattttagccacaacaaatgaaaaaaaaattaaaatgctttcctaaaataataatataaaaaaatataaaaataatctctgttaaaataaatacagtagccaaaagcgaattagttgcattatatagaaaatggacaattttcttaagtacatatttggattgcaaactgaagattgcctaaaaatcattgaaatgaaatttgttttgcaattctgctagtgaatggataaagatcagttaaaggtttttttggcatttttacagtcgcgaacaaaagaaaaaacgcatttaaaattacaatatttacttgtgcccaaaatagggacaataggggcggtggggggcggcaaaggtcggcggtggattcggttacatttattcgtcacaaactttgcacggtgccgttcggagagggggggggggaagggtggtggcacatgacgacactaatctttttttgcattactgggcacttttataaccaaaaaaagatgcttcaattattttgaacggatgctaattttatatcgatgaatttctcaccaaaaaatcatgggaa

SEQ ID NO: 19980 - DNA, 1934 bp, Heterodera glycines
  misc_feature (1928)..(1928): n is a, c, g, or t
aacaaaacagaaaaaaaataaattaaaaaatgtgtgccttcgggttcatttcgctccgttttaagagagaaaaaacgatgataaatgctaataagaattgcattatgagtgggtgggacgagctgaatagggcaaaattaattattttcgagcaattgttccatgaagagaatgtcggtcgatgcgccattgtttttgttgtatgcaagcaagcccatattaggcattattaaattaatagtctcattcatcgatgccattgtcggctgacgacaaaggcgcgacttttaatggctgcccaatttgtcggcattaattcaattagccaaatgttttttttgctgcaaattatgcgcagaaaaacacaatgagataatagacaaaaaacttaaatagtcactcattcaaatatcttttcatttatttgggttgttcaataaagaaaaaataaaaaataatttttaaattttaaattttccttataaataagagttgatctatcaaaagtttccaatggatgaatttgtcaactctgtaatttacattgtttgtcttaaattttcataattttgactaattatactaattaactcctattggttgctctcatattctgcattggatgttaccaaatacttgaatatattttaatttttcacatttgttcaatttatgtaatagagttgtatgatatcacactaataaaagcaatggtatctgttttgaacgatttaattaaccaatttacattttattttatttctttcgcgtttagtttttgcaattcctagtggaataaatatttcttaaaatcgaaacttctcaccatttcagttaatagaatttttttgccttataaatgaattcaaatgctttgacattatgttaatgagttatttcttgaagaaaagtattaaaatgacactgaaaagtatgacggatttgttaaactaaggaaattattcttagaatgaataacattatatgcactttatcttatcgactattatagcaccttcacctatcttctacgctttacatatttattgaatattatgagcaatcaataaaatatttctaagattttcaaaaattatataaatcagtttggccgtgttaaataagaaagaaaatcattgaaaattaagaagcaaatagtttttcttggtcaaaaaaaacaagcaacaaatgccatcccgaacaaagcaaaatgaatgaatgatcagagaaaaacaaacaaaaaatgaacaaactcagaaatcacacattttcatcgccaacaatttctgagttcaaatttgcgtttggtttcgctaaattaattaaataaatggtaaaaaattactgtattttcaaattaaaataactaaaccgttttttaatgaaattatgaatgtttttgcgccacaaatcggacaattgttgttctgtttaaccctaaatttgtaaatgtcaaagttaaagaaattaattttcctttcatttaccaaaaaccaatgttattttatgtgaaaatttcataaaaattttttaaattaataatttatgtttttattgttatacttgtgcatttttatttttctaaaaataagaaaattgaccttttctgtcagtccagcagcaaaatttgaatttctaggccatttggacagaaagccaacaacggcactttgtttttcttcaaaagtttcaaaataattcaaaatgcatcggttcgtttcttcgtctcgaaaatggcataaactgtcgagcgcaacattctttgccaaggaatacaatttttggggcgcgtaaggattttcaatgtcggaaatagccatcgcctctcggctcagcggaatgatgtgcacattgaaggacggcccattgactttcagcattttcgatgccaatcccccatttttaattgtgccatttgtctgcaccanaaaatt

SEQ ID NO: 19981 - DNA, 1902 bp, Heterodera glycines
aaaaatgcatttttgggctaattttaggaagcaaaaaaattttttcaagaaaatccaaaacccagggggtccccccttatgttttttatttttcaaaatcacaattaatttcataactttttttaaactcatggttaaaacatgagataaagcacattagattgggcttaaaattctctacaaaaaagctcttagacgattttttgataaaatcaactcctgacgagttattgagccagaactgaaattgaggcctagcaaccaaaattttctatttccaaaaaaattttaaaaattttttctgaaaatgactcccagcaagcattttttgatcaaagcaaaagaaaaaaatttcgtaacagtgagactgaaacgaatattcgtgatcagcggcgctaacccctaaagacatgtttttggaagatttttggtgaaaaaatttttcctctcaaaaatcatggtcacacccctgtggtcccaaattccaaaatcacttttatttctataacttttttcaaaaaagtgataaaaagctaaaataaaatttataaaatagagcaaaaaattgcggattttttgagtatattatttttataaaatacttttttagaagggagttctgaatttttttctgaaaaatcgaatttttccagaaattctggaataacttttttattttggaagttagaaattccaaataaatttcataaaattctcctaattttttgctatttttcaaactttattccactaaatttgaccaaaaacgaagagagttatgaattttcaaaatttcactggattttccggggctcaaattttgacgatttttcaaaaatttataaccaccttccaaaaagtctgaaaccaaaaataaagtatatattcgagttcagcaccttaaattaggccataaaaatgcattttggctaatttaggagcaaaaaaatttttcatgaaatgcaaaaccatggggtcccccctatggtttttaatttcaaaatcacaattaatttcataactttttttaaactcatggttaaaacatgagataaagcacattagattgggcttaaaattctctacaaaaaagctcttagacgattttttgataaaatcaactcctgacgagttattgagccagaactgaaattgaggcctagcaaccaaaattttctatttccaaaaaaattttaaaaattttttctgaaaatgactcccagcaagcattttttgatcaaagcaaaagaaaaaaatttcgtaacagtgagactgaaacgaaaagccgtttcagcgccgccggcgctgacatgtttttggaagatttttggtgaaaaaatttttcctctcaaaaatcatggtcacacccctgtggtcccaaattccaaaatcacttttatttctataacttttttcaaaaaagtgataaaaagctaaaataaaatttataaaatagagcaaaaaattgcggattttttgagtatattatttttataaaatacttttttagaagggagttctgaatttttttctgaaaaatcgaatttttccagaaattctggaataacttttttattttggaagttagaaattccaaataaatttcataaaattctcctaattttttgctatttttcaaactttattccactaaatttgaccaaaaacgaagagagttatgaattttcaaaatttcactggattttccggggctcaaattttgacgatttttcaaaaatttataaccaccttccaaaaagtctgaaaccaaaaataaagtatatattcgagttcagcaccttaaattaggccataaaaatgcattttggctaatttaggagcaaaaaaatttttcatgaaataaagaaccatggggtccccccctatggtttttaatttcaa

SEQ ID NO: 19982 - DNA, 2408 bp, Heterodera glycines
  misc_feature (2382)..(2382): n is a, c, g, or t
tgtgaacctttgccatcgaccagcgccggaatatttctctccctagcgaggtaaaatgaataacaataaacagatgaatttatcctttcgttaaggcaaagtccaagtaacgaaacggagcgacaaattatattcgaagaaaatgaaagtgatcaccaagacgaggcaaaagatcaaagaaattttagttgaaaaaatgctatttcaggaatttagcagagaattcactgattatggcgatgaagacacgacacgcgacacatcggaattacaggacgaggaagtaagcctaattgcgctaaatgctgcttttggaaatgttactatttttcctcatcgggaagacaattctatccttgccgcttcaatctttttaatacggaacaaaataattttaaaaagttaaggatgatttgtacgacgaactggcagacgaccttgaagaagaaatgcagggaggaaaaagaaaggattattttgacgaagatggatagtagcagaatatgatgtgcatttacacgctgttggttttatttttatttttctggaagcgtttagcttaaacaacaataacaagtacaaatagcctgtccatttcaattgtcttttcttctgcgtctgtccgttttcactgtcgctttttgatgctttcgcgctggttccaattcgtctccttcgtccccaattcctcttttatacccttttctttcaaacatttctttataccgctaaacaaactcaaatacgatgaatatttaaatttaaatactctcacatttgcagcaattctgccagcttcggagactctttccacctaaaaacaacttttaaaattagttgattaatgtttctcgtttcttgccagttgcatcacatcttcgtgggttatctcgaaaacatcaagtcgtttcccaatcgaattttcaaccttttggtacacctccacgtcgtactgagttactatagtgagcgcaattccggacttaagagatgcagaataatttacgaagtccgggcagtttccactcatttatttcttgcggtacctttcccgctctcgcagttcgtccgactctgtgaacgtagtctttcgagctttgaggaacgtcgtaattgatgaccatgtcaacatttggtatgtcaagccctgcaagcaaattttccactaattgcccacttctaattgtaagtaaaacacctcgtgatgccacgtccgtacaaacgaggattggtctgtcctttttcttaaacttatgcaaagcccccaaacgcttcggctgtgacatctgtccgtgaagggaaatcgcaccaaagcccaaatgtcgcagcagcaacgacaatttgaccgcacttgcgcacgtactgacgaacacaatggcagtattgcccgccttttcgttgagtaaataaaccaaataagcctcctaaagtggaaaaagtaagcacataatttgaatctcattgccattagagtattaattgaaatcccaacctgtacttgaacgggatgaacagcatattttggatgagagtgctcaccgtttggtacttcgtcgaaagttcaattctctctggttttttgagatgcgctctttctaatttggacacctataaatgccaaaaacaatttttatagaggtacacaagtgagtaagaggaaaaacatcttgccgaaattagattctaaaaattcacccctttgtttcaatagattcaattttccattttgatttatgacttataatagcagtcaaacaaaatccaacaccttttgggtcattgtcgccgagaaaagataagttttacgagcctttggcaatactttcaaaattttgtcaagttccacttcaaaatccatgtttaagattcgatcagcttcatccaatacaagaaatttgacagtgcgcagatcgaaccctttggtattttccaaatgatcgacgagacggccgggagttgcttaaaatagacgattaattaaaattaaaagaaaaagataatgcagtcgatgggttactcctacaccaaaaaaatgatgaggaccaccactgacgggtgtactacgccccccacgccggaaatttttttagggaggggggggaggggaactgctttcaccaccgacagaattatcaagtaaaatacttaccaacgataatgtgaggacgttttgccaaagaaagtgtctgtgatgtcatatcgatgccgccaacaattgtacctcaaagcaagagatttgaagaatataacaaacttacaaagaaacgtattgaaatgtgtatcacattagaacctttttatcctgttagcatggtggattaagattgaaccataaacttttttaaaataacagaaaaaatcgattaaaatttttaaaaatcnaaaaatctcagaaagatagattgagc

SEQ ID NO: 19983 - DNA, 1999 bp, Heterodera glycines
tcgttgaaagcattactattaatttgacgtgatcttcctagagaatgtgctgctcttttgtgctcttcacctgtctgtcgcctttggcatttccctcccccgtggcattttaagaacttttttttgtttgcttattcattaagcactgccccctccctctccataatttgattcgttctgttcagtttgtccgcgttcgtttggccgtgccattggcaaattcctcgacttcgttatgggttccgcgcactcttccgccaacccttcgtcttccgtctcttcttgctcatcgcccaccaattttcgggaaaagcacacgcccgactcgttggaggacaaaattgagctgatctttgaactgttggagaaaaagcccacccgattgggctacagcatccagtgggcagtgcaggtgagggagggggagggaacggccggcacaatgccatggagcatggcacccaactgatcatttaaatcatcaaactcattaggaaagggaaggaatgcgagggaaatggcacggcgcaatgccattgcatccacccaaagtcccaacatccatttcttaccatttcattttgtaagttgttggccaatgcaacagaagaagagaagttggagatgttgcggtgtcgtgtgctcagccgaatctgtgccttaatcacccgctacagtaacgtcgaagttgcggcgcccccgggcacaccgaaggcgcggagtttgagtgtgtcgagagcggacttggaaaacgtcgggagtgaggcggaaaggaacacggaagagggagatgatcagcagcagaagagtgggagtgatcggagggcacgaaagacggaggacggatcaatgaaaagggcggacagcgcgggttcgacgcggaaaaaggagggcatcggctacggcacgggttcgacaaggtcgcgatggaagtaagtagcaatggcatcaattgcattgtgccatccgatgaaacgcggacaaattcagaccaataaaatgggtggttggaagcttttagctaatttaattgcttacatttatccccctccccctaaaaagctaagtttcgaaacgaattcatccgttgtccgtttagcattgcgcgtacagttgaggagcgttctctgcacgagcagcatctgatcagtcttctgtccgcgctggtcgcctttctttggggtggtcaactgtccgatcggctgacagattgggaaatggcacaagcgcacaaagggggcgaccggcgccgctcaaacaccgcacttctgctggagaaaatgcctgcccatttgctggacgaggcggtcgctcgacagatcagcgcgtcggcagtgtttccactgatcaacgcccatttgagtgagttggccaaattaaggcatcgatcactgatcggttgccatcaatgggaataattttgtgatctttaaaatgccgtcgctctcttaggcaatgattcggtgttggacgtctcccaacacatgccctttttccaaattctgttggaattgtgcgccgcgttggcttccgtcccggcactgctcccaaagattgttttgccgcaagacgcacacggaaaatcaatcgcgaaacagctgatcccgcagtttcggaacaacctgaacaattaccccacactgatgagtggaatcagcgaagctgacttatcattcatggactttattcgcaaagtcaacgattattcggaggttggggaagacaaaaaaatgatttccaatttaaattttaacttttcaggtcatcattcgtttggcacggcaatttgaacgtcaaattccagcggaaaagcgcgtcaaaacgtcccattcccatcgctatttcacccgcattggcgccgaccgcgtgcgacgactgcgtaacgcgtcggcgactgtgccatcgtcgacgggtccgagttcggcggttggcagtgccattgcgtcaccgcaagccgaccagcttcggctcgcagttgtcgtctccttcagcccaatcg

SEQ ID NO: 19984 - DNA, 2503 bp, Heterodera glycines
acaaatattcgtggatccgctggttgttgtgctgaacggcacggaacacaaaccaattggtggtgaccatctccgcttcgaattggtacccttttgagaagaaccgaaaaaagcaattactctgaaaaatactcagatagcggaggatgaaagcgcatttgaaattcagcaaaactctcgagtttcaatttggcccaaggaaatgggcagacaaatcaaagaaagcgacaaaattgcgggaattgtgtacgcaaaaaggtgggcaaaatttcttttgcgctttaaagaattttagagacttataaatagtacatcatccaattaatccttaaataatttgcttttttaatccgttgaaatattttttaattattcagcaatgctttgttggaagtgcgtctgaacaatgacctttcgtctgctacggcgttgcgtcagtttacacttcacgagcacagcgaatggcttctgaagccggtcatttggaagttcgaaatcgaattatgcaattcatttcagaatcccgtgaacccttaccaatatttggtcaatttgttgtgcaaccctcgcgaaatgcaaagactccccggcttcgacactttgctttatgcctatggcattttgcgaagcgaaaaactgaagaaaaccaagcgggataagaaaatgtggaatttgttggccaaagtaacggattggcactaaactttcatttgaattgacactttgtcagaaattcaacagctcccaaatctccgccatcgcttcggcaattaacagaagtcgtccctttgtcgcaatccatgggccaccggggacaggcaaaaccaaagtcattgccgaaatcgttttgcaggtccaattcactcataagcgaatgctatctgaaataaatttagcatgtcaaaaagggcaaaaatgtgttggtctgtgccccgtcgcataaggcagtcgatgtaataatttgcgctgaatgtccttttcaatccctccgtttcagaatgcaatggaggcgtgcaaaatgaatgggttggacaattttgtacgtttgggggaagaggcggacgacggcgcactgagcgaatatcgaattgggaaattggcacaaaaccacgccgaatacgaacgcattgagaaggacattcggaactcacgagaaatcaaaagccaaagggactttctggacaagtcgcggctttgtaattccatttgaaactttcgccttcagtgaccgacacattcgccgttttcattcgcttttgaggaaaatgggcaaaaggaagaacaaaatctgcgaaagcatcggaaagggcacaagtgtggtcagtccggcgcaatggtgccaaaagtgtcggcctttcccacagattttctgcacgtgcacctcgggacaggcactgcgctttctactcaagcgttggttctgccccgacttggtcgtgatggacgaggcgtcccaaatggtcgaatgcgccagttggattatgctgcttcacgtcctcccccccccttttcacgttcttgccaaatgcctccttttaaggctccccgtttcgtaattgttggagaccaccagcaattgcccccttttttgctttctgctcggaactctccggtgaactcagctgaaagactgcacatttcgctgttagaatatatcaacgaaaccttcaaaaatgaggtgctgcatggaaagagtgtttaaaactgtgtagaacatcacttttaaggatttctaccattttctttctgtccaatatcggtcaaatgaactaattcaaaaatggtccaacaaaatattctacgacaacaaattggtcacttatcagttgacgaaaaacattcacttgcgccaaataataaaccaacaaaatggtaagaaaacgaacagacatttccgtccctaataataatgtacgaatttcggctgatctctcctctggtcctttgtcctcaaaacaaaaatttctgatcgatggtccgcttgtgctcatcgatacggtgagctatcgccgagacatttcgggatatttcgaaattggaaaggccacttttcgcattgagttgaagcattttcgcataatttgtaaattctctcagcaattttataaagtagaatcattcccgattaaggacaaaggcatttctgacagtaaatggcagaaagtctacagcttgttcaagttgtggtatcccctctctttccgcgagggtcagaatgagcacacgcactcctaccacaacattggttggtttcccattcttttcaatttaactttttgcttaaggcgaggctttctgtgccgtccttcacctccacgcgttgaatttattcggcggtttggatttgtcgaaaatcggttgtattacgccgtactcggcacaggcggaaaagattcaaaagctaatggccatgggaagggacgagggaccacgcttcgaagtcagctctgtcgacgcccttccagggcagcagcgagaagccattgtgatgtcattggtgcgc

SEQ ID NO: 19985 - DNA, 2533 bp, Heterodera glycines
atgcccaaatatgcactaaaatatgccttaaaactgccaaaaatagcttttaaccctcaaaaaaattccaaaaattgtgtaaaaattcagaattgacttttaaaactccaaaacataggttaaggagcgttttttagacaattgtaaaacattttggttttcaaatttataaatttttcttatatgctaaaacaaaattatgtttttatataaattaatttttttcaaaaaagcttacaaagtttaaaaatttctcgatttttaagggtgtatttttaaaaaaattccaaaaaagtcgatccgtagggggtgtatttttcgtttttattgcattttcttatgaattttgccaaaaatgaccgaaatatgctctaaaaacgcaaaaatggccaaatatgcatttattctcaaaaacccccaaaatatgtttatatatgcactaaaaaccttcaccaaatcaaaaattttaatgcagaaatgctattttgagcccctttcttcatagcatatgcgcagaaaaaataagcaaaatcatacaaattataaccctattcataactagggcatccaaaaatatggatataaaatcgcgaaaaagaaaaaaacacgatacagcttaaaatttactcattttagcgaaaaatcaacctgaaaagcgaaattttcgcttttttgcttatttttaatataaattacgcaatttttaagaaaatttaaatttaatcaatattttcgacaaaattttgctaaaaatgtctttttctgaaattttttaggggtcaaaaatgccaatttacctgatggggccgttatgatagaggttttttggaaaaaatttaaaatatggacataaaatatggataaaaatgccaaaatatggaaaaatatggaaatatggacataaatcgtgaaatatggaaaaatatggatatggaaagtcatcctagaagcttcaaaccaagcttaaaacatgtttttcgtgcgtttcaggcctcccacagtccaggaaaaaaaatatggatttccatataattggatgccctattattcataacaattgaaaaaaaaaaaaagtttttcactagaaatcggtaccctattaattaaatatattgcactcaaaatatggccccctgttcacaaagttttttttagaaaaagctcgccgcaaaatttgtttttatttattttagtatttggaataaattttccaaattagcaaattaacactggccctaactgatatttttaatttcccttctttaatggactttttttaaacaaacaaacacaacaaaaacaacggtgaaaatgatttatgaaatcaattattttcgcattgattagagaatgggctcgcaatttgctgtgctatttatttgtcattcgtccagcagcaaaattggtttttcgcgagcaaagaattttctcactttttgttgtaaaaaaatttacaatttcgattttcaaatttttccagggcctcggaaaaccattcttgtgtacattaactctctgaggattgaatatttaggcaaatgtcttctggttcctattttcaggaatttggggaaaaatctttaacaaaaatgcaataaaaatgtccgaaaaaaagtttcaggaatacaaccccctataaatttgaaagtaaaaatgtcttcattgggcataatttgcaacaaaaaaaaatggtcgaacgtagaaaaattgggggggggggggtcaaattcaaacgtaacttcattgaccctcctccccttgcacacgaatgatgcccttaaaatgcacttcctaattgtctcattgtcaaagatacttaaatttaaaatttgcatttcaaatggcaacaaaaccgctcctctactgctactggcgcaggcgagtaaaacatatttaaatattaattttgttaaaaaaactttttagttatttttttatttttttctctgtgattaactcaatttcattttagctcatgctcctggcgagttcgaatcgcattgcatttgaagggcattgaatttgatcagcgcattgtcaatttgttgaacggtgatcaggtgtggtttgaacaaaaaaaatcatgataaatggaatttgtgagtgatctgttggggagcaggtctcccccccccccccgaaaaatttttgttaaaaaactttttcaaacatgaattttccaaaaaaaaaaaaaatttttcttaggaaattcttagtaagaaaatttcaagaaaaaaaatttgaaaaacttttcagcgatttttttgaggaactattttcaaaaatttttccaaaaacccctgaaatattttcaaaaaatgttttcatgaaattttcttactaaaaaatttcttaaatttttttttaataacatttcggtactagtaaagtttgtatccccattttgggtcaaatttttttttcttttttattgtcgcaattgctttttagattaatggacaagcttaaaaatttcactcttgccgatttattcaaagtattggctctaccagacaaagaattctaagaatgg

SEQ ID NO: 19986 - DNA, 341 bp, Heterodera glycines
  misc_feature (8)..(9): n is a, c, g, or t
  misc_feature (23)..(23): n is a, c, g, or t
taatttanncgctatttcgaaancacgagaaaaaaattttcatgtcacaaaatgagaaaaattgtcaaaaaagaggaagcgaaatttgaattttatcgaaagagagcaaaaacgctggagaagataatgaaaggtataatttctttactaaaatgtgccaaaaagacgggttggaggcgaaaagggaaaaaagagggacactttttttggagggggcgggggcaaagagaaagggaggggaggggaaaatgggagggagggggagggggcgtggtcagcaaagtccgtccttcggtcggtccatccgccttcccgcgtttgcccctcggccacaattcccc

SEQ ID NO: 19987 - DNA, 2162 bp, Heterodera glycines
caacgaccctcccgtgccgattaaaaacggcatttccaagtgtcagacggactgcgacggcaacaacagcccccggtaaaaggcgaaggtcttcctcggagagcttacttcgaccgtgccgttccgtgcacgctccgtccgccgtcgttctgttagcttttgttttgttactaataattggcacaaaggacgggaccaacgcaatgccaaacgaatgggaggagcagcgaatgtgcggacgactgctgatccaagcattaaaaatggtgtgcaaccaccaatacgcgcagccgaacagaggtgggaacagacaaagggagacgattaattagtgcaattcattagccccaaattagcaaaatgattggtcgtcctttggttcccatcgaatgccctttcctctcaaatttccataagtctaacacctctaattgtcagccgaaagctcctcctgaccatttttgagcttgccatgcaattccattagctcattttcaaaatgagattatccgcccccttttaccatttcttttctcaataaaaccttttgtctttttatcatttattctttcaaaattcttaaaatgccaacaaacataacacccgccctctccattttaaatactttcaaaataatgttttttcctttcttacgatttactcaacataatcctctgttttgcccgacggggcgaaatgagacaaatatagccttcttctgccaacgcaaaatattttgcttttttcaaccgccggcaaaaggcgccggggaaattagcctcgtctgctgaccattttactaattatggctcaaaggcacaaaaatgggaagggcttaatgaggaggaaaatggatgacaaagaagagagagaaaaggaatgaccaaattgagggaaaggccaaagaagcgcaatttcaaattagcaccttttgcagataatttctacgaaaccaccggcgttttgttgcgcgtccgccgttcgtccgcctcccgcgcttatgtggtgaagcggcaacggtcgccgacagacgacggcgccgcgccaatggccgcgccacacggagcgatgggacggaacagacgcggcatcatctgggagtgctgcaccaacaaatgctcgctgaattacattcgcaacaattactgtgccgcaccgccgcaccaaagcgaacagacagaggaaaacgccgcattccaattggaggacgagcggaggcggcggaaatgatacactcagcaacggtggggaataaggacgagggaaaagcatacgggaaaagaaaacggggaaaagaaagagggaaaaagagaggggaaaagaaaacggggaaaagaaagaggggaaaagaaagagggaaaaagagagagggaaaaataaagaggggaaaagaaagaggggaaaagagagagggaaaaataaagaggggaaaagaaagaggggaaaagagagaggggaaaagaaagcggggaaaagaaagaggggaaaagagagagggaaaaataaagaggggaaaagaaagaggggaaaagaaaatggggaagggacggacgaccaaggggaacttgatcaagaagcaattgcaacaataatactaattaaactgatcaaaaacccaacactgggtaccgcctccaagccaaaagcctctgggaagaagtggggtaacaacgcatgtcaaaggcggggggggggggaagaaaaacactcggaatgcaaatgacagcaaatggtttagcattatccaattaattagtcggctttaagcatccccttctgcaatctcactgcgatctctcatcatttcccccttcgtccaatgaatgaatgaatttgtcctcctttggtacgacagtctgtgctgcgagtgaccaaacaccgaaacgaacgaaagcgacggacgacaaaaccaaacaaagccaaggaccattcccaaagcatcccaaaatgatcggcaatgatttgcgttcattgttagtgttatcaatgaattgaaaaatgatgcaaaagtgcacttcgaaaagagtgcatttgcactcttttcggtaatggagagacgccaaaacaggcgccagacaataatattaatatccaaaacaaacagtccaactccccaatttcccccttctcattttttgtttgtttttgtcagcgaggtgact

SEQ ID NO: 19988 - DNA, 1618 bp, Heterodera glycines
  misc_feature (22)..(22): n is a, c, g, or t
  misc_feature (26)..(27): n is a, c, g, or t
aagcagcagcaaggtcatattntatnntattcttccctctcgccataaaaaggttttttgtgaaattcgcagctgattcgcccgtgtcccattgccttaagcactgtctcgagccgatgacacaactcgagaaaactgtctcttttatgtaccgccattacgaagccgtaagtttggctgattggggcgagtgaagccggccacaatggcactttaggtctgtgagaagctcgaatggtcagccaattgtgctcagagctgtaaggtactgggaagaggagctgaagaatgaaccattagctcatttgtaatgggtccccttctgatcagagcgaagaccgtggtgctttcttccaatttacgactttttaccgaatgcattgcgtcgactttgaagaaggcatttccaattcggtatttcaaaggccaataagctcatcccccaattttagaactcgaagagcatttgccgtgtcttaaggaagccgcttttaaggctgacgttggtaagcgaagggacaacgaaagtggcgattaattaagtgaatttttgaagtttgtcgcgagcgatgcgcaccaaaagaaacggcggaaaagcaaaacgccaaagaagaacggcagaaaatgctgtgcaagtgggagaatttgggggggggggacgaaaataagcaaaattcggtaggaatgttgaatgctcgacgctttgttatgtgcagcaattggccaacggatgtccaaaggcaaaggacacaataattgtaaggaaaatggggaaaaggggcggtggacggaagaagggctttttgggactcaaattggaactcattagcttaaaaatcagaatttcagtcttagcactacttatgcccatcaattatttgggggggggggtaatgccgaattaatgatgatgaattatcgtcgggtttatgtctcaaagtgatgaattgtctttgtcagcgtctgaacattcgaattgcggatgaaatgcgtcgactgacccgtgattccgatttcgacaaactctccatccattgtcagagagtgcacgacgctaattacatgcgaaagcgactggatgaagtgacgaagaaaaataacactgtgtaattgtcatttatttgaacggcgtgccaatatttgccttattttaaattattttctcccaacaaaaatcatacatgaaaaaggggggtgagtcaaccgaaatttttgtgaaagggtcccatgtaaatcgacgcacttttttttgcggcgcgctcttttaaaaactttttggtcgacagggggcccggcgtagccgataggcgccgccgggaaaattttttgtaattttaatgctattgttagcagattttgtctaaaaaatgacctaattttgagatggctaattttttaagaaaaaaaactaggcttttggggcccggcggtgccgataggcgccgccggggaaaaattttaagaatttttaatgaattttgttaagaaaatagccaatttttaagaaattacacctctttaccccttcgccaacgacccccccccccccacctcttttacaccggccccccttcgatgcgaaggggtcccccattttgggaccctttgcgggcgaagg

SEQ ID NO: 19989 - DNA, 2283 bp, Heterodera glycines
aaacgggcgcgaagcgcccgtcttgaggccgcgaagcgtcccaatgtcctcaacaaaattaaaaaacgggcgcaaagcgcccgtcttgaggccgcgaagcgtcccaatgtcctcaacaaaattaaaaacgggcgcgaagcgcccgtcctgaggccgcgaagcggccgaatgtttccacaaaattaaaaaacgggcacgaagcgcccgtcctgaggccgcgaagcggcccaatgtcctcaacaaaattaaaaaacgggcgcgaagcgcccgtcttgaggccgcgaagcgtcccaatgtcctccacaaattagaaaacgggtgcgaaacgcccgtattgaagacgcgatgagtcccaatgacctcaacgagattaaggaaaagattgatcgacgacaaggatcaagaaataaaagaaatttcaaggaaatttgtgtcgctttggcgacatactccgggcctctaggatggcggcatctgttgccgtctcttcgccaaaattcttttcatcgtcggtttggaagtcgacgagccaccctaggaggacgattctccaaacgtccatctggtagctgtgcttggtcacgtggaggagggtgaggttcctccaaaactgctggcgctctccaagcaactccgattctggatcggatgttgaccagttcgatcggataaatgtcgacaagcatcccttgctcgcgagggctaaaccctacatattcttgtatgcacggttttactgggtctacttgaagacccaaccgtacaaaatggtcaatgttatgcccggagagatgaaaagaccctccggaccataacaggtgaatccatcaaaatggatcgaagcaattctgccaaaatgttctcctaagagattggccccttcgcgaagttctccgcgaaggcggacttcgacagcacggcgctcccgtgctgtttcataccaatgcggtccataagaccgctcaatccatgagctcaatggctcaatttggcgaggaacaggaggttcctgccagcgaggaactctctcctcctcttcaaatcgtggatcgccaagtccgtaaaggcgatcattgaagacctcggcattttcgggtatgaccacccggcgggccgagaaataaggcccttctcgtatgggaataggcattccgtggaaggatgatttgaagagtgtggtttggtggcacacccttttataccaccattcaatggaagcgatgaatcattcccctgaacgaggagtgactcacaaaattttttgaatgccgaggggataggacgtgattcaacaccacatccgaaggatcctcccccggccaagtacagtattgccaatactgtaggcacattaccataaccctttctcgttaaagaccaggaaattaatttccaaagtctatagaaaggagaaagtttaatgaaaactgttaggcaaacaatgcctacacaaataatcattatgaaggcaagtgatgattggaggccaatcaaagaccaaagggtcgccttccaatcaaaattccagttcggccaactggattggctgtttatcactctttcggagtgatttggaccgtaatcttctatttgttcgggttggacatagtgtaatgtccccctgagaacaaaagaagtgtttccagccaaacactttgtttggcaatttgtctcaattctggctttatcaaaagccaaaattgtttggtaaattgatgcattggaatcacattttgttgaaaaatgtgttccatcgtcgcaattaatttcggcaagagaattgccaaaatttgtcgagcacacataacggaattgtgctcccgttgaacatctgtaacacccagatatgttcaacggcaaaattgtgcaaaggctttggtgaagttccaaagctatttggagaccttcgatttgaaggtttaattggacaggactaaatcctgtcaaggcaattacctttctcccagtatttctgagttggtaatttttgatgtttaatggaagtctcctctcaggactttccattaacttttcaaggttatgtgaacggcaattgcagttcactaaacctgatgaatggtcaggtatgcaatcagtgcatgcctgaacgccaagactgcaattgaaatcaattgcttcttgtcgacttttacagttaaagtcaattgttaatggctctctggttagagctatgttgctcccgtcaaaaacaaaatctgagtttaagacgggggcgggcggaaaagttactccgatcggagtaaggctgatgttgttccatct

SEQ ID NO: 19990 - DNA, 1956 bp, Heterodera glycines
agccaagtttatccgttctcaatgagattcattgcaatctgtctttaagtacaaaatattatcctttcgaattttgaatactttactggttcgatcccaattagaatctgtaggttttataaattttgtgcgactaaccaaaagggcttcccccggaatcccgtattttttattggattatagtttctaaaatatatgctctaaatagtaggaaaaaactcatcttttgcatccaaaagttggaatttttatttgctttttgtatatttccgtatttattagtgcaggaatcaattccctcggcccaaaatcatttttaacaggttttgccaaaaataacttaattttgagcaaattatttaaagaaaattgatgagttttattatttttcaatccatgaaatttgattttttttttgttgcttttgacccgacatttgggaacaaaacgacatttgacgacaaaacaacatttggggatccgacttttgggattttaatgaaaaattaaaaaataaatgaataattaagtatttaaccctaaatacaacaaaactatgtctgcttttgcccatacagtcccaaaaaaccagaggtgaaccattaaatagaaagtgcagagaaaaatgcatctcttatttataattctggcacaaagagtccggaaaatgagctcctgttaggaaaaaaattagcatctgtaactcagttgggcaaaacgggtggaggttcgaaccagggatggacgaaatttcgtttcgttttcgtttcgtcctacattttcggcactttttgagtttcgttttcgtctaccaaagttttttcgtttcgttttcggtttcggttttcaaaattttgtttttcattcgtgtttcgttttcggtttttaaattttggattttcgtttcgttttcgttttcgtcagagcaaaattggacgaaaaagacgaaaatatttacacccttaagaatgacttttttggtaagaaaaaataagatatttattgaagtattgtattaaatctgctaagaaattgtatgtaaagtttttaaaaattttcctgtcggagcctatcggcgccaccggacccacctcccattccccaactttttttgaaaaaatcatcccgatttcactgaaatggatttgatagttttccccaaaattgttaaatccataatgggatctgaaaacggacgacacccaactcgtactaggccatctcgcactgccccaactcttagtttttcgacaaaaaaatcgtcataacttttgtaatagtcgaccaaattatacattcttggtatctttctatagcccttaaagctctctatctcctggtaattgcaagaaaattttttgttttcaaaaaagttatgaccaaaaatcgtaaaaaaatttcgtccataactttttcaaattagataaaattttttgaaacttggtatatttagagagaattataaaggatatcgaataataccaagaatgtttaatttggtaactttgacaaaagttatgacgattttttttttgggaaaacggtacgagttggatttttaccgtaaaagacataaaatttgatgcctttttatcgaatatttgttaaaataactgttcgaatgcaaaatgccttttttgaccctaaatcttattttttggccttgatgttcttattttgaaaatttttcggtcacacccatgtcctagagccacatccgcttttccacctactaggatctcaattccctgttagaggatacaattgtaaagttcttaattaaaattgaatatgtttaaaaaattttcggttttttcgtttcgtttcgtacgaaaatggttattttttcgtttttgtgtttcgttttcgtccgtcaaaattttttcatttcgtgtttcgttttcggttttcaaaatttcattgttcgtttcgtgtttcgttttcgtgtcgagtgcc

SEQ ID NO: 19991 - DNA, 2689 bp, Heterodera glycines
  misc_feature (2476)..(2477): n is a, c, g, or t
  misc_feature (2484)..(2485): n is a, c, g, or t
  misc_feature (2491)..(2491): n is a, c, g, or t
  misc_feature (2497)..(2497): n is a, c, g, or t
  misc_feature (2499)..(2499): n is a, c, g, or t
  misc_feature (2506)..(2506): n is a, c, g, or t
  misc_feature (2529)..(2529): n is a, c, g, or t
  misc_feature (2548)..(2549): n is a, c, g, or t
  misc_feature (2555)..(2555): n is a, c, g, or t
  misc_feature (2558)..(2558): n is a, c, g, or t
  misc_feature (2573)..(2573): n is a, c, g, or t
  misc_feature (2624)..(2624): n is a, c, g, or t
  misc_feature (2635)..(2635): n is a, c, g, or t
caccaatttcccctcgacccatgcgaattgcattaaaatgcgtagcgcatttcctttctcgctcgacttccgattggacaaaacgaacacccgcgtgttctgatcagtttccaccgtcacatagccggtcaaaccttaagcaaatgctttcaaaattcggctttcttttgcatttcttgcccatgaatggctttctgttgttccgtgccaacagagtgccgtttcggtacacttcgggccgaatgccaaattggcggaaagattcgttcagtgccattccgtaattgtaaattgcgtcgtacaacagaagcgaatagatggatgcctaaagagtgattggatgtagcgaataatcaaaaaataatccattcacattgatcactttgctgcaattggattcatcgcaataaaagggccaatcgcccgttctgtcgatcactcttttgaaaaagccgtagtaattttgattggacaacgcggacaaagtgatgtcgtagtgccactgcaagcatcaattgaaaattaacctatcaaaatgtgccaatttctacccataaggccaatcggccaatcacttcggcgtccgcgtttcttccgtcgagcgtatttgaattgttactgtaatggataaagaattaccataggatttttttatgcaatattataagtaaaatgggccacatcattgttaaattcaaatttgtttttaatgtataaatattttaatatgaagcaatggcttggcttttgagatgattcttatttttctaatttttgaaaccataaattacctcgattgtacccaaaaaggtaatctcgtcaaattgactaaattgtggaaaaaatcattcagattcctcaattaaactcacaagataaatacatgtcattatccaccattatgtaaacataatcctaaaaatatttacaattaacaaaaaatgaataaaataaataaagacgacttttgtgtttagtcctccatcgaacaattgaagtgcgaaagttcgcatctgcttcaaatcgtcaaagcaaagcaaaacgactaaatttaaaaaagaaataaataatttaattttactttccctaattataaattattattttaaaatgcgtactcctcgcccgttctcgaattgcattgacaattgtgcttgtgtcggatgattgaatgttgaaaatgcgtgttttataattaattgtgattttcgactgttcgctaagcgaattctaaaataatttttaaaacatttaaaaatgcaataaaatgactcacgtcaatgtcagtgccaaaataatcacaaccgaaaaagaaaatggaaatgtttaaatttaattttgcgatttcttaattattacctccacttgctgatatgatatcactttggattataatgccgatttgtgtccaattaaaatactgaagaagacttataagcccggaagccatgctaatggtaaagtcaggcaattaaataatatacaaatcaaaatgagtgtactatttgtaatttggcacaatgttcaacagagttggataggtggcattgtttgaggaggcaagactgatgagaattcgaagattaattagtcaaattaattgaacgaactcactttgaagacatgctttgtccccagacaagcatcggaatgttagaattggcagccaaatggcccagcattggcggcacttcaaagaatttgcaacaaattaattattctaattaattatacatacaattatactaatttattcgcattaccgtcaatgcacgaagtcgcaatgattgcgtctgctcccaatttgctaatataattgtaagtttggccaaaatcgtttgcttcattacattgagaataagtccaatgaattctgtggcgacaaatttaaaattgccgtttaaagtgttagtaaactgacgaaaaattgacgctttttggaaggatttcgtccgcccacaactgttccaatgccattggaattgcgccgcccgaattgggcaacgcggcgttctttcgtgccaagccaaagtccgtgtcattttgggccaccaagatggccactttgatcagcgtctgattggccatgggagtggacggggtgctgaagccggccattacgctgtcgggaatcgtctgctgctcctcttggcactgaaaaaattgatcaaaagtcttccaagcatcatcatctcttattactaaaaattaaagtcaataataaatgttaattaggtgacaattattgtaattggacttcactttgattggcatggataagccgatgaaaaacattaatagcaaaaagaaacatttggtagcgttcaagaacatactacggtatgtgtacgaccaatttatgttattcaaatttaatgacaagcaaatgcttttttgctctttatgccggtttttgtgccatttttgggggaggaatcacctcaaggcaataaaagcccattattattaacaattnnctttttnntcattnaaaaantnaacaaantttaataaacacacattaatccnttcttatattcaaattatnnataatnatncttcttttactctanacacctttttcacaaatctaccataaggcattcataggcactttcaatttnatattttaaancatttttatctatgtgagttaaatacgagtttccattctttttataatattaaa

SEQ ID NO: 19992 - DNA, 1847 bp, Heterodera glycines
ttaccgcttccatcgcctttgtaatgcactttcaaagattccgagccaaagatttcgagatcattgtgaatggcattggcgtcccaacagttttgttttgggttcgaaaagttctaaaataatttccgtttttatgtatttttaaatctattccttctttttcacctcagcaatgttcttgcgaatgtccggatggacagcttttaaaagttctgaaaaattaataaattaaaatattaaaaattattttattttttcatttttaccatttccaaatcggtctttcaaaacgccaataaaggtttcttctttcttttgatgttcctccaatgcgatgacttttgttttgatggatttgaccacaaatgaaaattaattaacaaatatattttgaacaacacattttaatccaaatattgatgcccgagagtcacaactttgagtctcagggtcaattacagtctcgcgaaattttcgaatttaccccttttttataaatacctaaccccccataagaattaattgggaataaatatttaatataaatatgaatttagacttttgatttatgcagttccaaccttttccatgttgttccaattttccaacagagttcttcaaaatttccaactcagcattggtccgcccattctcaatctgataattgaatataactgtatatttgaagaaaaaacttttatattattttaaattaaaccaccgtaatgaagccgagcagtcccactgttaccgtaatgttcactacagtcaaaattatgaacttcgtcatttttctctgcattcctctgtctggaaattgaaaaaataagtctaattttataaaaatcagaaaatgttttcttttcctttacagggtcatgttgtctttttacccaaaaagctatattttaataaaagtggataaaaagcaacaaaaatgcttaaattattttttgtgtattgggtagagccggcgcgggacgggattttgcgggatctcagtcgaaaaatgcggtattatacatgcggaatcccgtctcgcaaaattttgagcacaaatcccgcagcaggatccgcaaatttgaaatttctgggctctctagtattgggcaacttccaaaataaaaacaaaaacaacaaaaattatgtttgaattaccatttgatagtatttatttttttattattaaaattattttttacattgtccaactcgtgccattggcggggattcatttgagataattggatcagtcatttccatcggttcgacagatcgaaataaatttgatgacatattttaaaagcgtaattataattattcacctaatttagtgttaaataattaaatgtaattaactaattataggctttttaggttattagtcaatttgtcttttgaataaatggaatttggactaaatagtaaaaaatgtaaggccaaatcaattggacggaataaatcattggacaatgagatgagaaaatgtgataaatgcagcaaaagcaaaatgaatgaatgcataaataaatgaataaattaacaaatgacagacaaaaaaaacttttaaatgacaaaatgaattaatgaaagcgaccgaattagagcggacggacaaacaaacaaatcgacggtgtcttaaaaaaatgcatttccatcaccaaaaatttaaatttaatttattatttttgccaacccaacggttgcccattctttgttaaaatgaagagagagagaggagataaaggagaagagaagtaatagagaagagaggaaacgatagagagagattgaggagaggagagattagaggatagagagcgaggagggagagagaaaagatgagg

SEQ ID NO: 19993 - DNA, 2339 bp, Heterodera glycines
  misc_feature (4)..(4): n is a, c, g, or t
aaancatttttattctgttaaaagcacatttaattacacatccccccgcagatcagaagtaattagggttaatgaaccgttaattctttcatcgcctaatgcgacctaatttgagctaatgaaacgttaattaaaccaccataattgctggggtaattagggctaataattctctcttttttccctccagggcggtgttcggtgcctgcggcgttgcatgtgcgctgatggcgctcggactgtttctgattcggagtcgaacccggcgcagcggcgccggcttagtcggcgccggattcaaaaaacagcagcaccaccaagcaataccatcatcttcaatgatgtccagcagccgacggcattggaaggagagcagtcagttcggcaaaggtgccaaaattggcgatgctttcgagaattgggttttgaggaaatttgggcactttgggtccccttttgttcggtattccctggcctggaattctcttggcccaagcgaacattttgacattttattgtcttcaagactcgactaaaccgcagcgccattagtatcatgagatttaccgagttctttattgaagcaaaactttcttgaattttaaccccattttttgcctggaattttttcaaacgttttttttaccgccgaaaatgttttcgtttcaataaattttcttattcaaaagatgatcagccgccctccaccacttatgtgaatttggtgcaattgctgatgccacatccgaagccgccacctgtgaacatgccacaacaagtgtaggagaaaaacaaagtgccatttcatttttcacattttttattcacaccattttcaaatgcgtacattaataatgaaattaaatttatttatggcaaaaataataatatttaatattaattacagtaattaattaattaatattttttatttatcaaatattgtttataaatgaaaagaaaaacaaatatatctttgccaagaactgtgtttaaatatattttacgacaataataccgtaatactttaagcaacgtaaaattgtaacaaattttgccgtttttgtacacagtcccgggcacattgatctggccaaccattaaaaggctgttttgaaaggggcaaataaagtgagtgatcactgattgatgaaccctgatcgatcacttattaacccccccccctgatcagagttcccccgggggctaaacatttcttgtccgattgccaaagcgtcgacagctgaagcagcagcgggcacgaacatgcggctgatcacacctaaaaacaacaatttcaataatcgaattctttgttattagcagttcttaattttgtgttggcataatgttttgaacggaaaactgtcccatacgaatactgtattgggtgggacggggggtgctacggtagtttcggtgcgggagagagtgggcgggtgctgtgccggatttttgggcggcttcgccccatgccaaaatgacacatttaaataaaattaataaaaaataagtgaaaatgccaaaaaatgcgcgtcaattttaaaactgacgtgtgaaaaaggcgcaaaatatcgcagaagcgactttggtcctcgcacagttggcgaagtgccgcggaaggaggcaaattttggagcactgaaaaacaatttttgttttttgaaatttttgagaaaattttttaatttaaagttttttttgagtttaaaaaattgtaatggatttttataattaaattggatataattaggaaaactaaagaacaaaacaattttattaattaggttagcacaaacaaaagtaattacaaataaaaattaaaataaaacaaaattacttgtgcaaaaatatgaaacaaattaaaatgaaatgaaagcaaaatttgaaaaggcgtgaaaatatttaaatggttaaattgggaccgaatttttgggttaattataattcgttttccccgttaaaattgtgaaagacaaaaaaaaaattaaaattaaatttaaaaacggcgccgaatttgtccattttcagcggcggcgccaaagtgtgccgacgggcgccatccgtagaggcgccggcgctgctgccatccggcgccggcgggcgacggcttcaccaaaccgccaacgtcacgaaggcgtcgtccgttgtcataagtcagcttttcctcgctcagaagcggcttttcctctgtccacacggtcgggaacggcttttcctcccatggaacatttttaatcggcttttccttttgaaaaagatcctggagcaacttttgctcttcggtagtcgccggggaggctctccaaatgctcgagactggcttttcccccatataa

SEQ ID NO: 19994 - DNA, 1460 bp, Heterodera glycines
  misc_feature (13)..(13): n is a, c, g, or t
ttatctcaatatntggcctaattttttttttactttttttgatacattttgtcattttacacccctaaatttcaggattttagtgcctattttccattttttagtgcctatttttggggttttttagagcctaaagcttttgaatcaaacagataaatcaaatctttaaagtcagtgattaaagatatcatggaatgaagtgaaattatgctataaaattgttaattgactttaatatttcatggttattaaaaaattgcccataaaatcagggttaccctttgtccttatttgtaagatttgtccttatttaagctctttgtccttattttcatcttattttttggattcagggagaaatttagatttttaatgataatttttgaaagaaatgtttttgaagcgaattaatatgcaaaatcttaacaagatttagttaaatattcaaatttttcttcggcggtttcttattctcttaaaaaaattagctcaaaatcgtaattttgtcatttttgaacaaaatcgttaagaaatcgcattaaaattacaaaaatttttccggcggcgcctattagagcaggggtgtatctgttcttatttctaagaaatgttctgatttggggtagtaccttattttcatttaaaagaggaaatttctgaaaaatttggctaattcctaacaaaattcattaaaaattcataaaaatttccctcggcggcgcctatcggcaccgccgaactctcttccctcacccatacccaaaaatttttcggaaaaatgcgccgaaaaaattgttaaaaatctgttttttttgattcaaaatgcactgaaatttaccaattgcttatgtttcgacaaaattgttaaaatcttaaaattgattttcggaaatgtataaatttctcatttctaagtcgaaattgctcagaaaatagttggcggtgagtaatgcttgattttgttgaataaaaaagcgattcaaatggataaaatatgttatacataattagggacggaaaggtttaaacgctttttgcaatgatttaacggattattgtcctttttgagggaatcgcaaattggacacttttgggccaatcttcttaaatctatgataattatatattgcaaattgtacaatattcaaaaaatcaaaacaaacacaaaattttagtgattttgtcgcaattttcaattttaaaatctaattttgccattatttataatatctgctttatttttgccgattgtcacaatattcgccgtataaattgtcgccaaggcaaagacacgtgaattttgtccgtggccatggctcattgctgtgccatggcactcgttggcggcgtcggtcgcgcaaaacgcaacggccatgggaatggcacaatcggctggcacaactgaaaaggaggaaaatgtgtgcttatagagccaatattaattaatagcccggttaatt

SEQ ID NO: 19995 - DNA, 2225 bp, Heterodera glycines
caaaatggacattttaaatggtccattttagtgaattacctaaaataaaataaaattaatctttatttaattcagaaatagaaataaaatattcgttttatgaaatagaaagttatgctcttggatattattaaattaaataatttgatggattaaaggcctagagctaatttcaggggagcttattaatagaatttagaaaatggccaaattggaagaataatttgctttttctacgcccaaaaattattcctttgtattcaaacaatgacgcattcgaattgatttattgaattttctatggtatctattaaatgcaatttaaggacggactctgtgagtcgagtgagagggcttctttttatttttagaaaaaaaacctatgattttttcgttttttttttaatttgccgaataggattttctccagatatttttacatcaaatctttgattccattttttcaaaaaaaaatttttataattttttaagaattttttttttattgaatttgtccgcaaaatgtccgtccttaaatttcatttacacatcatagaaaattcaataaatcaattcgaatgcgtctttgtttgaatacaattaaataatttttcgtgcagaaaaagcaaataattcttacaatttggtcatttttctaaattctattaataatctcccctctaaaattgaaaaatgagcatttaatgcctttaatctccaccattttctttatttaataatatccaaaataaaattttgcatttcatataccgtacttcttcgaataaagccccagtggctctattgttcagtcccttcaaaaatggggctatattcgagggtgggaaagttttgttcagtcccttcaaaaattggactatattcgagggtgggactgttttgttcagtcccttcaaaaatggggctatattcgagggtggcgttctattcgaggggggggggctctaatcgaagaagtacggtattaataatatttttaaagaattcacaaaatgatggcatttaaatgtcattttgttctttctctgttgctgttcttctgcgcctcatcatttttggtttatgggggagggaaaggtaaaaatataaaaaaatatttgttttaattagggtagggtttcagatttaatcaaaacttgtaaaatattcacgtaaaaaactttttcaaataattacaaattaaagtgaatgagtttttcgtgctcattagcctattttgcctattcccttgtaattttattcctaatttgcattttttaatcctttttacagatgcgtcttcgggatccaataacagtgaaaaaaagtcgttggccgatctgatggtagaagaaagattggccgaccgggacggaaaaccattgaatgaattgttaaaatttgacaaaattgacaaaaaagaattggatgcatttttgaaagaaaatggggaattgcttgacatctcatttgatgattacaatccgcaaaatgtgcagcttggtgaccatgaccaagtcagtgttctttttagtccaccaagtgcggcatcgccagcagaagtgggaagcgaatgccatccgatatttgtgccattttagtggaccaattccatctgagtcaatgtattttttaagtgtcgttcaaatccaacaaactttgtatcattcaaaggctctttgcagacttttttagcctaggaatttcacacagaaaaaaaatttgcaaaaaaacaataaaaattctgacttttttgcggttttcaagcgattatttttttgtgagttgtttaattgcttacaattagcattagcttaaaaatatcttctaaacacaagagctttcgaatatacaaaatgtcttacataggttttatcaattaagaaaaaatatatggcttcttaaccttggctgagacggagttggcccgacggagtttttaaataaaaattaaatagttttagtttatttattttaattcttattttcatattgattaaataattgtttaacattgcattttttaaaaaattgtatctttccttatttattaaattttttcacaatttttttagtctgaaactccttcaaagtcaaaataaaaagaaagcatcgaggggagaaccaatgttgaaaaaactgaaagaaaaaactgattcaattattcgcagtgaaaaaagaatgatcccgtaatggcacagataatggaaaatttattttctttt

SEQ ID NO: 19996 - DNA, 1630 bp, Heterodera glycines
gaatgatcagcagagagagaaaaataggagggagaaacagttacagaacagaaatgtaaattacagcaaagtgctggtgagagaaaagtcagcgatgggacggaagcctggcatgaataatccgcggtagtcaatgttttggatcaaagtgtgggcaatggacccggcggaaccggcaatttttgcgacaaacaaacagccattttgatcagtggtcatttgcttaggtgccaataattccagtccattttcttggagggtctgaaaaaagatttggcaattaattaatactcactaattagtgttaatggcctaccgcaagaacggcgtccaaattgtcaacttcgtaagactgaaagggacaaaagataaatggcacagaaaagggaattaattagtggcgaattgactgaccacgtccttgacaaaatctccgcgttttcccacttcagcgccaattccctccgaatcgtccggcgaaatgctacatttgaagacaaaaataatctgtgaaatcgcagaaactcttgaatttagccaattacaatacaataattaccggtccctttctaatggcaatttcggaggcattttccgtctgacgctgcgcaaaacgacgaaaatcgaaatggaaacaatgccaaaaagaagcctaattaaaggaaagaaaagggacaaataattaatgaatggaatagcaaatattcagcagcgcaataattagtttaaatggggcaattaattaattaattacctgtttagcattggacacaaaaaattcgatgtgatggaagcattggacgggcggaatttccggtgccgaagagggcattttgggtgaacaatcgaagaaaatgcgtaaaatcaaaaataattggaaaaaggcgtaaaataattttcatttaaattatacaattaataaattgtcatatttaattaataactgaatctccgcttcttttttgcgtccatttggtcattcccttcacacttttgtttatttcggtgggaattgcacgaaaaatggaggaattatcacaaaaatatgtaaaataaatcaattttttgtgcagcttttatttggtcttaggaaaaaagtgccgaaaattcaaaaatatttaattcagattttatgagtttggctttgaatcgaaaccgcttaaattacgtttaaattaaaaggagatggaaagcataaagtggacatttgccaatgagcaaaattatatttaataagtaaacaaaacgagctgatcaacaaatattcgtaattaattcgttaattagctaatttgttcattaattaattaattaattcgttaattaattccttaattggcttgtgccgttgcgctgtctctaaacgggaatgcttctcgaggcaatcgtttgccgttgcgcccccctttccgcccctccgttcgctccgtttccgcttctcctcatcccattgcccccatttgcgccattgaacgagttcagaacgatggtttgcccacctcttaagaaacaaatttgtaaaaaaatggaaaaatcacgcgatgtagacagattgacaggtgaaaatgggcaattatcatcagttggaagagcaaaaggggcggagaacagcgaaagtaaaaaagttaaa

SEQ ID NO: 19997 - DNA, 1252 bp, Heterodera glycines
ccccccccccccgctccctttttcaggattcattatgccaaacaatttgttgggcccgtgcgcgatttttccggtcaattgcccttctttttttggccaataattatttttgtgcgcttttaaggcctcactttgcatttgtcgtcggtgaagccccgctttttggccggcgtttaccttttcctcagcggcaaatttttccgctttcatcctctgttcgttgctgggccaaattgaaaaataaaaagcgaaatttgcgaaactgaaaaatgcgaaacgccaaaaaatgcgaataatgcgaaaggcgaaatgcgaaaagcgaaacctcggcccatccctgatacctacctaagtattttttaaatatgtaaagatttctatcctttttgaggacctgacaatttgcgccaaaaatttgggaatgaaattgttttgaggcctaaaactatggttttttacgaggcaatgagtgtcgggtccctattttaatagactcgggcaattaacaaaaaacaaacaaattaattttgcctataatctaaacacttttttctctcaaaaaggccgtcaaattctctgccgaacgctttgaagtgagccgggccgaccttttccccagcgtttactcggcacattaccagcagggtaaaacgggcatttaaatattaattgtaggaaaaagctgacacttaattttggcacccagcgattttctggattttcgactcgtttttgataaacattttcttgtattttgtaaaatttaaaaattttgctttttaattaaacattaaaatttgtagatttctcattatcaaaatgaagagttgtccctttcatattgcaatttccatatttttttccctaaaggcgtcggtctgatgtttgtgcccggcactccgttgtacactcaatacggccaggcacaggaaattgcgatttttgtggtgctgcaggccgactcggacaatgccacgcagcccaaaattcaatacgctttccgtggccaattcgcgccctttcgactgccccacgttttgcgctgttgggccaatcaggtgacggaaattggcaatcagaaaaaaggggggaattcggcaaaaacccaaaaaatgccaaaacaaacaaacaaaatttttactaattgacacaggtttatgtcggagagattgccaacggggaaggagtgttgtggtcattggaaatccaaccggaagcggccaaagaaaaacaaaatttttatgtgaattta

SEQ ID NO: 19998 - DNA, 2241 bp, Heterodera glycines
gcattttatagcaaaaacaataaatcttttagcagtttgaatgacttctgcggttaatccattaaaggcatttggacaaattggtgcgcggctcgggattcgcgagaagagaagccaatttgtgcagaaggcgtggccatacattgaccccggcacgcattttggttcgttgtttcgtaaacatatttgagatatgtattcattttttgacttaggcaagaagaatttcggctatttggtcagtgctgtttcgtttttggttttctacaaagtctccagcaatatcaagttgaagaaggcaatagaagcggttagtttttacgattgtttgcttatgcttttgtaaatgttgcattttagaaacagaaattggaaatgaagccgtacgttgttcaggacgcgatgacacgcagcggaatttaaagaaacaacgcattctaataggtgggaggcaaagtatcttcggattcattagttttaaactcagaatggcgtatttgttgtaactgttcacaagagtaaattaattctatgactaatattgaaactttcgtttttgtgaatttcaataattggttttgacaagttacctacctatattggttgattcgggaaaaaatagtaaaatttgattgaatgttaaagtacgggtaatttttcagaattgcggtcccgacgaaaagttaatttaaaaattttattttggttttttcagggtgaaaaatgtgctaattacgaatctgagctcagattttgcaaaatcattgattttatctatgatttttcatcaagtacttgattttttccaaaattttaaaaaaattaaacgagcgaaaaactcatgcatagatgttgtagagtttaaaaatagcttttgaatgaactattaaatttatgaagaaggcaaatttaaagttttatatgattttttgaaatttaattactggcccttaggggtctatgaaacgggtctggggttcaaatccgcttggctgcggattattttttatgacagccaatgaccgttcatgcctttcatataaaaataaaaggtaaacaaatggtgatgaaatttgagcaatgttttttgttgatcatgtgtgtggttatgtgcttccattgagtactttatttattgtcaaatgaacccaaaaactttcttcaaaacttactgattttctacgaactaaatgcatcttattgaccttattaaaattcatctcaattcgagtgaagcggccattcaatttctccgtgagcatgaaattcttcgatctttgccacctcgatgtccgttgattgcgtgccgaagagaaatgactgagattaagactggaagaagccgacggagtgggggtgatgacaaaatgtggcgttgcccatcccacaaaaataagaaagagtcaattcgtaaaggtgtatatgtagtgattagcagagatattttgttgtttaatttaggatcttttttggaaaatagcaacttgccaccacaaaaatttatactttttgtgtacttatgggcacatggtgtctcttcttcttgtcaagaatctctttgcgagatgtcatcaagcacagtgtgcgactggtcaagtttcatgcgcgatatttgttcgcgatggctcgttgaacatccaattaaattgggtggactgggaagagtggtccaaattggtaatttatcaattaaatgggctttcccatgatttttttgtagacgagtctcatgtgtaagagaaagtataatcgaggacgaattgtgcccgagagatgggtatttgggatgtatgacattgaacaaaaagttggtgtccttcggtttgtccacaacagaacccaggcaaccctgttcccaataattcgccaatacgttcgtggcggaacaatcattcattcggactctgctgcgatgtacgtagacaatgcacggcaacgcagccatatagtgaacatccccaccatcccgatgccggcataccagcatttgtgggttaatcacacagagaattttgtggacccaaatactggtgcatgtacgaatgccgtggaattattttggaatgctaagaaaaagaataaagaaatgagtgccacaacagccgaattgttggaaactcatcttgatgaattccaatggagacagattcacgggccaaagacaattgaagcgtacaataatatcttggcgcatattgcatattattatccgggaaacaattgccctcgcgtgacattacc

SEQ ID NO: 19999 - DNA, 1943 bp, Heterodera glycines
  misc_feature (67)..(67): n is a, c, g, or t
  misc_feature (74)..(74): n is a, c, g, or t
tttgttaagaaaaaataggtttttttgagtccggcggtgctccaaggtttcacaaaaaaaaaacagnaaaatanccgcgccagggatggatgagtgaatggacaagttgagagtggaggcccaaagtgacggaggaggacagattagcacagaaaacggggcaaaagcgtggcggtggtgctgctctctctgttggcccaacatcagcgccaacagtcgttggaagagcggcgcgtcggcacgctcccaacaccttttggggaagaaaatggtcaaaatcaattttaaatgagcagaaatggaaaagtggtgatccaaaaaagaaaaatagatcaagaatgcacccgaaaaattagaccgaattccgaatttaaaacttactgacgaaatttgtcggttttttaatccccagaaatcttatgaaaggtttggtttgaaagtgttgctataatgcaacaatctaaccaaatgtccaaatgtttaaaacccaaaaaataacaatttaaaatggccaaacaataaaaccgcgtaccaacagtgcgagcgcgttcagacacaggacgagagaatgggtgtcaatttgaaattggcgctgttcaagcagttgcagcagaatctgttgaattaaacggttataaaatgcttggtttcgctctgtctgcaccttttccgcgtccggatggttcaacgacagcagcgaggcgacacgaattgcacgggaggagaactcgtggttgcgcaccaacttttgcagggtcgcaattgtgtccgtggaaatgaccgccatgtctgtgcaggggaagggacaaaatggaaaacagaaaaacggaaatgcaaagaaaatcacgttccaaatggacaagaaaagcgatagtgccaagtgcgttaccataaaataatcattcaaatcatagaatcccaagtggcaaaacactaaataaaaatcaaaaactgttttatagcatttaaaagaattttttatgtgtaaaatcttaggctaattacgcgcctaattactaaaacatttacaacaattattaatttaatttgctataatgtccaattttcgagagacgttccgtattcccccccccctcctctccttcgtccgaatacgtctcggtcagctgctacctgaaacgggtcaatcggggcaccgaaggaggacgacttttgccgaacgctggccgccttcgcttggtgaagcgacggagcggcgccgccattctgccggggacaggccaacgaattgagccattcttcgctgcaaaaaaaaaaataaatttaattttagcaaaaagaattaatgttttacacgggcgactccgtctcctcctccatgcaaattggctgcatacggtaacagtgtcggccgacatgggtacgcgaccaaagactgttgctgtccttgtccaaactgaaaaattgtgtaacaacaattaattaacgaatgcaattgggtgggcattttcccaattaaagcctttgccgaaaaaattgttttaaatttcgaaagaaaacctcatctacaaaattttaattttcttttgtctcttacactttcctttaaaaaattgaattttaaacttttacgtaaaaaacaaagtatttttataaaattttatgaaacaacagggtggggaaacacgaattactccagtttcaaaactcctcaaatttgattggtgttcaattcaataaatacgcctgtgccatttgctgcccgatttgccagcgtttctgcccccactcacttcagcacggcaccctccgtctccatgaaggtgaccatttgttgctgctgcagttggtcgccgccaacaccgtccccaacatttgcctgctgctgttgttgttgctggtggtcatgtggtgccgttgtcgctgttgcggttgttgagggtggcaacgaattccattgggtgaccgggaatccgggcaat

SEQ ID NO: 20000 - DNA, 1271 bp, Heterodera glycines
ttcagaaaaatcccttgtgtgcaaacatatttcacatttcacttcataacttttgagtttctgcacggatcgagaccgggataagaccattggaaagagcagctcgagctctacaagaagctatggaaagaaaaaatcgacatttcagggacttttcagaaatcatgtttaattccccaatggggccccattttgggtcctcagctacagccccatgcttctcccaattgtggcgaaaacaatatttcacatttcacttcataactttttgagttctgcacggatcgagaccgggataagaccattggaaagagcagctcgagctctacaagaagctatagaaagaaaaaatcgacatttcagggacttttcagaaatcatgtttaattccccaatggggccccattttgggtcctcagctacagccccatgcttctcccaattttaagtcttggatttgtcaaataaattaaagatttcgaattaataataaaaaattctattataaatttttttttgtagagggaaaaattctgaaccaaactactattttaaaacccaatcaaaactgggaaaaaatttgaagtcaaaaaattattcgaatttctccaattttgtttccataatttccgaatgttattcggtatcataatgccaaaccaaaacgaattcgttttaagatattcttttctggacttgacttggtttctcaatatcgaagcttttttctccgcaatttctaaaacgcttataccaaaccctagatttttggttccgatgggtttcagaaaaaatcccttgtggtgcaaacatatttcacatttcacttcataactttttgagttctgcacggatcgagaccgggataagaccattggaaagagcagctcgagctctacaagaagctatggaaagaaaaaatcgacatttcagggacttttcagaaatcatgtttaattccccaatggggccccattttgggtcctcagctacagccccatgcttctcccaattgtggcgaaaacaatatttcacatttcacttcataactttttgagttctgcacggatcgagaccgggataagaccattggaaagagcagctcgagctctacaagaagctatggaaagaaaaaatcgacatttcagggactttttcagaaatcatatttaattccccaatggggccccattttgggtccccagccacagccccatgcttctcccaattagtggcgaaaacaatatttcacatttcacttcataactttt

SEQ ID NO: 20001 - DNA, 2260 bp, Heterodera glycines
gctcgcggcatagatcggaatgccctttttggagccaaaaatgcccaataaaggcttgtggtccgtttgcaaaataaattttctgccgtataccatgcggtaaaatttctgaacggcgaacacaatggccaatgcctctttttcaatttggctgtaattttgctgcgctgctgtcagtgtgcatgcggcgtgttcgaccactttttcctttttgtccgggaatgtgtggcttaatgtggcgccgattccatctttggacgcgtctgctgatacgacgattggtcgtgccgggtcgtagtgggtcagcaataaatcggatgtcatcatttcttttgctttttcaaaagcattttgctgttcagaagtccaattccaagctacgtttttttggaggagtcggtcgagcggtgcacgcaactcacgcatgcatttgacaaatctgccataataattcaaagctcccaagaatgatcggagcgtgcttttgtcgatcggtgcgggcattttccgaattgcgtctgaacgcgatgggtctggacgaatgccatttgctgacacaatatgcccaaggaacaaaagttcgggctgcaaaaatttgcatttgtccagttggatgcgaagaccgtactcttttatgcgcccaaaaagagtgtaaagtgccgtgatgtgttgctccagggttttcgttgcgatcaatccatcgtcaagatacgcgaaaacaccagggatgccagcacaaatttggtccatcagatgctgaaatattgccggtgccgatttgactccgaatggcaggcgttggcattggaagagtccacgatgcgtgttgatggcgcacaattgcttggatttgtcatccatttccatttgcaaatatgcatcgcgcaaatccaaatttgagaaaaatttcgcgccattcagtgaagcgtagatgtcgtccggccttggcagtgggtgccagttcaattccaatgcattgttgaggccagttgagaagtcgatgcagactctcgtcttgccgtttttcttttttacggccaagatcggtgcggcccaatgactgaaatcgattggcttaattgcgccaatttgaagaagacggtccaattcggcattcacagcttccatggcgccatgtggaattgggcgggctcggcaaaatataggctttgcatcagaccgcaaaatgagatgcgcctttgcctttgagcagtgccccaatccatcttcaaaaacttccggaaaatccttttggagtgccgttgtgagcgttgtcacatcactgatcgatttgtttggcggcttcactgtcgaaaaattttcaatcatttttgtcgcctgagccaatttgctggtcgggaataaaatttggcgtgggatgatctccaaagcttcaatccatggtagtcccaataaattgtgtccgacttcgccgctgacataggcgatcagagtttgcggtggtttgtcggcaaattggacggtgcattggaatttgccaagcaaagctaatggctggtcattgcagtttttggcatcgatgtcggatggagtcaaattcggttctcccaactctcgccatgtttgcaaagaaataattgtggcttgagcgccggtgtcgccattcatggaagtttgccttccatttatcaaaatgatcaatttccaccatcggccttgagttgtgccaacatgtaggcaatgtgtgtcaactttgactgtgtggaatgaccggtggctgttcggtggggcctttgtcttgttttgtcggcagactgtcgaaatgtgcccttttttgttgcacttgaggcaaatggcgtccttgaatgagcaatcggagcgccaatggtcggatttgccacatgatgcacacggaagcgttgggcgaccacgtgtttgctttccatttgaatttgcattgtgatgttgtcgttgattggagccactttgtctttgcgctgggtcggtccattgccgcggtcttgtgttaatggcgttggtggcaattggcgggttgaccagcgaaagtgcgctctctttgacaagttgaattgcccttaactcctcctcaattttcttgagtgaaatgttggtgccatttttctgagcgtcctccaacattttcagtgccttttgtcgcaaatcgtgatgttcatcgttgagcgcgatgatcaaaataatgcacttgagttgttcctttgtcagactcagatcggcatttcacatgatgcgttgatctgcgcaatagtgatgaaacatc

SEQ ID NO: 20002 - DNA, 2417 bp, Heterodera glycines
tcaaaattaaacctgcttgatatcgttcggtaactttaagtattcaatgttagcttatacaatttcaaaaaatttctttgctttcataaaatatgacggaaaaagttaaaaacttttatcacatttttcgctgctattagataaagttataagcattaaagttatcaatttattttatggccgtgtaaactacaatgtagctgatttcatggctttttacttaatatgggcttggatactttgtgggtccgtcgacattaagtttgggcactcactatatggaggaatttcgaaaaaaaatataattttgtaaaatcttattaaaatttaaaattaaatttagtaatttaacaaaagatgtgcttacaaatttatattttcttgaaaataaaaaactttaattgtggaaacctcttgaacagactgagccttgtaatgattacaaataatacatatgtatgaaattgatatataatgaattataatgagcctagcaaaataagcatggttaattgagaggacatgcgttaaaaaactttcgattcctaaacttgattaaaattactatgcttttaaattagatgattgtaatttttaggcaattaaaacatttttaaatttgaaatccttaatttggtgcccaaacttcccggtgcctaaatttctggtgcccaaaacccccgcggtgggggcgccggaatgaatgttaccgatttgaattctacaaattttacagtttggcgttgtgttgtcgttgattgtattggcaccaaaactgtgaatgaaatgatcgaaatgacttttcgtatcacagaagactatgaaccgcagacagatgatgaagaaataatggtcaaagtgttgaagcaatgccatgaatattttcttaaagaaagatttatggtcaattttaaagagatcatggacaattttgttggagtaattgttcggattggctttacgaatgtgcacaaatttttggaaagtgaattcgagacgaagccgaatgatttctgggattcaataaagaagggcattgacgaaataaggtttttttttaaatatttatttatattcaaccaattttagtaagataaacacatcaatgcctttcatttttgttttgatgctgttcaaaattgaatgcgtttactgtatttttcactcctcattattccaggatttttcagttgttatgttttaaaatataaatttaaattttgtattcacttaatgtacctttttttaaaaaaagtacacttataagtaaaatatatgacaatatttattaaaatatatagatatatataactggcgctcaatattctccttttagttcatgttttgaatcggatgtaaagtcagaaatttgggaaccagtcaatgaaaaaagtggcaaacagaaaatgaagcaattatcatcatcctcttcatcatcatcatggtacgagaagcaaaatcagcaagaatttcttgcattagaaaagcatgacatcctgaaggaaaagccattgcgcggggaactgatgctccaagcggagcgggtcagtgctgcactactgtacacactgatacacatgaaaatgcggttgttgttcgaccgcaagcaggtcaaaaaaggaatcaacatatcgaaaaccaacatatcgaagacatccgcaaaggtcaaatcaaaaatgcggaaacagttaaagcgtctgcaaaaaacagtggtggaacgaatcaattcggtaccgtaattcgtcagtgtatgcatattttgggttggggtcagtcccaaaaaaccgattttttggggtacattttcaaaataaatttttaaattttgaacaagcaatttctataatactcaaaaaccttcaattatgtaaaagataaacgcgattatgtgtgaaaattgcgatatgtataaaaatcccgaattataaaaatatgtaagtaaatgtccaaaacttttattcgcataatacaaaaaagaaaatggttttgctactatttaaagctttgagaatccaggaaaaaagttgtatttacataaaattggcagccctaatcattagctataaaaataaagttatagtacaaaataaatttaatttttaaaaattcattatggattctctcttcgaatatttaatttttggaatatttttgataatttttaaatctaatgagataagcttggggtttcttagtttaaaattttgcatagcttaagaatattggggtcttatataagtttttataatagtttagaacttatttatttgcgaaatttttaaactgtctccgaatattcattgccaaataaaaataacaaataaatataccatccgaaatataaatttttgggcactttaattaaaaaaaatttttaacttttttaattcttctgccaaaaaggctaattctttctc

SEQ ID NO: 20003 - DNA, 1294 bp, Heterodera glycines
  misc_feature (642)..(642): n is a, c, g, or t
aaaccggtccggcgattttagggaaaattccggtttgacctgtttttgagaagccgggcccggaaaccggtcattttgaaaatgccaaaccggtccggaatattcattaaaaattttctaactaaactgaatgccaattattaacgaagacaagattaaatgcttttctctttcccctttaaaactaacaatcatttatttcatcctcacttgttaactcagcaaaaatttgttctttttatttaattctacaatgagtgggaagcagcggttggatggcgcagtcggtagggactttgtttcccccgcgccacagagtttgtgaacccacctttccacggctattttttcctttttcatttaattaagactagggctggccgggcaccgggtatttgggcaaaaaccggcacgggtattaccgggtattgaaaagccgggtaccgggtcgggtgccaatttttaaaccgggtcgggtacccggtaaaaaatcggggtattgaaaattttcataattttcatttttttcaaataataattttaccaaaatacctttactaaaataaaaacaaaaaaaaatatttccaaaggtcaggggcggtctcattttgtcttggagtgagtaccaccgcccggtagacnctttttttggttttcacataactttttcggcacgctttgttcaaaaaacttttgggaaagaagggggttccggcggtgccgataggcgccgccgggaaaattttttgtaatttttaatgggatttattaacagatttatccacaaaaagagtgatttttgggattactatgttaaatttgttaaccgatttttttttaaatggcaaaatatatgttagttaaaaaacatacgataaattatattttgtcgataggaaacccatgagtatatcaaaaaagtttcaaaatattttacttcctgtagaggaaatgaaccaaggaaaagtaatagaaaacaaagaagattacccactaggctattttcacagttggtggtgtcacttttatataatatattaattttttttaatttttacctttaacaacaattttcttcactaattttcactcaaacccgcatgcattttttgaaaaaatgttggtaatactttggtttgtcccctctatttttcaaaaaaaataaaaaaattttaaaatcgcttaaaacatctctcctggggtttttggggccactgatcacgaatccggcatccttttcgacccatttcgaacccctgacccaaattcgaacaaaaatctaaaaattattttt

SEQ ID NO: 20004 - DNA, 950 bp, Heterodera glycines
cggggttcggaaatggtttggtaaacatattttaaatttaaagcatctcaaactgaatcaattcggatgcgtttttgggtaaataaatatccatcataggttcccagactcaaaattgcataaaaaatataagttttcttaggtacttaaaaagattaaagcatcaaaaaaaaactacgcggcaaagcgtttaaaccggtttttgaactggttaaaccacgaaaaatggaaaaaattgggaccaattataaccttttcaaaaaagtaaaactggataaattaaggtatagttgaattttgtgattttgagtaaatttttaagaaataaagaatttttatggttcggcggtgccgatggcgccgccgcgaagaattttgaaaatttaaatgcgatttgttaacagatttttgcccaagaaatgaccaaaattgttatcaaatttaaaatttctagataaaatattgactaattatgcaataaaatttcaaaattatgagtatgtttaagaaatcagaacgaaattgtgccaccaccccaaatcagaaaatttctttgaaataagaacatattaaacccatgatttattgggtttcaaagaacatttttttaaaaaggatgcttcaaattttcaaaggatggaagctaaaaagggaagtatttttaagcaaagaaagaaaggatgggaggcgagtggaggggagcatgcgatattggcaaaatgcccgtgaaatactcaaaaaaagaaagtttaattaacaaaattatgacaaaatcaaaaacaaatggaacagtattccattttcataacaagacaatgccgtattgtttaagaacaatttacgattcctctgaattatttacttcttccacactaaaatctatggccaatttcactttgtccgcttctctgtcgtaaagtcctttgctcggatccatcaattccttaatt

SEQ ID NO: 20005 - DNA, 2459 bp, Heterodera glycines
tgcttttccagtgcccgtgccgtctttctgttgctgtcgtcccaatgtttttgggggagttcggtgcgtttctttcagcactgtaacccatagagtcgtttaggctttttgtgtacatttgcacactaaatgccaaggatgatgccaatgagtgcaagtaaacggccaccacggggaattcctttgatggtttgggtgagatttgatggatgtcaacggcaaacttggaatttgcatccgacagaggacacaaagggcgcgcaaggggagccggcggaaagggcggaaaagagccaaaaagactttttggccagcaaaatggcggccagaaaagcatagctgaccgaagtgagagacttggaaatgggcacaaattaattttgaaaagaatcagtgagaggtaagacaatttgaaacgaacgaaagaacgacgaacggagaggggcaaaggacgggcgattacggttgacgcggtcagcaaggagttcagagacagtgccaagagggcaagaaggatgtccatggaggagatgagcctttttgtggatggaatgaatgaataaatgagttaattaattaattgggggagagacgcggaaaaacgaatgaattggatgggaggacaaaccaaagggaaaggtgaaggattcgagaggagcaaatgcgagtgggggaggacgaattgggcaggagaagcaaaagactcgggtcgaaaaattgcaattcctcaaattcatcggcagaaactgagggccgaacagaaatatacgaagaaaaatttatccgaggcatttttgacgattcgcttaaatgtcgtccttttcttcgcctttttctctgctttttgcaagcactgctaaaatatttttgctttacacaacaacaaacaatgggcataaataagattcagtagagaatatttgctaaaggagacaaatgccgtgccatttcaaactttccgtccctaaatggcatcaaaacaaaaattgacgaaaagactttgctgcaaaatatgtaacgaagtttatttgtttcgttggaagaatgaaaaagaaaaaaatgaaaagggacaacaaaatgaaaaataaacaaaaacatttaaaatattattttttaattctatttccacagtatttatatttattcgtctactgtatttgcatgacttctgttgagttaactcttttattccgacttgatcagaccacttctgcaactaaattagaaaagttcaaatccatcgggctgtgactataccgctgaaccctaaataaaaaaatttagaatttgaccacaaatattaataaatattttcatttaataaattatattttgcaagttctttcctgaaaatatatttattgaaaattttgaatttctggacctggcccagcatagtcttaaataggaatgtccatcactttcgtatttaaataacaaattctccaatttccctcattttttttgtacgccaacttttttttcctttcagtcattcgctgctgtgtctctgccaatggcattctttccaattccttttcatttggcactttgcgttgtcgtcgcttccgttctgttgatcctcactcaatgttgttgttgtaaaaaggtgaggtcgaatttcacttggcgtaataaaatcaaatccattgcaattttaagaaagcagcgccggcgtatcccgtggcaggtaaaggaaagagaaagggagcgaaatgcgcacttttcagttgcaccgattccaatcccaacgccgccgagtgcgccgcgacagcctcccgtagcaggtgaaaacgaatcgaataaacacacgcagcacatccctttttgttggtttagcaaatgacccgaattacgctacccttgccaatttggacaagaatatgttcctcaacaaagccctcggtgattcgaaatgaaagcggaacggaacgaattttaatgtcaaacacggaaacgatgttaatggagaagaacgaagtgctaaattaataccaatgctgtaattatacgaacttatgtatgtaaatgcaaatgtctttctcattagtaaattgtaactgatttatggacggaaaaccccattttaattcattcggacgaactgacaaatggggggggggataagtaacaaaaggataaactgtagtgaacgccccgtgaaaaaatgggtcaaattatataccaatcgattcgtctcaaggagctaagcatggaaaaatatgtctcgagttgcggaaatgccaaaaaaccggtttttgaaccggttcaaaacttgaaaaattgagtgaaaaggggggcggctcctgactctaaaatgatcaaatttggacaaatttggtaccattcgaaagctcttgatgagctaagtctaaaaaacaaggtataaactcgaaccaatgccatctaagcactgggacaactgagccccagagaaaatggacacttcagtaccaaaa

SEQ ID NO: 20006 - DNA, 2564 bp, Heterodera glycines
tttacaaggcaaagtatggggttcttcaaaactaggaaccaataatggattatttgatttctgaacgccttccaatagctgcacgtaagtagtgtatggcaccttaatccggtgtaaaattccccccccccctgccctccacccttccacatcctttctttctgccttttcacattccatttcaatttcctcctcgcaccacttttcacccttttcttccgcgcagtttgttagttgttgccccccaatttcaacgcctaattgcgcacaaatcgattgctgtccttcgcaacaccccccccccccccgacgaatatccttcacaaatacaataagttgcggagatgattctccttttacattttacgttttgtaggacgtttaatctatgtattataatttttttattttagcatcagaaatgttttaaactctccaattgtcttcaacatgtctggacaaggaaacggaggaaagggacgcggaaaaagaggggcaaaaggttaccgtaaagtgagtaaaaaataatttgcaaaaaataataactatcgaaatttaattagtttttaccaagccacttcatttaaagctatttatgagaaaattattttaaatttgacaaattttctagggcaactaatacttttaaataaaatttaattgattaaatgtgaagtttttgttaagtttttccaaatgggacattgttaactattcttattttagaccaatcttgacaacatccaaggcatcaccaaacaggtcatccgtcgtttggcacgctgtggggggctaaaacgcattcccggcctgaactacagagaaattccggtatcaaaaaatggacgaagggttttttcatttgttaacaaaaatgaaaatttttgacagtatctggtattattatttttaactcaatttctggtaaaaaaatcattttgagtcaatttttttttgttgtttgtgcgtttcattgcactgggagctcaggaaaaaaatagggcaaaaacctaaaaatataagccctattttcaatacgattgtttgaaatttgccgaaattccctgagaaattcaatgatttttttcaaaaatcattgttgggctgggaattatatggaaatccatattttttttcctggacagtgggatgcctgaaacggacgacacccaactcatactgctccaactcgtactgctccaactcgtactgctccaactcatactgctccaactcgtactgctccaactcgtactgctccaactcgtactgtttttcgacaaaaaaaaatgtcataacttttgttaaggtcgaccaaattaaaaacattcttggtatcattcaatagcctttaaaattctctataaaatgagtattagctgcgttttgtttttttcctctaaaataatttttaacaccatatttagccaacttttgaaacaaaaattttcttcataaaatacatttgatcactgatttgaattatgctcggtcattttcaattaatattcatttcttctgcgtctgatcattgattttgttcgtttgtccgtcactcatttgtcagcagaagacgtcccttttgtgatgctttgtcccgcttcatcttcttctgctggtggtggaggagataatggcctaaattaagcgcaaaattcaaattcggataaaaattaaatgccttttttttattgctcacccaatgcaattagtgccagcaaaaagccaaatgaacacattgtcccaattttcatctttcttctgctgctgaaccgacgaggtctcgtcaattttgcatcgtttcattatccaatcgatgtcccattcatttgctttggcgaatgtcagcttttcctttgtcgattcgttcaccaattcaaacggcaccattggcattgacggcacaagaaaagaaaaatgaatttcgtaactgacggaagaaatggcattggcacggagaaattgctaaacaatttggaaaacaaaaatcagtgatttgtcgaattatggccacacctccttgaaattgttgacccaatcgaagtccgtttgtctgaagaaatatgcgcaacgcaaccgcttgggttggccatcttttctcggcgtgtgcaaccatttgtacaatgcttggccagcagaaattgttgagacgacgcaaattgtccaaatgatcaccatcggtaaagcgcaaacggtgaatgtttgtcgaaaaaatgggccaaatttcacgaacaaaaatgtcccaaattagttggccattcgtggtagttgaagaaggaagccacaactgcaaatcggtgcctcttttgtcgaaaatttggtgatttgaacgaagaaaagcgatgacggagtgatcgatgtaactgtgaaaatgggataaatgcttttattgccataaatctctgattccgaattactcaatccgaagccatttaaaacggattttgctggacagcggacggtccggcaatggaaatggcacaaatttgtaatcgaaccgtacagacagcttcgtttctggtcctttgtccttgctaattccgatttgtctccaaattgtcaat

SEQ ID NO: 20007 - DNA, 2303 bp, Heterodera glycines
  misc_feature (2160)..(2160): n is a, c, g, or t
  misc_feature (2198)..(2198): n is a, c, g, or t
  misc_feature (2205)..(2205): n is a, c, g, or t
  misc_feature (2213)..(2213): n is a, c, g, or t
tttacagtagaccaatttccttggttgttgcatattgggactgacttaaacaaccaaaaaaatgggcaacgcgtttgggaagttttgcctaatttaacttttcattcattaaaatttcaaaaaaaatttcaggcggatcctccggcaccacgggaccccattataccatttttgttgaaattttaactccaaaatagcaaaatttgtctttttttgaaaaaccgctacaaattcctgcttttgcgccccggcggtgaaaattttgaaaaataaccgttgagaaaacaatttttttgcccattcgagtgccttccctgaaatttttgaaatttttttctggatacaggccggaatgaagaagccctttgtaataattcagcttaaatattttttcatttaaataccgcgccactttttcgctgctccttccccacttttctgtcatttccacccatttatcccacaaattccttgaattattagttaactaaatgggcgccacaacaaacaaaaaaatccattaaacaaaatgccgctttttcggcaccagtggtgcgcccccccccctcgtcatttgataattgattcctaaacattttcattaaaagataaattgccacgcttttttagtgtgagacagacgacgggaagatgaaaatcactttagggcaaataattaatttcattctttcattaggcattccttttgtggatttgttggaaaaaagaccaaaccaagtcaataataaaaataaaaaatggcgccgcaaaatttgggattgattaatatgctaaatctctttaaattatacaaacaaaaaactcatgaaaatggactttgttaagtcgatttcgctttctccatccaaaaatattttttggggtccggacattccgtcaatggacaattcgtcagcaaattttatttttttgagcattgctcacaaatcttaactttattttaaaatgatttttttatatcaaaattcaaatatttcaaacagtttgttgcactttctctcttttctctcatgatttgctcactctacatattttgcttcttcctcctgctcctcactatttatgtgctctaaacgggacaggaaatcgcattccctcttcgcttcgcttcacttcactctcatatgccagcgtgtcggggggctttgcgaccatgacacagtgccggtctgcttcgcgaccatggcacccatatcggtctgctttgcgaccatgatatggaaagcaagcccagacttgctctcgcatagagatgcatgtggctgggccgctcaatggtggcgccatgaattccttatcgttactggccaacatccggtgcgaagctggtcccgcactttgtcaagaccagtggactggtgagaagtaacgtaggaaatctgagttcatcaaaataaatgtggactgcctttttaggattgtggttcaatggccagtcccttaaaggattgtagttcgcactatgctgatctttcccctacttgggaaagattcggcaaaaaatgcataatttttatctgcattcttaatgggatgtgtgagcgatcaatttctgcattcaatgacctttgtgcgaaattggacatgtttgattcgcagcggcatcactgtggcaaacaaggaaaatgcaccttaatttttcacatttcaatgtttttgataaatatttgattaatgtggtttaatggttgttttcccaaatattttgccgcatgtacacatcattgcttcatttttgttttcagatgccttcaaagcaaaagaatttaagagcgaagagacaagagcgtcatgaacagcggacagaggaatctgtcagccaaggtcgctcacccgtcccagacgggagtgcagatgagaatggggtggcatcgccccggggcttcaacaccccaaatttaagtgctttgcaattaagcaccccggcttcttcaattggaagtaaaagaaggggaagacccccgaaagccggagcggagtcaatcacgccttcgcaaaataatgtgtcttcagttgacacacaatttacatcggccactcaaaatattgaaacgccgtgcagcaaaaaatggaaggtcgacgatgttaaccgacccagctctgctattgaagaaattgctttcacgcctatttccacgncaagaagccgtggagggcggccggcccagaaaagacgncgcttangcaggagncaagctaatgattccatgagcgagagatcgtcaatgaaccagagctctgaagctaccacatctgtggccctttttgccactgtgcctgaa

SEQ ID NO: 20008 - DNA, 2043 bp, Heterodera glycines
  misc_feature (2030)..(2030): n is a, c, g, or t
ttgttgtgccatggcatttattgggttgtgccgcgaatatgccaagcttttaccgtttttattattagccatttatcaacgattaattactcacaacgaatttcacatatatgtttacataaaatacaatggaaatggacgcatttccaagcaagcaaaggtcaaatacaaacaaacaaacaattaggcaatatttaaatggcaaagtgccaacatcatttttgctcatcataatcgcatcaattaatgattaattcattcatttctgctgctgatcactcggtccaggagaagcggcatcgagaagactgaaaaaacgatgattaactccatttcaaattataagtcaatggcattttatgagtcaaatcaactaactattcttgattttttgtaccaaaagtctgtccatttcaaaacaaaactgtacatttttggatacgaatacaaagtctaagcaaaattgtcgacgattggactcagaaaacaccaacaaaaaaaagattaagcattttaaattgttcacccgtcgtcgtatctgccatcttcaatcaaaaaatcaattgggttctgtgaatcaatcatttcatccaccacattattccattttctctcatcccacgcaattggacaacggctgagccaaaagtcatttgctgattgcagaagatacaatttctctccagtcacttcgttgatccgatcaaatggcacaacggagtcaagcggagaaggcggaaagtgaaaacaaatgcgaaaagtaaccggagaagaagcattggaaaatgcctgaaaatgggacaaaaaaatcatagaaaatccaattaaatcgggataatcaccgctttaaactgttccatcgttgacgaccattgattcaccggtgaattcacagagtatctgagccacttgggcagaccatccggacgaggcgtgaacaaccatttggtcaccgcttgtccatccgacgcattggcactttcatcgggcggaaattcggggagaatgacgtcaccgaaagaaacatagtgaagggatggacaatcgttgagaagtgacggggccaattggcgcaaacggcgaaaagcgatggtattcaaaaacatcatcagatgcatagaatggcgaagcattggccaaatgttgagcaaaataaattccaaaatgcggtcattgccagtggtaatgtacaaatccgttgaacaaatggcgaaaaaatggtgaaaacggcgaagaaatgcgatgacattttgatcgatgtagctgaaaagcagaaaatttagacgaaaaattacaaattaatcagttttttacttgatctgaatgtatctgaatccgatgactttgttcgacaacggattttgcaggattggcaatggatttccatcggaattgacaatttgcattttcttcgtgccattctctccaattttgtggcaaattcgcattttgcccaatttccatttgcgtgttttgaagtgttcatccacgtaaacgtcaaagcgacggctaatcaatgcaattccaaggccaagctgagaaggcgcaagaaaatcgaacaccaaaagccaacaatcggcgcagataaagctgaaaattgaatttttatgaaatttcaaattttttgattaattatttacatttctttgtgaggacttcgtcgttttttgacatggccaaaaaagaaccaaagaatggtggcaaagccgaccaacagaagaaacacggtagaccaactgtgaaggggaatgaaaatccaatgaaaggatcaaaggctaaagacgaagaaataaattgtgaattttagtgtccgatgcaagctaatctttcgaaattgattttgaatttttcatctcccaattctggtcaaaagtcaagcaaaagaaatgcgaaatgtttcaaaaagaaataataaacgtacataattcctgaagacatttgcagcagcaaaatcaccgggaaatagattgaaaataatgagagaatggaatgaggaggaggaggagaaaaatgggcatttttataataanatatttgcgtagc

SEQ ID NO: 20009 - DNA, 2646 bp, Heterodera glycines
tttgccaagttgggctggacttggccggcccctttccatttcactcaaaaagggaacaaacacattttaaatatcgtttgttggttcaccaaatacgtaatttctgtcccagtccccgacacaaaagcacaaacaattgcccacacttttctcaccaattgttacttaaaatacggcggttgtgttgaattgatcaccgataatgcctctgccttcacttccgaatttttcagagaattttgctccatgctttacatcgacaaaagtatgcctgtcctcattggagtcaaggcaatgcgtcaactgaacgcacttttcggacatttcacaacatcttggccaaatacatttcgaagactcagcccgacttcgatgaatttttggatgctgctaatttttgctacaacacgtcagtgcatgcttcaacaggtgagactccattttttcttatgtttgggcgtgacccaattttttgtgttgaccaaataattgacccaaaggttcgtgatccgatagcaatttcggatcgaaatgaatttaaacagaagttagtcgttgccataagacacgcgtggcacgccgcagctgatgaatatgcaaaagctcagcgaaaaatgaaggaacaatatgacagaaaggcaaggccacagcaaatcacaattggtgatcgagtgctgatcagaaactacgacggacgggtaggcacatccaaaaaattccaattaccgtggcgaggaatttttcgggtcatcaaaattgagggcatttatgttactgtgatcagttgcacttcgccaaattcgaacccaaaaagacttcacttaaatcaaatcaaaaagtgcttcgaaattttgggccctccctgcactatgccaacccaaccgattgaagaggaaaagtgccttgaaaataccgaaaatgccgataaagcaatttcgaaagggtctgaaattcaaaatgaaatggaccccgaatcccgggaaggcgaaaatttggagcaaatccacccccgagggccggaaacaagaccagaacttgaagcagatgaggagaaaaatgagcataaaaaaacagatacggaaccaaggaaatatgaccttaggaagaggacgagaacttggaaagatcttgtaaattattagcacagtaatcagcaacgtcaaaatttattttaacaaaatcaatgaaattattcgagatcgatctcgtctaaaacgaagtcagttcggaaaggtccgaaactaggaataaaatggaccccaagtcccaagaagatgtgaacttgaaccaaacccaagcccgagggctggaaacaagaccagacattggaacgaaaaaatgaaatgacgacggaaccgagaaaatataaccttagatcgagaacgaagacttggaatgcccaagtcaattaataaaatgagtatcaaatcacaatttatgattcaagtgggacaaatttaactgatttaaatcggaaaaacgaattaaataaaattattaaacaaaagatcgaaaggattttttttatcccccttagggtttacaaatcaagagagggaacacctccttcaaaataattgacatcgtatgactcagccgccagttcaaacagctgctgttgattcggttgaaaagtcgactcatgagaatgctcctttccctgtttgccccattcgtacttcgctccctccttccgcaactgaagtgaaacccggcaactacttttttggcaacatttatatgagaatgttgattccgtctcctttgcgttcttataccaataatcattgacctgaacagtaaacagcttagaatctgatcaaaaaaaattcctatattacttttatgtattttaaaggacggggcgtacgtgtcctccgccccatcgcctccggaaatggttcaccatcccggaaccaatacaaagaacaaccacgaccagcgttgtagtcggaccaaatgtctctcacttccgcatcacccctctcaatgccatccagcataaaatgacgacaaatctcctcaacatttactcgaaccgttgtcggcagacacgcacaatatccggccaagcgaccatatttcaaccaattacgtgtggcggcgttccacgccatggccacagaaggtccaaagttggcgattcagcccacgctccaacgcggcccaacttttggacgaaaaggtgtacctcaatacaattgcccttattgatccgcctagtcaaacgctcaagttcaaagtaccatattttcacaccgccactataattcacattcaaggaacgcagattagcatcttcaagatgtaaaggagcgaagctaccactgcgtccgaaataccagaatggactggtgataccaggaatgttgcggaggtcaggtgccaaaattttcggcaaacagctgaggcattcacccagcggcactttcccacgtgttgtgatgcttatctcctggtgatagagcattcgagttggcaaattggcccaaacgctttctttcgtcgatgttgttactgcccaaaagggcaggttgctgcccgaaatattcctccaaactcatccgcacaccagcagaatgaattggcaggatttcgtaaagtccttcttttcactcggtcaattggtactcactaagacattta

SEQ ID NO: 20010 - DNA, 2001 bp, Heterodera glycines
attttttaatgggtgaaattgaatctaaggaacttttaatttcctctttttttctaaatttcgtcccacattttactgcaaattcgcacaacctgacagcgaagcaaggatcaatgagaagatcagaaatgcaatgggataagtgccgacaaaacggacaaaaatgcggaacattgtgcacagtgtgaactgctccaaaaagctgagaaatttggccgtctttgggcctaaagaaatgaaatttgagccaaatatttgggaatagaaagagccctcagacttaaatttaaaagaaaaggaaactaaaattttaaggcattttctttagcgaattttgtagatttcggcctgaatctaggcctggattttcctggacaagttccaggtccaggccatttttgccaacctggattttatatctattctaggattttaaaaattttaaaaaatgtttgaaaaaatcaataaattgcttgggaacatctaaaaatatctaaaaaatccaggcctggatccaggtctaggtcgagctctaattttaggctaaaaattccattgccaaaaattgacaataaaaagtcgctaaaatccaaaccggatgagccaagaaattcgctgagtacgtccgttttgtagcgtgacatggacgtggtcggcgtgtacccgtcccgaactcggtccctcaattccaactggaaaggggaggaaatggggggttcgaaaatgcgaatttcgtagagttcgacccggacctggatccaggtctgggttttcctgggtccaggtccagtccctggctattccggcaaccttggcttttcctggaaatggatttttgtcaggaaatccaggtccagctcaaacatggaacccaggtccaggcttttagaatgttgaactctagaactttttataaaaaataattttttaattaatttgatcggatttttaaaaaaacttcctttaaaaattgaaaatttgttcgtataatattcgaggaaatttgaaatgttttttttagaaattgaatgtaattttctcaaagttttcaattttttaatgggtgaaattgaatctaaggaaattgtaatttcctctttttttctaaatttcgtcccacattttactgcaaattcgcacaacctgacagcgaagcaaggatcaatgagaagatcagaaatgcaatgggataagtgccgacaaaacggacaaaaatgcggaacattgtgcacagtgtgaactgctccaaaaagctgagaaatttggcctcctttggccctaaagaaatgaaatttgagccaaatatttcgcaaaaatggattttatgatttattttaacaaaagattttggaaaaatctaaagtattggaaagggctcttttataaaatttagcatttttttttctaaatttcactcaaatttccaaaaattcccaggtaagcattaatttccacaggcattttttcaatctttgccctcaaaatccacaaattggccatttcggcaaaaagcgaaccccgctcaacgactgccgaagttgaggacgatgttgatgaactgctgctggcaccatctgcttttatgagggggattagattttttaatggccgggaatagcctctttctctttctttctcttcctcttcatcttttttcttctattctcctcctgtttctcattctgttcctcttcccttctcttcctcttcgccttttgttcctcatctcttcctctttttccctctattcccctcctgtttctctttctgttcgtcttttgctcctcttcatcttctgttcctcttttcctttcccttctgttcttccccttctcttcctcttcgcctcccttcctcctatcttctcctcctgttcctctttccctttctcttcttctttgccttctattcctcttcgtctgctgtcttctccttctgttcctcttccccttctccttagaagagcctttcccttctgttcctctccccctttctcttccc

SEQ ID NO: 20011 - DNA, 2509 bp, Heterodera glycines
tgcaaaattaaaattcaaatttaaattaatttttaatttcataaattaaaaaaataattaatttgccttcaactcgcagtcgaaaattcatccacacagtgccattgggataaatcaacacaaaagtatttgccgaaggtgaaatgtgcagctccgattttttgctgttctatttttaaacaattttaattttttatttatggaaatatttaaattctttaactaggcggctaatttttttatgcaaataaaaacattttattttcaaaaaataagaagaaattaaaaattttgaaaatttttatttaataaattataaataatttttgaaatttacaaagtatttaaggaaaatttttaatcaactaatttatataaaatcaattaatcaatctaaagaaattcgttacattttacccattcattttttttcatttggcttgttttttccaaatttttaacggatatatagtttctaggttttatggcactcgtacaatggcttaggctaggccaaagttttaggcttatgcttaagcctattttgtacaatttacgagtttgccttttgtatgagtcgcctttgtacgagttgccattaaccatttttacgagttttttcagttcattatacttttcatacaaaaaatacgacttcactaactatttggcacttaataaacaaaaaaaataaaaaataaattaccacaaaacaaacgaatggttgccataaacggtcaacaattgctgaacttaaagttaaattttgatgacaattgctcatgtgtgaatagcgcaagcgacggtcgtgccaaatttggctcattagcacatcggctgtaaagctggcactaaaatgattttttaatttgaaaacccagtcctttttattgccacgagtcggcagacaattaagtaattaatgcaaaaattaaattatggcaaatgtttaaaaaatttcgaacgaaattttttaaaattttgcagaataaatagaaaaaatttaatgctttcaaattatatcaagaattaaaatttgattacttttgagcaaaattatgaatagcttcttggccaaaaatttcccatttgatgcttttttgagttaaagaccaaacccctagcgaaagactaaaggtaaagaaatgagagtaaatgaaaatagcacaggcaaatgctctgtttctcttccctttatataaactcatataaaaatgtaaaacgaaaaaatgaaaaaggtgaaagtaaagtaactgcttcacttgacttgcacactacgtgaaggaatttttggaccggggccatcaggggatggccctaaaaatttgtgtttcgtcgttaaacacaatttttccataccgaaaaatggtgcaaaaaatctatcgattttttttacagaaatttcgattttttaaaaaggttttgcacatccaattccaaaaacaagagaggaaccaataaatagagagtgtgcagagaaaaaaatgtcccccttttttttgtggagaatacatgatacttaaattataataaagcaggtgataacttcagagaaacaaatattttttgttcaatttatgaaaagaattaatttattgaaacaaatatttggcgtatttgaaacaatgaataaaaagtttggcttatttgttttttttatttttaaggctattcaaatgcaattaatgatgacccaagcggcggtgctgttgatcatcccttgtacagcggaattgattccgtttattcaacagccggtggattgtcggtgttggcacttgtcgttttggttggcacgctattcggctttttggtaacaaatttaaaaaatatatttatttttttcttaaaaacgaataattaaaataataattttttttataggttggctggcgaatttcgagatggcgaatgctcagcgagctggcacgtcatacatcatcaggcatgtgtaaaataatattcaggggtcaagctaatagtcccaaaaaatacttcagatggagaaagcaccttttgtttttattttctgttacttaaaaaaatttcgacaaaaattataataacttttttttcaaaagcaaactaaacttatattttttggtattttgatagacctatttttttttattagacagaaaaatttaaaaaatttggcaaccttattaaggcctgaaaaattaaaaattctcgcttttctagaattttttggcgccacaagttctttgtattttgtccaaatttgaaattttgcttgctaaaaaactaatcatttcatgctatcgaatgatactaattatataagatttggcagaattctaaacaaaatcattatatgaaaagaatacatcttctttttatgcgaggaaaatggaagtaattattgatgataaaatttttccccttttttctcactgtgttaatatttttttatgttggagtgatttctgtttaaattttattttcatacggtatcaccaccgtatcagacttaaaaatggaacaaatg

SEQ ID NO: 20012 - DNA, 973 bp, Heterodera glycines
tacgccacaaatttctgaacaactcttgtcggaatgtgctaatctccggctgttgcttctgatagccaagcttgttctgcatttgtcgttgttttctgttcaaaaattgtgcaatttggcgttccgtcctttgtttcatttgtcggtggccaaaattggcactgtgatcatttggcgacaccacaaattcggacaatttgtcaccaccgatgtgcgtttcaaatgagcgctgttggccaggactgcgcaacaaacattggacaggcgaaaagtagcagggcctatttttgggagaaataaaaaatttaattttggcgcagagacaaatcgccaattaatcaaatcatagggccacaatttatattttttagtgggccattttaaccaattattatgcaattgctcaactaatttgacattttcttgcaaaatttcactacggtaaaaacaagttatagtgaaaacttaaaaattggctgttcgtaaattctattaaataattagcagcgctgtcaaaaatatgcaaatgcatttttttcctgaatttgtagtctaattaataggaaaatcatcttctttttggtatttgcgtataaaagtcgagacttttatttgcatatttttgcatgttttgggtttttctgcatatttcatgcatattttgccattttttgtaaatattttcagattttttgcatattttgccatttttcgtcaaatatttttcgatttgaatatcccttaggaaaaaaatttgattatgcctaaaattaaatccaaatctgaatgggtgcgcgagtgggtcaacagtgagttcactgccgaaaatcttgagaaatttttgatttgcaattacaaaaactaccgatataatttatgaggaataaaattttttaaattattttgcacccctaattttcaagtttttttgtgcatatttggtgcatatttcacgattttatttgcatattta

SEQ ID NO: 20013 - DNA, 2263 bp, Heterodera glycines
cttctattaatggcattgacgtcaatggcaaaagatgaggcaattttgtatttcaaacaaagaaatgaacttcgcaattgatgaatgaaataaaaagggcattcattcgcatgtccatatttgggcatgacaatgaaaatgccaacagaaagtatcatcaggtaaatgccacgggtgagggggcgagaggagggggaaggtgccgcttggagcgtgccgttttaaagcggagaatcagccaccaatccatgcgcatcactcacaatttttttcatatctcctccattatcgctggaataaagaaaactaaaaaaaattcaaaaatgactgtcgtcgtattttttttatttctgctcgcaccgatatgcgaaattgctttagctgataacaaaggaaatgctcttcatctgaataatcatccgaaggatgtcaaaactaacactaaaaaggcacctcctaaaaattccattaaaaccaatggaatttctcaaaaagcaccgcttcatgaaaatgccaacgttttaactggaaggaatgagaagcatcataaagacaagaaacttccggtgcataaaaatggaaatgctttaccaaaaaacaatgattcttcggagttcgaagatgacttactgagtcaggcactaactcatcttcgtaaaatgaatggtaattattttttttaaattataattttgtttctccctcattttagaacaactaaagaatagaaactggccacaaaattcggagtaagcattttcgaagtttcattttttgaaaaatggaggccaaaatggtaaaaataataatttttttggcgaaaaattttgtaaaaatacaccccctaattcgagatttcaaaaaagcaaaaatacacccctaaaaatcaactaaaaatgaaaaatacacccctaaaaatcaattttttgacttcagccccccccccccccaaagccaagggtctggctacgtctggctacgcccttgtatgaatacaaaaccggagtttggcgatgtgtttttttgcacgatttaatgcatttaaaaaaattcaaattctttacctcaaaatgtctttggcgctggacggcactttttcaatttcggcactttgccctttgtcaataatgttcgcatgttttatctgctgttccgcgtcaagaatcgttgccatttgttcacgctcaatttttcggatcataaattggggcaacaaaagtgacttccacggcagcggcaaatttaaattttgatttggcaaatggcgacagtttgccaagaatgacagtgaagagaaaatgccaaatattgccaatgtaacggaaaattgcatcttttaaaaaattaaaatttttagaggataaatagaaaatttcactttttgtaaggattaatttaaagaagggaattaaaattaaaattaaatttatttttaagtattactttttttttatattttgcaaacaaatttatttgcgaaaagtcaaattcattattattttttgacaccaaaaataaaaatgccgaactaaaagccaattatttaattgggtgtcgcaatgagagtaatgtgttataaattttgatggattacaatatcaaatgggtaataattgaagtggagaagcaaattaaatatgtggcaaaacttttgagtaatattaaatatgtatttagttaaaaaatgataaattattttttaaaactaaaaatgatatcatttttagttttaaaaaataatttaattaagtaagaatttattaaataattagcaatttcagttcataataatgttaactttaaggtgggtcattgccatttttgaattggtagctatgttcgagactctcggtgtcaaactttaaaagttttgtttatttttatttttttgagggggtggtcgttctcgagtctcgaacgcagcattttcggtctagagaacagcatcaatttagggcagggcagaaggaggccttataattaataattgtaatccataaaaagcgaattattttcaacaaaattttcttgcgaatttcagcgttaattaattaccatggtgaacactaattaacatcattattttacgacattaggcaaaattattatggtaaattttatcgcgcaaatcacaacaatcgtaagtgattttatataacactttttaaccgtgagaaatttccatttttattttattttgtgaatttttttcctaaaagagtcaaacacgtaatattgttaaaacaaaaatagaattacgccc

SEQ ID NO: 20014 - DNA, 2024 bp, Heterodera glycines
aagagcagcagggcgttcattcaagctgtcccatcaccgacgccccaagctgttcgaccgccgacgccacaacgccgctaccctgatcgccgacggcaaccacctgtgcgatactcgccccgttgagatcttttaaaaggggaggtgttcgggtggtcaaccccgagagatgaaagaacacatttgcattatttccctttgcatttgtatttttcttttcctctccattttccccactctctaattattgtgtcttcctttatttatgtaagacactattgatttattatgtccattgcatgtcctttcccctcattcattcagttgctttttatgcacttatttcacttcgcctaaatatttgttctcctccaatttatttattcacgccaccgacttcgcccatttttatttaaattgtttaatttatttgttcatcaaataaacattttattgtgtcggttcaaagaccgaacaattggcgacgcccgtcttaaataaagactcaacgacggatattttggcaatttcggacagattccgaattgctattcaactttcttcaaaaaagcaatagacccaataagggtgagcttccgccaggtgcggtttattcatcgaaaaaaaccaagatacccaggtggttgcggtttccgccaggtgcggtttactcaacaaagacaaggaaattcccaaaaagttgatcaacaaaaatggcgttaaatccgacaattgaccagctcgtgaaaatgctggcggatcaacagaaaatggtgcaggaccaatcacagcaaattgctcaactgattgcgatcggacaaaacgcaccaaatgcggcggcacagcccaatcaaggagcaaattcagtaccaatattgccggacatttcaccattcgagccaacggacgacaagagccgaatttcggaatggattgagcgattcaaattcgcgttggattgcacagcaccaacggcggacgacgaagtcaaggttaaatgcctgatgaataagctgagcgaatcggcattcagtgaatacagcagatcagttctgccgtcgtcggtcacagatttcagttttaaagtgacgaccgaaaagcttgagaagctatttgccaaggctcagtccatattcatcgaccgctacgagtgtttaaaagcggtgagaggagaaggcgaacaattcaggcagttcataaatcggcacagaaaattgctgaccgattttaaattcgatgagctgacaaaagagcaatttaattgcctcatgttattgatggcactcaaagcgcccaacgaagctgcattgcgacagcgaattctgacaaaattgtcagcagatggcgccaacatcagctatgatggagtggtggaagacttaatcagcttccaatccacaatttcagaagcaaaggcaatcgaagcgacaagttcttcgaggccagtgaattcgattcgacaaaattcaaagccgaacaattcaacgaacaaatacgtcaaggaaagtccaaagccaaataatttgccgaacaaattcaaagaaaggaccaacactgaggcaactacaatatgttggcgatgtggcttcggcgtgcatcgacctgacgaatgccgttacaaaacgagcaaatgccgcaagtgtgagtttgtcggccatttggacaaacaatgcgagcgtgtccaagagtggcgcaaacgccaaaatgccaaaaagaaaggcaacaaccgcgttggccaccttcgtattggaatgaccacgcatgccgtaaattccatttcgctgctaaaaacagcggttctgttcaacatgaagccagtcgaattccatctcgacacggggtcggacattgttgtcattgatcaattgacgcacgaatatgttggacgacaccgatcgaaaaatgcaacgaaattggcaaggctttcgacggcacaaaaatttcctttattggaaaaggattcggtacattcaaatttggtaaaaataaagtcgagcaaacattttatgttgcaaaagcaggct

SEQ ID NO: 20015 - DNA, 1613 bp, Heterodera glycines
ttccccttcggctgattctttcttatcgactgatccatctttcccccccccattttctgtcctcccgcctcatttattttgcatcggtgcgcgaaagacatgtaaattgtcttgaaaatgaggggaagggcagggaaatgcccatccatcgcaatcgcccgtcagcagtcacttcgaactcgcaaaagtccttcgagggacactttttgggtcatcacactttaaaccaaaaagccctgggcatcactcattaccaaaaattaactcaaaagcatttcattctctttgcacttttttagcttcgacgcccgcggcggtgcactcgcaaaattacgccgaagaaaatgcacaccaacagcagcagcaacaaattcaacagcagcaacaaattcaacagcagcaacaacagcatttggacggactgaacagaacggacaaagggccgatggacgacgactgctgggccgaaatgaacgcaatgggcggcaccggcacagcggtgccgacgacggtggtcagagacgcattcctcggcgggggattcgtaccgcacacttcggcagcatcgccgccttcgacgacactgaacacttcggagttttatgagacgaactcatcagccaccaacccaatcctcgagggtgagacaaatagcaaaaaagaaagacattgaaatgttaacggaatcccttcgtcttccatcacaacaaaacgtcgccgtacgaatttttggaccataactttttctttctcaaccaaattaaaaatgttcgaaagtgcttggcaaactctattaatttaaaaaattccaaaatatttatacaaaaaaatcatggcattgaattcttatggccataactgtttttaaacttaaccaaattttttcgctttggcataattaaatactataaacacatagagctaccgaacaataccaagaatgcttaatttagttaaacgaaaaatttatggtccaaaaaatgttccagcgacgttttgggataccacactctcgcccctcactctctctctcgcccctcactctctctctcgcccctcactctctctctcgcccctcactctctctctcgcccctcactctctctctcgcccctcactctctctctcgcccctcactctctctctcgcccctcactctctctctcgcccctcactctctctctcgcccctcactctctctctcgcccctcactctctctcgcccctcactctctctctcgcccctcactctctctctcgcccctcactctctctctcgcccctcactctctctctcgcccctcactctctctctctctctctctctctcttcatctcccttgctgatcattgctctccctctcccacagatgcctttctgtccatggctccaagttcgctgttggatgtccggtgcggccctttcaccactaccgcttcgtccgtcgatgcggcccctcatcaccattttcgggacgcgggctccgtcggcatttcgccctgttcttcctccacccaaatttcatccatttcgtcttccgatgactccacaatccattctctccaacaacatcaaaagtgccactcccattatgctttccagcaacatccct

SEQ ID NO: 20016 - DNA, 2167 bp, Heterodera glycines
attatatttattaaaaggaatatgttttaattgattgaaaatggttgcttcatcgattgatagtgatcaatcaataattaattagtgatgtattaaacattggtgctcgataagcttgccgattcgctagcttattatcgattgatcagtaacgcgatcaataattgattgacaaactaattggattggtcggttgatcgtttttgatcaataggttaaaaaatgcttatccttttttttgtgtctgtctgtctgtctgtgtatgtctgtgcttttctctctctcacactgtttttttttcttttaccgcttttgctattttcgcactttctttttccacgcttttccgcactgtaatctctttcaatgtttaaagtttttttttaacatttcgccaagaaattatatttttaaaatttattctctcgcatcttcagggcaagcacaatgctgttggaaatgtcaatgcgcatgggatcgaaggtagaaaaaattcagtgggaaaatttcggcccacttttacgcgaaaattttttgcaattttttgaaaatttcaaattttcggaaccattttggaatcaaaatttaaaaaaaggcggtaataaaaataattgcgttaagcatgtcagcacggaggtgaacgaagtggcgacacgacgagcaaatcggcaacagcagcgaattctttttcaggtaaaaacaaaattgaacggcacttttaattatttattttttgacacgtaatttgttttgaaaaaatcttttttcaaattttttcacctttttaattactcaaaacagcgaaagtttgccatttttgaacaaattttcacatccaaaattttatttttacctcaaaatctttgacttttcctatgaatattttgaaaattatcaaaaggaatttctgggtcatttggatgctttaaattttaatgttttaaaatgtgtttaaatttttgaaacgaaaacttatttagaaacgatactgtatttttaaaaaagatacaatcaattttaaattatgccaatttttttcattttttcgaaataaatttatttgtttagatttctgttgtggccatcatcttctacctgtacatgtctggtaaaatattaaaaaaacattttttctaatttttaaatttttccctcacccattttatttagcctattatttgctttaccatgtgttcaatgtgtccaataaatggctggtgttgttcaactcgttcttttattccaccacacacatgatcaatcccgtaaaatggagaataatttcacatttaaatgaaaaaaacgatttatttttggcatttttatgccaattttaaacaaattttggcacatttttttttgattttcttactaaattttgggtgatttgaaaatttttgacattttcatcaggtcaaaaaaataatatgagaattttttaaatcaaatttttcaaaatttaatttattttttcaaattttttcgttctacaggtgatctacttttcgttgaacaaggacatgcgagcgcagctgatccgtgccattgccgactgtttgaattgggcttgttgtgtcggtgacgcggccggcctcagtcggttcggcggcattcactcgtccatctacggccgggccagccggcggacacagcccggcgctgagtcgtcttccggcggcagtgtgctgctgcacaagtcctcgtacggcgccggttgcatgacagaggcgaacaggtggagaatgaatgcatggcaggcacggcatggcaggcacggcatggcatacaaaattggtgcaggatggcttagtgccagccggcggttcggttctggcactttttgtgattaaactagacgttttttgatcacttatcggatgcgagatccaggtcacggccgacacgggtacggctatttgagaatctcgggttcattttctcgaatcgaatttttgaaatgggtgccaattaattggtaattcaaccatttgttttctttcagttccgtgcaaaccgaaaatgccaaaccaggatggacgcttaggtgagagatggtgaaataatatataaatgtcatggtcccagaatttaaatttgacattgatcatggcatatgcctacaacggatatctgatcgtaaattatttaccagttgatcaaatccgct

SEQ ID NO: 20017 - DNA, 1047 bp, Heterodera glycines
  misc_feature (5)..(6): n is a, c, g, or t
atcanngcggcagtcggtcgaccaataacagcgaaaatggtcaatttggccaaattaattactgtcataatttaagtctttttttgagtttaccataatagttttaacagtgctcatttagcttataaatgactttatctttttcaataatttttatatttttctttaatttaatgctattattgacgtctttatgtgcggtgtgctcagtttccttttttcgtcttaactttttctaaaaattgcgatgggcgcactttcatcgatgacgcaaatgtggcggaaagagaagaaaggggacaaaaacgaactttttaaaatgacaaataccatcagtttattaagcctaaaacaaaatttattatttttgataccttaacataaaatggcgagtaattaacaaaaagaaaaaatatatattattaaactttgacataaataattaggcttttgtattgcgtcattcacttcttttcatgctgcttacctacctcatttttatttttctgttccaatgcttcttgtctcatcatttgcgtcatccgacgttctcccttttgttgatttttgcttgtgcaaatattttacgatggtcgagagtctctaaaagcggcgatgcgagatgctttacgcggatgggggggtggggagaccaatcaacattgatcagtgagtgttggccacaacaagttgatcagaaggaaagacaaaaaacgattgatcagcaagtagttaattgtttagatagtttttgtatttataataattgaaaaaaacagcaattgatttgccaccgacttccgtccggcaacaattggaccaagcagtagttgggcgcttcagttgggtccatcaaatgtttgtccaacgcacgctcgatcagctgcggcattcgatcgccattctccacttttatgcactgaagttttaaaagtaaaaattaaacatccttttgacaattttcaggcttttttcatattttatgagaaaaaactagttttccaaaaaatcgcttaaaattttttaccctaaattccttaaaatttt

SEQ ID NO: 20018 - DNA, 1658 bp, Heterodera glycines
aatggttttaatggcctttagtgacaatgccatcggcgatccatcgttaccattccccaccggacaattgggcaaacggaaccgagcagtacatgaaattcacatgtaattgtttcataatgatatgaacttgctcaaccattataatccctcccttttaattttcttagtccctctggctcgggtggtgctccgctgctccattcccaactgcgaaaaatgcggatttcaactggtgcatcggttccatcgacaccaaacccaacaacgagtgaccaaaacagtccgggtccgaccgaaaagagggtcggcggagttggcactgttttgggaatgtcgaaacgaatttcgctaccggaaaatttggaattccaaccgcaaatgctgctcaatttgaagcaatcaattcatgtggaaaaacagttgacgaggtggagaaaacgaacctgaaatggagaaacaactgatcaaaataattttagcaactctgacacgagtgattccgcctcagaaatgagtgtatttgagaagccagttttgaaggcatcacgactgcaacattatcaacaccagcaacaacagaagaggaaagcggcacgtttgcaattgctgcgccaacaggcaaaatcattaaattaaaatacaataaaaagcataaaattgcatagggaggcaatgttatttttaatttaacaaatgaaatatttattaaatcaaacggtttaaaataactaattattaagagttatcaactggcacagaaacagagcatgctaagctacaatcagcaacagctttcgctcaactcaccagttggtggcactgtgacaattccggcacaattaggccaatcatttcatcagggccttcagttgcaaacatcgaaggtacaatgaggggaatggttgtaattaataatgcttaaattgagcatatccaacgacagattgaaccgcaaaccatggaggagaccgactcggatgttgaggtccaatcgccatcatcctccggcgatcgagtgccactttcaccaattgaggatttgaaaattgaagaagtgatggacacaagttgaacaatgctcctcattatgcaacgcataattagcattggtagtctctattaattaagttttactagcacgtaaaaaatgagaacatcatgaatattaagcagaatctgaaatttttaaattgttgtaaaaggatattgaactaaatgatattctcttatacattacgatagattctcccatcccagacttccatttttcacgttttgtacaatttggcaatttaaagcgtctttttaaatttaaatataattttgctcattctcgaatatttattttttatttcattaattattcgtctgtcatagataatattttgtgcataaatattgataggaagtatgcattatacaattattagtaataaagcaaaggaaaaagtcatagtgcaagactttagccagatacatccatacatatagcgtgctgcctccgttcaactaatgcctagtgctaagtggtgaatgctttgaaattcgatgatctttcactgatttaaaaataaaatttttaatttcgttgttagtatcatgacaactcatacacaggcaactcgaacaatggcttagactaggcttaggctttt

SEQ ID NO: 20019 - DNA, 2179 bp, Heterodera glycines
atattttgattgatgtcaatttcttggcccatcctccccccctattataattgagaccaaatatttgtttaatttttgctctaaattcttcccattctttccgtgaatgtttcccaatttgcataaattcattttttgttttaaaatatttttcaacaatttctcttttttgctcaaaaattctttgatttttcatagttttcccattttttaattctttcttccattgataaatgcttctgatatttatgcccaaatgtgttgctattattttttggcattttgtacttttttatgcaattttccatttaatttcatttttaatttgccatatatttgatcaaattgattcaatattttaagtttttcatcatccgagtaactgtctttaattataagtccaaattctctcttccatttgtaaattttcatttgatttgcacctaatttttttgcaatttttctttcaattttatgccattcttttcttgtgaatttctttcccatttgcttaattttctcttttattttatggaatttttcaacaatttctctcttttgtttatcatttaaaattggaatttgatcataaatttgtccactattttctgtcatttgttccaattgatcacaatttgtggacatttcttcacttttctcatctttcatttccaaattttcatcaaaaatttgattagattcttctacaaataatctttgcacaaaattttcaatatttgttggtccattttgatcatttgtttgtccatttattccattttgatcagtttcaatttctccattttcctcctctttttcgtcccatctttggccaaatatttcgtcaaagtttttttcttcttttattccaccagcataaattgtatttaaatttttgagcattaataaaaataataaaactattttaaactccatttttcataaaataaaaatgattagaaattcattttattaattgcttttattctcattgattttatgaaaattcatttttcctactcatattaattaaatattgatgaaatatgttatgcatattttttttttgcttattattattattaatattttatctaaataaaatttaaaatttattaatgataattatatttttacaaaatttaaattttgatttttgccaaattttcattttacttttctttttaaattgccattctttagttgaacattttttcccaaatgaattaaaaaattttctattttatgaaatttttcaacaattttttcgaattctaaaaaaaggaaaataaaatatttttaaataaattacctttttaaatttgttgcttgaactcaattttcttggcccatgcatgcccagaggggatatgtttttggatttgttcgatttttgataattttataacattttttgaaattttttctcgaatccgttaaaaaattgattagaagcgcaccaaatttgaatatgaattcaatttaaagccaaactgtcaattaacaataattttatttggtctttccttcacaaatgcaaataaaattataaaaaagaaaagttttgttcttttgtatcaaaaaaaataatttaatatgtaaatctaatttattatgagcataaaaaaatgattaaatgaattcgcgtaatttgataaaatcaaaagcatttatttatttaattttgaaatgaatttgcaattaagagttggttcatttaaaatttttcccctaaaatttgttttcatccattcaccatttataaagatttttttttatccaaaataataacaattttaaaaatttatttacatatttggtaaatattttggtgctatgtcgttataaaaaagccatcaaaaagggcgttataaaaaacaatcaaatggaaatttccaacaaaaaaactacccataactttgctcaatagcaaccaaatttttaattcttgataaggttcgatagccctaacaattctatattagtcaaactaaataccaaaaaatttggtcaacttccagcaaagttagggccaaaagtacccaaggaaccgggttttcgagcctttttggccataacttttttgaaacctaatgaaattttttgaaattttgcaagctaatagaggacacatagagctatcgaattatagcaagaaaatgaaaataaaaataatttc

SEQ ID NO: 20020 - DNA, 1675 bp, Heterodera glycines
aaaagcattgacgaataacggcgacacttttttaaggcgagatccaattgagcatacatttgcgtctcttttttcaactcgctcatgggctttctcgagtggtctatctcagcgcgggactcttttctctacttggccatttgtctgagcatcccttcggcgctgctttacgtggccgaaattgtcaccattctgcggcataaacaattccaccattgaaaaactcaccattgataatcaatattaataatataacttcctttaaaataatgtaaaaaaacttaaataaaatttttaaatattttttgatgtggatggcagttgtaagctgggcagcagcctacggggtttttgtacctgtaattaatagattacggaattccttaattgaaaaaatcgccataattaggggttacgggtttctataattgaaaaatcgccataataggggttacgggtttccgtaattgaaaacccggttaggtgcagcctgtttctcatgcttgctcgaccaaaatcgttctcaatcgctctaagaattcttattatcaaaatttttcataaactttaaaaaaatatattaatatatataactatatatttttttttcatttttctaaatcttctcttaatttctttgaatatatttcaaaatttttccggaatttttaagtgagaagggcgggaccataaagcaattaacaaaaatattatctgacatgacttgaacaatgttataatggtaaaatgccgtcatttcaccgtaaaaagtaacaaattttatggaaaatgtccaaattttaactgtcgcgtatagcttttaatgcaaatattttctcgctttaatatttaatctcaaaatttatcatccaatcaagagaattacgatacaataatgacaaaagctttaggaaaattgacaaattttatagaagcaattacagatcgaagaaataaggacaagcaaaagaaaaatgattgttttcaatgaaaattacgaaaaaaaaaccaacggttgttgttgctgctaatttcgtcgcaccaatttgcccccacatttgtggggcaattaaaattttatcgtcgccatgtacaaaactacacattcacatacaatgtacaacaataacacaacaaaaataattatgacgacctcgacgaaagatttgtacattgtgtgcaccacaaattttgcgggaatataaaatggtgacagccgacgaagcgacagaattactgctgccagccgactgctgatgactgacaaactattccttcttcatcatttctcttcattcatgtacaacaacagcagcgaaacgggccagttgcgtctgagccaagtttagaccaccataacttgtttctttgttgaccaaatccaacaatgttggtatcattcgaaatctcttaacaagctctatcggctttttccctccaaaaatcacaaagacataccgacataaaaaaaagttataaattaaaatatgcaaaaattctgactttttggtagtgttcatgttgcaacttttttataagttgctcaatcgcttagccatatcttatcaaaagcttctaaacatgtagagctttcgaatgatgccaaatttataaaatttgacaaacaaagaaaaaagttatggtgctttatgcttggctcagacgcaactggccc

SEQ ID NO: 20021 - DNA, 986 bp, Heterodera glycines
tttttgccgaattccggccaaaaaattgttgtgtcaatggcatactcttttttttccgtaacttttttccaaatttccaactgcttctttaatgcttttcccctttttcaattggctgcaaaaagtttcatataattgttgaaaatttttgctgaagtttatttgaattttttctttgcacaaaacgccaattgcatgcttattaagcaaattgaacactttgttcatgaatccatccttatcaatttttgtagtatcttttggaattaattctttagatgcagaatccacgagttcatttgatgatttaaacagatcaccttaagagaaaaataaaaataatttgaaagattttaaggaattttttttttgatttttgatgtatttagacttatatacgaaaaacatacccaatttttaaatcttgcgacttttaatcctataattaataatacgaggatttttagtcgagacccaaagcaccggaaccggtactggtgaattttatgttaatcaaaaaattgaaaaaaggggctctttctctactctaggataaatttatcaagttttcagggtctcgatctcgactctctctcttaagtaaattcagggtaaattttgattgtcgagcaaccctgatgcatattaatacaaaatactttttttttaaattaattttattttaccatttttgtcgtgaaaatgcagtgtcgtatttgttttgtttttccttactaaaagcatgacaatcgcaaataaaaacaattttggtggcaaatgcaatgaaaacattttttaaattttatattaaatttgcttaaatatttgattttttagattttttggcaacaagtaattaatttgaataaaatttgaaaacacaaaaaatgattgattccttcctaaaataaattaggaattcgcttaaaatattaatatttggctttgccttttatttcaatttttctactttctgtaacgatcaa

SEQ ID NO: 20022 - DNA, 2352 bp, Heterodera glycines
taaatcttagctttatcgtgtttttttcttctaaaatgatttttaataacatatttagccatttttgaacgttttactttacatttagcgaatttgaagaaattttgagaaatatacatttaatttcgaaaaatttatgtccatatttttgccattttatgtccatatttcgcgatttgttgtccatattttatggccatatttcgcgatttcttctcgtttttttgaaatgtcggggaaagttttaatgatttgttaggaaaattggtataattctaaaaaaaagttccgtttttcatttttaaaaaattattattttttcggtttcgagtatggggagaagggatacgacgactctaaatgtcgcagtaaaaaaaacaattttcaaaaaatcggttttaaaaacgaacctgcctcccccggctacgcaaacttgggaaaatcttgatacaatttctgattagtgaatttgtctgtgttttattccctcccattccccacccaccaacaaatcgtcatggtctgctgtaggtgtgccatgttgttgctgttgattgtttgttggtgccatgacagcgccgctgtgccgtctcatcgccaccatcgccctctgctggttgtccaactttttctgctcatattgctcaacactgggcaaatcggggccaacactgaccacatcctgaaggaaaaaatttggaattaaaatttaaaaatttctaacaaaaatgcattaaaaagccacaaatggcatcacaatcccaataatttggcatttattggtcacttaactttgatacactacgttcccggcgcccaatttttttcccaaaattttatgacgattacaaaaaaaattttacaaaaaaatcgctgactgtccccttacatggagtgtgtgtagggcaagcattttgatgtttttttgaagttgcatttgccgaagtgatggtgcttctccaacagtttcagcgggtgaaccgttgttgttctgttgacttggagaggaagaccaaacttcgatggaattacttaaaaaatcgcacaaaactacacatttttaagggcggaattcttatttttatatattttttggtgatctttttggattttttctttttgattatacaaaataataaattggttgtgtttttcccaattctctgaacctcagtcgaatgatttgctcttggagctctttgagtttgagtcggactgaagcggccgatgaaagggagtacaatgtttcgccattgctttaaaaattgtaaaaataaaataaagcaaaattcattaaaagcaaaataaatttcacttcaaagagtcggccatatttttgtaggacgaggccaaatgggagatttgtgacagcaaattgcatctgacaaaacaaaggcattaaaagccaattaggtaaatagcgaaatgaatgaaaaataagtgtttttatttgcgattgtttgtatttcaaaaacaaaaggaggacacgaaaaattgaggtaaattaagaaaaaaaaacaattaattttttttttgccgtgacaatttttacagataaaattgtccttcgtttttttttttttggtgtaaaaatgggaataaaaacgaacaatttttggtaggcgtccaccagcgagtcgttggcattctcccacctcagttccatggctcgttctcgcctgtccaacaactttttacattttgcacaaattcgtaacgaataggcggaggaagtcgccgaggcaaccgacggaacggcactcttttcgctacaatctgagcgaaatatttaaaaaattccaccacattaaggcacttattcgtggggatttagatatttctccgttttgtcctacacttcaaaattttaaaaaggcaataaagatgctcgactctcattgtgcgcgaatacatttgaccgcaaggactggaagagacgcaatgttaacccatgttaaaattttggcgtcaattgtgcgtttttggcctccaaaaagagaagcgttcgtttttgcacgccttttttaaattttgaggtgtaggcacaaaatggaaaagtatcgtgacttatttttgagttttacaaaatttaaaattttttttacgaatggctcggctctcctctcccgtttttttgaaatgaacacacctccaattccaccgccactactaatggaccgaccgacgacggaacccagtttgtttttcaccagcgcaaatgaattgcccaaattgtgcaaagtccgatcaaccgcaaaggtttggccctgaaaaaatgtccaaaggatcatatgtatttgagtcaatttgagttcggaaaagcgtgacaactaaccattggttttgtccatg

SEQ ID NO: 20023 - DNA, 1939 bp, Heterodera glycines
tgatttgtgcatttaaatcaaaaaatccggcattatttgtctctattctcaaattttcaaaagaatttcaatgaatttatccagtctttcacccggttaatttcgctgcatttaaaccaagtgattccgatattagagaagaaaataaaatggacacgaatttgttgagcctaaaaaccgtattatgacggtttttgacaaaaatttctgaaaatttacttttgaatatttaggtatcataaatcctctttgcgattcctttcgattaatttgaaaaatattctctaaactggatacacaaatttcattctacaggtttaggttagcctggtaaaaactggagaaattcagaaatgttttggaaaattacaaaatgcatccgaaattgacttaattggatgaattgccattttaattaatgggttcattattctctgtaattgaccgggatcgcggcgcacctttctgttgaaagtttcaaaacaacaattggaaattttataaatctgagtttcaaaaatataaattaatacactgttttttacatacattagccggtaattttgaattaactcaattaagtgtccctgtcattagtgtgttaagtgttctttgtaaatgatcgggattggtggctgaaatgagcagagattcccacaaaagaaaaataaaaaaatatactaataaaagatcacgggacaattttaaattccatgccaatttggcaattttttcagggcttttttattccttttatagtgaatgggatttgggtggaaaggttctaaaaccctaccatatttttaataaattttgagtttattttcaaaacaggccttgggcaaatgaaaatttcatgctcaaactaacacttaatgtcggcacatttttattacttctaatcgctcggtgcctttgtgtagaaattcatagaaaaaatttttttctaataatttatgtggaatttaccccgtttttcctgagcttatcccaacccatttagaaagtaaaatttacacaccctgacaatgccctatactctggggtctgttgggactcggggacacccaaaatggggcccctcgtcgcagccccgggctggccaaattggcccaaaacaccaaatccccaaattcgctgttcgatgtcccctttatttgttgagtaaaaaccaagccaagcgaacaaaattggataattaatagaatgaatgaacgaacgggccaggggaattgagggtggcagaaaggggaggggcagttggtcaattgaggagagaaaaagtgatgagaggggctgacacaaaggaagggggaagaactccaagccaaaggggaaccccggtcaatgaccatcttttcatcacattccccaccgacgacattgccgcgccctcgcggcaaaaataacaaagcgatgtggaaaaggggaaaaagcagagagaaggaagaaaaatgacgttaaagagagagagagaaaatggagaaaatgaaatgattttgagacaaagagatgcagccccctgccccaaccgacgaccgatcgctccagcgttgttgtggtcgggtagcagaaaaagttagatgtgaaaagatgataattcgacatccaaaagtgttggtcatttgcaaaatatcttctggtggtgttcatttcaaacccctcttctcttttcatttcccctcagttttgtagctattccatttttagtgaattatttcggcgtaaaattttcaaatgcgtttggccttgttcaccgtcgtttcggctcttcttttgatggctctgatttggccctctgttttggcttcagccggaaattggtcggttgagtggatttccgatcggtggggcggggggagaaagagagagagagaatgagaggagtgagggctgagaggggagtgcgccaaattggaatggaaaaatggccataagg

SEQ ID NO: 20024 - DNA, 1042 bp, Heterodera glycines
  misc_feature (993)..(993): n is a, c, g, or t
attgtttaacattctgggaaaacaaataagaggcccctcccccgcagagagagaacaaaaattaaaaaatttcaaggaaaagccgccgcatttttgaaaattttataatttcaaattgcaaagtatcccaagcttaggattgttatggtaaacaatcaaacgcctaaatggacgggggcagtgtaccgcacaattgcacaatttgtgttgtggtaaaatgtcgtgttgatcacttttttcaccctctcttctctttccccttcttaatcgctttatttaatcgctttctcgcaacgcgcaaccgaaaattctcgagagtaacaatcaccatcatcacgttttaatttttttgcatttttctcctccgcgccttgcctctaaataagcaccaaaaaccccgtccgatctattgcccattactcctcctcctcctctttgtgtgttaaccccaaaaactcgtttagcaaatatttatgtatgtgctccctcctcctcacaatatacgacgcacacacaaatatagaatagcattttcatttcatttttattcccattgttacaaaaactgaaaattgatcagctggcgctggttgagcaagcataattttgtattgttgaataatatatttttaaatattaaaatgagaattgttttttttaaattaattttgaaagagaataagaggatgatggaaaacgttggtttgttttttttattaacataaaacaagatatgtacaacaaaaaagaatgtacaaaatgaaatgaatcatatacgaaaatatcgttacaaatgcaaacattataatgcgtagacaaaaaaaaagctaaattttgctctaaaaaattcgagatttataagacaaaatgaggatgtttattggcatgagcataatgtattggttgttggaatctcacagcgcaactgtcatgtagcaatttgataaaaaaaaacacttgaaaattgagatttatttacaataattacagcgncaatgctccttttatataattgctagatttgtgatggattaactcccac

SEQ ID NO: 20025 - DNA, 1894 bp, Heterodera glycines
cgcggcattttcgctgacagctcgtctcaatgtgttgtttgacatcagcaaatgtttaagttcgtcgtccaccaaccccaacaagcagttcagctgttgttgaagctgcgctcgttgcctgatcagaacacgttgctgcttcaaaacaattttatttttgaaaatttattaatttatttttccaattttaatcactttcatcggagttgaggagaagctccagttttcgcgctgttcactgccccgatgcttcatctccaattcggccaaatgatcccggaattttaataccaggtccacaatttcaacctaaaattacagaaataataaaaatgaaaaagggtgcaaaaaaaaatttagtgtatgtctctggtgtcttcctgacctggtttctatgacataaaacctcagtggacaaatttgcactgcacaataattccaggtactcctccttcagttgcttttcaatatgttttcgtcgttgttgcaaccagccgataaagttgggcgaccgagtcacaaattgccggtagaggccttaatgtaattaattaataattaaaatttttttttttttggaattcattttctgagtctgtgagttaattgtaaacgcaatttattttgaaattttggtcttatttatttaacagattatccattttaatcaaaagtttttaaaaaattaagattttatgtgaacttttctactaaaaaactttatagttagaaaaatccaaaaatttcaattttctaaatttccgtcctggtaaacatttttgggaatttttaatgaaatggttaaaaaaattttcagaaaattcaccctgccaatcgcctctgacacccggatgcccaaaatgttgtaatttagtcaggaattgatccaatgaaaatgggcgcattgatggcacaggttgaaaggggcataaatgacgtcgcagaggcagcaatgaagcgatgtacctaattgggtaatatatttgaaattgtgcagaaaaaagtcaaaaagtgtttttacaccacaccgttcaagcggattgatgaagctctgagtgagctccatgaaatgccgttccaatgtgtgcctttttaaagccgagtcgccggactaaaacttggcacactttaattaaaatgctgattttttttggcacccgtttgagcaacttttgcgccagcaacttgtcatccgagaggaactgacgatgcgtggacaaaaaaccgcccatggcctggttgtcaagctgtgcatggccagagagtcgtctaaaaaaggcatttttgtttggaggctgacttgtgatggtcaattttcgaacactttattgtttttgcgtttctgagtacgcgtccaacttcccagcgtccgttgaagaacgacgccgccgcctctcttccgttgccttttgctgcaattgtttcttttggtgttgtttccggtggtcccgcccttgaggcgctgtcattgtgacgctgctgcgggttgtttttgttgttgcaatgttggccaattttaagaatgtggggccaatgcgcaaaagccttcaagaaaaacggattggtgacgccgagcacaaaattgttaacacagctaaaagaaaaaataaataaaattttagaattgatattaggtgaattatgaattatatttggagtttgaatttcggaaataagcgtaggctccatgttgtacctctttcggacaaaaattcaggtccatgagaaaaatcgatggctggaaattattggttagatggaataacaaatttgaaaaattttatacgaaaatacatctttttcatacctaatctggacctgaatttctggacaagatcccgggtctgtcgattaaaggccgaaaaaactctaatgatattttcgtttggtataa

SEQ ID NO: 20026 - DNA, 1179 bp, Heterodera glycines
taatatatttaaaaccaattattttttgtcagtttctttcaaaactcacttcatttttccacatcgaatgtcggacatttttcgctgcttgccaaagtgatcttgcaaaaacttctcaaggcattccggcttgtatccgccaaaacggcttgctttcgcctccgggccgaagacgtcgtctttgagacgcaaataaagccgaagacagtcgatcaaagaagtgccatccgcgagggcaagtgccaaaatctgagaaattcagcttaatctattatccaagactattataatcggatgagaattcgataatggacaaatgattttaaattaaatttctttttaacttaccgcccctgtgcttgtcccggcgacccaatcgaaatggcgctgaacaaaattgtccttttttctctgccctttcttttgtgtgtcgccgccgtccaccaaacgctcaatttcaagcaaaatctgaaaaaagtatataaaattaataatatttacaaaccataaatgccaatgtgatcaacaagaaggcattgattggtccgaatggagatttgcagggaaagggactgacccggcaagaaaatcgaaaacggactgatggaggtgaattcccaaacgcgcgcccccattcaaaacccccaaaaacgatgctaaatcctgaaacatcctgatttgtgagggcctcgaaaaactgattcccgctggtttcgtccttgagggactcttccccccccccccccccgcgtccttaaatcgtctccagccgttggtttcgtccgtgtccttcccgatcagttccgaacgtctgtgcaccacctgaatgagcaccaatcctctgatgccgcctccgtccaatgagagcagtcgcaatgcgtcgccgttgtccttcgccgcccttcgctcgcgctgatggcccattgcgcgtcgctgctgctcgcgcgtcactttggacagcgcctcctcgcgcccatttttgaactttgtcttggaattgcactgaaaggaaagcacccattaatacctaattaattacccattaatgaccttaattcctgttaaaataataatttatatcaaatggaattgtactcgctttgcgtaatttttagttccatttacaaattcttaaatgagtagtttttttttgagtatgacttggacttttaaacattt

SEQ ID NO: 20027 - DNA, 869 bp, Heterodera glycines
tgcagtcttcttatttaatggcttttttggctccacgaacttcggtggcgcaaattccatattgtgaccaggtccgggcacggctcagaacctcgacgagccgttcattccttgaaaaatgccatttaattttgtggattgaaaaaaattggctcttgtggagtttaggccccattcgaatcttctatacactctatatcgtcatccatactcaaccttttatctttattgggtttttttctttttctaaaagttttatgtttttcgatgattgatattgtgaatagaatttcttaaaaaagaatgtatgagccaaaatttggaaagaataggaagagaaataatgagcacaaaattatgaagacacacgtgattcgcatgccattcgcagtttgtcccaatttgttcggcacgtccaaatcggcaccgaaacaaagcagcagttttacgattggcacagaaccggcctaaatagtgctgcgataagggagcttaccaaaaataccaacccgaaaatgagctcctgtagaaaaaaagtttgcatatgtggctcagtggtttttgtaaggtagtcaatggaaaaaggatggaggttcgaagccgctccatgacaccaatattttttaaatttattttcttccgaaaaattgaaaaatagttatttaaaaaaatatttttgaagatttttttcaaccaaattggacattcttggtatcattcgaaagctcttgaatagggaaagcttttcctaagcaaaagctaagcgtgataagttagaaaaagacataggcgtttaaaaaaaacgaagtaaatttaacataggagaaagcatagagaaaagcaaattctgcttttctctattagcagag

SEQ ID NO: 20028 - DNA, 2587 bp, Heterodera glycines
cagtgccatctaaatgccgcacatttaccagcgccatgtccttaccatagacatggtcatacagatcatgcgacgcaatcagcactacgcaactgaaaattattcaacatttaatttcagtaccggtaaattaaaaatatgataaaatttaactaatttatttgacaatttgttagctttttattcctaatttaatgagcttcccatttatttatagcatagaatttttgtcacctgtctgctgcggcatggtgtttactgtactcggcaaatcgttgaaccactttgatcattcccttaatttttttaatttaaataaataaaaattcattatttgaattactcacatccgcagtcaaattttggtttacaaacaagctgtatcccagctcgaccatcagcgaatggaacatcctggcatcgcattggagccgtgccggtttttctgcgagtcgtcgaacaactcattgtttattatgagtgccaatcctcgaggcgctgacgcattttgatatgcctaaaatcctttgtactaaaaaattcttgacaaaaaaatttaacataacagtaggtttaatttccgcggtttcatctttttaaatttttgtaaaatgacacggcaaaatataatgccttaattgttttgattttgttaaattgaaatcaattctaaattaattttattattttttgtccaatttcattatttttaaacggccacggctaatcagcaggacaatggccaaaaatgcatttgaaaatgacacttttggctcataaaataattaggagaatttcgttacaatggtactcattgttcgaataaataattccatatttgaatatgatgcccaaaacgaatttatttaattattaattaatagtgttcagttactcaaaaaactttcgttttaattacaatcatcatcagaaggtaaatttttggttttattccatataaatccataatatgggggggggggggggggttaggggaataaatcccatatttcggtcattttaggaaattttgacaataaaaatgcaaaaaagcgaaaaaatacatcaagaaggatcaaccttatggaattttttttaaacacacccccataaacaagaaaaacttgcgtcttttttggctttttaatcaatattttaactattttttgttattttatctttttttgaaatgagaatttttttcgaacttttgcaaatttggacaaatcgcttctgaaatgccaaaatttcaaaatcgtgttaagccttaattcgaattccctggaggagtttatacatcggacaaccaaaaaataagtttaaatttttttttaaatttatttaagcaaatattgaataaatattaatattttagaatttttggaggttttaaacttatattctggtagtttttagtctatattttaatccatatttgtcctttttcagctttttagtccatattttatgttcacgtaagaaatggttttgctttaaaaatgctaatttttaattgccctctgttgtataaactccttcatggcattttgtgatctattggcgaattaagtagcatatgctcataaaaacgtaaaccatacgatttatagccctacaaattaacaatatgttactgaaacatattggcaattaaccgcggaagcaaattttctccaatgatatcccaaatccaaaattttaaatgttcaaacctaacaaattgctgccaagatttgggcgcctctcaattcgaagagcgctccaaacatgcactttcagctttctgacgaggccggagaggatgacacactcgtccttttgcatctcggagtcagtgctttcatcctcatcacttgacgacgcttcatcagcgggagaagaagaagaatctgattcttcataaaataattttttttactgcaaaaattataaaaaatttactaaaaccaaaacatacatgaactcgttcacatgcagcttcagtgttcctttttcagtctgcttttgaagagtggttggaacactggctcattttaaacttttattaatagttgtttgagctagaaaaatgtattaaaaaattaaaataataaaattttcttaaaattttgaatgctagtgatttcatatatgaaagaactgggaaagcaaagccttttttgtttccttattcaagctttaattttgacctaaatatcttgtggaaacgatatgaagaggtgagaatcatttttgctgaaataaaaatacaataaaaattaaaataccaaaaattaaaaaatttgtatgaaagatttttggaaaattatgtatttagtgtacaagcgaagccatttttcgtaggaaatttaatttattaaaaaaatttggatagcataataagggcggaaaaatagtaattgttacatccgatggggcacacaaaaggcaagggttaaaattacatacaatttaatgccggtcaatgtgtgctaatttcaatgacacatttgaaatatttttaatctataaatattatatatttatgccattgcatcccgcctcccgcaatttgccttttttttagtaggtcattcctttcgctcgc

SEQ ID NO: 20029 - DNA, 1833 bp, Heterodera glycines
ttaaaatttctttcatttctctccccttgttttgttcattatcagtgatcacaacaacattcactcacccgcttgcttcgggtggaaaacgcaccaccacctttcccatctcggcaccatccaactcaacgaactttccctcgtcgcgcgtctgtttagccatctccaaattcaagagcaactatggtgtaattctaaatgttcaaaaattaaattcatgagtcaaatcagcatgtgagttgggatctctcgggaatggtccgtttcagcttcaaaaaaataagcgttgaaaatttgaatttgaattcaacactatgggtacgccccagtgcggtaggggacggttcggtgcccgccgtttcggtgccagcccaagttttggactacaacttttttcattgttgaccaaatctaataatttggtatcattcgaaagctttatatgtttagaagctttttctaacctattgcttagcgattagtcaattaccaaaaaatttataacatgaaataacaaaaaaaccaaaatttggaagttttttcttaataacttttttacaagctaaaattttttgttttttgtaaggctaatagagcttttgaagggctttctcatgatgggtccacctcgtttcggcgccgctcgtttcgacgccagcccagtttttggactataacttttttctttttccaccaaatctaacattgttggtacagtggcggaaaaaagtcttgactcaagatgataaaatttgttgaattttaaatttcgactggaaatttagctgattattttttgtttatgtatatttatttaccccgatatatgggcctttcatataccacaaaataatttcattccgctttatcattctcgtgaataattcttctagtcataatttttttgagcatcaacgaaattttttgaaacttagcaggctaatagagaacacttagagctttcgaatgataccaataatgttagatttggttgacaaagaaaaagttatagtccaaaaactgggctggcgccgaaacgagcggcgccgaaacgagggtgtcccctcatgataccaagattttagatttggtcaacaatgaaaaaagttgtagtccaaaacttgggctggcaccgaaactgctggcaccgaaccgtcctgttccggccccagtgttagacgggtcggggtcggtttagtacgggccgttttagtacgagcgcaagtttttggctataacttttttctttgccaacaaaatccaacatttttagtatcgttcgatagccctaagtgttctctattaatctgcaaaattgcgaaaaatctcgttaagcttcaaaaaagttatggccagaagaattcaaaaaaccagatttttcaacttttttggctcgaactttttttaaactaaacaaaattttttgaaattttgcaggctaatagagcatccgaagggctctcgtatgatattaatagtgttggatttggatgtctaagcaataagggtagggatatgtgagcgttagatctaatggtggggttctcatttagtgaaatgataaaaatagatgaattttataaaaaactatgaggaatcatattttgtttatagtaaacccacgagaatacaaaacgaaaaattgaagataatctaatttctgaatagtgattgaaccaggggaaagaataaggaaatgtcaaggagactaggcattaggacatttgcaccctcgagaatctgtgacttatagagaatatagaaattattatggtattagttttccctttgacgccagttttcgtcactaattattcactcagaccccattct

SEQ ID NO: 20030 - DNA, 2117 bp, Heterodera glycines
tttactttaacttctcaatcgacctttccttggcccctctactcccttttaatttcccttcttaaaacagtgccaactcagcatcaaccactgaggaagtccttctgctgatcaattccccatcggcggaagacaacaaagtgccaaaaagcgaacagaggaggacaaaggacgaagaaaggagaagcaaagcgagaaggacggtggaaatacgcgtggacatgggacaggacgaattggaaaaactaatggaacgggcgagcggcaccaccacaaccatcgaatgggagagacggacgaatggacaaaagtgatcaacggagaggaaaatgatcaaataggggacgaagcaatgaacgggcagaaaatgatctctcggaggacggagtgatcaattggaggaaagtgggaaaatagtcatcggaggatggaattgaccaaaggggtgaaaacgatatttatataaataaattaattaaaatagacaaaagacacgactgacaaaagtgaagttggccaaataaagcatttgggtagaagctcagtcagtgggaaatgggaaaacgaaatgtgccattgaaaatgggaatgaatgatttattgtccgtcctctgatcagtttcccccttttgtgccattgttttttcttcccttcaaatgtgttggcactttggtcagttgagttcgcttaatatttcgcaatttccttttaattttcgattgtccaaacttcgcttttaactgtccgctgcagaaaagcctcaacagaaagtgtccctcctcgtcgggttcgaaagtcgaagggacaacaacgtattggccgggggccaatcggaaacgagcagtcacctaagggaggggggagggggcagctgatcagacctgtcacatctgatcactccttttttctgatcacctctctcaaattgatgaatgacgcacttttggccactgatttggccccttccaaaaactgttggccaattcgttttgggtttgtctgatattggcaattttgctgtttgggcaaatgcgtttcatacgtttggccgtacaaaatgcttaaacttaaccaattaaaatcagtttgttatgatcacattattatcactttatctgtctctcactttcctttttggcattgcatttgcgggagactttgataataatttgggacgaggggttgaagctgttgctgaacatgatgttgttgctgttgcacatatgcgctaccgtacgaatttggctgtccatagcccggcccaaatcccctaaggcaattaattaattggccaaatgagtccaaatcacccaatggcaccaaatcatctaatgaccaataaaccaaatgtccaaatcctctaagataaattaattcccaaaatgaatgtccaaattgccacgatgggccaacccactgacaagctccttccactcgccggtgcttctgcgttctgtcgctgaacgtggctaacttgtgctgtgtgcttttgctgctgctggtgcttctgtccctcctccgtcccttcgtccgtcgcataaatggcgaatccaatggccaattcgtccaatccgaccgcgcgcaattctctccggtatttctgcagcactgcgcaaatcaccgtgcattttccgtcatcctccgttccattgtttggtgaaatgctgaacgaaatggtcgtcccaaactgaggattattcgcaaaagtggctgaaaagagagaaaatgaaacgaaatgccaaattcaaatgccatacgaaagttgcgacatccgccggcggtgcctttctgtcgcgaccattcgccgtccgacgcaaactgcgcccattgtgcgctcgaccgaaggcacgaagggacgtccgaagtgcgcaagtccatcatgctacagatttcgtccaacacctcagggcccaagttgcagcattccattcgctggcaataagcaacggattggagaaagtggcgaaaagggggtgccttcccccccaaaatccccccccccccgccactttattggatctctccaatttgacagcagatcacctaccttccacactatccggagacccatttgttgaccagttcctctcctcacccccccccccccccctgcctc

SEQ ID NO: 20031 - DNA, 1893 bp, Heterodera glycines
ctccttcggtccgaattccttgtccttttacaccttttttccttttcatcaaactctttccgactaacaataaggttgataaaggcgcttacttcttgtagggatggatttgtcgttttactgagaatgagttcgtttattgtctcttctttcagttgcactcaatggacagtcattcggatgaaaaggttcaagtgcgtcgaatgtcgttgaaggaattcacggtgggacaaaaggacggcaaaaggggcgaaagggacactttgcttttagggattggacgtggaggagcagcgtcagctgaagtgcatgcccaataataagtgagtcatggcataacccaaacaatcaaattaaaaattggtgttcgactggtctcgtgccaccgtttctttctctttttttttctaagtgccgaggtcggaggcgcccatttgccctttgggtcgcctttgctgcacccgtggaagggcggctcgcaagcattgggcagtttgatcgacaagttcagcactcggcgccgctcctcttcctctgccgcaacaaaattggcagttgggggaaggctcggcacgacgcccgaagcggcggtcggacaatgggaggagggcacgtcgaccaatgcatttgacagagcgatcgaatgcatttgcgaagcgatgcaggaaatggcgggggacaatcagaaactgacggagcaaacgctgcagcaaagggacgaggacggaggcggaaaggagacgggcagaggcggattcggacaaacctaccaaaggtacgaccgatcagtgcccaacagagcggacagtacatcccaggctaacaaacatccgaaaccgattgaactccacgctccaatctgtgcccaatgtgagtccgcgaaaagtgccaccggtggagaaggaaaagctgattttgttgagcgaatgtcgactgttcgttggcatgtacgtttttttgttcttttccccggccttactcattattaaccgtttcgttaagctgtaaagagatggtccgttgtccttccgcctcggtttgttcagcttcatcctccgtctcttctgctgatgattcttccatttcgtcaaattcgcttcgaattactcaaaatgcggtggaaagtgtcgatcggctgacccaaagcgtggaaatactcatccgcaagagcagctccatattccaagcccaacagctgactaccaatgccgaccaggtcagaagaagagtgccctcggcggatggccaaacaatcgcaaattttagcttttaaaaacactgacggacactttgaaagaagttgaaaagtgccagaaaggtggccaatcgcgcggctttgatcagacgagggaagtgattagatgcagcacatctttggccgtcacgcttgtccaatttacgcagttaattcacggcctctgagtcggcatttcggttgaatggaattggccataagcaccggttctttggaattttactttgttccctcactgatttcacaatttccaattctatcgaaaataaatttcctttcaacaaccttagtgcttttcttttgcgaaatcacgtgcccgaactccgaacgaactgagaaaacgccgatcattcactcactgcccattgctcacgtcgttttgtctctttcccccaggcactgatcgattgattaatcattccgggggcaaatgctcttcgaaagcatccgccaaagggcagtcactcgttcaatatttggtcctttctatcaaattttgagaatttcgtgtcaacatcagcaggcggaaattggctggcaaaatggtggatattagctttagtcatacatttgaaaaacagacataatttgtttggaattctttcttggcttttttccatgtcatccaaacccaacgc

SEQ ID NO: 20032 - DNA, 2270 bp, Heterodera glycines
aaaacaaataaatgaaaaagcaagccgattcacgaccgatttggccagccctgaaaacccccgatcccggggtcggggttctattgcactttatgagtccaaacgcatattttttaagagtccaatttgagtttattagtccaatcaattaaccatactgctggtttaataactttgttcatgttcgaataaaccctaaattcttggtatcattcgaaagtattaagtctgaagaaagtaataatacgagaaaacaagaaataaatgctgagtttttacatattttagcttttttataacgccataggactcataaaagtcgatttgactaataaatctgggtgccaaccctattttaattcttagctagtgaaaataataatgttgatgatttaactgttatgtgaacaaacttcaccttatttttcaaaagtttccctggcttactcccggctcaaactagccaaagtgtacttcataaagcaaaaaagggtctttgcaatctcaagttcctcaatttccgtacatttttgatgaaaaacaatgcgaataatttagttaaatcataaaagcggtatggttttcagacttcgtttggcgctcaaacggcacaatcgcatgaattcatggccgacactgcacaaaccgaacggtccatcatcaacatgatactttccggtgctgccttatattcggggtgcaattttctctgatgattaatccggtggatttgccgagtcttgtgaatcatgccgggtttttggcttatgggagtttatttttgctcttaaatttggagctatttgtagaagcaaatgacatttgaatgctttcctgttctctctggcaacacttgtcagggcggcctctaccaatttgaaacccccgcttggctttgagaaatataagtttatttaaagaaaaaaggtttaaacaaaaaaacaaatatttaaaaatgatttttaagtaaaaaattgaatttacgcaagaattggagagcagaggaaaagaaaacaaggattgtgagcggggtgggggggggggggaagagaaaactcctaattgtggtcaaatataaatcactttaaatactggtcgcgagcggcggatagagaactactggtttaaagcgcactgggacatttgcggacaatttcgagtttcgagaaataataaaaaatatttcttgaattttcggcacatcaaagaagaggcagagagagtacaatgcttggacaaaacgccagaggcgatggggacagggtttatctgcacaaatccagtccagaatttccacagttcttttacaaagaggttcttgacaaaaaggctctctgcccaatggcacaataaaaattttgccaatttcctcttagacttgtcactcgcccccgctttccagacagacaattgccgttggattcgctgcggcgcattgaggaaaagctgcgccaaaagcgtgccgaaatggagctgaacgacacgcggatgagcgcactgctgttgcacaactttttggagttgatgatcgagaagcgtgaccaaacgctcaaacaagtgcaaggcaatgatgattgtgatgttttctgtttttttgcatcaaaaccaacccaacttgggaaaggggcaggcctgcagcagcgagggggagagtaggatccccaccccgcccgaactgaaaattcaaaattttttaataattttcctaaaattttccccgacgcctcctattgggaccaccagattttcattgaaattttagcccgaatagcaaaaaaaaaaagaaaaaagatcttcggattccacccaccgacattttttctggatgcattctgttaccaaatttttctaacgcctcatttggctggcaaaaaggggagggaggggcagcgcttttttctctctctctctctttttctgttgtactttttttccgcaatattttttaatatggtaattttttttacataatttgcagcaatcgtaaggatgcattgattcaattttgccaattttttgtagctgagcttgagcttctaaagcaggacagacagcgcgtgttcgcctcgctgatcagtgacgacgaccaacagcagcagctgatcagtgctccgtccttgcagcagttggtgcccgatttgtccgcaaatattgccgtcgctgctgctgcttctgctgctaaacacccatcggcttcaactccggttgctgctgctgctgcaggtggtgcttatagaggagcagctccgtcggatcttccctacccctcc

SEQ ID NO: 20033 - DNA, 2713 bp, Heterodera glycines
ccggaaaaaaaccgaaatttttccgacattataccagtcgatagagcttgaaaaactatgttttggaagtggtctccgtttctctgggaaaaatcgttaaaaaatcctaaaattcaaaaacccgaaaaccgttttttaggcctaactcgaaaaattttgaaaattttcgaaatttttaaatttcaaaaaatcgagctttcaaagctctacaataagttcgctggccaccccccgctcagatcaaaccctggcgcggtattcacctggtactgaagtgtactttttgagcacgcttcagttgccattttttgcaggccaggggtttgctcaaaaaaaattttaaaaaatacctctttgtagaggacccttaggcggagacagtgatcagaagaggtacaactgtgattaatttgaaatgtacatgaattatatatacatttaaattgaaattaattttttgacaaattctaattaaaaaacaaatgaattctttaatttaaaaagaaataaataatcaattttaaatgtcaaacatttattcatcacaaaaaaaaatttaaattcaaaatttaaaaatttttgtattattaataaaacaaaaaactattttcaattaattaaaagcatttaactactcacttttacaaaaaaaaaagtcaaaaaaacttgccgaaattggaattgtcatcaaaatgtttgtccaccagagctcattgaaacggtgcaaaagcagtgccaatttgaggccgagttgagaacattcaaaaaaggggaaaaataatggacgatttggacggagaagcatttaatgtcatttgttagcgcacccacagaatttgccatttaataaattaaatagagcctttaaaaacttttagagataaaggttggcttgagattaaaaatgttataaaaataatttaaaaatagcaattactgatttttaataatgaatattgcaagaataaagtgaaggatgtcaaaacaaaaatcaataatgaactttttattttttaagaaatttgtcttaaaaacaaaattagaatcataaaaaaatttgtgaatgatcttataagataaataatacagttctttttttaataggaaattttatttgtatgtcattactaaatttgacaaagtgaattacaaattttaagcaaaaataactctaaggaagcaattatatatttattttttcattcaacaaaacttcttcgacgaatgcaaaaaaagacgaaataatcaatagcacaccgtgtcccaaacacgagatgtgtcaataaaagagggtgtagagaaaaatgcaaattttaactctatcgaatattacgccgactatgaaatattaatgacaaaaaatgggtaattaaaaaaaataaaaagtttattttagtgattaaaagaggtacaaaaatgatttgaagaggtacaatattgattagaagaggtacaataaatggtagaagaggtaaaatagtgattagaagaggtacaatattgattagaagaggtacaataaatggtagaagaggtaaaatagtgattagaagaggtacaactgtgattaaaagaggtaaacattgattaggagagatattagatgcattataatttataaaaaattttagaacaaattctacttttatttaaaaaataaacttgaattgtttaattatagaatatttattaattaaattttatttttttacaaattcaatttaaattgaaacatgatattctttaattttttaattcaaaatttaaaaattatttttaaataaaattttcaccaaaaaataatctaattcaaatgaaaattttttatttattattaataaattaaaaaatattttaaatgaataaaaattgaaaaacacaaaataaatggtagaaaattaatgtacaccgtccggatccgaacttgccccccccccccccctcaaaatgatgccccagaatccccaatcacacagggattctgaggcctaaacgatgtcaaaagtaaaatctgattacgtattcgtgatcagcggcccaaataaccactaaagacatgtttttggaagatttttgtgaaaaaaaatttctcaactcaaaaatcctgtccaccccctttggtcccgaatcccaaaatcacttttatttttgtatctttttttaaaaatgtgataaaaataccaaataaaatttatataatagaggaaaaaactacggatttttgtagtattttatttttccagaatatcttttcagaaccgagttatgaatttttttctgaaaattcgaatttttccagaaattctggaataacttttttccttttttagatagaaattccaaataaagtccataaaattctcctgatttttctctatttttaagactttatacctgtaaaattgatcaaccctttgatttgttatgaattttcaaatattaggccaaaatcccgtgggccaaaaaattgccaaaaaataaagaatttttaaaaaattccaaaaattatgaaacttaaaatagacattatattcgtactcagcaccttattttaccccagaaaaatatttttcaccaccattttcgtccgaaaaaaaatttccgaaaatttctagggggcctagctcgaaaattttttgaaattttctcgacctatcctacaccattcgatagagcttcaaaagctctacaaaaatgttctaagacaattttt

SEQ ID NO: 20034 - DNA, 750 bp, Heterodera glycines
acgaaataatcaatagcacaccgtgtcccaaacacgagatgtgtcaataaaagagggtgtagagaaaaatgcaaattttaactctctcgaatattacgccgactatgaaatattaatgacaaaaaatgggtaattaaaaaaaataaaaagtttattttagtgattaaaagaggtacaaaaatgatttgaagaggtacaatattgattagaagaggtacaataaatggtagaagaggtaaaatagtgattagaagaggtacaactgtgattaaaagaggtacaacattgattaggagagatattagatgcattataatttataaaaaattttagaacaaattctacttttatttataaaaataaacttgaattgtttaattatagaatatttattaattaaattttatttttttacaaattcaatttaaattgaaacatgatattctttaattttttaattcaaaatttaaaaattatttttaaataaaattttcaccaaaaaataatttaattcaaatgaaaattttttatttattattaataaattaaaaaatattttaaatgaataaaaattgaaaaacacaaaataaatggtagaaaattaatgtacaccgcccggattcgaacttgcccccccccctcaaaatgatgccccagaatccccaatcacacagggattctgaggctttatcgaaatccaaacggaaatttgatcacgtattcgtgatcagcggcccaaataacccctaa

SEQ ID NO: 20035 - DNA, 1255 bp, Heterodera glycines
ccccattttgtctaattgggtctttggattaaatcaaggttcctcttagtatttcggaggtactggataactccgtgattccgtcgtttccattggccaataaatcattggcggaagtcaaattcaggcgtgccttggggactgaggtggtcagtacactacgaattgttgaggacatttttatgagatgaaaaaggttttttttttttttttttttttttagttttaaatgtttttttttatgaggaaaattagggatggggttctgtgtggctcagtcggtagagcaccaccagactcttaatctttttctatcgccgccgttttcggagtgggaacggcggttcagaaagtatgggaaaagggatggaaaattgcgtttaaattttgggtggaaaagaataaattggagaatgtgatggcttatggtttgggatggaagctccaaattcctataggaggaatgagggcaattggttggaaaaaggggtttccttatgggaaggaaaagtgaaaggttttctggataaaacctttattcaaaaacgcaatgaataatgtgaaaaattgaaatgtgtgaagaaaattggatcgtttgatcgtttggaaaaagatcgtttgataactgttggatagcagttaaaaaatgggaaattgaattcggtctagtggctcttccttcgttcttttatacgggttcttcttgggcttgggcgtggatccaaaaaggggcggtcgcacagatgagcatgttgaaaagcgcatggggcaaatggtggacatcaatgacaagaaaaaatggggaaaaacggattaaggggccagggaaagaaccatggatgaccacttttaagggatttctcagattaatttcaaaaagtggctctcattaagacaaaaatttatgaatacggcaaaaagtaaagttaacaaagttggtgatcaatgatcaccgccaattttttctgtcggcgacagaaaactccccccgggcttaatcctcttcagccggctccggttgcttttccccctcttccgctttcttcgcctgtttttctttcccatcttccgcttttctcgcctgtctctccttctcatcttcttgttcaccaatttgggcctgtttcacgatgaattggaagaaacgagaaaattcggccgcgtgcttgttcaacgcatcgctaagggtattgatctcagaaagcacctccgtgaggagtttcttgacccccaggagccgggaacttttttggga

SEQ ID NO: 20036 - DNA, 971 bp, Heterodera glycines
aaaacgtgcttaggaaaagtcttcttatttaggatatttccactgacaacgatagcgtagattctagcaataaatttaataactaccaaagtgaaacaaaggctaaaatgtgagtgatttttttaaaaaaggccgcacagctttctggcggaagcatttttctgaacctttttctcagaaaaaaatagtcgcattataaaattaattttcacccattatattggttgttagacaatattaatatcttacgcgctaggtaaagcgctggcaatttcgcttttttaaattggcgttacaacaagaaccttaaacgatatgtagcggcaccgaataataaaaataaatcttttatcgtgttcacattgttaaaaaattgaaaatgatgccatcttgcatggattcaacaaaagtatgttggcttatagaagtgaaacggaaaaatgttcgaatatgagcagaacattaaagacttggtgaatcccggtaacaaaatctcaatttagctaggcaagcactcacagaagtgattccttgaaaacaggatgcataaccttggcaacttattaggagattctggcaataaattaagaaacaacaaaacagaaagaaatattcaaaagtgagcaatttttttcgaatgggccggattcttctgaacattttatttttcttaattttctttgctagaaattatgacattattgcaaaactaattcacggcccttttttgattagagacaattgaatatatgcgaaattttttaaaaacgtgcttcggaaaagtcttcttatttaggatatttccttgacaacgatagcgtagattctagcaataaatttaataactaccaaagtgaaacaaaggctaaaatgtgagtgattttttttaaaaaggccgcacagctttctggcggaagcatttttctgaacctttttctcagaaaaaaatagtcgcattataaaattaattt

SEQ ID NO: 20037 - DNA, 2362 bp, Heterodera glycines
  misc_feature (18)..(18): n is a, c, g, or t
  misc_feature (55)..(55): n is a, c, g, or t
ggaaatagaaaaaaattntggcctgagcgggacatttgagtcccgggcccatacntcgtcaggagttgtttttagccaaaaatgaccttagagcaaaattgtagagctttcgaaactctatcgaatggtgtactacatgtttggaaattttcaaaaattttcgagctaggccccctagaaattttcggaatttttttttgggttgaaaaagagggtgaaaaatatatttctggggtattttggggtcctgagcacaaatatgatgtttgtttttcgtttcagattttttggaattttttaaaaattctttattttttggcaattttttggccctcgggattttggcctaatatttgaaaattcataacaaatcgaagggttgaccaattttgattaaataaagcattaaaaatggagaaaaatcaggagaattttatgggttttatttggcttttgtatcataaatatgaaaaaagttattccagaatttctggaaattttcgatttttcagaaaaaaattcgtagctgccttctgaaaatctattcgggaaaagtaaaatactacaaaaatccgcaatttttttctctataatataaattttattttacatttttatcacatttttaaaaaaagatatagaaatagaagtgattttggaatttgggaccaaaggggtgtgtaaccaggatttttgattgaaaaaattttttcacaaaaatcttccaaaaacatgtcattaggggtaatttgggccgctgatcatgaatacataatcagtttttacttttgacatcgttaagccctcagaatccctgtgtgattggggattctgaggcatcattttgagggggggggggcgaagttcggatccgatcggtgtacattatttttctgtgcatttttgattacttttacatgttttattaatttcaaatattttttataaattatttaaatttatttattttttttaattaaagaatttcattatttattttttgaatttgtaaaaaaattaatttaatttcaaattaaatgaataaatttccaacgttgtttttaattaataactaccattttttcctgttttcattgtgttattcatttaaaatattttttattttattaataataaattacattttttatttgaattaaatttttttttataaataaatgttttgttttaaaattaattatttatttattttaattaatttaatattgtttgtttaattaaatgttttaatataaaattaatttcttatttatttttaaataaaagaaggaatttattttataatttttaaaaaattattaacacatttgttttgcctcttctgatcactgttgtacctcttctgatcacagtgtacctcttctaatcactgtttacctcttttagttattgttgtacctcttttaatcatttttgtacctcttttaatcactgttatacctcttttaatcatttttgtacctcttctaatcactgttgtacctcttctatttactgttgtacctcttctaatcactgttgtacctcttctaatcactgttgaacctcttctaatcactcttctaatcactgttgtaccacttctaatcaccgttgtacctcttttaatcactgttgtacctcttttaatcatttttgtacctcttttaatcacttttgtacctcttttaatcactgttgtacctcttttaatcatttttgtacctcttttaatcacttttgtacctcttttaatcacttttgtacctcttttaatcactgttgtacctcttctatttactgttgtacctcttctaatcacttttgtacctcttctcatcacttttgtacctcaaaatttaaataacgggcgctacgcgcccgtccaaggccgcgaagcggcctaacaagctaaaaaacgggcgcgaagcgcccgtatgagttcaacgaatttaaaaaacgggcgcgaagcgcccgttcgaggccgcgaagcggcctaaaaatcactgaaattctttaaaaattcaaaatctcttcacaaccagatagctaatctaggtagcgaagctcgagaagcgcgaagcgctttccccagcgccaccctcgcatgcaacacccgctagttatatatacgttatattgacaaggagtttcgtttcaaaaactaatttgagcttaacggctaatgggacgggtctgaaagtagtggaagggtcttacaactttttgaggagaattcgggaaaactatagagaaaaattctgcgcggacgactgagtcccggggaccgatttctcactttttcttgcgtttgacggcccataactttttttctgaaacccgaatcaaaaagtgcccgctg

SEQ ID NO: 20038 - DNA, 2400 bp, Heterodera glycines
  misc_feature (8)..(8): n is a, c, g, or t
  misc_feature (140)..(140): n is a, c, g, or t
gctattgntctatcatttcgccagcacacaattagaagtcttttcagcgcaattctcgaatgccacgatcacgctcaaattcatcgtcctctgatccgatccatggcttatatacattttccctttatcttttgtagtgnaagagaaaagcgccggagggaattgattattgggccgagatgaagctggcgcccgaatagttttgttttgttattattattatttattgttcttttgcttcgttttttctttggtaaatttgattgttttttttgtgtcttgaatttcgcctttttctgtcatatacgaaagagcagaccaagtttaaaaaatttgtagtgaaaaaagttatttgactctacgcccatatccaagaatatcaaaaatattaaattttccaactttttgccactttcttcattaaaaatttgggtgaaagggactttgaaatttttgttggcctaattaataatttacttaaatttaaaacgttttgcattcgtttttctgtctgggttcattgccacctgtgtagaagaaaattaaattacctgtccatcactttctttatatttagtaaattttgaaaaaaatatttattttccctcgccaaatgaggtggaggaaatgtaaaggatttcgttatttcggatcacgcgcggacttcttccgtagcccgtagtctctccccacctactggccgccgtagtcgagtgtgcggcggttttttagcgcaataagctaaattcaatcttttatatttgacgttcttttaccattttctgactactagtttaaaatagttttaacaattttgaggacccataacacgcgtcggttcgacttcattccctgatttttagacttagctcgttaagagctttcgaatgatacaaatttgttcaaaaatttttatttaaaatttcgaatttttgttcgaattcggtcaatatttaccaatataaggcataaattacccgtttaaatcccaaatttcttacgaagcttctgtatgcgtaatcaaaacgctggtgccacccctgttttttacataaataggtaacataataattttctttccctccgctgtttctctagaagttctaattgacatagtcatagaacacaaaattcaatagaatattggagagtgggcaattctttgatgtctgcatttgttgctccaaccaccacacatcgccgcttctcccatttcattagttttcctcgctttgcgggggagcaagtgtttgtgttttgaaatgagagaaagaagtggagaaatgtgtgggtgtgctaatctgagatgtgtgtacatgcacccctgtgaaattctgttgctggctgggaaagtttagaaataaaatgggattaggtgaaagagaagcgaaaaatgcgtggtaatacacacagagggaagttgcagcaccagcggcccgctttatactcccaccggctggtcgtacgcgcctttccccacctttctcttcatctcttaaatctctatgcaaacaattttcacttgggctcgattcaatttactctttctcgcattgcttcagatgacaacattattatatccaactgacttatagatcggggaactagagaccgcgctttgtagattaaaaaacaccaaatatgatagccattgtctaattgaccaaaatactacaagaaatggatcaaaaaatggcaaaataatctcatatactatgtgtatgtattgccaaaacattactgtaattaaattttatttttttcacgccatttggattttaagactcactccaaactggctagtagaatgaatttttaaattttccacgtaaagtattaactaattctacataagacagatttaaaagacgacaacaattaatacataatctcactatcgttaacaacttcatcggttctgctagcatttattttcatcgtcttccacacacagtgctacaggctttctcaacaacaaacgactgtaatcgttccttcgacttctcatagtcaggataatctttagctagttaaataatctcgcttccgcagatatcctcctaaaacattgttctcagaacattattccaaaaaaacaaccacggacaaatcacagcaacttgatcatcgtccgcaacacgaaacgcggaagttttcaactttgggtcgaagcagcgctgcaaacgcttcaactacgcctctggctggacttagttaaaacatttatttgatttcgatcatctcaacttttaggttcaccgagtaacacaatggctaatgctagagggccgagttcatcgacctcaacctcaactaatgcatcggttggcgttcttatggtcgggccaaatttcaaggtttgttttattatttagttttttctttctcccactaatacta

SEQ ID NO: 20039 - DNA, 2460 bp, Heterodera glycines
acaacaattatgctcagctttttgcaaactggtgcattgcgatgcgtggaagggtccaagaaatccttgataagccagtttacaaatgggaccattcggaatacagctgcgttaaactgtaatgcacaaaaatggaaaaagaaatttggtgaaaacattttttaggcacacaggtctctacattatctgttcttctgcacagcgtggagaggtgctaaaatttgttaccaaaaatgcaattttgtgtggcaaagacaaagtcgtgcaaacagcagttgggaacacgcagaagtaaaagcaaaagcaaaactaataggtttttaattttgtccattatttattgagatttgtactcattcctgtgcatggtggtaaaacaaaacgcagtcgttttttgtgcttagaggccggcgttgttaatgcttttaaatgcttgtattattacaatacgcttaaacaaggagcaacaaacgcgacaaacactttagccgagggccttttgcatgcaaatgtatcgcactgtagcagcttgaatgatcaagcattgttgaaagacaaaaacattaaccggtataaagtgaataaaataaaaaaacaatgctaacaacaacattgtaatcatcgtctttagcacaatgagaagacaccacagtgccttgaatggcaatgtgtcgcaacagtgtttgaccgtgcataaaattcgtcatgctgctgcaacagatgcaaaatgtttttgcttatcaaagcaacgttagtagtatagggatcactttcttggccttttttttgccccccccccctccctcgcgcactcaacccatattcaaatgaaagccaaaaaaattgatgaaaacatgtaacaagtgatcagatatattattagtcggatgtgaatttgtcgattaaggcaacaaaaattagaaatgaatgtaatatcgattcatacgattttcaggcccccaaccacctcataaaagattaacatagatgatttaagaaaaatgcagaacgaattgattgaagacaaatgcagaatgatctgataaaaaataattgaaataaaaatgacggagtaatctaacaactaaaataacaaatgaaataaattaagcataatgattattagttacataaatccccaccaccaaaaaaaaaaaaatgcaggaatattttggagttttaaaaaaaaagcaattaatcatgcaaaattttctctctcaccaatttggtcgcccatttttttttgtgttaaaaaaataaagtggatggaacgaaatgggacggaacgtaaacaaaagtttttttttgatggcattaaaagtgagtttggagattgaaatgtaattaatcatacaaatttttggctttcatcgccgttcggtcgactattattggcaataattccaaaaaaagagggatggaacggaatgggtgaaaagggaaaggaattaggtgcgcatttagtgaattttgcggagccaaggacattttttattagtagaagctgtcaatcgtccgcgttccatttgcaatcttgatgtggcatccattgggcggacgactgctatttaaacgcgtagaaaagccattgccgttcattatttctcaatgttttcgcttttcttatggttatttaaatgcgtttatttaaaattgcgtatttttaattgtttattttgagatgccattttcatttgacccaaaaaaatttatatcattccctttgatagggatagaaccagttttggtacatcctaactccgaaatgaattcgcttcctgccaaccgtccaaccgctcctctcccacttttccaagctattccaccccgaattgctttaccaattcctcccccaaattttccaatcaattctgcccatcaaccaattcctctcttctgtcctcctccgccaagtttcccaaattgtctgcccaatcatcaaccaatcccgatcagcgctccccaaaattttccaatcaattctgcccttcaacaaattttccgttcgtctgtcctccacacccaagtttcccaaaccattcgccccatcaccaacacatcccaatctgctgttctccctcccttttgccgttcaattcgcctcgtcatctcgtcccaatgccgcttcacgttcctgcttcctttccgcgcccacctctccaaacattttttccacgtccacccccacattaccatgtcctcagccgttctccacgtcaaatcagcaattttcaaatgtttgtccgacgccattaatcagccatactttagcgccgataagttcacgtaatttcaatgattcacatattttttagaatataattatttcaatttaagcaccatcaaaaaaacgacaaataattgaggacagagcgggtaatctattaatggaaagaaattgttaacaaataattgtgataaaaaagcaaactaattccttatatttagaacgctggcgct

SEQ ID NO: 20040 - DNA, 2799 bp, Heterodera glycines
  misc_feature (94)..(94): n is a, c, g, or t
ctttgcagggatactgaaaggaagagaaataacctatttcatatattatctagtcagttcatttaaataatttttatccaaaaaattttttttntgggttttcggggcagtccccctgaaccgatgcgcccagatttatggggagaccgaatccttccggaatagcttcactatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaacggacacttgaaaaatcgattgtttgttcataatatttttttcagaagtcatgcgcacccgtccgatctggcagttaagcaacgattgctgactaccaaaagggtccgtgccgtgatgaaacgaccagcactgcctacccccgcgcacccggccacggtcccccaaggaatggaattaattaattttctccttccggggatttttttcctttaggtcgtccggtagcgttcgattggttctaccaatttttcaaaattttttttaaaatttgccggtctagggggggggggggggggggggggggggggggggggggggggggcggcgcccccccccccccccccccccccaaaaaaaaaaaatatttttttttttttttttttttttccccccccccccttttttgtttttttttaaaagaaaaaagaagggggggggggggtttttttttttttttgaaaaaaaaattttttttttttttattttcacacccccccccccccagggggggggggggggggggggggggaaaaaaaaaaaaccaccccccccccccccccccccggaaaaattttttttttttttttttttttttttttttttgggggggggggggggggggggggggggggggggggggggtgttttttttttttttttttttttttttttttttttgttgggggggaaaaaaaaaaaaaaaaaaaaaaaaagaagggaggggggtgtcttcctgggggtgggagaaaaaaaaaaaaaaaaaaaaaaaaaaaatttttttgtttgcttcttttttagagagggcgcctgatttttcctccctccccccccctctcccccccccccccccttttggtgtggttgggggggggggggccgaaaaaaaaaaaaaaaaaaaaggggagaaaaaaaaacaaaacttttctctttttttttctcctgctggggaaaaaaaaaaacccacaaaaaagtggggggggaatttggggttgccccccaaattttttttttttcaaaaagggggggggggcaaaaaaaaaggggcccaaaaaagggggtaaatccccttgggaaagttttaaaaaaaaaaaaaaaatttttttggcacatttttaaaaaactccatttaaatttccaattccccctttttttcccccccccgtgtttgtggtttagggttgggaagcggcaataaaaaaagccaaaaagggggaaaaagaaacccaattcccgggtttgcctttccggtgtggggaaacgcaatgcccagaataaactgggaagactttggggtaaggcattcaatttatttttttcaaggatgggatcggggtacaaaaaaatacgggtccaaaaaatgggtgtaatcccgcttggagatgcgttagaaaagaaagaaaatattgttcggacagcttttgaagagctgcattgaatgctgcagtcgccgctgctgtacgcccacgcgttgctgagttagggtcgagagcggcatgaaaaaagacaaaaaggaggaaaatgaaacaaattcgcggctttgctctcgcgttggagaaagcaatgcgcagaataactggggagacttagggttagcgcatcaattatttttttcagaatgtgttcggggtacaaaaaatacgggtccaaaaatgggtgtaaatccgcttggagatgcgttagaaaagaaagaaaaatatgttcggacagcttttgaagagctgcattgaatgctgcagtcgccgctgctgtacgcccacgcgttgctgagttagggtcgagagcggcatgaaaaaagacaaaaaggaggaaaatgaaacaaattcgcggctttgctctcgcgttggagaaagcaatgcgcagaataactgaggagacttagggttagcgcatcaattatttttttcaga

SEQ ID NO: 20041 - DNA, 1559 bp, Heterodera glycines
atttgtctcctctccgccgcttttcttctttttctccctttccatcggtgcgttcggcttttccctttttgcttaagccgagggcacatcagacgcctccgcttaaaaaggggtacttgttttgttatgccaaaaagggactgattgtgggactcacccggcgcgccttccgccgggggcgcctcttcagctgcgggcggttgttctgctgcaggctctgccattgtttatgctttttggttttttcttttgttttatacttaccggctgcttccggcgcgggggaaacgccgtccgccggcgtttcctcgggggcagcgggcgcttccgctggcgttgcttcggatgctggtggagcgcattcagccgctggaacctcggctgggggcggcactgcttcttcgacagggacagcggcgggcgcctcttccgcgaccggtgcttccgcagctggcgcttgttcctccaaactcagctgggcgacctcagcagccggcgcttcttcggctggtactgcttcagctggcggggcagagacgggctctgcctctgcgggcgcgacttcaatgggggcagcaacagcttcttccactggcgcttctgccgctggaacagcttccgaaacgggtgcctaaaattgcgcgttattccaacttttcccacaaaattcacctcaggctctgctgcctttggctcttccactggtggtgccggttcaacgggcgcctcagcaggcggtgccgcctcctctaccggttgcgctgcttccgctggtgccgcttcaacgggcgcctcagcaggcggtgccgcctcctctatcggtggcgctgcttccgctggtgccgcttcaacgggcgcctcagcaggcggtgccgcctcctctaccggttgcgctgcttccgctggtgcagtttcggccgccgcttctactggcggtgccgccgcctcctggacagggaccgcttcagctggtgctgcttcggctggtggcggttgctctgcggctggcggtgcgtcgtttccttcggcagacattgcggcaccttctttttgttgctggggcggaattgtgtcttctgcgacgggggaagactgctgctgttccggctgttgtttggagaaggggcagagtttagtccagaaaggaattttcgaggataaggagactaaaagtggaaaaaaagtgggaaagtgagttgatcatttgtccattttgaataaatggcacgacaaatgcaattgtcttgggtaaggtgttttgtcgcgggttacgcgttgccaatgggtcactctgtcccccgagggttcggatgatttgtcctttccttttgccattgcccaaagcgttttcttaaagagcgagcagagaatgagtctcatcagccttctatgcactgaacatcatcagaatggatgggccaaccgtttgaaatcggacattttattttgttcatgcttgtcagcctttccagcccgcccactcggtccattctcaaatgaaatgaaatgaacatttgtccgttcgttttccgtcatttcgtaccgggggaggggcaatg

SEQ ID NO: 20042 - DNA, 73 bp, Heterodera glycines
ggaagagagaaagggaaaaagaggggaaggggaaaagagaggggggaaagagagaaaggggaaaagaggggaa

SEQ ID NO: 20043 - DNA, 2456 bp, Heterodera glycines
  misc_feature (2439)..(2440): n is a, c, g, or t
  misc_feature (2449)..(2450): n is a, c, g, or t
tgataatgaatgaattaatcaattgactgattggtcggcccttccttttcaactttcgtatattttgtaaccttttgaaattaatttccattttatgttattttattaaaaattttattatttttttttctttcattttaatggctgccttttaatttttattttctccatattttcttctcacactttttcaaattaatgcaaattttgtgggagagtggcgagtggccaggggccagcattgagcaggccatcaccactttgagttggactccggcggccaaggagggccggggactgctcggcgtcggatgcgacacgggcgcagttggcgtaacgtacaccgatttgggccctgaccacaactgctgtaaaaggtgaaaacattttaaaacagtgtgaaaatgttggatttttcccccaattttcttcctttgtaaatatttgtcattttctccttcctcagacacaatttcaacttacgcgggcatcaggcggcgattgctttggtggcgtggaacaaagcacagaccaaattgctttcctacgacatcaatggcgtcatttacttttgggtgccaaacgaagagcgatggacagtggagctgatcaatgatcggggattcaaagtccgtcaatttttatcccttttgacgaaaattgaaatgccatgtttaaggtccgtgacttcgattggagtccgagtggggcgtcagcattaatttgttatgaagacaattttgtgctaatcggtttgaatttggcagtttttgtatttttggttcctttttcagtttcgtcctccggccaacgcatttggtccaacactttccttttctccattctctgcggcgcgtgggcccccaattcgcaagaattggtcatcggcctcagcagcggcgttgtccatgtgctgaacgaccagggcactttgatcactgaacgcactctcttccaagtgggcgtccaacgggcggccttttccccgctgcgaagtgccgaggcgcacggagatggcaaatggactttggcgtgttgttcggtcggtctctttttcatttacgaataattgtaataaccaatgataacatttgatttctgctggtaaaattggggtttcaatgccaaaaattaatcaataattgcttggttcggcttctaaaattttatatgaacaaatttcttatttcatacagaaaaataataagtcgatttctgacacattaaatagcattcacaattctatcaccgattcacataatattttggacttttccgtttgggggccgcacattcaaatttaaaaaaataacaacgaatgctttgaacattcgtacgtttcccatattatattaggaaaagtaccaatattttgtttgacatgctaaattctcccaaggaaaggaatttttttgtttttaatttccattttttctcctcaggccaccgatcagattctcttcctgaacaccttctacgaggttgagctgtgctcttggcaagcgccggacccggtgatttcgatgcgttggagcagtgacggcacaatgctcgcggtcgtgtgcagtccgaatcgcattgtcattttggactacaacggccgtggcattcactctttctcggcacccatccccggcggcactctctccgcattcacttgggcgcacagcgatcaggccattgtcgtgacggcaaagggcaaaatcgccacgggccgtttggtgcgccgagtgccgtcgctgtcccaattggtgtcctattcgctgtgggaacagttgggccgctcctccaaaggggtggaccatcttccgattccgaagagagagcgcaaacagatcgcccagtttgaccatcacatcatccgagtgccaattcacacctttgacttcattcaaaaaacgctgtttagtgccgtgtccccgttgctgaacgtctctacgacgtggtgtgtcagccgagcatttggcgttggtattgcaccattgtgccggtgacccgtaaaaatctctacatgctttgcgtcgaggtttattcctcagtttgccctcctccatccttttgcgctctcttcagcacatgggcggtttcgtgccgattctcctcggtcgacagaccaaccgaattattccccaatttgttatttcgcttcctgctcatttgctggcaaagtgccgtcgttcctccgacatttcgcctcaattcgtcgccttttcccctcgtccgtccgattcgtccgctgttcatccagcagcagcagcaacagactttcatcagttgacttctgatcattcgttgccattcgttagtggtggttcttcggcacaagttggtcagtgcatttttatggcattttgtaatttttcggattttttttttgctgattttcgagatatagtccaatattctctacgcatttacttttgtttttgcttcagaccnntgcaggcanntgcaag

SEQ ID NO: 20044 - DNA, 2564 bp, Heterodera glycines
  misc_feature (1863)..(1863): n is a, c, g, or t
gaatgtcagtgaattggcctccaatttttcccataatttgtccgaatacttggttcgatgaagtcagtcaggtcaaccacattttaaacaacatggacgaagcagaattcatgcgactgacaacagagcaaaaatggcagaaaattttcagcgttcattttcccagtctgtacaggctcgtaagcaaattcatgtcaattcccgtctcaaatgcatttgtggagagagtgttttcgctttgttcggctcaatggacagatgtgcgaaatttgttaaaggtcgacacagtgaagtcattggcccaaatgaaagtcaacttcggtttttcgtgctcagaatttcacaaaattcttatttctaacaaaaaaaattactcaaatcgatcatggacaatcaaaaatataacatatgaacattttatacgtgttttgaataaattttgcaaaatgaggctttttgacgcacaatgagtcttttttgcctgtcaaatgaggctttttaaaattttcatctggcaaccctgttttagaatgatattatttgatttcacaatttagttaataggtaaattttcaaaaagtctccttaatttaaataaataaagatgactaaaaatagaaaatcgagattttgatttattgggcataattctttttttttgaatcttcaaaattttctttattatagcacaacatctctttgttccgtttttaattgtaaaatattgccattttcatgcataaaaattgcgtgccgatgtcgtcgaatgtgagcaattcgccatcaacaccaccaacaaactccgtgccacaaatacttctccaacagttcggcaaggattttgttgcgggcgctgtggccgcttgtgttgccaaaactgtcattgctccggtggagcgcgtcaaactgattttacaagtgaatatgcaaaaactgtgctcaaagagagaatccaatgctaatagtggataaaattaccataaattaaatatttaaaagagattttcaggccaattttcaatgatccctttttttaaacggtaaccgcaggcaaaaccatgttaacgcttaaaaaaaggcaaatttttgtatggacaaaattcgaaaaattccattgaaattggtggccgacgtgccatgccgacaggcgccatcaaaaaaaactatttttttgaacgtttcctcccgcatttagctccaaactgcccagcggaccatcgcggccgcgtcccgctactccggcatggtcgactgtttcgtgcggttgcctcgagagcagggcttcctctctttttggcgtggcaatctgtccaacatcgcccgggcggcgagtcaggcaggtgcgaagagggccaactgtgtcccggggcaagtttaagaagccaccaaatttcatcatttggcatcatgcgaaagtctccttaacaagccttatatctctcaagaaatcacaaggatttgtcgccatacaaaaaagatatgcataaaatgagcaaaatttcttgaatttttacggaatttcatgttacaattttttaaaaagttttttattcgcttaaaatagccttcggacctccattttaccttattttttgaaaatttaaccacaaaatctaaaaataggtcccttttttgacgaaaggcggctacatattcctgttttttgctctccggcgccggcaattttaaaattatgcgggaaaaattttttggttacggacctgatgtcaagatgataaaaaaaaagatcaactgtcttgagaaaaaaaagtcatggcttcttcaaattgcctgggcttggttggcggtacagagttgccatcgagcagaagacaaaccatttctgaacaataccaactcacngttttgacaatttataaagtgccaataattttgggctaaaaccaaattttaatttttccctttttttgcataaaatttgggctcctggaaaatgtctcctgtttcgtaacaagtcctattaatagaaatattaatttttaaggactttttccgagtccgttctcttcgaaaaacttccatttatcccttttttcataatcattttgtgcttttattaatattccatttcgctttttaggagtcgcttggcatggcttttaaggagttgttcaagcgttggtgtgtcactgagtctgatcgctctgtaaattatcgtcgttttgttgccggttggtcgggcaaaaaatatttccgaatgtctcaatgccttaggcaatttgttggccggcggtttggccggaagcgtcacctttttcttcatttacccgttggacttcgcgcgcactcggctcgctgttgacatgggcaaaggttgacccccagctccattctcacaatcagatggcactttttattacgggacataattttgcagaaatcccggtcttatgcccgattttggagaaattgaatgacccatggagtccagcaaaacgggactttttaccgctggtttcttgttcacaaacagcaccattttcgaaacctattcctccgtttctgcgttaaacgaaattccggcctaagttggttaatttctc

SEQ ID NO: 20045 - DNA, 691 bp, Heterodera glycines
ttcctatttttgcatattgttgaaaaaatattatccgcattcaattcaacatttcaaaggcataaaaataaaaaaaataaaaaatcttaactcctttttcaaaaaaaaatgaaaccttttttttatgaaaaactttaataattttttttatcaaatcgattttttaaagtttatcttatttttttatttttttttttaaattttgtacgctttgcaaattctccactttgcctatacataattaaaacccatcacaacgaaccatggttcaaaactgatttttcccatttgcacgcaattttttgtcatctaattaatgaagaaattattttttgtttcattttgtcttcattttcaaattcttagaaatgaagtatgaagccacgggcaaaaattaaagtgtaaaagccaaaaaataaatgaaaaatatgactttcggctaatccaacaattttgttagaattcgttgcaggtgctagtgctgtccgagaccaaaaatttccagagactcgagactgagactcgaccccgagactcgagaccgagacccaaaaacccgagaccgagacccaaaaccccgagaccgagaccaaaaaaagccgagacccgagacttttttcaaaaaaatttcttattcgcttaaaaattgttaaaaatatttttttgcgtatttcttaataaatttttgttt

SEQ ID NO: 20046 - DNA, 1631 bp, Heterodera glycines
  misc_feature (1602)..(1602): n is a, c, g, or t
cccgagacttttctcgagtcgagactcgagaccgagactctcggacagcactagcaggtgctaatagaggaggacacggacaagggcgtagctcccagacccttggctttgtggggggggggggactgaagtcaaaaatttggtttctaggagtgtatttttcttttttcagtcaattttaggggtctattttacaaaatttttagccatttttcgccaaaaaattactcacctttttcaaaaatatggtaaaatgggggtccggcggtgccgataggtgccgccggcgcaaatttttgagtattttaatgcaattttgttaagaaattttatatggatttcactttttgcaagaattttttatggtttgctttggtgtctaaatgcaattattggcggcattttcacaaaaaatattgaaatttggaattttcaaaattttgttcttcaagagaatttaagtgtcttttgattttttgttaaaaaattataattcgaaatattaaccctgtatttggagtaactcaatgtaagtaaaaaatataaatattgtaataaattaaatttcaagattttgtcatttcttttctccatgttttaccaattaattaggaaagatcatttaaataaccaaattaaaaaaaattaaaagggaattttatttaaaaaaatttttcgtatataaatctaatagtttaatttaataattacattcttttcaaaatatatgggcttttattttttgttaatttttttttttgttattttaattgaatcattcaatcaaaaaaggatttttatgataaaatagaaagactcaaaaatatataaatttataatttatgaaagtaattgcatgagaaaagtgttaattgaatcgttttttaacaattttttaaaagtcatacgaataaaaatggagggatataacatacaataattagaaatatatgatttttactaatttttttcaattttccatttatttagggtggacggagagattttcaaaaatgtagcaatttgtctgtcacttaaatacggatttttattcttcattttataataatctttcattttgctgattttctctttattcgaataaactcctaaaaatgataaaatatttaattaataaaattaaataatatttacttttgctaatttcaatgccaaattcctttttccaagtgcttaatgttgttttgccaatgcccaacgctttcgcaaattgcttctgttttcctctttttgacattcttttaaactcatcaattctttcaacaaattccctctttttcttttcataataattcttttggcttctttcattttttctgcttaatcctaattgttttttccatttgtaaattttcattcgtgaaagtcccaatttttctgctattttttgctcaattttaccacggccttttgccgaatattttcctcttttcttaattccttcttttattgcgtggaatttacaaatgctttcatatttttgctgatcattgaattgttcgttgttctgatcattgccaattgaatcctccgaatttaattcattttcatcattttgccaatttgaattttgaatatttntccatccttggccaaatatttcagcaaaa

SEQ ID NO: 20047 - DNA, 1809 bp, Heterodera glycines
ttcaaatttcaaaaatttctaaaatcggaaatttctgtgaaattttttgggggggggggtggaaatttagaaaatatgaatgaatttaatacctcttcagctttagaaaaaattttttcagttttttgcctttcgtaattatcgaaatttacaattccctcctgcgtttaaaaatctcagaaataaaatttttcaaaatttctaactgttcttcattcctctaaaatttttgagctttctttttttcccataattttcggaatttctaatccccccctggaatttaatttttctccaccctttctaaattttttcggaaatttcagtttttcactacctctctttgtcccctcttcaggatgcccattttcccgtccttttgctccgcctttgcaccctccggcgtcgttttgtttcctccgccgcagcgacggatgacaaaatgccgacaaacaatgtgctggtcgggttggcatcggtgcccaactttttgctggtgccgtcctcttcgcctcaaaatgggccccttgtggaacgaatcatcgaatttgttcaccgaatacggtaagccaattgggatacactgtcacgggttacggtgtgtatgttcctatccgatagtgttggattactataaattggattactgtattttatttttattttttaatttcagcgaagcccaaccgcccgttgagttgtgccccactgatcgtcagctgtgagttttttcaatttgtataatgtccgttttatcggtggtatacgataatatcgtgcagtttcgcccttttctaattcgatctctactattattaataaagtttcaccataatatttcaatgagttccaccccctttttgcttcctttcttttaccgtatgcctttctcttactgtggttcattactatagctcatgtaatacatgtattacaaataaatcaattattgagtgcctttaacagatcgctcatcgccgcgctgtgtttgtgccgttccgacggtgccggtgagcatgccgccggtgcgatgatgagcgcctcagtgccgaccgcaacgagcgatgacggcaccggccatgcccagctgcagttggccatcgcacgtcgcattcacgaacgactttggcaggtgtgcaaactgagcatggcatttttggatttttaatttttttggaattgaaatttttaattggatttggaatattttttaaatttaatttttaatatttaattcataatttaaatttttaaagttggatttacaaattataactttttaaattaaatgttaatttttaaaatttgattgatatttaaatattttaaaatttgattgaaaaattaaatgttttattttacaaatttaaatttttaataattcgttttaattagtttactaataaacatttccgaggttttaattattttttcattttaagggtttttaaattgtgctttacactaatcattctaatgacattcttaccgtaatcggaattgtaccgtaataataatttgccctccgtacagtcgctcaacgccaccttggccaccgatctgctcccatttggcccctcgttgcttcgccgtgattccatggaacgccaacatttggccgccatgttggaggcgttgcgccaactgcgcttggcacatcgccaatgcttggcacacacaaattgttacaatgtgccggccgaactgttcacggcacaacgacgaggcgagcaaaaaaagagcaattaattttaaaatttcaataattatcattttatattttaaaaaattttggaataaaaaaaatta

SEQ ID NO: 20048 - DNA, 2526 bp, Heterodera glycines
aatcattaaaatttagtaaatttaacaactctcgtgcttaaaaatttatattttctttaaatttaaaaacctggcaatgttattatttcgtcaattcttagtgggtttaacgtagagttaaacatgtatttgtttctgtttggacttagtcctgaatacccagcttagttgggcccgaagtatcaagagtcccgtctaattctgtttaactcataaaatttcaagtctttgaacagaccgagcattgtaatgatagacaatacaaatgtatgacattgacaaagaatgaattgtaatgagtttagcaaaataagcatggttaaaattgaatcgattcataacttgtttcaatttaatatgctttaaattagatgtttgcaatttatagacaattaagaatatttttaattttagtccttaatttggtgcccaaacttccgcctcccttttcagccccccccctccccttattttttaataatttctatatatgcgtctttgaaacgagcgcaaattattaacaatgtaacttaaaacaattttcaaactaaagcaggaggacaaaggacaatcgacgcttaaaagccttccgactcgtcaatatttggacatgaccattgtgccaattttacttcaagctttgagtggttcgtttcccatttattttgggttaaatttttagtctgacaatgagtagaagggtatctgattcatttacaattttgcttctcctgaatactttacacaaataaaagctctattccctggtgggtttttatctttcaattctcactttttcaaaaattttttataatcctgtaaaattatggcaaaaaataatttatttattatttaaaatttctcctctcacaatcagcggcttctattacttttttttgaacctccccctgagaaatataaaacctttttacaacgtacaaagtcgattttaactttttttgatttcagcacttgcaaaagaacgaccatcggacccaatcgaatttgtcgcgaattatcttttgaaggaaaagccacgttttaacggtgcagctaatgcatcagcaaccaatgaacattgattttatttgattgtttaacagtttagccacttgtctcttgaaataggtacttttacatttatgtgacaaaaagcgattttgcccctgattttcgaacagtttcagagcagatcaagaaaacttgacttgctctgaaaattattgctcaatatttgaaaaaaaaagaatctgaacctggttccatattgtacctggatttcctgacaaaaacacagctctaggaaacatccaggcttgtcatggcttgaatccgtgcatggactggattttttgaaattggttatcagaattaaaatttctggggaccagggggttcggtagtgccgaagggagagggggtgtccgaggcctcttactattgttcgtaaccttaactgtaaaagtatcttggaacaaagtaatcaaatcgtgagtaaattgtttatactaataatgcggttactggggaaattctttgaaacaataaataactaacgttttagtgcataatttaaaaaaaaaagtttatgtacatctttttgtaattcgccaatggataaataatccgcttttttgttcgaaaatttaaatgagaaagtaccaatgttacaaaaaattacgatgatactgtagtagccagccacctttttaaaaataatttaatgctatttgaaactgtttaggtggatttgattcttttttttcaaaaagggggaacaaactacagtcttatccaatagacgttttatcttgattctcaattacttttgactgtgttggggtcagagcaatatgacaaacagaaccgtcattcccattctgaacaggtataaagtattgtccattggctccatcatataacaattgcacgggttggtggcttgaggtgatcatcagcgtttgctcttgctaaatacaaaatgtgttttccggtagcaataaaaattgttgatgaattactgtggtaattcacaaaattatgtgagggaaattataaagaatatgcaaatattaccaaatatatgtcagcggacctttcatcgccacgattcattgtttgaatcaaatggttgtctgaattcatgatcgacgttgttgtctgacagctttgtaacttgtttgctataaaaaatgaattagatacgggtaattaaaaagagatatagtggtgcagctgcacaccatcctgaatttctaaaatcacgcttataaaatctcttcccggatctttccatgttttttttctgagcttggagtctgtaggttagcagatgttttcaaattacggtaaacaatccacagccaagcggatttgaaccccagacgctcgcctcgtattgaccccctaacaaatataggatcaaaataaatttcaagatcgtaaaactaaaatgtgacttctccgtataaatatttatagatgcctatctgtttatataccttcttctatattttttcaggacct

SEQ ID NO: 20049 - DNA, 929 bp, Heterodera glycines
  misc_feature (750)..(750): n is a, c, g, or t
tatacaaacgatagcattgtccaggttgggtccgcccatcacgacctgctctttgcattgctgaggcttgtgaaattggcgtaaccagaaggctctgtgatataaaaaattaatatacaaccaaattcatgttatacaaacacaccaaacaacctacttacatcaacacgaatttgtggattgtaaattttttgtttgcaaaagccagtgtcaacaaaaaaaggcaataccatcaatagtaattgacgtttcggcaacattggtagcgacaatgcatttacgatctaataaaaaaagttgcgaaaattttattaagactatttattgcttattactgatcaatgtgttatttttgtttggaatgcattgttggaaaacacgttgttgtttgtccaatggcattgaggcatacaaaggaaaacaatactgtaattaaacaaaagggaaaataaataaattatatatatatatatatatatgatatttaaaattatttattactaattgtccatattgtgaaactgtctcatcggtcatgtccttgcgaattagccgacaaacctttcagtctccttaaaattttaattaaatattctattcaactttcaggtataaaatgattattactttttgaccagtcacaaaaattaaaatatccccaggacgcctttcagtcaaatggatttgcaatgctgtttccaccgcagcatgtgtgtagctaattactggtgttggagaatactgaattanaatgcttttattgtgtgaaattgttgttgaagaattttacacgcaaacaaatttaccaaaatgtcaactggaaatgtgcgccatcgaattatcagcatttcacaatattttaaataatttttggaatcgggcagaatccaacgtggcactcattaaaaatcagcttaagctttggacat

SEQ ID NO: 20050 - DNA, 1730 bp, Heterodera glycines
  misc_feature (13)..(13): n is a, c, g, or t
caacttttgggcncaactgaagatatgaacaaattattataatgattatttaaatggttctatagagtgcggcaaaagttcttctacaatccacttttgtaagcaaaatttaagtttaaaataattaaaccatatggcaattccattttataaaaaaattacataaaaagacaaagtagccattaatttttggaagcgtttggacgcatgtattttcgcctatgtggtaactacaatactttgaacttatgatgtaatttctagtaactaacttcttattgaatgatattgctatgcatttgcggttttctttttgttttgagctttaatttttaatggaaaaacggattgcaaaactttggccacattctgtatatgctttttaacgtacagaaacatccatttcctctgcaacacggtttgccacgcacgtcgcagccagccttcgtggctgcgtgcaaatcactttttgtgctgtgccgtgaacaaaatccattgcccattgtggaatttgagtggttttgccactaccagtttctccaacaattagcagacattggttttgtgattgtaaatgttgaacaaattgctgttgatatctaactacaggaagttgccttcgggtttcaagcactcaaaatatttgctggagtatggacggttatttaagggattaatgtgggacatttttgctaaagtttttaaaaaatcgttaaattcgatattaagttatttagaataagaaattgtttactctattctacgggccgttagcttctccaataaatgcatacttgatatgtatttattgggtactggacttgcacaccgcgatgaggtggcccttttgtgcaagacctacctatctaactaacagtatataattgtgctgtacaaatttgagaaattttattaaaaaaatttattgaaacacaccactggggagtaaggactccgaccaagtggtgtgaacaaatagaaaccacacaattaaataataaaattaaaatttgaaagaaaaacactacatatataattaaccatattctaaaaagtatggtcctgattctttttccttttacgccgttcaagcgttttcaaattacgtttacgatgttgctcctcaagacgcgctttttttgcttcttccggatattctaaattatatttctaataaataaatgtgtttgctagataattattttagctttaaccataatggtccaaaaattctttttgctgctgttgttgttgtggttgtgactgctgctgctgctggtgctgctgcacaagttcctcatcatcatatgaatgtaaattgatgtagaacctatattttgtacattgttcataaaaacttaaatgcttattttggctacccgacatttaatgacctgacatttgagtacatacacaattttataaaataaacttcatcacataaattcattcattctttggacttaaagtcctaataagttccatgtgtgcatagaaaaggggcaatcttctagcattaccatgaacacatacatgttcaaggggaattagagcaggacggggactagtactgaaaaaagcgaacaactgagtacctaagtcccggttttgatcagttttgaccaggaccggactattcgcggttttttcccggttttgacagccaaaaaatcccggtttttcaacacgataattcccgctaccggtttttctcaaaattcacggtcccg

SEQ ID NO: 20051 - DNA, 1851 bp, Heterodera glycines
caaatttagggacaaagtggggtcaccaattgatcggatcaaatattggatgagaaatcgtctgacaattgaaagaaagaccagggtaggctctcttcaccaaccccgaaattcgacatgccaaatcatcaatcgattcgttgggttttcgtcggacccctaacatcagctcatcaaaagcattcaagttttttgagtccgtttcctccaactgtcgcatcatttcaccccgaagcagttcatactttatcggaatgactgctttcgccacttcaaaagctctttcagctcggccatacactttgctttctagtcccttaattcttttttcatccggccaactgtcggtgtaagcgtcgaattttttgaaaaaacgcttaacttcgtccgtcccttcctttccgttgaggtctgggatcctttcaaggaccatattgtactccagactacttaaaaccgctaaattttggctttggggtggcagcatttggttttcgtaattcggaaaattttgctgttgtcgcgccaccggacggtacaaaacactggtttgttgctgccatccacgctcttctcttggcggttgttgatgcatttgcctcggcatctccgttgggtgcatcatccgacgcccaccctcaaaaatatgtcgtccgacgaattcgttgtgttgccgttcgcatggcaaaaagccgaagtttgcgttttgttgttgccgcgctaacgcaggttgttggcgaatttgaatttggctggagcgaaaattttcatgctcccggtaagggccaaaatcctcataaatttctcggtgccggatttggttgtttacaattggaaagttgtgcaattcgccattaaaatttattggcgtcgatgtacgcccaatgagttcgctttgcgaaacatgacgcgaatttggcgccgtttcccgaaccaaatttctgttaatttgctcgaaacgcctattttcggtgccactctcaacgaatctcatccttactccttcttcacgcaccaaaaagcttccaaaatttggtcgcaaaccttcaacaaagtcctcgtgaccaacattttcattgcgaatttgctgctgctcggcgccattgttgccaccaccgtttgctcgcggcggcaaattcgattggatggacacatgcaaaaggcgccgccgaatttcatcgtcatttgctgctgctgctgccatttcactaaaatggtgttcgttttcctccgccgacaaactcaaatttcggttaagtcctggcgagatcggagcgttaaacaatggttcattttcaccatgaactccttcaacctgttgttgttgctgctgctcttcaaccgctgcgttttggttttgcgcaaaggttcgcaaattcaacgctctttgtcgtgtcaatggcggcgaacgaattatcatttttgcacctggctcaggtttagcaaaaacaaaacaaaattttgctgtcggcagtttttcactttttcgtttgatggcgtggcgattaggacggtgaatagtacggcgaatgcgaaagttcggctcgaatttgttgcaatttgaaaacgttcgactcgaatcgttttgttgccctttttcctggctcaggacttttcaactccactttcttcttttcttcaaattcaactccaacttcttttcctccaacttcactccaacttcttttcttccaacttcactccaacttcttttcttcaaattttgaaatttgccctggctcagggtcaattcaaattccgttgattttgttgtccggttcggacttcaaacaaaactacctaattccgatctcgcctttccccgttttacctgctgttcctcaggagcgc

SEQ ID NO: 20052 - DNA, 2898 bp, Heterodera glycines
  misc_feature (43)..(43): n is a, c, g, or t
  misc_feature (571)..(571): n is a, c, g, or t
  misc_feature (1778)..(1778): n is a, c, g, or t
ggggatctctagagtcttaaatttaattattatttaatttttntggaagataacctttacgtatcctctatattatattataattttaaaaaaatcttgcaaaaatttacaaaaaattataaacaaaaacttccataaaatctatactcaataatctaaccctaaatttttaaaactcgataaattttttttaatttaaaagaaatttagagacatttttaagctatctaattatatcaaaattgatatgaaataattaaagtttgaacaattttcatgcatttaaacgacctcatattttttatttttcttgaaagtaaaaaatgctggtttttcggaaaatttaatcattctccgaccggtccggtccccaacttttgccccagaggagcggggcgcaatcctagtccgaaggatcgaagtcggaaattaaatacaaaatttcctacaatatttcaaaaaaaaatcattcattgagaaatgcgaagattttgcaaaactcgctaattttctttatttttttttatttggtatttactttaaattgaatttttgactgcttttgctttanatgtgaaaatttgtcatcaatttgtagattttttttcatcataaaagctaaaacctaattgttaaaatttgagacaatttcacctcaaaatcacatatttatgcgcatatttcttcagtttttgcgtttataaatcgtctgcctaacatcattaattttcaatctatgatcaatactactcacagttcaattgtttcacgagttaatgaatttgtccagcgcctcgcttacattcattcgcctataaaattggaaatattagtatattcaaatgtgatatccaatgttgtcagataaaaattttcaaaatcatcatttttcaaacaaaaaatcatcatttgggggtccaaaataagcattttggaaaattttttcaaatgaagaaaaatcaataaaaaggttttttacggcgcgtttttttccaaaaactttttgagaacaagggtccggcgatgtcgttaggcgccgccggggagaattttgaaaatttgagtgcaatttgctaaaagactgatatctctggtttttgtcattttataattttaaaaaatcgttattttttcagaatttctccgtcaaggccaagtaaaatagaagaaaatcgtaaaaatgatatttttgtcagttttttaaaataatatacacaaaataatcattcaagaattttccctgaccgcgtctcaattacgactaccgaaattttttggaacctcggaacttcattcctggaaaccgcctgacccttaaaccctttcatttttttaaatcatttaaatattttatcggtttgctgcgctttttttcgcttacccctttgatgtccagctcaattttgaccttcacattctgttgatcaattacacattcaaatttctggttgttttctctcctcctcctcccgccgtttgtccaaactcattaacctttaaatggagttgctcattttccgccgtaattttttgaatgatttcgtccttaatttatatgcaaatatagatatttaattgatgctaatttaatgggggaaaaatatttcactcaacatttggtttaatatttttatttgctatattatttttatcacacctgtaaaatgatttgcaatgtcaaagacactgtgaaagactcccagaaaatacgcaagtgatacagaattttaaaaaagaaaatcctctaacacaatatattgaaaacataaatggtcaanatataggggaaaaagtatctttttataataaattattagcactttggcaatattctgtaaatggagctgttcgttttgagatgacattttttgcatttgcattcgcatttccgttttttcgtcgtcatttcgcgcattcatttcatcctaaattaatttgttttgggttactttttattttttttatcaaaatttgcaaaagttttgcacattttgctgtcgacttgcaaaaagcgtttcatcgtatttcattatcagacgtttgttggcatcgcatttaatcccattttcggtacacaaaactttttcacaatgaaaagcacgttttgcccattctttgctctgaactcaaagaagtttggaaaaaagaaaaataattttattgtatttttacttttggtgttggcgatttaatgtcaacacattttctttggcactcatcggcaaaaattttgacctaaattaaggaaattggaattttatttaattaagcgggtcacaaccctagtcggcaccaccgtttgtaccacaaaattctatatttttaaataattttgaattctctttatatgaaaatctgcaaaaaatttttgaaaaagtgtttttcattctttcctcattccccgttcaccgacatataccgaattccccttcctgacgacgggcaagtaaatttttttttgatttttatttaaccttttccggcttttcacaaattggatgaattggtgcaaaattcggagccccatgcttttgctgtgaaaatataatgaataattagctattttattaattatctcatataaaaatcaccttttgtgttgtttttttgttggtaagaacatttttaaggattggtttggacataacactgcttaaagcatgaaaaatcattaaaatttaaaacaatttaatataattaatgtctgattacaccttaacagaaaataatgagttggaacatttttaattagccaaaattcgcgaattaaattcaatgcaattttgataaattgtacatcatgtcatcacatcctttgcattatcacagattattattgataaattaaatttgtaatccgatttaattgattaaattaattgttttattttgaatttg

SEQ ID NO: 20053 - DNA, 1207 bp, Heterodera glycines
gagtaccgcaaacggaaaaaatcgattttttttgcttttcgggcagtccccccaaaccgatccgcccagatttatgggagaccgaatccttcgggaatagcttccctatagcctgtactttaattctgcgttggatttttgctccccataattgtttgagtaccccaaacggaaaaaatcgattttttttgcttttcgggccgtccccctaccgatgcgctcagatttatggggagaccgaatcctccgggaatagcttccctatagcctgtactttaattctgcgttggatttttgctccccataattgtttgagtaccccaaacggacacttgaaaaaatcgatttttttgttttcggtgcagtccccccgaaccgatgcgcccagatttatggggagaccgaatccttcgggaatagcttccccatagcctgtactttaattctgcgttggatttttgctccccataattgtttgagtaccccaaacggaaaaaatcgattttttttgcttttcgggcagtccccccaaaccgatgcgcccagatttatgggagaccgaatccttcgggaatagcttccctatagcctgtactttaattctgcgttggatttttgctccccataattgtttgagtaccccaaacggaaaaaatcgattttttttgcttttcgggccgtccccctaccgatgcgctcagatttatggggagaccgaatccttcgggaatagcttccctatagcctgtactttaatttctgcgttggatttttgctccccataattgtttgagtaccccaaacggacacttgaaaaaatcgatttttttgtttttgggcagtccccccaaaccgatgcgcccagatttatggggagaccgaatcctccgggaatagcttccctatagcctgtactttaattctgcgttggatttttgctccccataattgtttgagtaccccaaacggacacttgaaaaaatcgattttttttgttttcggggcagtccccccgaaccgatgcgcccagatttatggggagaacgaatacttcggggaatagcttccccatagcctgaacttttattctgcggtggatttttgctccccataattggttgagaaccccaaacggaaaaaatcgatttttttttgtttttccggccgcccccctcccaatgggctcaaatttattggggaaaacgaa

SEQ ID NO: 20054 - DNA, 1683 bp, Heterodera glycines
atttttatagaattattagggcacattaaacgatcgtaccttcctagctactgacagggatggagctcgtctgaaaaaaggaaacataattatattagcaaagcattagtgtgattaatttctttgggaaatacaaatgcttatttcattattttttataaagagtaatttcactcagatttgtcattttaaaataaaaaataaatgttagtttgcttttgattttttttataaattcaaaggaataatagtatatacatttcagtcacaacagaaacctggattttaggcagtgttagttgagttttccaaaatgcattacatccccagtttttgtcgataaaaaatctgaaaaatcggggtagttcgaaagaaaaatttattggggttagaaaatattttccatgaaaaacaattgggctcatcaaaatacaaatgacattaggatgattgctatactgcgattctcctctgaggagtgctttgtgaaacacgaatgacaaaaatatggaaaaattattaggtagatgtattttaggaaacaaataaataattaaaataatttaagtaaaatattaataattattgtattactaccattaaaacctataaaaattgctacttacctctccactcagttggaaaagatgaaattcttcgctctggggttgtcttataagcaattccttgattaacagaacatcgcgaaaagtttcattcatttctagaaaatttttcattatatttcctttaaaagttgaattttaaaaatgttcttaatttcttaaatatttttaagtcttcaatatttttcttgaaaatttctgcctgagcaattgcttttatagggagcttaagctggccagcagcttggtggtctcatatttttgtcctcttaccttacctctttattctgtcgatttctctttttatttattcagctcttttcacgttttcgcacattatttctcattgaatctgcttcgcaccattctcttttcccctattaatttaaaattctgaaatattaatcttaaaattatcaattaatcagctcaagtaatgataattgttgcttattagttttccagaaaatcagctttacctaccattattggaatgcttattgggctgtgagtgatgcttcaaaatattagtttcattaaatacttttggtaaaactgggctgctgaaaacacattgacatattttgatcatcaaaattacttgtttaataaacaagaaaaaaatacaaatgaattttacacccaaaatatttctatattacttaatattaatcaattatattaacatatttaaccaaaagatttacaaaaaaaaaattaattatataaattatataattcattaatttgatcaaaattattaaaaaagccgattaatacaaataaattaaagaacattaaatttttatttatatttttattttgagaaagattttttatgaagaaagttttataatatatatttatcttttaggcttaattatacacgtgctgaatgtccttgaagttttcaaggaaattttttatttcataggggtattttttttcattgctgggcgacgatgttttagtcaaattaaaaaaataatgtcaataagcacaaaaaagcataagattttatgcttgaattacataacaaaataataaaatcaaaaaa

SEQ ID NO: 20055 - DNA, 2185 bp, Heterodera glycines
aaaagtaattcgagtaaatgtaaattggacgtcaccccggccccgctagtggtttgtaatcgcgggcgaaacgtccccaccattccctgactccaccccccgttgcacagacaagggccatctgttttccacatatcgtgttgatgctgattccactttgttgattctttttaatttttaaatctttttatgtataaatttttttaaatatgtatgtgaagattggcttttaaaaagtgagacaaagctaaaggatgagataaaaataaatccggactatgacgctgctgtactcttgtttatcattttattgggtctttaattttgtaattaataaaaaattattgtaaaatttgttatgttttgccgtttttgtttaattaatgttaaaatactggcaaaaactttaagctaattaaattagtcgagaattttctgaaaacccaaaaaaaaagacgagaaaaaaggtgaagaacactttttccaattccggaatttactgacgatcaaattattggtgtgactatgatatccatcccaaaggcacccaaaagccagaattctaggatcatccatggccgcaattattttctcaaccaaaatgcaaagtccaaagcgcatgatgaatgaattttggcatatattcgtaaataatccaatggatattaggatctgacagatgtttcattattagggccgcaatttttagtgaaaaaacttttttgttgctcaattgttttgaagaaaggagctcaaaatacgcatttctgcattaaaattttttgattctgatgtcactatctgtcactagaaatcactattttggcgacttcgtcactaaaatagttaaaaatcactattttggcgttttgtcattattttttgctatttcggcatttttaggaaaatttattaacaaaaatccaataaaaacgaaaaatgcacccctaagaatcgaacaaaaaattttcaaaaaataaacccctaagaatcgacccaaaaattttcaaaaatacactcctaagaaatgaaaaaattttcattttcctggcaagaattttaatttaaaaaattattttttcggtactaattttgggttttttgcccttcaaaatctctgtcctactcatttgtaactgcaaccagtgaataaaaattatttttgctcaatttttggctgaaaattatgtcactattttggactttttgacactattttttcactattttggcatttttactcactattttagttaactatttcgagatttttagtcactaaaagtggcggccctaatactcccacaacactttttattggcttttttaaactttgagatgtatgaacaaaacggaaagtacccaaaaaattgtgtgcacatcgtttataggtatatatacatacaattagacaacagaatagggagaatacggtctccaaacaagacacatggatataaaagatcacgatgaacaggccacacagattatttggtatcgagcaattgtttacaccagcggtaggtcggctcttccttccttcttccttcagttcttcctacttcttacacttgaccacagccaggacgatgtcgacaagaagaatcctgtaaacaatgaattagaatggacatacaataaatacacggaaaaaaggaagaatttgacccgtgcacataaggataactgtttttgcatagctaaaaagcgtgaaagtcccctatgatcatctgttagactccgtacacacttacacggcgataagtcccattaagacgatattgaggatcgtcatttggaagctgctggtcgagggcggagcaggctttgcggtcgtcttgatagttgggccttcggtcgtctcgccagtcacctcggaggtagtcatcgtcgcgttcgtatcaggcgtctccgtagcgttgatggacggcgtcggcgtaggggtgacattttcgggtgtgttctcttccgcatgcttgagtttctcgttgaatgccagagcgcgttcctgatgacctttgaaggggttcacatcattggcatcgttccaactagaaatttgttaaaattaatgatttacaattagacagaaagtgcagaagcgaatcacttacgctgcatcgccgtttgtgagttgcgccacgaagagaagaacgcagagaatgcccagcagacggaaagacat

SEQ ID NO: 20056 - DNA, 2610 bp, Heterodera glycines
  misc_feature (1169)..(1169): n is a, c, g, or t
  misc_feature (2454)..(2454): n is a, c, g, or t
  misc_feature (2486)..(2486): n is a, c, g, or t
tggtgcattgttaacattattcgcattgctcggggctcttcattcgccgctacgaatccgccatttgacaaacagtcacttgagtgaatgtaacggccgagctgaaaaaggggtgggacacaatgggcaatgaatggcacggattggcacgggcgaacattgcgatggtgccgttggaacacttccaagttgtcaaggatcaggcaaacctttgcaaacaatggagcaaagcattggcgagagcggcagaacggacttaccaagttgattttgtcagtgttcaaaaggccgccgactccgattttggacgaaaagtgatcttcaccattgagatcatgcaaaaactgaacagggaaccaatgaacggccaaagaatcgtcggatggtcaccttaagcttctcagtctctccgtcgtggccaatgatcagaaggcttggcaaatcattgacaattgcgtacaaatcgtaaagaaaagagccgaaaaagggaatgacgcgacattggggcatccgaagggcgcgttgcattgcctaaggcaccatttgcacatttcaaaattggacataacggcccaatcaattttggtctcccggttaaagttttgatgaattgcccactcccttggccacctcaatgtacgccgggtggggcgtccaatgtgcggttcctccgccattcatttgctgatatgcgcaaccattcgttggtatttgattttgctgcttttgattcgtcggtggcaccaaaatggccgcaaattcgtcgaagcgttggcgctcctcctgcttcaacgaaagccaaaaggggcgcaggcggggactcttcaggcccagcagaatttcaatggtagcattgaaattgccaatgttccaactgaaagaacatgggtttattaaaccggcttctctagcacttcggaccaatgttttgccgttgaactaaccgtcatttgccagccccccaaggcaaacattagctaattgaccaaccacgtgtccatcactcgcataatcgccgccagacagctcttccgctcttcgtgcgtcggctggctgatgatgatgtgagtgatccatgagctaacttctgacagtcgcttcaccaaattcttcaccggacttgggttgtcctgggcactgatgttggccaagtcgcaaccgacgaaacngaacaaaatccaaagctgcaaatgttgtagaacaactggtactccgtggaggagagctgaatgaatgcaaatgaacagcgaacaaaagtatggtgttttaagtgatcggagtgtgatcagacagagatcactaatcaaccctcagagaggtataatcatcattataatgcgattgatcaaaggcattttggtcggaatatgtgttggtgtgagcatggcaacaactcctgcttctgttgggaatgcgttcgggtcgcttgcctgaaaggcgacttcctccgggaagtgcaggatgtactgcagccgttccagttccagcctgaacaaagtgatcggctcagctccgcagagaattccgcctgcactgttgcggatggatgagcaagtggtggaggaagagtaagaagtgttgcgtgaggaacgggaggcgtcgttgccggggatggcggactgatcgaacagagactgactgggccgagctgatcggttgaagatcttgtgcacaaacagtgtggatcgagcttgcatgatctcccacagggtcatggagattgatttaagcgtggtgtaagagagtgctgaacggaggaagggacattctctgggtggaggaggagggaagagaagggcactccctgggggaggagggaagagaagggcactccctgggggatttataggaggggttcttcataattgatttaactgccgctgaaattatccaattttactaaccgatcaattgccatttagtgccacggaattcaagcagaagctaaaaaatgaaatgtacccaatgcaaactcaacagttgccagtccctcccatttcggcggggggagaaggaacaaatcccaaaaactttcgcttatcaaaattcaaattttgctattttttaaaatttgttttttgtattcgggggggggggagtgaaaagcttttacctagcgtagtcattcctcactttacccataatgaatctgttacaatgagttcgccatcccctgaaaattgcctggtgcttcgacactcctccgcccactcgccactgctgcagtgtcgcggcgtgctgtcgccgaagtgccaatttggtggtgccgtccaacagacaaatggtcgaactgctcagacaaagcaaacgcacagtctgaagaacagcgaattggccaatgttttgcaatttgtgcttctcctcgccctacctttcgcaatgtgtgcccatgcaaaagctctttcacttggaacactttgcagccgaatgccggcaatttctttgccgtcttanaaccgaacgtccaattgtttgttctcccgtgngttcgcttcacctgaatgtaaagtcgcttcatcgcctgttcactttcgtagagttgactgtggaaaagctttcgcttcccgtcctaaaatttgacaccaaaatatcgcttggctcttttgctca

SEQ ID NO: 20057 - DNA, 3065 bp, Heterodera glycines
ttaaatccacaaaaaatgaaataaaaacatttttagccctttaggtgagaaaaaagaaacgagaatttatttacttatccatattgtttttgtttattttttttaattgaaaataactggctctgttcaaagaatgcaaatatttccgagttcagacattatggcgatcggaattcaaacatcctaaatctactctgatgatttggtggtgcctgttaatttagaaatcacaccaaaaatccacataaatgacaatttttgtgcaaatctgttgacgaaacctacaaaatttcttaattcccccttcttttttttttacaaaaatcgttacaaataattcttaatgcccaaaaaatacatttagcataacttgtgtctttctaggttttgattgataaaaagtttagctgattgacaaagtccaaatttttttgtagcattttttgtgggctttcaagtaccagtcgtaggacaaagtaatgtttggaaactgagtgcattaagaaaccaaactttacccattttcaagtggtcatatgtttagctaaacaatttgttttttaaaaatatcaatattttgtgtgccaaaaattttgaaaaaattcctgttaaagtatctagcacacaaaatgttctaccgattgctctttgaattaaaaatttataaatccaaaatttttttttttcgaatttgctttttagcatcaatgccgcggccacgtcaaaatttcaaactttacatgtcttcttacttcgcgggtacgatggccgaccaaaaggaattccgtcagtgaagcattcatcacctgaataggaaatcgctttatgaacacactttctcttttatgttttcgaatagtgtaaaattattttggtagtctgctgatggtaccaataggcaacaccagagaaatagtttaatttatgaaatgttcagaaatttaaagaccagcaaattatcagggatttcccaaaatccaattaattaggtctatactctaaaattggaatattttattttaaaccatgaattaagacatcaatgtatttggcatatgaatttccaaagccaaaattcattcaataatatttctttgtcaattccgtgaattgaatttgttaaggcgctagagagtcaaatttgtatgaccaactccttattagccaagtttaagaagccatttattatttgcgttttctgccgaaatttatcaattccatttcactttatgagtccaatcgattttctgagtccaatctgcagattttttcgagtatattcatgaataatttttatctgttgcttttattcttgaatttaaatctacaaaaaattctaaagactttaaactttcgtttgatatcaagaatgtaggtattgaccaagtaagaaaaaaagttatggccaagaaactgtagatcataaaaattgattcgcctaaaaagtgaaatagaactatttgggttttgtcatcgtgctgggtcgtttcgtaaaatccactagaaaaaacaaaatcatacattggttaaaatttccctaattattagggattccttttttagtcaaaaaataataatcgcaaaatagacattaaataggcacaaaaaaaggcaaataaaatttttaaaccaaaaaatttaccaagaaaaaaaaatttttagggaatcaatttttgggaaaatgtttcaattcttaggggtgtatttctggattttttgagtcatttcttaggatgtattttttataagtcatcatagaaatcgcaaatcaaacagaaaccgcatttttcgtccttatctgtgcgttttaagtgcgaagaaattttagacgcatttgcctaaaaaggaatcctactaattatatatattgttttcaaaatttctattgaatgatgccaagaaagttacaagtctttaaaaatttaaaaaatcatcaaatgtttgcatttggatataaaaaacatgataatttaagtgcttcataactacttcatatgcaatcaaagaaaaatgcccttagtcccatttaatctaggcttcttcaataatgcattaaaaaattccattaattttcaaaaaattaatttaataaaatccgaaagtccgatttttcgcatttgattttaatagcactggcgggtctttatgaacgacttcgcagttttatcctctgctggaattaggattttgtcgcttacaagcgtcagagaaaaatgacaaatgataattgtcgttagactatctaaaaataggcatttgtcgtttctcatttttttcgactaacgccaaatttcagacgacaaatatttgtgcgggggtggggtggggcgccaacaccacccttcaaatttgtcgtaaatgaaatgacccaaaaataaatcaaattattttcacccaataattttgtttcatgttaaaaacatgttccagtcgataattcgctgatcatgaattcgctctcagattttcatcatctatgctttggtctatgatttttcatcaagttatctaagtctatcgaattatatttaagaatggaattagagctaaataaagttaaattcgtaatatgtgcctcaaaaacccacagagacacttttaccatttttcatattttttgtattttatgaaatttttcgttaactcaaaagaaatttagtttgttaattctaattagacgatatttggacgaaagagacaaagatgaatgccaacccctgtcttccctaccgttgtgtcgagcactgtccccggtggacagttttcttcagggggagtagcgctcataaatccacttcctccagatttaacaatgcggtaatttgcgttgcgctgacacacgatgattgtcagtgcaggttgttttggagcagaaaatccaagaggcttcatcatttcactcgacacttcggcaaaggcagtgtcgaatgcttgccgttcccaatatgctatcttcaaaaagtggcgcgttttaaaaatgcgacttccctcactcccgaaaaatacaagaaaaaaggtacttatttattatctggtgcaaagttcaaaaaatttttttatgaatt

SEQ ID NO: 20058 - DNA, 1441 bp, Heterodera glycines
ccccccccccctagataatacgcccttgtcgggcggcctaaatgccatacaaattatttgaactcaatgaagaaaatagcatctttcttcatcatcttttgtttgcttgattttcaaacgttatttcccaaaagtttttcgaatgttttttttttaaattttttgcttatttgtaaaaaaaaatgtaccctaagcatcagagtgaggtcacttgcgtatcttgtctggaaaaaatgattgtttattaaaaaaatttatgaaaaaaactgtccaaccattggaccggcagtggccatttgaatcagataaccgccgtggacgcgcggcaaaatgccggatgatggcacaacgcctggcagttggaaaaaggttaaaattcctttacaaattgagcaaaatgtaagacattcattccattgcataattattaaattgtgttcaaaaccctcaaaaaatggccatttttcacttaaatttttatattttatcaaaaatactacacattttctcaagctccaaggttggtcatttttagaataggttttaaaaaattgaggcctaaaatttcgaaaagcagtgtcttaattgtttggccataacttttttgaaaaataaccattaatcttttgagattttacagactgatagagagagaacgatggcttttaattattacctggacccggcttcaggccgaacacgccgcaaaacagtgccggcacgcgcaacgagccgcccacgtcgttgccgagtccgatcactgagccggccgctgccaacagagcgccctcgccgcccgaactgccgccgggcgtccggcgcaaatcgtaggctaacaaaaaaggattacactcaaaaattgtggggctaaagcctccccccccgccccgaaatgcaaaaaataaattttaaaaaattgggatggcttcggcttacggttgttggtgaccccgtagacggtgttgttcgtctcccaccacagggccaactcgggcacattggtgatgcccaacagaatggcaccggcctccttcagcctgtcagtcagttgaacaaattataatggtaacatcaattcaaattcgaaaaaaaaaattctcgaacttcgtgtcccaattttaaaaaatttggcaaaaaaaactatcaaaaatcgcaccaaatttttaaaagtgttgcctttttcaaaattcaaaaaagaaaataaattaccaaccagaatcattttcatactgaacccagaggggtgcggccggcgcaccagcctcctcgttcgtcgtattggggggcggctgtagaggatgcggggcagaggtatgctacggatactatacgtgtgcaaaaaagtggaaattgcggactgttacctgcacacaacagtaattgttttagaataattatgaaatttaaataaagactgctaattagataatgaataattact

SEQ ID NO: 20059 - DNA, 1717 bp, Heterodera glycines
tctatccaatgggtatataatacatatgcattttccgagctttgctcggaatgttcccttgtcagaataaacatgaaaaagggctgcacagattggcactttgaggagggccaaggaggggaaagaaacggcactctcaaatcataaccaaaaatggacctttttgcacagtttgcgttcctcgtcgttcagaatgactttcttgcattttgtaacggccattgcgccactcattggcatttgagtttcggtcaccaacgacggctcgactaaaatactgtttttgaccgtaaggtttccgctgctcacagaattggatgggactcgccgaagccgacccaacgacattcattttgcgctgtgtcatcgttgcgcctggtgaaagacggcgaaattgttgagggccgttcaaatggaaattcccatcttgtcgaaatgaatccaaaggacttatccctaaattaaaaaaaggatttgcgatttcattaacaaaactatgccataacgaatttagccattctcttagcatttaactagtttctaataaataattttagttttttgtgtaaataggcccacagtttctaccgttttcaaaaagttctctcaaaatgaataaacttgtcacttaccatttgtatctgccattgtgacattctgtctgaattggatgttcgttttggtctctacggattgatccaattgtcccatttcattcacaaatccctgaaaagggttccttccatttagtttcagcattttctaaaactaccaacttggcaatcgattgtttccgctgacatttgaaggcccgtctctctgtgtttgggcggcgttggcggggccgtcgttgtgacactgtccgtctcgtcgctatgcaatggccaaatgccttcgctggaatttgcacaataaatattgtgattgattaagttactataatttgaccgttaaaaaatgtcgaatgctttttggtttacctttctccactgtgttcgttaccattttcgaccattgccatgtcattttgtccgatggagacgctgctctgcgttgccgagaacattcccgagtcgggggacgcgcaggggacagagccatagtcatggtcatgcaaaactgccgtgtgctgctgaaaatgtttacaattgaaatacaaacatttattgtaaaatgtgcttgccaaattctcttcttcagcgacttgggcaaaaagttcttcagtgtcaagaaacgactcaaaacgttctgcttgaaggcaaccgctttcaacttcctcttttctctaaatacatttcttaggaatgaagaaaacattcaactgaccaacacgggcaatttgctatccatcccattgttaattaaatgcctatcagcatcagaagcatattcgaagtaaatatcactcccctgctgatcaaaatcggaagtattcatcgccgaataagaaaagaaaaaggagtcggccaaacagaccgctgaaagaaaagaaatccgaattaaaaaactttatgtacatatgttgaggaaaagcaattcggtaatagtacggatggtaccccccttttcgaaaaacaaaatgtttgaaattttttttcgtgaaaagaccatattaagggttttaagggtcggagaatccgaatctgacattaattttgacctatgtcgaaccccgaacctgaattcgagtaaaagtcgaaaatttcaattttccaat

SEQ ID NO: 20060 - DNA, 1174 bp, Heterodera glycines
gggtaatcctgtattttattggtcccataaaaaaaaagagattaaagttgtttttatgcaattcagagtagtacccgtggggttttcgggggctctgatcacgaatgtgacattaattttaacctatttcgaatcccgaacccgaattcgaacatttttttataaaaaattgttgaaacgcatttcctagggtttttcggggtcgctaatcacgaatctaacttcagttttatctatgccgaactccggacccgaaatcgaacaaaaggagaaaattaatttttcaccaagaatcacatttattgtcccaaacttattcaaatgaacggaatataatagaaaataaagattcaaggccatttagtgaatttgaatcgattttggacaatacatgtgaattttggtgaaaaattaacttccgacttgtgttcgaattcgggttcgggattcgaaataggtcaaaattgatatcatattcgtgatcagcgcccccgaaaacccccgagtattactccgaaatgcataaaaacaactttttaatctctttttttttatgggaccaataaaatacaggattaccggaaacaccttgaaaatttgacggataagaaattccttttcttcgagcgtattcgagtccaaatggtacacattgttacgaattgtcagaataatatcagttacgggctgaattattcttagttttgaaattttctgcttaaaacttttcgtgggtgaactccgtcgaccacgcgcaattccctcaacgcaaattgctccttcttcgcaaaagtgtcgtccttttccaatttgacaatataaaaccttaccgccacgggttgacttattgtaactaaaaagcaatgcataggttatgatgaattacaaaatccttttgttttcatttcgccctaatccaagccaaaccgaccagcaaggcaccaaaacgtctctttcttccgtttggagtcttttttaacatttgccagtcccaataacctttcgccgtcttgttggaaaagtgatttttgtagattcaacctaaatgcagccattgctataagaaacctacggaattttcaaattttaaagcaactaaatattttatggcataatgtttataatttaatcttcttatcacttaccgctcaggcccaccgaaaaacagtactca

SEQ ID NO: 20061 - DNA, 816 bp, Heterodera glycines
aaaaaacaggcgaaaaaaatcattaaaaatgaggaaattttgcacatttctcggccttctaaaagttagattttttttttaatattatattaaagcaattataaatttaacctaaacccctcattatttgttagcccaatctatggttatcatcttttcataaataaatgggaatttgtcgtttaataattttttgctattaatagaaattatagaacaaaaaattttttagagaaatattttaataaaaataaattttgaaaccataaaaatataatataaatgaaatgcatttgaataaatgcgcttatgaatatattagcgtgacctcaatcaaataatactactacaacatattcgtttattgaaatctctttgtttaatataacatatgaatagccttttgtatataataaaaatggcaatattagccgaatttttattaaaacaatcaatataactaactattcaacaggtttattttttcagctttacgaaaaattttatccctcgacattttttaaaaattatacagctatcctcaccgaatttgctagcgaattaaaatggtaaatggattaatttaattataaaaacttattatattaaattgagttaccatttaataaacagaatcagctgcattctttcaatttgctgctggtctgtggtcttataaaacaaaatgtttttacttacatataaacgattttatgtttcttaattgtaagcactttaacgaaaacggataattagagtcgattcacataaaaatttgaaatactagggccgcgattttagtgaaaactttttttt

SEQ ID NO: 20062 - DNA, 1552 bp, Heterodera glycines
agaaatcactattttggcgcttcggcactaaaatagttaaaattcactattttggcattttttcactatttcgacattttttagataatttttcaataaaaatgtaataaaaacgaaaatacacccctaagaaacgacttaaaaatttcagaaaaatacacccttaaaatcgatccaaaaattttcaaaaatagactcataagaaaagaaaatttttttcttattattagcttaaagccaatggtcgtagcagttaaaaaaggaagtaaaacattaaaaaatatttatccattaaatttaatttttgaatacattcatttaatccattattgtattggattggaacaaaaggatgtagtttttgatttaacagatgctttttgattgcccttttaagtagatatcggcgcgaacgggattcccgcgggaaaagatgggaatcccattctaagattttgttatttttgtgcattaaaaaaactcatttacttagatacaattttaaatgtttaaattataaattttcacttgaaaaataattaaagtaaaaattttagaaaaaatcaaaattttttcgcaaaaataaaaatttttcccgtcccaggcgggattaccattaaaattgacgagatttttttatgggaacgggagaaaatcgggaatcccgtttgggaatccccgtcccgttcattttcgttttcccattcccgttccaaaaattttcaaccaaggagattggattttctcggataagtttatacaaattttgaggtttcccctgagcataataatggtttaggtgggctgctgataggccaaaaatacgttaaaaacggataaatttattagctgaagaaaaattcgaagggattgaaaaatttctcattaaaaattatttagaaatttttcataaaaattttttattaatgaaaatgattgatttaaatttttaccattttaattatgttactgtttcgttcaaaaaagcttttcaaaataattgattgttttgattattagtttgatcgtttctaatcaaaattacaaattttcccactgaaaagaaaattgaataatgtttaaattcgtaaaaaatgtgtgatctcctaaaaatattaaataatttaatgaaaaatgacgctaaaaaattgcaaatatatttttttaaaagagacataaaaaatatgtattaaaaaaagcttggaaataaattttggattagctagctttcttcacacttttcaaattgagataccaaattaatttattaattatctaaatttagaaaaactgaaaacttcaattctttatcaaatcattttttgtgccattaagcagttttgtgttgcttttgttcataaatttgtgattaattttataaaaagtcatttttgaatttttatagaacatttctaccttttaataagttatttaatttaactgattttcaggaaaaatataaagctgatgaaaatgatttttaagccacttttacaattaattgtttagcttttattaaattatttatttcatttttttattaaatccggca

SEQ ID NO: 20063 - DNA, 1940 bp, Heterodera glycines
  misc_feature (1922)..(1923): n is a, c, g, or t
accattgccgaaataatcgcctaataatacatatagtcgagttgcagaaaaatatgactatttttgtataaaaattgactcgtagtgtattaccaattcttactgtcttttcttgacaaggcattcgtttccgatattttcagttaattgataagtttcggaattgccaattttctttgcgtcctattaccatggctttctcagctcgcgctttgcattacgttttccgtgtggcggacagacgcgcgtctcacaaattttacacacaaacgcttgggatgaaagtgttgcgtcacgaggaatttcgggaaacatgcaaagcgaattgtaatgggtacgcattgagatgagaaacagtaatcaggtcaattaacccttgaatttatttagcccttttgatggaatgtggagcaaaacgatggttggctacggaagtgaggacgaacactttgtgttggagtgagtgggggtgggggggggagaggtgaagaatgggcaaaaaggcattggttgggctgacccctacatgaaatcaaggttgttttgaactgcttgaaattgtgctttcctcattaaggctcacttacaattacggtgtccattcttacgaactcggcaatgatttcagtgtacgaatttaacccagggatttgcttccattttttagttcattttcaggccattctcattgaatctgacgacgttttggcgcgcgtggaaagtgtgggagagcggacagcagaagggactcttttgctgaaagaccccgacggacattcttttttcgtcgagggcggaagcgctgcgcatccgttgaccaaagtgtcactgaatatcaccgatttacacgaatcacgcggtcctttccgctaattcggttagcttttagtcccgtttcaatgattttcagaattttggtgccaactcctcgggatgaaattggtcgaagggacggacaacggaagtaaaaaatgccaactcgcatatgaccaaaatcaggttgaccaaacaatctttatttccatatttgctgacttttaagtgtcacctcgagctcatttcgttagcaaatggagaacctttggaccgaaagacggcattcggtcgaattgcttttgccacggcgacggaaaatgttttatttaaagttattaaaacaacacgcaattgccgctcctttcagttgaggccactcgaagagaaagtcggcacaaagcgcattcattcgccactcatttctttgggcacacccggcaaagcgaccgtttgggtggtcattttgaaagacccggttacttaacctcataaacgaatctaattacttgctttttaggatgagcatgaaatttgttttgtgggcgacgaaggtttccaagaattatcgaaagtcgacactgaagcggagaaactgttgctgagtgcgattgagaaagacgacagttgaagcagagtgataataatttatttaaaattgtgcttgtattttatataaatatatatgggtgagataataaaatgtctttaattacactcatcactcatagtcaacaacaaaacaaacaaaaagctcagtcaacataaaaaagtcatcgaatgtttattggcactcccatttcgtcactagtttttctgctccaacctgcacaaagggtttctgtagatcatttcgagatcaatctgaaaatataaaaaatttatctgttagtgagcaaatggtgaatgccttatggccaaaaagctctcttatgttggaaatgccgtatctgatcatggttggcctgaaaagggggcttagagactgatttaagccgaaccaaactccccaccgctcgagggagagaccgaacccagccacggcaacgtcttccggaagtcccatcggaagcaacatctcaggcctaaatgcaaaattagccataganntaaatgaatgatttctt

SEQ ID NO: 20064 - DNA, 968 bp, Heterodera glycines
cgtctccgagtcgcaagtccatttgtggtacacctgtctttaatggtggcaaactgaagggaataaaaagcaattagaaaagggtttttcattttaataatggtaataaattttgatagatctaacactcgcaaatgttgattaatttataggtaattaaatctgttttttgactataactgcccaatttcaacatgacaatggctttattgcccctcgccttggctgacctgaaccggctgaccatgtgggccgccttcgaggatctgaaccgggtcgaactgaccagtcatttggcgaaccccaaccagtgagtactcacctcgtacctgcacaccggcatcggcaccacttgcgtttggaattgggtggtgatctcggacacctccaactgggaggagacggtcttgtccgcctccatgtagaagcattggatgcgataggcgcggtcaactttggtgacgaattgcgggtggaaggagatgaccacggtggtggacacgaacacgcctttcgggttcagcgaacgggtgcgtgccacgttgcacgtgtcgaatggcaactcaatgccggcaacctgaacagggggggggggggaaagtcagaacaaaataaattatggccagaaaattaggaaataagaaaaagcgaaaagggaaaccatatttgaatttggaattattataattatttttgaattaatttttataatcaatttgaactcaaaattggctgattttttgtctattggtctccgatcatttttaattgttaaataaatttgataaaattattatttttttaatttataaatttgacataattttttttgttctgaaaaatctctattccccaaaagaaccgaaaaccttgcaaatttcatagaaaaataatatgcttaatggtgtgtttgtttgcccacttgtcgtccgtgctcatccgatcggcacccgccctggtcgaacagt

SEQ ID NO: 20065 - DNA, 1868 bp, Heterodera glycines
ttgctttctctcccggcgctgctttgatgatacggaaaaagtaatcactcatcatcatcatctgctgttattatgcctaacaaaaagtcggacgaaacaaattcagtaagagagagagagggaggaagaaacagaaacagaaatagaagttggacaccgctgccacccggacaacgaacgaccaagacgacggagatggtcattagcatcatcatcatcatcattaagtgatgagcatgatcaactgcagcagctgattgccatcacaagcggacaccggcggtggaatgagaaggcctcgcgatggcaatcatttatggaatgcaagtgtttttgacgcacgccgaggtcgacccgtctccgtcattattacttttgttaatgaaaaagtgaaaaaaaggaagcggcaaaaagcgacaaggcaacaagattttaaaataaaactgtattaaattatttaaagaataatgctgggcaaatggttgacctgggagggaatcgaaccctcgacctacgccggtgcagaatcggttaccccacatttgcgcctcagacattcgcgcctatgtccaaaaccgagttcaaaaatcatcaattattcaaaaagcagaattaatgctccaaataactagaagacttggatttcttctttctgtctatacatataaaaaaggaatactaatcacttgggtgaggattaatttacaacaaaatcccaaatatttaagaaaaagtgccaaaatacttaagaataaaaatatatcgacaaaaaaattcaaaatctcttctaaaatgcaaaaaaaaaaaaaaatttaaaatttatccgctgttgcagttgctacttaagtattttccgaggtaaaatttatacggttttcgacatgaatatttttgttaaaagaaaatgctcgtcaaaaataagcacattttaaagcgccattaaagcctaaatttgcatgttactgaacaaaaacaaatgttattaaaagaatgttcttcatatttttcaataatttaattatttcaatatttttgggtgaaaacattttacagatttagtccaaaaattggtcattttcgagatgtaacaacctaaataaaaaaaaattggtcaggcggtgccgacaggcgtagccgaggaaatttcgtgggttttagcctgttttgagaacagattttgcacccaaaaataagtaaaaaaaattcaaaatgccaaaatatttaccaaaatattataaaatgccaaatatttaacaaaatattttatttacgaaagccttaaaaatatattttttatatttactagcggggtcagcgccttcggcgcatcccccgctaggcagtacgattgtgttatagaattatgaatgataaaatcgactggctcggccgcttcgcgccctcgcatcattttcttggcttttctccaatctctgggactaaacccaccagcaattcaatcactgggactcaacccaccaacatttcaatcactgggactcaacccaccagcattccaatcactgggactcaacccaccagcatttcaatcactgggactcaacccaccagcatttcaatcactgggactcaacccaccaacatttcaatcactgggactcaacccaccagcattccaatcactgggactcaacccaccagcatttcaatcactgggactcaacccaccagcatttcaatcactgggactcaacccaccagcattccaatcactgggactcaacccaccagcattccaatcactgggactcaacccaacatcatttcaatcactgggactcaacccaccagcatttcaatcactgggactcaacccaccaacatttcaatgactgggactcaaccca

SEQ ID NO: 20066 - DNA, 1912 bp, Heterodera glycines
  misc_feature (28)..(30): n is a, c, g, or t
  misc_feature (35)..(35): n is a, c, g, or t
  misc_feature (48)..(48): n is a, c, g, or t
  misc_feature (84)..(84): n is a, c, g, or t
aaaaaagacatgaccataaatattgacnnnacttnaatgcaccatacngtacagaaaacaaatgtgttgttttattactttttntgaaacatatcgaaattctttgaaattttgcaggctcatacagaactcttatttgttagagctattgaatttatggagaattttaatttgggtgtttttagaaaaagttatggtgcattaaagttgcaaattttttatggtcatgttcgtgtcttttttatggtcttgtgaactgcaatagagccagattttgccctcgtttttttctttgtagttcagtttatctctgaatttttaggataacattcgaatccaacgaaagataaaatgtcattttattgctctattcgagtgaatcggtcgcgggttttttacccagaaatatgtagagaaaaccgcaacaaacgaaaaacacactcctataaatcgaaacaatttcagtaaatttactcctaggaattgaaacattttcttaaaaattcaaccctaaaatttgtttttctcttgggaaaatttttttcgattttaaaaatcttcgaaataggtatttaattagttataactggaataatccctactattgattatgttttttgtttattaatacagaaagaacaaaattccacttaaaagaatctgtcaccccaccaaatttggctgggtttgtggtggaaggcgtccgtccgtccctcactcctttcgtttgaaaatgcgcagatttatgttttgctaattttctgttcataaaaaacgggccaagaatttgactttgctgagcgaatagcgcaccattccgttcattccgttttgtaatcggtggaacgtttttcactttgttaaattactacacatactttacctttaaattttccaacgctggagagaccgcagaaatcacaaaaattctcattaaactaaaacctatcaaataaaacggggattggataattaaagaatatttccgatttcctcaattttttttcattagaacaaaggaaaaacctaaaaacattgggggagggaccctcttgatttacaaatgttttaattatatttttcgcaaataggatttttgggggttgctgaacacgagcttgatatttttcgatgaattctcgattttttgttcgagttcaagtttggagttcgaatttagtcgaaataaatatcaaactcgtgttcagcgatccctaaacccctagtaactaataaagaaccctgaaaaatagttgcttttctgtttaaaaatcgtcccacctaaactacatataaaagtaccgctatacttattgtcatttttaccaaaaaattacagaggtcctaaatatttataaagattttttttaacattggccactaatggaggaccgacaaggccaattgagatcacgaagggcacaaacacaacagacagaaacaacggtggaaggaccaactgacaacagaaatgggaggactgggggagaagaaacgacggcgaggactcatcgaaatgggggaccgaatgaggcgagttttcatggatatgtgaccagttttagaatttatgtccagaatttcaaaattcgcttttttgagtattattaaaaattaaaggagaattgaggaccgaaagaatgtaggcattgaccaagtaagaaaataaagttatgggccaaagaaacttaacattggatgcctaaaattagctatccaaaactccaactttagggatataaatttttatcgtttttaatgaaaattaggaattttaaaggaaattgtgaaacggaaataggccactttaactgaatccgcctagccctgttaacgaggctgcccgtttagcttggctttcttcactggcttctcgtcttctgtctcgtgggcactctctacggaatgagta

SEQ ID NO: 20067 - DNA, 2027 bp, Heterodera glycines
  misc_feature (11)..(11): n is a, c, g, or t
ccgccggaccnccctgtcccccaaaaaatttttttggaaaaaccgcgccaacaaaaaaaacgggtgtgaaaagcaaaaaaaaaaaaaaaaaaaggtcgtcgcacggggggaggtgccccccccaagccaaaatcctgggaccgtccctgtaaacaaggttatttttaatttgattttaaaatttttgcaatatcttaattaatacatatttgcattacatttatacatttggtttttatatctgtttatttttcgatttaaaaattaattatatcaaaattaatcattgggattattatgcattatctttttaaattttttccaaattattatgaagcgactataatatgcaaaaatgatatttttaatgcttggtttcaataaaattaataatgtcgggaataataattgtttttttagaaaaagcctcatatgctgcaataatgtggttttatttgttatattgttttatattgattctatcaattaatgttaaattgacaatataactttaaaacaaaatttgctcttcgaattttttatttcatcatttaaggcatgaataatttaaaacattttcacatggcacaaaagtgtaaagccattaggtcatcatttgctgcccttcaaaattttcattttattatataaatgctgtttacgtgaataattaaatgaactaatttttgctgtttatatattacaaaatttttaattttttaaacaatgcataatttcttattatacaattagattataattaaatttcttcttcttcaaatattttcattaaaaattcattctatcgctgatcgattttagcccttatttctggtttcattcggcgacaaaaaaaatcatgctttgttgttatgaatcagcatttttacttattttatttatttttgataattaaatgagttataaatttgcgtttacgtttcatcaaataaacattttcgctcattgtgtagtttgtgttgcggcacatgaggaaaaagtgttgatgttggatttggatttggatacattagtcaagctcgacattttgaaaaaagtctggacctggacctgaacctggattccatgttggacctggagctggatttcctggacaaaaatccaggaaaatccaggtccaggaaaaatccaggctcctcgagacctggatccaggcctggacctggattttttgaaatttgttttaaaaaggcaaaaaaatctttgaaaaaattaattaattgcttgagaatgtctaaaaatatcaatttcgtaataataatgtgtttttaaatctatttatcattttttgataaacttgaaaaaaaatcagtcaattgaaataataaattccaaaaaacataacatttggaaaaaaagtccaaaaaattttgaagggggttttcatttttttttatttgaattaataagtttttcaaaaatttttacaacatgtaattttggaattttttcataaaaaattttctgatttttttctaagtttataggtcaatcgatttaaacaattttgtgggaaacataaacaatttgaaaatttcagtgcattcagaatcaaaaaaccagatttctaacaatttttcggcacattttttcaaaaaaatttttaggatgtgtgagggaagagagcccggcggtgccgataggcgccgctggaaaattttgtatttttaatgcgatttgttaacgagtttgttcaaaaaatgacaaattttttcgattttgagccaattttttaagaggataagaatttttagggggcggagtgaaaattttggcacattttataccaattttaatacatttcgccataaaaaaccgaaaaaaaatttatccaggaaatccaggttttttgtgcttggacctggacctggattttcaaattgacctggacctggatttcctggacaaaaatccaggaaaaatccaggttgtcgaaaaatgacctggacctggacctggatccaggaaaaatccaggcctggatccaggtccaggtcgagctctat

SEQ ID NO: 20068 - DNA, 1626 bp, Heterodera glycines
cccgccccggtcaattttcgaagcccggtcccggtactttcaaaattccggtctctactaaatttttatgcattcatatatcatcattttgacaaaaattgcctaacattataaaaaaaaatgagtattgaaacgagggcgccaaattcaaaaatctttttattcccaactgatcaaatctaagcaaacataattcttagtcgataattggtgtttgaaaggtttatctgatcaaaatattaacgtgaacagtattttaacaaaaccggataataaaattaacgattcctaacaattgttgatcaaaggaaaccgttttgtctgtcgaaaatagaattgagcaatgtctgatgttctccgatcttcagcagcagttcgtcgcccttgtaccgcatgaagcgctcagactaaaacaaaaaataggtttttgaactatgaaattgagtctgtccaacctgcttgttcaaaacgtggtgaaggtgttcgatgccctgttcactgatccatgcgaaccacccccagcgcttggcaaagtctggcccatgggcgagaagccagtgtaattttggggtgaatccagcggcattgtttgtgtcgaattttgatcacctaaaattaattagaaaaaaggaaagaggtgaatgtcaggaccagtatactcttgcgtcttggcatgccgaattgctcccgatttaaaaattgtgcaaaagaatgaaaaaattataagaccattcaatcgtcaaatttcgatcaaatgacaaatcagcgatttgctcaagctgttccaagaccggacctagtcgcgcttccatttccgagcgggtttcgggtccctcccaaaacgcaagtaaagtcacttggcaaaatttgatttttaaatgaaatgaaatttttggtcaaaatttcactactttttggtgttgaaccgccttttcttccactttccatgcgccattctttccgctttcgctttgcttcattaccagaattgcttagtttcattaatttatcagtttttttacgtgtaaaaaccatctaaagcataaaaaaaagttgtgaatttatttaaatttttgtccttggaaaaattttttcctgttggccaattttcttgaaatttgctatagtctcatattttaataaaacttataggatgatgctttattttttgtcaaaatgctttttaactcgagatcgactcttcagtttttacaagggaaaatatcggcaaaatttttaaattagtggggtttttggcggtttgtccttaggcaatttttgtcaaaatgataatatatgatacatgaatttctgataacagttctgcgaataacgaaaatggagtaacaaaacaatgacagaatggacacaaagcaataatctcgaatcacgtttattggtccgctttccctctttccgcaacggtttgactggtcaaaactttacgaggaagtgactttttcctgcagggccaactgagtcttggctcaattggccagcagagagaccataagataatctcggagcgaatgctccaccacacacttcatcttctcggcaggcaattgcgtgttcgccagtgaaacaatctaaaatcgtggcaatatcaatcgcgttaatttctgg

SEQ ID NO: 20069 - DNA, 2278 bp, Heterodera glycines
aatacccgagaaaagcttgcaattccccaccaaattcaaaaaccaccaaaatgtttcccttgaaaattgcatttctgcttgttcttatatgcacccctaattttggggaaaattcttcaacggaaagcagcaaaaaatcgcgaaaagagcgcggaattatttcaattccgctggcaattggggccgtgacagcttttctgacgccgatcatcatcggtgcaacggtcgcgggctactacatcggcaccaaatcgactattgacagcaatgatcgtgcgaaaaaataattaaaataaaataaaaattagagttgagcgggttcaggggcgaaatttttgagttttttgatcaaaatggtttaaaaaaatattttcattttttagtcaatctaaagaatgaatttaacactgaagggaaatatatttttaaattaaaaatttgttattatatggcaaaaaaatattgacatacattgattatcgtttccgacgtaataatattttatgtagaaaacaatttttattacttgcaaaatatttgtttcattgaataataattattttaattaattttatcattgatattattttaggatcgcccacattgatacttttttaggatcgcccacattgatactattttaggaacgcccacattgatactattttaggaacgccccattgatactattttaggatcgtctcagcacgtaaaaaactattgaaaaagaggataataaaaaattaatctatttaaaattaaaaaaatcaaagtaaaatttataatgaaaaatcaacaaaagaaaaatggggacaaaagaaatttaatgaaaatgagaataataggaaaaaaaagtaagaaaggttcgatgaacacaataaggtacagtaaatgctctatttgaatgcccgggcattgtattgttcaacccgtcccaaaaggggcatttaagtggagggaggcattcaaatagagcattttttgatcagcaccaaaagttatgttaacatgaattatttcagatattttggcccataaaatattgactttttcttcgataaatttaatgggacgacaacacttttgaccacctaaaaatggggttggcacataaaatcgaatagaattcgggcaccaaattttatcttgactaatgattggtttcattgaaaagcccataaaaaatcttatcagaaagtgtgcttctttttttattgaaagcaaaaaaataacatttttacttcctataatatttctcaaaaaaagatgagacaacacttttgaccacgactgtaattgatttgataatattttatttttatttgtctctttttcggaatttttacaacttttttctaaattttcagatgtcttcagaaattttttgttcgcctcggcgaaagcccaacgacatgtccaaagtgtcggtcgcacacttcgctgatggaaaacatttcactgtcctcttccaacgcgcaaacaccagcaaatgaaacggattcaaacagtaagtgatgagagacgaggagaaatgccgaattaagtgcaaaattaccgacaaaaatggcatttttgggtcaaaatacggcattttcagttgccgagttcgccgtctgtcctcttccgaccgatccatgcacttccgctgcttcaacttcgtcacaaattcagcagccgccgcccattcccgcggctgtactttgtgaacgcaattttgtacggcctcaattaccaaaactgattagaataattggcattttcttaaaggatgactcgcgatggaaggcgaattcgcattttggcgccgtccctttgccctcctccgccaccactgaaatggcatcggcagagcgtcggatttgtctgtcaacttccaccgtttcttccacctgttcaatttcaatgcgacaaaaggggggaaaagagagcgatgacggaacgccaaaaaatggacaaaatgggaggggacaaaagaggcgggaggagaaacaacgaaggacggcacagccaatcacaacactttcgacattcgcaacccaaaaaggtgagagaaacggacgaagaccgatcgatggtgaccactgatcagcagaagtgatcagcgcaaattcaattgatcagaaaaggggaggaagaggaaagagactgatcagaaataatcacaagagagagacactgatcatcaatcttttcgaaaaataataaatcagggaaagcgatcagcgcaaagcaattgattataaagggggaggaggaaacaggctgatcagaatttctt

SEQ ID NO: 20070 - DNA, 2475 bp, Heterodera glycines
taattaatttttaccgttcgcagtaattagacataattaattaattactctataattgcagtcaaagaaaaagctggaaaccgacatcaatgatttggagttgggcttggacatggccaataaaacaaacatggaagcgcagaaaacgatcaaaaaattgattggccaagtgcaggatcttcagctgcaggcaagtgaaccacaaaatttggttttttttgtcgtgttaaaatttgttgccactagtgattaagttgtccaggcatgttttgtgctctttctgattttgggtgtctcgattatcatggagtggtctgatcaaaatggttttctagtattcccgttgatcactcactgatcaccggcatttttacttgaattacatttttggcggagaacggaaaaatttgctagttttttttcataattttttttttcaaaatggttcattcaggttgaggaggagcagcgtcggcgtgaggaacagcgagagaactttttgatgagtgaaaagtgagagaacaattaaaaatataattaatattttaatttataaattattcaacaaaaaaaaatcttccaaaatttaaattatttaataaaattaaaaatatttgtttcaggaaattgaacattgtgctgtccgaacgcgatgaacttgttgtgcgccgagagcaaatggaacgggataaacaacgggtggaagccgaagtgcaggaggaacgggcgcgcaagacggagctgcaaatggacaactcacagctgagcgccgcacgacgccaagtggacaatgacctacaattgacgaaggcaaaaaatataaaaataaaatttgaataaaatatatttcaaaattgaaaaaatgacaattttaaaaggctataaaatgaaatgaataaattttttttattaattttaatttttagatcagattatgtttcttaactttagcctgcaaacaaaaaaaaaaaataaatttaattttaaataattatatttattaaaaaaggttttttttattaattatatatttttttattaaattatgtttctttacaatagcctgcaattaaacaaaagaaatttaattttgaatttttgttaaataaataatagtaaatttatgtgaaaatttgtgaaatgttgaaatgtttaaaaaaaatattttgaaattaatttaataaattatttaaaaaatgaataaatatgcatttgaaataaacaatttttagactgagttggacaaaacgctaaacgaactgaaaatggcggaagaatcgtccaaaaaagtgagcgccgatgtgacacgacttcaagaagaatatcgcaatgagcaacaccacaatgaccatgtggagaggcaaaagcgaggattggacgcgcaattaaaggtcaaattaatgaaaatgaaaacaaatttgtttaaaaaaatatgtaattaatacaataatatttattgttttttatttcatttaaatttttatttatatcggttcataaaaaataaatgctttatcatttctttttaattctaatttaattttaattcgtttattttttatttaaattatttttatttagtcatttcattaaaaaatggatttatcagttattttaaattttaattaattttaaacttcattccttttttatttttttctttagtcggttcattaaaaataattgaattgttttttgttttaatttcttatttttttaatattttaaatgatttattcgaattatatttgttcaatctgaaattagaattttgttaaaattatttttataaaataatccttttaaatacaattaatataaggaattgcaactgcgtcttgaccaagcggaagcgaccgcgcaacgcattggccaacggacggttgaccaactacaacaactgatcatggcccgtaaccacgagttggacctggagcagaaacgtcacaaggaattgatacgccaattaaacaaggtggttaattaataatgcacagtcagtcagtcattgatctgctctcaaatctcttttaattaccaataatttggacattttttttttgcaaattgattaattgtttaaatttcacataagcctagcaattaatataaaaatttttaagtctcgagcaaaaaaataattctgctttataaaattttgaaaaatcttgaaaagtttttagaaaaaaaattttcttgaacattttcgtaaaaaaattttataatattttttattgtcctaaatctttttggtttccaacaatgatttcgttctgctggtctctgaaataaaaaaattgtcaaacatttatttgtttgtattatgaattttattatataaattaaataatgtttttttttattattttttaattcaattttgccaatgctttcagtccgaccgcgagtgccgtgagttccaattccaagtggaggagcagaaaagggcacggccaaatacaatcgttgatcgaa

SEQ ID NO: 20071 - DNA, 2433 bp, Heterodera glycines
ctattcctgagcaggatgaagccagaggaaactctggtggaagtccgaagcgattctgacgtgcaaatcgatcgtctgacttgggtataggggcgaaagactaatcgaaccatctagtagctggttccctccgaagtttcccccaggatagctggagctcgttaagcagttatactcggtaaagcgaatgattagaggacttggggacgaaatgtccttaacctattctcaaactctaaatgggtatgaagccagggttgcttgactctgaacccaggcgttgaatgtttgagctccaagtgggccatttttggtaagcagaactggcgatgtgggatgaaccaaacgtggagttaaggtgccaaagtgcccgctcattagacctcataaaaggtgttggttgatatagacagcaggacggtggccatggaagtcggaatccgctaaggagtgtgtaacaactcacctgccgaatcaactagccctgaaaatggatggcgctggagcgggccacctatactccaccgtcattggcttgtacacgtgcttgtcgcgtagtctggccatgacgtgtaggagggtcgtggtggttgcgttgaaggctttgggcgtgggcccggccggagcttccaccagtgcagatcttggtggtagtagcaaatattcaagtgagatccttgaagactgaagtggagaagggttccacgtgaacagcagttgaatgtgggtcagccgatcctaaggcaccggctaacgccgtaacacactacggatgacgacttttctgtgcttgcgcagttggtccatccggtgccggaagggaagtgggttaacattcccacgccaggctagggaaatgacggttcgcaagagctgttttgcgcggtaacgcaaatgaactcgcagacgtcgtgtggagtccgagccagagttctcttttctggtttagggtgtgcgtgcctggaagtggctcagcctgagatagggatgttgcgcccgtaaagcaccgcggttcctgtggtgtctcgtgcgctccacacggcccttgaaaatgcgagggaagctatttgaatctcctgcctgatcgtaccgatatccgcagcaggtctccaaggtgaacagcctctagtcgatagaataatgtaggtaagggaagtcggcaaattagattcgtaacttcgggaaaagaattggctctaaaggtcgggtcagccgggctgttgcgtgaaacaggcggcttttgcccgtggctgcgtgctgttctttcggggatggtgcgtggactagtggtgagagctgcttgtggagcgcttcagctgcgtgtatgctcgtcagggtatgcacttcggttggcgctgaacgaccagtttagaactggcacgaactcggggaatccgactgtctaattaaaacagaggagacggatggtccttgtggacgttgaccgtgtctgatttctgcccagtgctctgaatgttaagccaaggaaacttgattaagcgcgggtaaacggcgggagtaactatgactctcttaaggtagccaaatgcctcgtcggctaactaccgacgcgcacgaatggatcaacgagattcccactgtccctatctactatctagcgaaaccacagccaagggaacgggcttggcaaatttagcggggaaagaagaccctgttgagcttgactctagtctgactttgtgaagaatcatgagaggtgtagcataagtgggagccgcaaggcgccagtgaaataccactactttcatcgattccttacttaatcggtaaaacgggagtgcgcccgaaagggtgtccattttggtgttaagtcgggccacccggtggcccggcgacccgcgccgatgacagtgtcaggcggggagtttgactggggcggtacatctgtcaaagcgtaacgcaggtgtcctaaggcgagctcagagaggacggaaacctctcgtagagcaaaaaggcaaatgcttacttgatcctgattttcagtacgaatacggaccgcgaaagcgtggcttatcgatccttttgaatgtgtaaagtttccagcaagaggtgtcagaaaagttaccacagggataactggcttgtggcggccaagcgtccatagcgacgtcgctttttgatccttcgatgtcggctcttcctatcattgcgaagcagaattcgccaagcgttggattgttcacccaccaatagggaacgtgagctgggtttagaccgtcgtgagacaggttagttttaccctactaaagacctgttgctatgatagtaatcctgcttagtacgagaggaaccgcaggttcagacatttggttcatgtgcttggtcgatagaccaatggtgcgaagctaccatctgagggattatgactgaacgcctctaagtcagaatcccgcctaggcaagatagcaatat

SEQ ID NO: 20072 - DNA, 4018 bp, Heterodera glycines
ttcatcttggatttctccatagttcttaattcgttgtgtgcctgtgaattttgtttttttataaaatccatcatggctatgcaaacagaaattatcaacagttgtttaaaatctctagattatgaaatattaattttatgataacttattttaacatgtttgtgttatctatgaaaactcattatcatccgagatttatttttgtcaattatttcataaatttgaaattgttttgttaattattgttaataaacttctatatcccattgtctgtacttgtctctattccaatttttctaatttttctaacaattcttctcttgtttatttattttgcaagttattggtcaattaaataattagctccattatgtttcacgaatgcatcaaaattatttataatataattatttccaaattaaatatttttgtttttcatttttttaccacgtgaattaatttatttttatatcattgaaaactaaagataaaacaaaaaatattaaatttaaattttttattaaagaaatataatcagtaaaagaagcatttcaaaaaattgtttgcctatattaatgcagtaattaataacatttatatcattgctataatataaatttaaatatttattctagcattaaataaatagaaataaatattacttaaataatatttttttattatattctaatcatttaattatatttttgtttaattattcttgatgtcttttaaataataattctctttttcatgccttttacacgtttatatgcattactttattttataagaaaaaataaattcaagtaaccattatttttttttgttacagtactttaagaaaaaatatcattttaaattatgtgttttgaattttatatttaaatttatttatttatttatttacgctatttccaaaatgtatattttttaaagttagcataaaatgcccgaaaattacaaaaaaatgtcaaagaaaggcattgttatttaagtatcgtaatccgaataaagggaaattggaaatttcgtccgtaattataaaatttataaatttattaaattatttttactttaatatttaaataattaattgacaaagatgacttttatttttattataaaatggttaacaaatttaaaaaatgttgattttttaatgttaaaatttataaaaattatttaaatataaaaatacaaaaaaatgcatttaatgaagtataaatattattttttaattaaacaaaaacagaataaatcataataatttttttgaacaatttaaatatttatgaaaagaaatagaatttaaaacttaaacctctgaataaaagcatatttttcaaaaataatttcattaatcattattcttaattaaatggctgcgtgcaaaaattaataaataatagataacaaaattaaatgtttctttaaaatattaatatataaaaaaaaataataattaactttatgctattaattttcggcgtgagtttgtcgttcggcgccgatttggctgtaatttttttcgttgtcaaattaatccatctattgtaacattcgaaaaccttcacacaagcatatattattggcaccatgaaagaagagatctcatacacccatagagaagcaatgaaaaactttattcttataatagaaatattgtaaaaataaatatcattttggacacttaattgaaatcaattaaaaatattaattaaaaaatttcaacaaataataataataaattccataattaaaattatgatttaaattaaagacaatttgtattattatttacaaaatcctaaattaaattaacaactaatttaataataattattaagattattcgtgtccgagtctgttgctagatctatggaaaaaaactcagtgattgaaaaataattaaatttatttatgcgattcgctaaatttatataaaaactagtataaaacttaatatagaaaaaaatttcattgactagcagaatggatccgccaacagaagactcggggtgggattttcttttaacgcatttttaaaatttcaattgagttaaatcaaatcttattaaagaatgttctgatatttctatataattaaattacattatctcatctatttgttcaaatggttaaaaatcattttgccataaaaaataatttaataaacaaaaattatgaaacttagtggaatttcatcaaaaaatttatctttatctaagttttattttaatgtatatttaaaaataaaattatttataaaaataagtattggtggttttagaacaaaaatattaaaaggataaatttattccaaataaatttatatgtatttttttatttattaatctcttcaatttaaatgttatttaaaaacagaatataaaagatttaattcgaaaatattacaaaatctaagaagtaatgcttaaattcaagaaacataaataaattattataaataatctattttagttttaaaatcatatattttttaaatcttacataaattaaattattgattgaattaaaattggttttaaaaaatagcataaaaagtcaaagtggcgccctgtcacaaggatggaattgagattaaaacatttttaatatttatttggtaattttttatataaatattcttatttataaatctttttgctctgagtttacattcaaaatccaataaagcttttattataataattttttggtaattaatttttttagttcttcaaattagcattttttcaatattttattttatttatttcctttataaatttgtagactaattacatgaaccttaatgactttttcaatttttactcagaaatttattttataattatatatttaaaaaggttgcatttaaaaaaaaattttgacagttttaaacataagttttcctatatcgaagaatgcatgaaggattttgtaaattgtccaaatattttttagcaatttaacacatttttgcttctttttttggtttatgttaaattaaaaaataaatcataaattattaatcaaaatgattttataatttatttttagtgaaacatttgaaattttttaaataaatttttgtttcatttttctatattatttagtagaattgaataaaatatttgtttgttaattgtttattttattttttttgaaatttatatatatttaatcaacaagtcatcagggaccctatcaaccttgtaaaaaaattaatttacgagatagaatctaagttagatttccaatttctagtgatttaaaaaaattcaggacgatttagaggcaggccggtagccagaaaaatgtcaatgtaatttgtttattcggtattttcgataatttttatttattttttgaattccaggtttaattgacaaaaaacaaataaattttgttttataaaatattttttggaaattatttctttaggtattttattaaaatttaatttaaaaataaaaatctatgctagatttcggtattttcattttctattgaattatattaaaaaatgaaatgatatttaattatagcttcttaatttgaagatttaaaattattttctatttgataagaatataacaattaacattaaaaatctttaaaaaaaattgaatgtaattaaaataattaaattagatttattgaaattttttaacttatttattattagttttttaataatttatcacattccttttttcggtaatttctttgctttatttttatgcatttattttgtaaatatttcaatcttgggctctttcctagagtcactgacgtggtgaagctaatattagtttttttttgtctttttatgctatttttaacaatcagtttcaatccaattcaaacaataaaaatatggttttaagttattaattttttttttttgctattctataaatatttaaattattcaaaaaatgataatgacttatttcgtaattttgtttagtgaataaaatatttacatttcattaattgcataatttat

SEQ ID NO: 20073 - DNA, 3103 bp, Heterodera glycines
atcattttttcatttaatatttacatttatataaacattattaattcatttttaagcagtttgattagtccataaattaatataattaataaaggtaaaatgtaaaatagtcatataattctaactttgttcaatattaatataaattggccatttatgaccggtaaaaaatgttttaaagaattcttcatcatggtgtattaaatgcgacataaaaaattgcgtttgataaatgaacaaaatgaatacctttgaatgcaagttcgagaagtgaacctaattttacaacatttacaacaaaatttgagtcataaattccttttaacaaatattttttagaaaaataattttaaaaattttattgtgatgacatcaattaaataattgaattggatttaatgtgagttaaaatgacttaataatttctaatgtttttactaattttataacaactcacaatccaaaataaatgtagaaatgtgaaaaaatctaataaataatttaataattaatggtttaaaaaagtaaaatgtcttcatgaattacaaagcgaaagaatttgcatcaaaaacacgagaaaaaggtggatatatctattctataataaaggtgataaagcatataatattcaatgacatttataaccgctgaagaacaagtcgcgtgtgttcaagcttccatacggcgacctgccctttgagtccgtattggcgcgcttctcttccgtgcgcttccaatttatattttaaatttacaatatatatatatatataatccatttaaaaaacacaaagaaaattcaaggagcaaaacaaagtaaattttataatcagtgtattttctcttacaaataaaaataagtataatattttaaattcctatagcaaaattttttcaaaattaaaacttctatttaacaagtaagaacatcaacatttcgtcacatatttttccataataattaactgaaaaatattttgtgtcaatacaattggaacaaataaatttataataattcttattaaacataaaagaaattgattttgcaacatgaaagtttgggtgcgaaaaaagagtttgatctaagcattttcaaaaatgaaaaaacattttttctaaatttttgctcaaattcaagccggagattgtcatcaaattggtttgatttatcctcctcgttaatttcatcaatcttatttttcaaaatcagaccattggtacctttaatactcaatgtgttttcgcctatgccgaaaaacatttaatttttcatttagggattcgacgacgaaaattaaatgctgtagaagatctcggtaataatttaaaatataagctgaacttctaaaaatttatggggccaattcattgcttttactttaaatattataaaaaaaatttaaaatgcttaatttaaaatagatgattgcatattatacctccaacataaagtcggaataaatatttgtacaaaatgttcaaatatttgcgcttcgtttttcattctgtcattttattttctccaattctttcccaagtttggaacattgccaattctttcgcagcaaatacacaacgccaagatggtcttaaaatttagttgcaaatgctcttgcattttctaaatttcttatgtacgatttgtaaataattttgaagccattttagcaagtaccattcgttttcattctttctcattcgcaatcatttggaataaattataaatctttcctttcaaaaactttttaaattaaatttatactggaaataataagattattttaaaataagtaaaaattgttaaataaaaatgctacaataatatattgttgggatcggtactcttgtccgcccatattattttatttctttatttctctcccctttatctctcctctctctctctcttccctgttgtcccccataaataccccgcgtcctctgacctcccctcattcagttgtcaaccatttattttgcttatattgtttcaatcaatattcgccctttgtcctccgtccctcttctcttcatttatttatttgtgttttcccaacttgaataaaataattgtttattcacttcgccggtttggggtttgacggcacaacatatattataaaactttttaaatgcccgagtgcttatagaaaataatctacaaaatatatgttgttttacttatcatagaatataaaaagttaaaaggaaatagttttttatattagattttttgaataaagttaaatttatcataaagtaaataaatcttctcgagcaggaatcaaaaaagaaatactagatttcagggtgatatcaatatttttaatcaaaaattagatatcaaaatttaaaaaattaacaaacactaaactactagatacaaacgatgagtacaatggaaaaataacacaatagagttaaatcaatcatttaattattaaatatatttaattaaaaaactacagaaaacacatatatttttcaacataaactaatatatgctatacataatttaaatatgggagctattgggaaataaaaaacaaaattttattaataaaaagaaaaattgaattaccatgctaaattatatccatactctaattgaaaaaaagataattaatagtgttcattataaaaattttctaagttttatatcgaatataaaaattttctctcactatacattataagatagcatttaaataatgaataaactaaataattaaattacttttaaataaaacatctaaacatatttaaatgtattttatgtatataaatgcaatattaacataataaatttgtaaacaataaataaaaattcgttttacctaatgatgacatgcactacataattttgatggaatacctaacaaatatttgcaaatctttatgcgcatattcgacaaaaaaagatatccctgtttgtcggccacggaatttaaaggcgatagactaaattagataacaattaaattaaaaaatcaaaaatttaatgaaaatcatattatttttagtaatttagcaaactatttgaattaaaaaactaatcataaaagatataaacaattttaatatttctataatatattgagat

SEQ ID NO: 20074 - DNA, 2110 bp, Heterodera glycines
cttttcttccggtgcagcaccaccagcagcagaagaagttggagcagtcgcggcactaacggtggaaaatcgggccgccggacggggccgacgggcggtgcagcaggaaaaattcaaattccattcatacggcgttacgttggctacaagatacctaatttttgaaaaatcgtggaggggtgagaattttttgaaaattttcccttcccgaataattccacacacattccaaaagtgatgccacaaattgacagcaaaatgcacagccaaatttccaaggacaacgggttcaggaaggaaaaaatgtcctggaaaataattggatttacagcagaggggagaaggaatggctggcatactgtaccggttggtagtcttccgggatacggtacagaatactgatgcccagcgacaggaagggtttggtgaagtcgaccacttcggcacgccgaaaattggcctgaaatgccgtagcagttcgttcatctactttcacacagtcaaaaatttatttacttatttatttttattataataaaatttaaattaatagatttcaaatttcataatgaataatcgcaaatattttcttagaaccagaatttttagattaaaaaatatgctgcatgcctttaggaggataaatcttactataatagctccccttttagttcattccttctcccagagtcaaaatttaattttttatttttaaaaatttttaaatcccaaaataaaatttgaaaaattttaattttcaaattcctttaattagtgtggtgtacggacgcatataattcagtcattgtccaaaacctatgccggatattttcgtcacagcacacaccgtgaacggtgccatcaccatgtccgcctcgcctctcaacagttcaccaatcattccgtcccaactgttgttaccgttgtctttaccgtatttgttgtcccgtacaacgtggatcttcaattcacagaaatttgttttttgaaaatgccaaaaaaaaatttatttttgacatgccgtgtaggtaaagccaagatcttgggccaactcagacaacaaatcaatgcaaaagccttaaacaaaaatgaaatattggcttacaaattagcaaaacaattaaatgatttatataaattattatttttaagaattaattatttccaatattttacaaaaaatgccaaaaacgagtgccaccttcgaattttgcattttgttgttcatgtgcgtcttggtggttgtcattgtggtcaatgtttgtcctcaacatcacataaggccgttccaaaatagttgtgacacggaaacggggcttcaactcatttgacacctttttgaatgtaattatttattattaattttttatttcgaaaataatttaaaatctttttaattaattaaattttatttaaatatttttaattatttacgtggttcaatttattttagagtgccacgggaccgggaatttttgccaaaaccgggaccgggacttgccgggacctgagaagccggaaccgggacctcgattttttttcggaaccgggacctcgattttttttcgggaccgggaccgggaccgcaagaaaaaccgggaaccgggaccaaccgggaaattttaaaaattcaaaaaaaatttaaaaatttaaaaaaaaattcaaattttaatttatatcaagtgaaaataatacaaaattatttggttttttatttaataaattaaattaatgaaaattttcaaacaaattttcttcaattatttcaaacaattaatcatttttggactaaatcatcgaatattaatagaaattcagatttgattttcacatcactttttttcggagcgctttttcaaaaaacttttgggaaagaagtcccccctccggcggtgccgataggcgccgccgggggaaattttaaaaatttgggtgcaatttgttaacagattttcaacaaaaaaaggttggtttttgcgattattaagctcaaattggtaggattttcatttaaaaaatgataaaatatgtatcaattaaaaaaaaactatgaggaatcatattttctttataggaaaccctaccgggaccgggaccgggactgactttt

SEQ ID NO: 20075 - DNA, 860 bp, Heterodera glycines
atttattacatctttttatgtaattatttcaattattaatcaatctaaaatatttttacaaaaacgttaatgggccaaataatgaaaaaattataaaagaatggataagctctgcaaattaatttttaattaaaaatatatcaattgtattttaaattacttttccaaaattaaaaaaattaattttattttaaattatttttaattcacactttcacattgcgacgcagttgagctcgcgaattgtcggacatgttaagaatcggcgcaaccgcggagctctcccaataaccaatctgaaaatatataaaagcaaattagacccaaaaacctgacaaaacaaaatactttaattcaaaactgtgcccccataaatagcggcgttaataatcgaaagaatcgaaacaaaaaaattatgattttcgacctcctcattgcccttaactagaatttatttacgtcaaattagctagtgtgattttggcctattaaatattgtttctcaagcactcattaaaacgctaattacccccctcatccccccagaaaagttaggcataaaaacgacatcgtcaatgttgcccgtgtagccaagcaagttgatgcggaatgtgaaatttgtgctgctagctctattgttgttgttgttgttgttcagtctgtccaagtgaccgctaatgccatggatgttggcattctgtcgaaattggcgcgcaatttgaaccccaaatttggacggacgatgcgcgtgctgaccgctggcgcaccgtgccgccgccgccccagttgagccggaaatgttgttgttgttgggcatggaccactgacgcgccatcaaataaaccgcatcaaagagaaaa

SEQ ID NO: 20076 - DNA, 2582 bp, Heterodera glycines
ttgctgatgtaccgcaatcccggattcttcttcactttagtcaactcaatttcgattccatatttttctttatattcttctctccaaatattcttctgctcatccgtctcaactcccttcggaaaaccgctcgcctcctccttcagtttcaaaaataatctcacatatcccttgaataaatcgtccgcctcctcttcgtaatgccacgctctataaaatctgtccacagtataaccgcattccaacgcctttgcctgaaaaatgtcaaaattttctttaaaattttttcttggaaattcttaccaattcgacgctggtgtatgttgccacgtatcgccgctgtgcctcatcatgtgggcacttgtagttacatctcgtagtctccttcttaaattttgacgcacatctccaacatagcggaaacaataatctctcatcgcacttcaactaaagaaccggaatccgcaaccccttcggcggggtgaccctcactttatacaatcccttatacttcaaatcctccggtctcatccaattaacattaatttcatcagtcttcggtataataatttcaggtaatccaatcgggtaagctgtaccgtaattcaccgacggatacagactcacaatgtcataaacactaatctttttcttctcatccgatttcgcatacaatttcatcggtccggtcctccctcccgcataagccatccgcggatcaataggccccttctcgttccctctgtcgtcgaagaagtcccgcatctcttcatcctttttcaactccttctcaatttgacagccctaaaaattcacaataaaaatgtaaatgtcaaataaacttacacaaacttcttcgacgtccaaagtcttccgcagctccgccaatctctcctgcgtctcatcattcaattcctgggccgtccttcctccaatcagttccgccgccgggtcataacagttcatacatccatgtatatagcatcccataacttcaatgcatttgtcgcgccctcccacattcgcaataaaaatccatccaatttatatttcccaactttgacctcccgtccgttccccgcgtgccgtatctcaattccatcccgcttgctccgccactccaaatactttattgccatcacgctggcccggtcacaccgctcatagcctttctccggcacaatcgataactgctccgtcaacaaaaacattgccttaaaaatattcatcgcaacccccgcatttgtacagctcctcggcaaggggtcaaatcctttcgtaatatcgttaatcaatatcctcctgaactcaataatcgataacagcaatatctccgtgtcgtttctgctataatttctcaattcttcatccaaataaaagggcgtccccttgttctcgttgtacctgaaaaagaatttttattatgatttgtccttcttttcttaccatttttcaaattttgcaaatttctccttgttcatagaccccggtgaatagtcctccattggtggcagatgttccaaacaaactccataattttctttcttattgtagtaatacgggaaaaagggcttgtcctcacagcccaaattgaaggtcgccttaagcgactcgagtttcaccggcattaataagcatgagtctctccatatcagcattgaatgtttcttcgagtttcgcactttgaattcataaattttgagtccattgataagcggtatcgggttcttcccggtacggcagagatagttaaatacaaaatgtcctgaaattttcaaaataaaaaacatttttaaaagataatttaccgtcaaatcgtccggcgttgtgcgcaaaaatgtacgtatcgtaattggtaaatgccgttaatatccactctacaaaatccttcgttgggtcatgtccctccgcctcactccaatccttggtcctctcctccccacaaattttacaattcgtcctatgtttgtcgtcacagcattccgtacacgtaactctcaccgaaatataattgattacatgctccttctgatcccccgtgtaaattgtatcctgcgatgtttccgaatcctgaaaatcaatatctattttgttaacgtgttgttttattaaatcttacccaaactacaattctgtagacatccttgtcctcattttcctcgatcggcataatataacaactccgcttggggtcatggctcacactacaaagttggcaataagtctctccgcattcatgatccttcttcgggttaaatcgatacgttttttcacaaatcatgcaacgtctccataatctgcaagtctgatgtccctgatgataattgtagcactcccaattgtaaaaatagcgatggcacttcgggcactcaattttaactccattctccttttcacatggcactcctcccactttgttacaataataacatctcgcccggcactccaaggtgtggtaaacatcctgatcgtaaaagcactcacagtcaatacaaaacttcctccctcgattaaaaaagcagacgtatttcttaagaccataacgagtgattattctccgaaaaaaattcggcactacattt

SEQ ID NO: 20077 - DNA, 2344 bp, Heterodera glycines
ctacttctttgactcttatggagagatgcctatcagcttgttcaaaaaatatttatccgataattttaaaaagatttactataataagaggcggtttcaatcggtgttgtccaatgtttgtggtcactatgtaattactttcgtttattttatgtccgtcggattgggtttcgaaaatattatgcaaattttgaatcgttcaaataaccctgatggatttgtttatcggtttgtaacaaagagcatagaataaatattaacgaaattagtcttcatcagatgtgtcatcatcatcaaaggcatggaaacagaaaaaagtaaaggcccaattccgaataaattcagcaaatccatttagtccatcatatttttcataatattcgttgaccactttttggctcgtgccgtcctcttgccttaagaaacccttcacctaaaatagcaataaaatatgaaacatattttccattttcttgcagatttaaagccatccattgcctgccggttctcggcacagcaaagcactaatagggtgtttgactcacttcaaaaaataattgcatacccaaaagttttttacaaccacatattgccaatctaatttcttgcagattgaaagccatccattgcctgccggttctcggcacagcaaagcactaatagggtgtttgactcacttcaaaaaataattccatacccaaaagttttttacaaccacatattgccaatctaatttcttgcagattgaaagccatccattgcctgccggttctcggcacagcaaagcactaatacggtgtttgactcacttcaaaaaataattcattacccaaaagttttttacaaccacatattgccgatctaatttcttgcagattgaaaccatcagtagttagtgcacacaaaaggtccggattacggtagcctcccatacctatgggaggggtgcacggccaactgagcgccagccaggtgagcgccgccaggtgagcgcgggccatctgagcgccaaaatttttcagtactgaagccaaaacctattgcgcgacttttttttgaaaacccaaacctattgcaggggtgcgcgactttttttgaaacccaaacctattgcaggggtgcgcgactttttttgaaacccaaaactattgcaggggtgcgcgactttttttgtaaaattttttctgaaaattattttttattatttttatttttaaataatattttttatttttttcaaattttttattcgaaaaattctgccgcagactagtggactcgaactttcgctctgccaccaaacccaacacactaccactctgccacgagaccacttgccagaaaaaggataattgtccactatatgctgcaaagatgatgacgtcaccactgcgaggggtacggtagtccggtgaaaattcgcaataaataagtcgcaggcaagcggattcgaacttttgctctgccaccaaacccaacacactaccactctgccacgagaccacttgccagaaaaaggataattgtccactatatgctgcaaagatgatgacgtcaccactgcgaggggtacggtagtccggtgaaaattcgcaataaataagtcgcaggcaagcggattcgaacttttgctctgccaccaaacccaacacactaccactcggccatgagaccagttgccagaaaaaggataattgtccactatatgctgcaaagatgatgacgtcaccactgagaggggtactgtagtccggtgaataattccaataaattagccacaggcaagcggactcgaacttttggtctgccaccaacccaacacactaccactctgccacgaaaccacttgccaaaaaaaggataattatcaactatatgcagcaaagatgatgacgtcatcactgcgaggggtactgtagtccggtgaaaaaactttgaaaatacgcaaaacaagacaaaacgccacaatatatacataacgccataatttattgagacgaaaacctttcgcattagattcaaattcaaaatttggcgggaaaagtggcttggcgtcgtttttttttgtttctatccttaatcctacccttttttcaaaatcattcttatcttttttcattatttattaacatgaatattttctgtttctgtcttttacaatgctgtttagccaaaccaactatgaatttcaacaatttgactacgccaattgatgaacaaacaatgattgaaagcctgtctttggatgaacatcaaacgagctacgatctggtgaggttaacctttataatatcatcaaatagaaataatattttagaaaatggacgaagaactgacaaaaagg

SEQ ID NO: 20078 - DNA, 700 bp, Heterodera glycines
atttggcacaacaaacagaaaaaataaaaaataaataaaacttttccccttttttcaggtgttattcggacatgaacacagcaattgggacaatcaatccggagaaggacacggtggcggttgttgaacagaccaaaaccggctttgcccatccgttggacttcgaatttgaggatttgggtcagtccgaaaagcatcgaaaaatttttgtttactcaaaatttccaccgcaaaaaagacatttctcggtttttcctcctatgggacacggcatttttatatttaaaatatattttttcaagtttatagatccaaattaggcattttgtattccccccccaccctcccgaactgtttcaggtgacccggctgatgttctccaggacggcgccgaatcatatgacggcgccacaatgaaacgcccgtcggacaaaggcaaaggtgccaatgggaagagcggcatgccgaggaaacagtcgttgaaattgttcggcacgtccaacagcaacggcaaggtgtcgttattatggtgctatgacgttagtcaaaaaccatcaaatgaaaatattttttgatataactttgctcaaaagaaactaaatttttaattcttgatataattagataggcctaagtgttttctattagcctacaaaatttcaaaaagtttcgttaagtttcaagaaaagttatgactgaa

SEQ ID NO: 20079 - DNA, 1435 bp, Heterodera glycines
atgtatatgttatgaaatacataattgccttagcatttactctagaacatatttcttataatggcctttttacgaaacgccctggcacttttacgaaacgcccaaaatggcctttttacgaaacgccctggcacttttacgaaactacaaaaatggcccttttacgaaacgccctggcacttttacgaaacgcccaaagtggcactttttacgaaacgacctagcaccactttttgctagtattcatgttgcaacttttttataagttgttcaatcgcagagaaataccttatcaaaagcttccaaaggtgtaggtagagctttcgaatgatgccaaccaaatatataaaatttggccaactgaaaaaaaagttatgatgttttaaacaagtctgggacggaactgaccccctaccgcctgctgctgctggtgatcaaatgtctggccctcaaatataaagcaaaaataaaaaataaataaaataaaataaaaaaatgattcgcgaaagcaaaaaaaaaaattagattgcttttcttcttacagcctctaaatcttatattttaagatgatgaacgaaaaatggaatgttgggatggctatgctcttaatgataaggcgggagagggttgggaactcgctattaaggattgcggaactcctcaaaaagacatgcaaaatcagatttgtgcatattttcactgtacgacggcgggtaaatgttttttttttggcttaaaattgcgctcaggtttcgaaaaaattctttatcaaatatttttcggaatcggaattgctaggcccaaaaatatgtgcaattggaattcctatgccaaaatttttttcggaaaccggaattcctaggcccaaatttttttcggaaaccggaattcctaggcccaaattttttggtgttacaattaattaataattatgtatatgtgtagaaggtgacgaccatttggatatgtggtcatgtttcgctaatattaatgcgggaggaggatgtgccagcgatgcttttgctccacgcatcacacagcctgagtaggaaaaaaaagaccaaaaatttagtataattttggtaaacacactgttaggactagggatgatatttgggtgggggggacccacgcgtttcggcgctcgcgtttcggcgctcccgtttcagcgctcgcgtttcggcgctcccgtttcggcgccagctcgtttttccacttaagcttttttctttggcatccaaatccaacaatcttggtatcattcgaaagctcttatcatgctccattagccttacaaaaagcggatagattttcaagcctggaaaaaattttattaagaaaaaacttcaaaaatttcaacttttcgcaattttcatgcatcacttttttgatatttgtctaatcatgaagcaatagcttagaaaaagcttctaaa

SEQ ID NO: 20080 - DNA, 530 bp, Heterodera glycines
ccatttttgagggtttttttccaaaaatcagcataaatcagcagattttgaaaatcttgcgctttgaattcataaatgtaatgaaaaatggatgaattaattaattaataaacaacataaacagtaaaatttaaaaagaataaaaagtcacacatagaaaaatcaacatattgccataaatttgaaagtttttggtagcagttttacacaaaaatggccatttttgaggattttttccaaaaaatcagtataaatcagcaaaatttctcaaaaagcagcaaaaatcagcatctcaaaaaataactcagctttgaccccttgaaataagcaaaatgctgataaaacagcacatctggtggctaccctgaataaaattattatggaattacaaaaaaaaaaaaaaagaaataaataaaaattattaattattaaaattaaaaaaaaaaacttacaattaaaagtaaaaataattgcttaattaattataaattaattaaacggatcaaacattaatttaaaaaaatatcggt

SEQ ID NO: 20081 - DNA, 876 bp, Heterodera glycines
gaaaaaaacataaaaatttggtgatttttaggcaaaaagttttatcagttaacaataaattttcaattttcttttcacactataattaatattttcttaacaaaaacagaaattttggatcaatttttcatgaaagaaaaaatgagtatggatttttaagaaaattttgtattttaggggtatgtatgttttttgaaaattttttaggtcgattcttaagggtgaatttttcgttgttattgctggaaacaatgttttagtgaaaattttacaaaaaatgcaaactaagcacaaaaatgctaaattcagcaaaaaattacaagctctcaatcagcattaagcacaaagcatgaaaaagttgggccaaggaacctcaaaccaagttataaatgcgtttttcatcaattgggggcctaaacggcacaaaagccatagagaaaagcataaaaatgaaaaaaaatttaaatttaaatggaaaaattgctcttccacagaccatgcagctgattggcactcggccgttgctcaaacattggccaatgtgctgtcgccagcagtcgtcgcagaaagtgtgtgtcgcgccaagcggttcatatcagggttgttccgggtcgagaaaaatatcgggtcgggtttcgggtcgagaaaaaggccgggtttcgggtatcgggtttcgggtaacccggaacaaccctggtgccattgtaataaattctttcttaaacatttatataaatggcgaagaacattttcccacttttttgttgaacttttgctgtttttggagcagtacacgcaacacaacaaaaatcaaaaatatataaagtgactagcgaatgcaaagtcttcaaatgttaattttttcttattcttcaa

SEQ ID NO: 20082 - DNA, 1101 bp, Heterodera glycines
cctattgttccttgcccgccaatcgattcactgatgccctaaagcgcacagaaaattggcgacaacactgaagatcattttgacagtatttgcagagcgtggaaatttttggccaaaattgacttgggccaatgcgaaaagtacggggagcggacacagctgcgcaacttttgccgcgaggtcgaattagtgaaagcaaaatgccaagtgtacaatttaaaaataaaaacggcaaaaaaacaattctgtttttgctgcgagtgatattcggcatcaaatcatagaattaaacacttttcagcacaacgaaattatgttcaaaagtccacataaaatggcttttcaaatggaaattaattagagtcatttgaataatttgcttaagcatggcctttgtcgcagaaccatgaaacggtacggggacggcactttgcgtgtacattcactcgcatgcagagaatggcattctatgtatgtgtgccgttagttgttttctactgttaataattgtttgtgtttgtgttggtccataaggacgagagagtgccaaatataaaccggaatttgcggatccctttttacgggacggaacccgcgccggtgttggactttcgtgcatatttcgacattgtcggttctgctcatgagatatttagttccgagtccataactccgccgaacaaagacttccacctcaattcattcattcctttagttataaatgtccgtaccgtgccatttacgtggtggatcgccgtgccattttcgaccggaatatgcataaccacgcatctttgccgccaactgggaaaacggaatcactgccgaagaaaataagagttttgccatccccgctgggcattttcgacaaagccatgccatataaaaggtgtcatagccctatactcacccaggatttgccatggcatttttgactaattttttgtccatcaaatcgcgcgcctttttcacagtccgttcacttctcatccgccgacattggaccattttctgctgaacctttctgagcattctcatcaatggcaaacatcaaaagcgacgccgccaattgcactgagcaaaacggggaaaatccttttg

SEQ ID NO: 20083 - DNA, 1676 bp, Heterodera glycines
ttgatcttatatgatcgagcaagtggggagctggagagggcagggtcggtagttcagctggtagaacactgtccggaaagccagagacgccggttcaaagccggcccgccccatagtttttccctcaaaggcttccccgctcgttcatatatttcatggcgacccttggcggcttccagttcacccagcagcagcagagaagcgaaaatgaagagagaggataaagctggcactggaagtgatcgaatctgcaaccttcagccgagcagcagctgacgcagagaagaagaagaatggacgaggacgtccataagagaggcccggaatgagatagagaagaagaagcttccccgagaggaagattaatggatcaattgaggcaacaattgatcctatatgatcgagcaaagtggggagctggagagggcagggtcggtagttcagctggtagaacactggtccggaaagccagagacgccggttcaaagccggcccgccccatagtttttccctcaaaggcttccccgctcgttcatatatttcagatataatgggcaaaagctggataatttatttatttttaaaattggcggatttttggccaatcaattagtcagcaattagttgcagcgaaacaataggcatttcaccgccagaaatttttggcgttgcatcccaaaacgcggcgcgggacaaaacatcgtattgaaataactgtagtctcagaaaaaataaaaaaattttaagaaagaaagttttggttagaatgaaattttgttgtggtgttttgaaaaaccactatgttctgaaaatcaaattttgcttaatttcaagaaaaaacggaaaaattccttgaaaatgttttttttcagggaaacgaaatttttttaaaattattttttgtattttttcgaatatatttttattttttcacggtgacgttaagttccggcgacgtctcgtcctgccctgatttttgggaggccataacttctttttcagtatgggcttagcgttttgtaggtttttggccaaacttttttgtatctcaactagattttttgaaattttgcaggctattagcgactatcaagcgctttaaaatcacatcaaaattttttaattcgaatgataaataaaaatgttatagcgtttggcgccaaagtgggtactctttaagtttgggtccacattcaaaatttttttttaataagcacgtaaaaaatgtgatgaatttatttctgtttcaaaattgtttttgcgttctttttgctctctcatttttcccaactctctctttttaagttacataacaacagagttttgccttgccttctttgacacaccaatcaattggaaaaagggaaaattgagccacaaaaatgaatcgacggtaaggaattttttttaaattacaaaattttcatttacccatacatttttttacgaatctcagttggctttgtaacgacgtgtggatggacaattctcccatcttttaactatgccaaactcggcctcaaaatggcattgctttccgaccgtttcgatgttttggtggacacgcattttgatggcaaaagcgaattcacaatttggagagcaatcgaaattgaaaaggaggaagggccaaaaccgaaaatgtttatacgaatcgatggcagttttgtggattt

SEQ ID NO: 20084 - DNA, 941 bp, Heterodera glycines
tggataaatttaatacattaacgaattggtaggaaagatttaatgattttttaattttttggaacaagaggggtccgacggtgccgaaggcgtgccgggaaattagaaattaattaggtttcctaagactttctgctaaaatttttgaaaattataaaatgatgtcattcagttcatgagcccgtcattagagtgtattttccccgaaattttgagtagttaacacgaagctcgaaacccgaagcacaaaaaaaaaacgtgaaattttcgaagccaaagtttcgtccaagatgctttggaagttctgatccgtcgggctctctttaattatttccagaattaatttattaatgttgctttataattttatttgtttttttggagctgtgttactttaagttcgatatttatcgaatttacaacaaaaaaattaaacttgtttatttcaaagctattccgtaattccaaaaatcaaattaatatttgggaatgagaaaaataaaagagtaaggggcggtgaagcaaaaaaatgtttattaaaaaaatttatattcataattttctatttgggaacagagggggtcttataaaactttgcaaaggggttaaatgatgccataagaaggagtctgtatcgttttggcgccgccgttttggcgccagcccaagtttttgggttataactttttttcttgttgaccaaatctaacaatcttggtatcattcgaaagcttaacatgtttagaagatatttgtaagctattgcttcgcgattagacaattaccaaaaaagttataacatgaaaatgcaaaaaagtcgaaaattttgaggtttttcctaataacttttttagaagctaaaatttttgtttgttttttgcaaggctaatagagcttgtgaatggctttcgaatgataccaagattgttagatttggtcaa

SEQ ID NO: 20085 - DNA, 1351 bp, Heterodera glycines
ctttttccgtgaatatttttatagtttattttaatgtagccataaaaggtaatattttcgacaaaaaaaaataaaaaataaatctcgtcaatgcttttatttattacaatttaataaaataaaaatatttagttttttttcttgaaaaaatcttagtttttagtccgattcaaaagtgcaagttcagatctgaatttttagtaatataagatataaatatattttaaaaaatatgataattgtataatttattatttattttgttcttttattttttaattgtaaaataagtttatttagtttttataatctttttttgctctacaaaagataattaatgcataaaaaatattatgttttaataattaaaatattacaaaaagcgtttataattatattaatatttatattcaacattagatatctcatataagataattgcataattaactttatttttttttgcatttaattataaatattttcaaattaagattaattctcctatattttatttcttttcattttcattctcagggtttgtttcagatattccatggttgagcgatgatggtttaattaagattaataagtgtatattattaaagtttatatattcgtattttgtttaatgttatatatttttcatcaatgttatttcaaatatgctattgaagatttatttggtttaaaaaaattttaaaaatttctgacttttgttgaactgtagtgcgccttaccgtattttacactccgttttgtaaacccatttatttaatttatcaatttctgggctaattttttaagtttgctttattgaatgaattctttttgaaatttaaaaactgtatatcacaaaactttttaattaataaattatttaatgttgctcttttttacctcttgttatttgttgtggtcctttccggttcgttgtaatcagattgaattttaaaaatgttttatttattggttatatataatataagtttctaattttaattgaaataattttcatttgatgaatttatttgttgtttatttaatattttaaattgcattaaaatgttttttattatcttggcttgtgataaataaattattattttattttttaatgaataataagaaatttaacataatttattttagtgcaaaaattcgacatcaaattttaaaaaacattctaaaatattgtaatatgttttgattatgattaatttaaatttaggtttttgcagtacatttagaatttgtctatgtatatttttcatttaaaggatttaatctattaataatcaatattaatagaagggatttaacccttaattatttttttcatgactctaga

SEQ ID NO: 20086 - DNA, 1363 bp, Heterodera glycines
  misc_feature (72)..(74): n is a, c, g, or t
  misc_feature (77)..(78): n is a, c, g, or t
actgatatttttaattttagcacgaatatcgcaagcattcggatgaatttctaatgatattaagcaaattannnttnnaatcaagtttctccacagcaaaatggaagctgattcgctctaaccacagggcattatcccaatgtattcctttttaggtatgtgtcatattttaatcattttctaaatattcgcaattattatcagtaaacagttaacttcattgaaaaaactctgaaatttaattgcagttagagaccgaaaatttcccgagaccgaaattgaaagtcccaagaccgagacccaaaaaaccctagattcgagaccacgccgaaaaaattattttaaaaaaactggtggaaagaaaaaataataaatacgtcacagttagagcactttgctattaataagaattcattaatttaaccaattatgcattaagtgtttaatatgttattgtctttggtattagtaaactgttgaaataatgacagatttgagcaatttaacggtaaatgcattcaaattaattatgcatttaataatttcataaaaattggcaattgaattttattcagtgttgaacaatcagtttaaaatctatgcaatgattatatctaaacaatggcacagtaagccaaaagaaaaaaattatgaattatttttccattttgaaagtataaaaaaatttatttataattggaatatgaacgacctaaaaaatatattatgcctaaaatcaaaaaattaattctgtattaaagtggtgataaatgtactgaaaatttaacgaaaaaatatttttatatttattaattagagccctcaatttgtttgtgtgaaattttacattcttttttttgagaaaaaaatctaagcacatgaaaattggagtttacgaatttaaagattacacaatactaaaaatgtttcaatttaaacggcgaaaataatttttatctttatagcgttgaaaatcatttgtttgcagcgaatgtggttccattttgctgcggagaaacttgaattacatttaaatttcgtttgaatattattggaaattcttcccgaaatgcttgacgatattccgtgctaaaatttgaaaaaaatatataaccttttaaatttaatttaaattattcaaaaaacacctcataatgtatagaatgggtccatttgatgccgcgccaatgttcaataaaattgcggtgatctcatgaacaaaccaagcagtgatcggagacggaatgaaatgcttgatcagcgcaataaaaaaaacacagatcaaatagcctccaatattcactgtgatgatacaaaaaagtgaacgaaaaacgcgatggttgatcgaatcagctgagggtaa

SEQ ID NO: 20087 - DNA, 1086 bp, Heterodera glycines
tcaattaaatttgtccagaaaatgcggtataaacaaacaaaaaatgaccagattggtgaataatttcaaaaaatgagcaaagtatcaaaaggtaattaacggtgccattgagtgacctaaaataataaatattaatattaattaaaaaggtatttaattactttgtcctgatggtgacataaatgactgaaaaattgaggacaattcccatggtcgcgatgatacccaatatggcagcacagctgatcaatttccagtttggagtttcatttgcgaattccaataaaaactaaattaataaaaataatacttataattaacagatttaattaccgttaaattgctcaaatcagccattattcaacagtttaccaatgacctaaaataataaaagaataatattaatatacaataggccaaatcattgaattcttgtgaagccttattgtgataagttttgtgattttcctaacaaaaaactattattatttaacgaagcgtctaaagataattggaaatatatttggttgagttacagcttttcctccctttaagtttcgaaagtttttgcaatggccgggctccttttttccaatttggagtttgattttgtgagtgccaatcggagggtgtgagaatggcaccggacttaaaaccgagcccatggcaactatggcgtgaaaaagtggtgaaaaaatttaataattattcactccaattattatgtcatttattaaaaaataaattgctaattggtggtagaacaatgaattcattttgaaaaaaggcgatttaaattaggaaaaattcatacagaattataaaaaaatttgagaccctcgattttcggtgcgacaataggcttctcaagtgctcttacaatagttacccaacccggggctgttggggttgatgttaatttgatataacagcttggatattttgggacacagattggtgagccaaacctagtggggtgttaattagccaagtaatataattttatcggtcacataagtcttaattggttttaaccggtactgctattctcttcatatcttttcctgaattacgaaataataaaaa

SEQ ID NO: 20088 - DNA, 1078 bp, Heterodera glycines
gaattacaaaataagtcctcatttgcgcttaaaagggcgagaaatgtcaattggagcaatattttcggcatgtagtgctggaatttcagaattctcgaaaactggcatctttgtgagaattgaaaacggtacgggagaattacaaaataagtccccatttgcgcttaaaagggcgagaaatgtcaattggagcaatattttcggcatgtagtgctggaatttcaaaattctcgaaaactggcatctttgtgagaattgaaaacggtacgggagaattacaaaataagtccccatttgcgcttaaaagggcgagaaatgtcaattggagcaatattttcggcatgtagtgctggaatttcaaaattctcgaaaactggcattttgtgagaattgaaaacggtacgggagaattacaaaataagtccccatttgcgcttaaaagggcgagaaatgtcaattggagcaatattttcggcatgtagtgctggaatttcaaaattctcgaaaactggcatctttgtgagaattgaaaacggtacgggagaattacaaaataagtccccatttgcgcttaaaagggcgagaaatgtcaattggagcaatattttcggcatgtagtgctggaatttcagaattctcgaaaactggcatcttagtgagaactgaaaacggtacgggagaattacaaaataagtccccatttgcgcttaaaagggcgagaaatgtcaaatggagcaatattttcggcatgtagtgctggaatttcaaaattctcgaaaactggcatctttgtgagaattgaaaacggtacgggagaattacaaaataagtccccatttgcgcttaaaagggcgagaaatgtcaattggagcaatattttcggcatgtagtgctggaatttcaaaattctcgaaaactggcattttgtgagaattgaaaacggtacgggagaattacaaaataagtccccatttgcgcttaaaagggcgagaaatgtcaattggagcaatattttcggcatgtagtgctggaatttcaaaattctcgaaaactggcatcttagtgagaattgaaaacg

SEQ ID NO: 20089 - DNA, 2618 bp, Heterodera glycines
  misc_feature (2553)..(2553): n is a, c, g, or t
  misc_feature (2595)..(2595): n is a, c, g, or t
ggacttttctatgatgtgcacctatcttctctgagttttttttaataccctatgattttggattgatttaagatggaatttagatttaaattttaatctattggttcgcacgccgtccgaccgacgaaaatctttcttatttcccaaagttgaatctgccccccccatttcttaggtctcatggaatattttccatatgaatgaacaaacgcacacacaaaattggcgccagggcggcggcacaaacattggacgaaacgacgacgacccctcgggggagaggtggggggacggcaaaaggggcactgaatgggaaatgatggagcattgagaagatgggaatttggggaaaaattggaacattttaggaaatttggacaggttgaggagacacactttacatacacctctctttactaaacaatgataaattttagaaaattgaaagggaggtgaaatttttctgagaaatttatagattttattcccattcatttggaatcgaaatgagcaaatttaaatgctcttgtctttttaagggagaaatgaaatttgaaaaaagaacatttaaacagcaaatatgatctcgcggttgcgagtcgctcattgcggattcaaatgatctaattgcgggtctcgagtaaacaaaatagcaaaattgtgtttaacgcattaaaaaagcaaaaattctcagcgaattttcaaaaattttcgtcctcatacttttcaaaaaaagacaatatgcttacaatcgcttagctacgttaaaattattgtctgttgatgttgaaaagggccaaaaaacaataattagaaaaatttaaataatttttttctttcttgcttatgaaaaacaatttcattaaaaaaatatgtcggaaaattggccaaaatggcacgacaaaaataaaatgccaattttacataaattctcactcaacgacgagagtcttgaataggcacttaaatgatggcacatgataatgccgagaattcggaggggagggatgcaaatttgccgagtgccgtcctcaagagggccatgtaaaaattcaattttgtcacctttcacaaaatttagtggcacataaacacttgatgagatttaaaattatcaaatttataaaaaaagagaaaaaaatctgaatcttcgagaaagacactaaaagcaagaaaagggtttttaaagtatgagttatcataaatctgtgatgatggcattggatagtgccgatgggcgatgccgaattggccgcgggtccttccgctggtgccgcccataatccgggaaaatgagacctcccccgtttaggtgagagggcgggggcggcgtttgtatcaattttcaacctccagtgcccgccgcacttctccgcttggtgggacgacctttttaaattggccattgtgtggtgccaatcggagaaaattgggcacatttttgtgaaaaaatgagtttttgaaattgagaagcatgaaaaaatggcaaggagaatgaaaagcatccatttacacctcaaagtggtgacatcattggctgataagatattagcatattatacaaagttttgagggaaataaatatttattaaaaattctttaatttaaattttcgttaaaagaattttaccgaaaaaagcattttcagagcagagaatttttaaaaaatggaagagcaaagaaaaaaaaccgaagtaaaacggcggaaaggacgaagaaatgaacgacacaagcagccaacttcaagtgttcttgccggaattcttgaggaggacgaagcaagattatggggagaagaaggaagcaccgcttctctcgaaggaggaaaagttagcattttgttggtgctattggagagcttttcctctcatcaaagtaatttgttagggaggggacaaggaaatttgcaaaaacatggaattttaatttgtaaatttatttatgatttaataaaaataaattcgtaggttttgaaacataacattaggtgcattttgggtttttaaaatttaaagttgctgaaataatcaataaatttgaaattcaagtcactggcttcgggaaacaatgtgcttcaggttaaggggatttttaaaaaaatttactaattaatacatacagtctgttcaaaaattattgaattttttataatttttgggatttttatgactttttttttcactttttaaggcaaaatttgaatttcagcaaagattgctgaaaaataaagatatgaccggtaaaaaggcaataaaatccggcagaataaattgttaaaaaatttgattttttttaacttttggctaattaatatttaagaacttttttgcttgtttctgacttttttgcgattttttatggcttttttagtcgacttcttggagatttttcgtaatttaaatttccagccctaatcatggtagaataggtcaaagtcccctgtggtgctaaattttgatcattgcagatcaccctgatggagtgatctggtcacggtggtgcaagtgccttttttgatcagcacaaaaatttataaggcatgaattttcccangattttatcaagtgcagaaaaaagaagatacatgtcttcaanatatttgtttatgtatttatttt

SEQ ID NO: 20090 - DNA, 1112 bp, Heterodera glycines
tttttgttttttatggatacacacgtcgaaagatgatcaccacctgagatttaattgctctactacaaaactattacatactaacatttaagagtttaatcacaaatagccattaaattccatcaataatcgttcgtcactttcgtccccacaaattgtcgaaaattgtgccgcgattgttggccaaggacagcgagtcggcataatacgactggggacgagcatttgtcagagaaactgtgagcagaagaagaaacagcagcaaacgggcgaaaaacattttaaagtttaatcaaattaattaattattatttggagaaaataaaagtaaatatttttgttgtcgcgcgatggaaatgatttttgatgggcaatttggaatttgccgccacggcctttccttttataggcatgcgaatggaaaggcacaaaacagaagcacaaaatagtgcccaatttttcatattttgtgttatctaaatataacattgggtcagtaattaattatcaaaaacaaacctaattaaaatatactcttatttatggagtcattaaaatggaaacaataataataataaatgattattatatgttttattttgcatcaatgccttaattgagcaattgaaggaatttctttgaataaacagtttttaaaaattacttgttagaccttcattgtctttataaaagtttgcttatcactaaactatttgtttgtctcccatccgctgcttttgcttattattgtcaagcatttgcgtcaccaattctttgttattaatattttttaaattaaaaatgataatgataatcgaatgttttgattggtccattaattaattaattgttaagcctttcgttgctcatcggtcggtctttcattcattccatcgcttttgtttcctcattggctccgcttgttcttcacaaatccgctaagtgacatctgcattttccggcgtagcaattcatgccaaagcacgtgtcctggtgattatgccattgtcatcattccattcccccccccctccctttgcccacctttttctccccctttttttctattatcacctttttgccctcccatttctgcttgttacacactttct

SEQ ID NO: 20091 - DNA, 1477 bp, Heterodera glycines
  misc_feature (99)..(99): n is a, c, g, or t
tttctgtttgtgcacactttcctctgtcatcccctcagattctttaaagcccgctttttggaagcccacttcgcagtcgcactttttggatttgctgcncacgaataatggcttttcgacacaagcatctttcagtccggcacactcccgcggcacaatgtttttgtcaagggaaagggcgccactgttgagaccgccttaagcaaaacaaaagtcaaaaagtgatccataggatcgaccttttcgctgattgaatagaaatgacaaaacaaaaaacgcagtaatttcataaatcattatttaatgtattttcattaattagcccaactcacacagcaataacagttggaatcccccgcacacgccgcagtcgcacgtgcccaccttcttcttcctgtccagcgtcgccggttcgcatttgctccttgcgccacactccgagtgtgcgtagcatttcctctcctcctgacactttatcggcttccgcttgtcttctttgctgtcctcctccgtctccgtgtcgtcctgttgcggccccggcttttcttgaggctgcttctgctggggcggctgttcagcaaaagagcgaataagtcaattagtgaattaattaattagtggatcaaccccctaattaacgcggtctttaatttaaaattgaaattgtcctccgttttaccaaactcatctcatttcgcatgtcttcttcaccttttcagtttcatttttttgcgatttcggccctttttccttttcctctgcgcgtaacaatttttgcgatgctgcccatgaagcacgcatctggccatcatcgccgtccatgccgcgcatttgtgccatatccatttctgatttttgtgttatgaccatgccgggcttttggcccctttccatcccgcgcatttggcccatttccattccgctcatttggcccatttccatgccacgcatttggcccatttccatgccacgcatttggcccatttccatgccgcgcatttggcccatttccatgccgcgcttttgatccccttccattcgacccatttgtgccatctgttgatgcgaggagaggacaagcccaacgaacaaccaacgcaacataatgatcggcgtcaattggtaagccatttggaagagtttggctgaaatattaatttttaatcatacataaaaatgttttaaatgaatttttaaatgcaacaaaagaaatgcccatttctgcaccttttcgcttataaatagctccaaatttgtccgccattgctcagaccgttgccatttgccgggagcgacaaaaaaatgcttttgaatattactcattggtttccgagtgaattttatggcttattcattcaattccgacaaattaaaagattatgtttgaacataagtaaatgattaagcaagtgacattttaggccaattaaatttaaaggccattttaaaagagtaaaaatcagtgttattaacgaaa

SEQ ID NO: 20092 - DNA, 2795 bp, Heterodera glycines
  misc_feature (34)..(34): n is a, c, g, or t
aatttaaaacttcacaaatcaaaaataaattttntggatcttcctgataagtaaaaattaaaggtttgacacaatttaaacgtgaattatataaagcattggttaattagcattagaaatgcaacaaattaacggaattattatgaaagtgtttcctttttaaagaatggccaacatttttgagacattccatcatataaaactcagatttccgtttcaatttaccgtagtatttcctaaaattatgcccatggctcacaaactctacaaagagggccttcaataattcacaatttttgaaaacccaaaacccttttcagcctcctcccgccagtgagtacgaaattcggtgttacgcctccgcgccaaccgacgaaagcggcgaatcgtcgccggcggctgccaacccaaagccaaaagcgatgcaaaagttggaggaggagcagcgcaacgaattcctcggcgagtacggcctctaccgcagttcggcacttcaaattgcgaagaatgtgatgtccaaactgttgcaggcgcacctagtggtaagcagccacagtttctgtgttcttggatgggttttggcatttaattttgaaaaatgatggaatggttaaaaattaatttaaattgaccattccgtgcattgcgatggggggggggggagtcggggtgtcatgacaattcgtacacagacaatcgtacaagcttaaggcttaagcctaagctttaggcctaggcttaagcttatgctttattttgcaaaaatttttattgtatgcgttgcaattgacccgaggagtcgacggacgactaaccataattatgttttccgatagtggaacctatgtttttcctccactaacatttgtcattatttgccaaaatctattccgcaacaaatgtgtttaggacgacgattctctggagacgagtctgaaccaatgggacgccatttttgaggccatgaaaaaggcgggtgccgcggcacaacaaagaggcgcacagccaccggcgggtgaagaacgggcgacggagccgaggggaggcggcggaggggaccaagggtcgtcgacgcccccgcattcggtgatttaactgtcataattcaaattgcataatttttcctccctttttaagcctccgacaaactctgacgctggtccaatgtcgcaggcgttggtcgaccgtttctggcgcggggacgtgtgcctgcagggcggcacggggtggtggaagcacgaggtgtgcctgggccgtacggtcagccaataccacgaggagacggcggaggacggcaccaaacagcgacggcagaccattctgctcggcaaatttgacgaagcggtgcacaaagtggggattctttgcggtttcgaaacttttttttgttggaaaaacccaaatttagtggcaaaattctaaaaaaaaatttttaaaggcatgggccacagaacatcctggcaaagccgtggagcgcaaggtggacggatcggtggttcaagtggcacacatgtacacacagggcgatgtgtgcacggagacgggtgcccatcggtgagaaattttcaggagggaagagaagagcacggttttggtgcatttgagaaactttagatgttaaactgttcatgtttgttttttgaattttaggctgggaagaaatgctcattcttaatcattcccattttttatatttcctctatttttctccagggactgtcaggtgcgcatgaaatgccgagaggacatcaatgcccagaaggtgttcatctacatgttggaggttggtttctttacttgtatcattaaaaataaataaacgaaaagcggttttaaaagtgctttttttgtacgttttgctattttgatttcctcacgttcacggtgttcatttcaaaaccaacaatacgtttttacattttgcctttttttgtcgttgtacgttttgccatccccccccccgccctcaaattcttttgcttttttccgtttttcaatcacttttttttcgctactaaatttagcccagcacttgctcctacgtggtggtgctcgagtcgtccctgttctgctccaaactgcagcgtgtggacgagttcggactgttgtcagtggacgaagcggcgaaagcgagcgttgccgaaaaggaaacggcgcccgaacagcaaaccgacgaccggttgatgaagaaacgcacttttggcgagaacacggtggtgttggacctggcaaatcaggtgggccgagccaaacggcagtttattttggtgttatcagaccaatgttcacaaatgggttgccagagggacggtccccatggaatttagggcttccagtagggaattgagtggaggtaccatggcgagtgttttccaggcctgggtttttttctgggtccgggtccagttcattttacggcaacctacattttcctggttttttatccaggtccaggctttttaaatgtcgattagtcaaaaatgatgtgatgccattttcaggaggaaataatgcgcgtggtgcgacaactgctcgaaggggccggcgatggccaagtgtttgtcagtgcggccaaactgaaaattggcaaaggcgaagacagtgaagaggacgaagaagcggaacaacaacagcagcaagagggaaagagcagagaaacggcggaagccgaagcagaacatggccaagggagtgaggcggaaaaaggcattggacgagaagagcaacagggacagacacaggtgacgacagacaacgagactgaccgcgagagagtgcgcagcggagcggagaca

SEQ ID NO: 20093 - DNA, 504 bp, Heterodera glycines
aatgtgacaaaaggccaaaaataacatggcaaaggccaatgtgacaaaaggccaaaaataacatggcaaaggccaatggaacaaaaggccaaaatgcaatggatcaacgggcaatgggacaaaaggccaaaatgcaatggatcaacggccaatgggacaaaatacaatggaaacggccaatggaacaaaaggccaaaatgaaatggatcaacggccaataggacaaaaggccaaaatgcaatggatcaatgggcaatgggacaaaaggccaaaatgcaatggatcaacggccaatgggacaaaatacaatggaaacggccaatgggacaaaaggccaaaatgaaatggatcaacggccaataggacaaaaggccaaaatgcaatggatcaacgggcaatgggacaaaaggccaaaatgaaattgatcaacgaccaatgggacaaaaggccaaaatgaaatagatcaacggacaatgagacaaaaaggcaaaatgcaatgaatca

SEQ ID NO: 20094 - DNA, 769 bp, Heterodera glycines
  misc_feature (8)..(8): n is a, c, g, or t
acaaaaanagtaatttttaatggcgaaaaaatagaaattggaagggggaaaagtaagaaattgcaaaattaaatcagaaatgtgatggaaaataaatggtataattgcaagggaaaattgaataatttttaattaaatttaattaattaataatgaagggggagataaaaagaaaagcgccgctttgagaagtttaaactccccacaaggtccaccataaaatgggtgcgcgcatgaatccgttgggccctgggccaatgccaggggcattggcccaaagcgcggattccccaattgaaagctccgattaattcaacaatcggtttatttagcgatgagtatatgtggaaaagcaaaaaggaaaagttcgcaacaaaccgatcaaagtccccgatcacactgatcaatccgatctctcccccaaacttttatattggcaacaggtgggcgggtcgggcgccccgtggaagaaaaggccaaaagcaagagaaattgggatgactagcgacagggaaaaagaaattgtgagagacaacaggggaaaggaagtcaagataggcggtcagacataacattcccccgcacctgggaaagccgtgccctcacggcttaagctggccccgggcagaaggaaggggtgcgaaggagaacatagattagagagaagatgagatagagagagaaagaaaaagattatttgaatatgagagggaaaagagatacgaagagagtgaacagtgagaggagtgttgtcgttgcttttgtgtac

SEQ ID NO: 20095 - DNA, 1952 bp, Heterodera glycines
  misc_feature (11)..(12): n is a, c, g, or t
agaatttagtnntggaatcggaagacttgggaggacattgtgagtcaaaaagctgggccacataaagcgcatttgcttggcactgaagaagctcagagtgagttggtgcctcccgcgcgatggcatttggccgtgcgatcgcttcttcccccccatcccccatgtccgttccgttcagaattaccgtgccgaattggtcgacccacccttggccgtatgtccgctgctctgtcctccctcttcgtcttcctccgtttgccctttgtcttccgtcgttggcattcctttggacattcactcgtcggcattttcatcagaaaatctgtttgtacagtccctcagcagcaaacgacgcaattcgcaagcgcaacaatcgaacagtcagctgacggcggtggaaattaacgagaaaaattgtcagcgaatttcctttaccaatggcatttcgacggatggcacgcgattaatgagcaaatggacagaagtgagagggacaaatgccaaagttattaacgcaattaccgaattataaaacatttgcaggatggcggccaacgagttcaaatgcgaaatgacgaaaggacggcgacagacaaaggaccgccacggctaaatttgtacagaaccagccaaatcattgcgcagttgcccagggatcctccgcccgaattagacgaggccgacgaatgggaagacgaacggggcacaaatggactgcacggagatgggcaccatgggcagcctcctcctccgccgggtgagtcacccactttttacaattcctggccaattacacttgagtcctttttcatgtccagttcgtccccttccccctaaatgcctcgggctttagccaattagcaactcgctaatatccattccatctctgtccatttcagcaccggcccctttcgctccgttggaagtgtttccgcttgcgcttccctcctcctcccgctccgccccgtcctcctcttacctccgcttgttctcctcccagccgaccactcctcgccacgctcctcccaatcatccgacattcgctcaaccgtttatggacgacgaccaatactatcagaggcatttgcgacaacggcaacttctgaacgcgctggaggggtcgattaatacgccgacagtgcgcacggaacagagacggattattatggagacagaaatgacaaatttggtctcaaaaagataacaaaatgaaattgaagaataaattgtcaaagaaatgccattcaacacaaattcactgctaattcaatggggtgacgaagtctaaaacattctcaaagttacgcgtaataattgacatttcatgtttgagtaaaagctaatttagccaaaataataatatttttttgtcatttttaattgatttgcagctgattaagcatagaattaatgcattgcctttcactttcggttcgatttgtgaatgttccatttccaaaatatgttaattaatcatttttatttcttttattcaaattcacttttatttttattttcctttttctcaattgttttattcgctttctctccccatttctttatttctctgctgctttccatgaatccctttgctcttggtctcggcagtgccttttcttcttccattcgttgtcccttaattctcgacggagctttcggcacacttttgggacaattgggatggaatttggaggcattttgcagcatatcttaataattatcggcactttaattgcagaaagatgacctttggagtggtggtgcactgatcagcgcgcctcaattagtggcaaaagcgcatcggatgtgagtggaaagaatgggatgatggcaccggtggggcgggcttgatcactccctctacgcggttagggtgctgatttgatcaataactgatcagttcttcatttgatgagcagtcctacttttactttcttcttcgtttgcttttc

SEQ ID NO: 20096 - DNA, 729 bp, Heterodera glycines
ttaaaaactttactgaatacctgacaaaaaaaagtttttctcttagttattaggacaactattataccatgagaccagggatggcacggaattccgatttccgaaaatttttggggcctcggaatgccatccccgccatggacacaaaatgtcatgggacgcgtaaagtgttgttgggacgcgtaaaatgtgatgggacgcgtaaaatgtcatgggacgcgtaaaatgtcatgggacgcgtaaaatgccatgggacgcgtaaaatgtcatgggacgcgtaaaatgccatgggacgcgtaaaatgtcatgggacgcgtaaaatgccatgggacgcgtaaaaccgactagaaccaacttttttcttatattagttgaatttctgttgacatcagtaagtgtgcttagagttgcttttgcacatttcgatgatcaaagtatacaaacaagaacaattagactattcggaaggtataaagtttccgattgacggttcgaaaaacattttttgacgcgtaaaatatgatgggacgcgtaaagtgttgttgggacgcgtaaaatgtgatgggacgcgtaaagtgttgttgggacgcgtaaaatgtgatgggacgcgtaaaatgtcatgggacgcgtaaagtgtcatgggacgcgtaaagtgttgttgggacgcgtaaaatgtgatgggacgcgtaaaatgtcatgggacgcgtaaagtgtcatgggacgcgtaaa

SEQ ID NO: 20097 - DNA, 1087 bp, Heterodera glycines
agattttgcaaaatcactgattttatctttgatttttcatcaagtacttgattttttgggaaaactttatgaaaattaatctggcataaaaaacttatatacagaatttgtagagctcaaaaagagctttcgaatgagctattgaatgtttggagaagttatgtttttcgttttttacgattttttgaaatttaattactggcctttacgggtcatgtgagacgggcgaggtcttgggttcgagcctgcttggcagcagtttattcttttatgaaaattgatgaaaaatcatagacaaaatgatggcttttgtaaaatctgagctcgcccagcagcacgccgtacgagcccaacaattggcccgtcgaattcgcgccgtcgctgaggcggcgccgtcgtcgcttcgactcgccagcggcgccgtcgaacttcaacagttagaccaccgcattgcacaccttttcgcacagcgggtgaatttgccgatttcgccggttctgtgggtgaaaatgaatgaatgcgcggaatggaaaaaagtgccaaaaagagaagataacaaaaaaatgccgaaaaagagggagaaagtagggccagtttctagataaaacattgtctttgaggcttttcctaacaaatttttgcttttatgattttggagtttgggccttatttattaaaagatttatgcgcaattttcagaatattgcctatactttgtttatgtaaaagtttgattttgatttcaactgagaaaattctaacggaattattaaatttgtagtgaattgccatagagaaaggaataatttaaaaattagaagaaaacaactacttggagggggggggactgctcgatctttaaaggtgtatttttcccaaaatttcgggtaaattacccgaggttcgaagcccaaaaaacgcgaagttttctaagctcgaattcgcccagcgctgagacaatattttttaatttaaaattcaagatcttaattaaaattggaatttttcgaaaagttatcgtgacatcaatcccgcgggatcccgcgggattggtaaaatagtcggtagagatcccgatgaaatcccg

SEQ ID NO: 20098 - DNA, 1915 bp, Heterodera glycines
agattggcaattgcaatttcattttgggttgatgaatttgttttctccacttttcccctctttattcaaattgttatcgaaataatcaaattcattttcaatttctttccaaaaatacttcgacttatcattcaatgtttcaacaacatcaattaaattcttcggagaatataattcaataaatattggcttgatcagtggtggcaattgtttcggcaccttcggacttttagcttaataaattattttattattgtcattattatttcaaaaattgaaaatttcaaacaaaccttcagcatgtaattggaataaatatttatattaaatgcccaattaattacgatatttttggcactctgcccaataagagtcttaataaaatccaaaaactcaacaacaaaaaaaagtttatcctgattttattgaataaattttttaatttgatgagtttaagtcacattatttatggagtacaataattataatttggtacatttattttgacattgatctaccatcttggaaattttttaaatttttattcttgtaatttttttttaattcggacttttttttgtaaaatttaaacgccgaattttcaatttttcataagttatgaaatatgaatgctcattttcgggcttaaaaaatctctcaaaattttaaaaaaaggtctaactttggcaatctccgattttgaaacaatttttcattaaaattaatcatttttttacaattcgaatttggtaaagcttcattattctttgctccaattcctttcgcttgtctttcgcttgtcttaagttttgggctcagttacttatataggtatttaagaaatattttttatttatttttttcattaaaatccccaaaagttggctcggtaaatatcggtcatagggcccggagcctaaaatggccaaattatatatcaatcgatagctctcggtctgtaatgaaagaatccgaaagaatttttttgcggcaaccaatccctgaagagttacagacccgggactgaaatggccaaatgcctttgggactgaaccgtccaactagtaaaaacgcatggaattgcgacaaaataaataccaatcgattcctctctgcaggtaacccacgaatccgaaagaactttttggaaaaaaagaaatttacaaaagttatctaagaaaatgacataaaaaatattagataagccaaatcacaaaaatactttaggtgcttccggagcccgtagtctcgccccacctactggccgccgtagtcgagtgtgcggcggttttttagcgcaataaacaaaattcaaacttaaattttattatggtattttaccctttcttcgggctgcacgttttaaaacagttaatgtttttgaggacccatttttgtaaatttacttttttccaaagaatatcagtgaaaatggaaaagaaaattccaaaataaatcgaaaaattggaaaaaatgggagaagaagacagaaacatgatcaatgaaaaatgggacatttgtatagaaatgccaaaaataaacaggaactttttacttcaatctcaattgctttttccaattttgccttttcttctttggcatttttgcatatattttccattaatccgtcaaattcttttcggagattggaaatatttttttccgtttcattttttgatggattttcctcacttttttcctctttcattttgtaattcaattcctcttcatttaacaaattggtttccaaaaaattatagatattcctcatttctttttcacctttttgccaccaaaaacttttcgaaatttcgttaagatttttgataacttcaattaaactgttcggcaatgctaatgtaataaatattggctacagccaatggtggcatttgttccgacaccttcggatttt

SEQ ID NO: 20099 - DNA, 2870 bp, Heterodera glycines
ttcagattctctattaacatgtaaaatttcaaaaaatttcgtcagtttacaaaaaagttatggccaaaaaacctcaaaaattaactttttcttggctttttcggcgccgcgtggcataacttttttatttttgaatcattcatttctatttttacatgtaaatatagagcacacatagagctttcaaatgatgccagattggctaaagctaactgacaaataaaaaagttatagcatttcaaaatttgcggctccgaaatggtccgcgccgaagtgaccccgaccctgatcaaaatgggcaaaatgggtttgccaaatgtgcgcaaatccatgagtttgctaggagcttattcctctgatcaaactccagcagcagttcatcttccctgcccttatttgttagggggggggggtgatcaatttggggaggaccatcttcccccgtgggaatgggagggatgcttccaagcggaccttgcgctggggatcaataaaaaaaattccatctcacgacggtgggattaatgggcaaccgatggacgacgacgattggtgctgaatggaatttcaaacataatattttcaaatattagcaatttagtgagccaatcaaaaccatagagggttcctaactaatttgttagcaattttttcgactttttttgccaaaaactatcatttattttccaaatgtgaacaattcgtgtcaatgttccatcaaaaatatatatgggtcaaattgtgccttctgttctctccaaataaatttcacttttacgtgcacatgtacataagaaaacgtgaaattacaaattacaattttgtgggtctaaaacgatttaacttttacgtacacttttacacaagaaaaacgtgaaatacaaattacaattcatttttgggtacatttcacttttacgtgcacatgttcactaaaaacgtgaaatacaattcattttttggtttttacacaataaaacgtgaagttgcgattaggcaattttctgtgtttttgtacactaaaaacgtgaaattacaattttgtgggtctaaaacgatttaacttttacgtgtatttgtacacgagaaaacatgaaatttaaaattacaattcatttttgggtacaatttcacttttacgtgcacatgttcactaaaaacgtgaaatacaattcattttacgggattttgcacaaagttttgcaggtaaagaatgaaaaaaataaataaactaaaaaaataaatatgtctatttagctccaaatatcatgaaataatgaaaaatgaatttccttgtgtcaaatttttgctgtgctcaaataatcataaaccgccggtcgttgttgtatccgtgtcatattattatgaattaagaatttagttttttagcaaaattatgaataaaattgtttacactttttcattttgtttctaatattaacgattaagcatttctttctgtttcatgaaaaagcacaaatgatttttgttttggtcaaaaattatttttctgtcatcctaaaatctatgagggtttctatcactttcacagttcattgataaaaattaaaataatttatctcctacaaataaatttttaagtatgttgagaggaattgaaaaaatttaaaaattttgtagtaataaatattgaaaagaccatcgcaattgggtgatgtcgaaattttttgaaaatcattaacgcaattcattgtacttgacgttttgtcaatcaatttgtgtaatttttttcaatataaagaagcctttggagtagcccaaattattattctctatttagctggtaaattataaaaaattatttttcctgcaataccttgtttttattccgatcaaataaataaattaaaaaataaaaaagcattcggaatttttgtcgaccatcaaaaccacagcaaaaatttgtcatcgctcatttttctgaagcacttcaacactgtttgttgttgtacttttctgcatctgattgtgggaagtgattgttgttgaacgggttgggggcgcaaggagtagcagcgacggagttgggcttccgattgtattgcgggaaatgacaaagaagtcttgaaaaaaaaaatttttttttaattaaaaataaaaatttatatttatttaaaaataaaacttctattgaaaaggtgttgagtaatctttaaataaataaaaacattgaaaaaattagtggaaaaaccatcaaaagaaatcaatcaatcattagatagggttagtaaatgaaaaagtaaatttgaaggaaaccatgtaatttctgaattaattttaattaagaatttttgtaaaattaaaattttttgacggccataggaattcgaattttcaagacccaggatgttgttgatcagcgcaaacaaaggtgttaatgggaaagcggcaacaaacaaggtgacaaagccaagttgtattaccaaacatttaaaatgagtcatatggaatataaattaaaccccccagggcttctaattttaggaacatgaaaacatgtaattttttaggcaaatttaatataaaaaataaaaataatttaagttttattaaaaaattctcttccaccacccacccagctgctcatataatttgagtttgatgttcggattgatacatttaattgtttgacgctgttctttgcaaatccgttcgcatttttgtttctttgtcgctggaatttttaaagcaccatcgtcgaacccaataggaaagcattctttaaaattaaaaaaatttaaattttaaataaacataaaaatttatataattcattaatttttgatttatcgggatgtaaataaaatattcccgaattgaaattcagggcaggaatttgtggaagatgg

SEQ ID NO: 20100 - DNA, 1536 bp, Heterodera glycines
ctgacaaccaaattattgaaaagttttggtatttaattgaaacaaaaaaaaacattaaaattgctaaataataggtcaataaaaaaatataacagcagaaaatttcataaattaaaaaaaaagcttataaaagaaaaaaggaaacgatcgtttcattccaaaggcaattccttttattttgcaaatttcttttgtcaattgggggttttcggggtcataatcacaatctgacatctatttaaaccttcaaatccctacaaaagggtcccccgttggaattcttcgggggtccccaacagcaaaagtgcacatggcttatactgtacatgcataaatcattacggtaaattatggcactttgtttcttaatgattcattcatccatttgcatttcttctctttggtctcctttccttcacttcctttcccaatcgcagtttggtctccattgcgggtcgaacttcggtttgccgtccaaattctccatttggcattcaagaatttttttaaggttcattaggcacggctataaattcagaaaccaaatgatgtcaaacatttttctttcctcttcacctgataagaaaagatgctttgtacgtcgcaggtcgggctgaaaattgaagggattaagcttaattaggcacccaattgttttttacacgtcgcccttgcaaaagctcaaacatttgtcctcaactcctaaaagtacagtgttttctgattgccaataattgtcgacctttccccctgcaacactttgtgttgtcattggcatcttaagcagcgaatgtttcttgggcttaaaaggttggccaacccccggcgcaatatgcccatgttgtcagttgcgaaacgcacttcaggccaagggcactccccagctgacaatgagcacaatggcattgagtaatttaataagggcaattaggaaaagaacctcattaacggtggtgttatagccgcagagggggaggcaaaagttcatgtcgtggtctccgaccttcaaagcaccgttttttgaaaaatatccgacgactttcaccactcaccgttctgcaacagttctgaatgcgtctgtgctgtgcactttcacaagaacatttgcactgtttggccagcaattttgcctaattttggcactttctgataaaataaaatttccgagttttgccttcactgatttcccaaaacaattgcccaacagtgccgttttgtaacagaactctttttcgtctgggcaaagcacggccaattcatcgaaagtcagctgacgactgactccaaatgccatttgaacgttggcacaaataatcagcaaaagaaaaaccgtagccaaaacgccaagagcaaaaagccttaagaacaaacggcgaaacataacgaaatccgagtgcaatttgccgattgacctgtacgaattgtgccgtgtcggcttcctcacttggctttggtcatgccataaatatgcgttttcgcttcgcttttcgcaatgtttcactttcagtttcctcggctcgacgtcacatcatttgc

SEQ ID NO: 20101 - DNA, 1221 bp, Heterodera glycines
caaaatgatacatcgaaagagaaacgaagcgaatgaattggcggatgagtgattggatgggcagggatatcagcacaatctccgcgtcaatctttagccttcgccaagacgaaacgcatcccggaaaaggaacaaacaaaggacagcagcgaagcggaagaacaaattgggggtggggaaagcgcaagttgagaaatgtttcaaagagaacatttggaagtgatctgacagaattggcaaaggcgggagaaagtggcaaacggagcgatcggaatttgccagaaaacgctgaaagaaaggcaagcgaatcgaattgaatggataaatccaacggaagggacactcaaaaggacgagggagggcacaatgctcacagccttaaattgaactttttggaaagggaaaggccggcacatccgccgatttgtcccttgaaaaggccgtggatttaaatgtttttgtttttctccccccccccctcctcctcaatttccccttaatttccctctctttcaaaatttgcccttatcagtggcttatcattaatcatttcttcttctgctgatcgcccagcccctacttcctccgccttttttcttctctttgccttttttgcacaccaaacgccaaagtcatcaccaaaaatcgtttcccttcgctccgtttactccgatggattattttacacaatttatcggccattttccttcccttggcactcttttaactaaacattcttcggaatccgagaaggaacagcaacttcagcaacacaacataaaaaaggacgaaacaaacggcggaggggacgaaatggcaactgaaaaagccgaattagtggccaaaagagcgaaaatgataaggcaatgatgagagttcaaacgcctaacgattgtttgccgacatttcagcagcaaatgccaaacattttacgccgatgagcccattttggtcactcgcgcgtcgatgcaattccttttcgatgagaatgggagacgtttcctggactgtatttcgaatgtgcaacgtaattttcgtacctcaccttacaccctcttcaacccccccccaatttcctctcctttaaaccctttcccttccttcccccctttgcccttcacagatgttggccattgccatccgcgcgtcgttgaggctgtccactgccaaatgcgactgaccacttgcaacattcggtaagccctcccactaatttatttg

SEQ ID NO: 20102 - DNA, 1044 bp, Heterodera glycines
  misc_feature (21)..(21): n is a, c, g, or t
  misc_feature (50)..(50): n is a, c, g, or t
  misc_feature (932)..(932): n is a, c, g, or t
atgtagaaattcggtgcaccnagaaaatgggtcgccgttcaatagacaantttcgccaaaaaaatataatttttcaaattttcaagaaaaaatttaaaaaaaaaacaattttagtttttatttttgaaaacctatgtttgtgggtaatcctggagtagggttaagccccgagccccccgacccgagacgtttatgggacctattcctattccctgacccccgaatcattttgctaacaaaaatcatcatttgtggtcaaaaatcagcattttgaaaaattttcttattccaactgaaaaaaaaattataatgtttttttgcggcgctcttttcctaaaagattgggaaaggggcccggcggtgccgacagtcgccgccgggggaaaaattttaaattttgaccatttaaagttaaaaacattatgccagagatatttttcaaaggaaaatgaaaaaaagttatggttttttggtagagaccgagtcggaccggatccggtcaaaaattcgccggaccggactggattggcattttcaaaaatgaccggattccggatccggtctcttataatccggtaatccggatttttcccaaaatcgctggaccggattgccggatccagaaaaatccggtaccggatccggtccggctcggtctctagtaaaaaatatgtgaaaattgggcgaaataaacgactaatgaaaattgggcatagaccccttggtattttacggcacaaaattttttttgtgacggcacctttttgtggttggttcacaatttacaaaagaaaaaaatttaaaacatgaagttgtaagtccgtacagaaagatagaaatcacattcagagagtgctaatgtcaagaggtgttccccgcgccccgtttttgtaaaattaaaaaaaaattttaatttttgagcgattttttanattttttgacgaatcacaaagttttacaactattttgactaaaaagttgctggaagttcaattaggaaaatttttcatttttttaaaagaaattttgtttaaaaatctttcg

SEQ ID NO: 20103 - DNA, 1935 bp, Heterodera glycines
cttcgttcccgccgcccttcaaaatttttttttaatttgaaattttcaagaaaaaatatttttcaaaaagttttctagcgtttttcaaaatttttatgatcaatattaattgtacgttttcttcaaaaaaaatttacaaaaaatcgctgaaacaactttaatttttttttcttgaaatttccttaaaaaaaattcgggtgggggggggggggggacgagctgccacttgtaattttaataagaaaacagatatgaaaaacaaggggggggggaacatttccaatccaaaaatccgaattctaacaaatgttttgaaacaaacaatttttcgatttaggtttttttttagaaatttaggttaggaaagtcgaagtgtggcaaacctcattgatgtccaattttttgagcgcaaacagtgtgtgcgacaggtcgtagtacagcatgttgcctttcgtctcaattcgccgctcaaattccctgaagacgtcgcggcacaaatatcggcggtccacattcagaaagcttaacaagcaattaaaatataaatggaatttccgaatgcatgcgatgaaacacacactcgaatttggttgtctcggtaatgtcgacgagcaaacattctccactttggcggacaatttgtccattgattttcacttcgtaacggaacacggtcgccggttgtttcatgtctatgccgaacagctaaaatggggaaaaaattggtataaaactatgttcatcatgtcacagtcattttgtcaggttacatgacatttgcgcctatgtcaaaaatcgggttcaaacttaaaattttcaatcccatatgatctagagcttaaaattttgcatccgatagttattgatcgttagcaaaattttgaaaaaaaatgtttcaaacaacggattattgtttctattgaaccaaaagacaatattttcttagctttaatgttgctatgagctctaatgaaaaaaaaacttaaaatccgattttggacaaaaggcgtgtccgtcgtacacgctttgtcatgttcccacttacattggtgacgacatttgtcgcaattgttgatccgtgtccttttcctggttccttttttacagccattacagtgctgcccttttcaatctgaaaaaatgagtcatgccaattacactgggaaagttaaagaccaaagaggctctactgcactttagacgtccaaccaatgagcaaccacgctcatcgtttcttaggtcataactttttttatttgatcaatggctatatttgtggtatcaaacggaagcctaaaagtcgaatggacgcctaaagtgcaatagagcggctaaagaaagaaaacttacgccccgcttcagcaagtatttctccgcttctctgttggtcgtagtttgtggtctgaggaccgtctccattttcaaattgtttttgagtaagtgttaattctagtctataagcgagggagtaatacattgtaaattggaaagcaatgagcatatgattaatgatactggcaatttccggggattactagacataagaaggtatcgtgtaaccatagcagtattctacgtgcacatttgaataattgaaatttaattttgattaattttggtccgcaattgtcaaaaaaatggggagggacacaacggcagttttatttcagaagtacgaatcatctttcgtaatgcgagatggtgttttttctcgcgtcattttttaacaaaaaattatgaaatcaaattcaaataaattttcttggcaatctgttttaaaaaaaaataaattgcggaccatcagttggttggccctcacgtttgggcccaacatgttttcggcatcaaccccaacaatcttggtatcattcgaaagctctttacatgcttctattagccttgcaaatgcgtaaaaattttcaagcctggaaaaaa

SEQ ID NO: 20104 - DNA, 2527 bp, Heterodera glycines
gattcggtatttcaaaataactaaccaccagataaattcaatttgattttctaatattgtttataaaacatgaaaatgccgataagcgcagtgatagcagatgcacaaaaaatcgcgaaatatgcacctaaaaaggcataaaaatgcaaaataggcaatcgaaataatgatgtttttatcttttcttagtagatttgaatttgatttacatcattaaaatataaaagagaataaactattatggtgcattgtttattgattaatttattatttatttttagctttttgttaaattgtctttttatgattttcagattaaattttgatttagtttttgccgacgcttatttgggcatttttttaaaaagtagttttcttttccagttttttaattattttaactaattttatattttatttatatgcttattttatttcctgaacttcattatctttttgttagggatgcgatttttagggacaaaaaatcgcgaaataggcactaaaaataacaaaataggcattaaataggcataaaaatcctcaagaaaaaacatttaaatattggggatcaatttttgtgaaaattttttcgattcttaatggtttattttctgaattttttcagatcgattattaggggtgtatttttcttttttattgcatttttgttaaggatttttccgaaaatcctgaaaaagactcaaaaaatgccaaaataggcacaaaactaggcatttcggcattaagcacaaaacgtattaagtgcgcagaaattttaggcatttccctaaaaaatggagtcaatatttttttatcaattttaatatttaaaattattttttaatgttaattatttattttttctaaattttaggcatttccctaaaaaatggagtcaatatttttttatcaattttaatatttaaaattattttttaatgttaattatttattttttctaaattttaggcatttgcctaaaaatggagtccctaaactttaccaatgcgcaaaacataaggatacatttcctccaacaaaaacaaatcaaacgaccccaataaataataaagccaatctttataattgtttatgtttttattgtagcacagataatgctgaaactccgtcgattccataattagtcgctcgaggcattttcttaattgatcatacaattatttatttgtttttaaattcagccgattacttataaaacagttgtttgcatttttggtacatcaatttgttcgcaattttgtttgaatattccaattcatcacactttttttcatgctccgcatattcggcttcagttagcgttttgaatgagtacttaatttggtgatttaattttagaaaagaggttttaggcggaactttttcgaattttatacgatttttaaaagattttgtccaaaaaaaaaagtttttttttctggtttttcttaatctcactaaaaactcgaatacattttaaaatatttaaatacccaatgaccctccaaaaacaaaattaatataatactcagacactcaactattagccgggatcaatgaattaattattttaatttttgggccattaatatcacttaagtaaaaaaaaataaaaaaagcaaaaaaaaaaaactaaaaaaagaggacaatttatctattatgtaaaacgtttctaaattaaaagagtttaattggtttttaaatttattttcaatagttctcccaatttccgtgccgtttttctttctctttatttatttattattttttgctcacttggctgaattttgggccaacatcgatgttgaaaatgacaaatagccactttcctcccaaatagtcgcccatttttcgtttttgtttaaattttcgtttcgaattattcggtgcgcgaacccttgcaacagacaaacgtctttgttgacgttattttttccaattttttgaactaaattttcccattccttcacaaatttcttttgcgtatcggatgtactgctgttgcattcatttgccttaagcatacaaaagattattattttttattaattggatattcgcgattaaaatatcttttttattttctataattttaacttttagctttttcatcatttttaatgtttcttcattgaattgaatgaagtgccaaatcgccacttttgcatttaattgcttgatcctgtccgagtccatgaaattgcttttaaaagttggttccgattcgatggaaaaaagtgatttgaattcgttttgcatttcgattaatattttttgctcttaaaaaataaaaattaaatgaattttaaacggctgggtcgtttcataaaacccgccattttagcgaatttttcgacaaaaactggcataactttgcttaaaatcaatcaaattttatacattcttggtaccatttgatagcccagctttttctctattagcctggaaaacttcaaataaaattatcaaatttaacataagttgtggcagaaatagtaattattttcatacaactttttgtaaa

SEQ ID NO: 20105 - DNA, 1606 bp, Heterodera glycines
  misc_feature (1571)..(1571): n is a, c, g, or t
actgattttcagattttgattttttacaacttttttggcttttccttcatttgagttttgaacacatattgaacaaatcaaaattatacaaaaaattattgccaatttaaaatcctttttgatttccattttaacaaaccttaaataaaaaagaagctgcttcattttttcatattattataattaaaataaaatggaaataagaaaaaaattctctaaatggaaattggaatatcaataaaattgatttgcataaatttctttttttatataatatgattattaaataatatttttaatgtcttgtaattatcaggcatggaattattacgcaaatgcctattttagccaattgtttcatcgagagaagcatcattttgtgccaatttttgccaagtgcacctttttgtgcttttcacaaatgcctcaacaaatgaaattttttcgcactaaatttttttttaaatactcttatatttttacagacagaaaatgttttttatttattttattttgaatacaattgaccaattttttgaccgttcttaaattgctgattttgaaatacattattgaattcaaccattttttgtataatattgccattaaaacatggcatttaattcatttatatttaattattggtaattaccataaaaactatgccaattaacgaattatggataattaatggcttttttgcttttcttctcgtttagactttacacctgaacaaacattatgcattccattatttggttttcggagcgattatttgccaacaaaaataataaaaaacgattttttcgctccctccagcagctgccttcaattcatagcagaaacagctaaaaaatcaaacgtacagcagtggccaaaatggtttattaggaaaataattaacacgcgaaaacgtaaaaaaatacaaaaattattttagataaatatttttatttaaattaattttgatttaaaaattgctctaaaacatatggcattgattgcgctttcattttattgcattggcattttgttgttgcctgcaacaattttttcacaaaaccgacgtggaaattcagagtttgcgcatatttgtggcaaatttcctaatcgatatttttcttatgaacgtaatttattataaaaaaatatataaaaaatagttttttaaatattaaattttaaaaaatttcagcatgccctgaggatgagcggcaatcttcacagaatcaacgaaaccgaaatgatcaaccgccaagacgtgatcagcagcaacaacaacaagtttgcacaagacaaggatggcaaccgattggaattaaatgccaaaatgttaatgattgctatcaacaccgagaaagtattttaataacatttcaataatttatatttattaattttataatacattctattaaaaatagaaaatgcacttgccaaattcattttggaatcactggaaattaatatcgaataaacaaataaatattctaattacaaaataaataataatatatttattttgtaaaaattacttattcaatgagaaaaacctttatataaaaataatntttttagatttttttaattatttatttatattttt

SEQ ID NO: 20106 - DNA, 1020 bp, Heterodera glycines
aagatgttgcgatgatgtgcgaaaagggccaatgttgttcgccggttgttcctcctacaactgctggccaaggtgaacgtgccggtgccagcggccgtgacggtcaaacacgaccaacaaatgctgacacttatgtgtggtggcaaacatgcgaaaatggtggctattttactggccaaagatgtcgtacaacatcagaatgtcgtcaaggctatggccctggtatgataaaatgctaatgatagcattccgatgcttaaagtgtgtgtatggcgttttggcacggtgtcgggaaacaaatgccacaaaaaaacgaagatagggaaggcaaaagacagagacatttgctcaattcgtggtgcttctaataagttttatgctcataaattcgtaaaaatatgcacatgaaaatgaaaatatgcatatacatttttctaaattaaagactaattttaacgaaaaaaattggtgtaaattatgtaaaaaaaaattccatttttgcactttttggtggaatttttcaagaggccaaaagggccgctttaatagaggttgacgctttcgtgcatataattggaagccctattagcttaatgatctaaatatgcttcataaaaaatagtttacaaaatatgtttaaaaatgaaatttaaaagaataaataaataaacaaaaaatattaataaatatttcttttattttttttcgacaaaatgtggaaaattttgttcaggaggacgcttggaacagaatctggcaaaatatgagcaaatttgcctgcaaggcgagtgctgcaccacaaatcgggaattggacatagagaacggcatcgctaatccgaatgtcaatccaaatcagaggataaatacgaacacaaacccaaatccgaggcctggccctgcggtgcaaaatccaagaataaatccaaatgtgccggccaatcaacccaatgctcatgggcaagaaaaaaaaaaattttaaatgatacaattaaaaatgaggaggaataatcatttaaat

SEQ ID NO: 20107 - DNA, 1030 bp, Heterodera glycines
attattttttataatttattctaacaaaaaatttaataactttatattttattttcggctccctttatttatttgagtaactcaaaaataaccatttttttttgcaaatttcagccattttttaagaaaattaaggattttaagtagatagtagagaccggaaatttcaaatttgcggatcctgttgcaggattggaattcaaaattttttacaggacaggatccggcaggattaatcctgcaaatcctgcaatcctgcaaatcctgcatttaaaatctgcaggatcctgcgcaggattgcggattttaggaaatttcaaaaaattctgtattaataaaaaagtctttcaaagtataaaaaagtattcaaatatatttttaaactaaaaaatgatgaagatgaaaaattaataacgtatttttgcttacactccaagcaatcggctgattcttctttaatgcgtttaaaaagaccgatttgccaaattgggtggctcataataatagcttaaattaaagtaaaataatttttatttaaatttctttgcaaaaaagtcataatccattatgtatagggatgggatttttaggcacaaaaaatcgcgaaataggcacttaaaaaggcagaaaaatcctaaaataggcacgaaaatagtaaaaaaaatttttattaacgctttttaggtagcaaaacacataaaaaattcaattgtataaacttttttcgaataaggataagtttttaaacgaaaaatttttattagaaaaaaatttttgaaaaaagaaagtttctgaatatttggcattctttttttttaaattttcaaaaaatcaatgcaggatcctgctgaatcctgcataaaaatcaaatttgcgggtcctgttgcaggattggaattcaaaattttttacaggacaggatccggcaggattaatcctgcaaatcctgtaaatcctgtattttccaaaatatgcaggattgcggactgagatcctgcaaaatcctgcgcaggatcctgtcctgcgccgg

SEQ ID NO: 20108 - DNA, 990 bp, Heterodera glycines
tggggataattggagactgcgggattaatagagactgggcgataattagagcatttacggtaattgtgtaattatttttgtttcctcaccccttggcggatttaagaaacgtccatagttgagaaatttctctatttttgattctcgaccaatattaatcacagggttgctattggaaaaacccgcttccaaggaagggtatactgatttccaaggacataatggcaaaaattagtgaaatccacatacacttaattattatatgcaatgaaaaattattaatttttattcgattttttcgggatcattttcctcatttcaccgtatgtgcacttttattaaaagattttgtacaaaattgttcaaagtttacgctttttgggtgagcttttgaaccaaattaaaaagaaagaaagagagattccggcagcgccgccgggaaaaaagaatgccataattttaaactttcataaaatggacctttttttacattcatatgcaaaaataccgctttttccaagcataatcttggaaataagtaccgttaaaattttccaagcatgaacgccgaaatccaagcacatacttggcatcaaagtacgaatggcagccctgattaattacttttaacttactgtccagcaaaagaagaatgagtgaggacaagatcattgctgcaaacaattggttgctgttgttgttacagtttttcggccacagttactcaaatcttaaaaaaaataaataatataaaattgaaaaattacggtgctttcctgtgttgtacacccctaaaaagtctataaaatgacgcgcaaaattatttttggtgacataaatgaacaatttcagacgaaacctctttaatttgcgggttactgtcaaaatggtagggaaaaagatttttatgaattgtcgcaccattttttgactgtttttaatcgtctaataccagggcttgggcaaatgaaaaacaaaaaggtgattttt

SEQ ID NO: 20109 - DNA, 1556 bp, Heterodera glycines
  misc_feature (1533)..(1533): n is a, c, g, or t
  misc_feature (1543)..(1543): n is a, c, g, or t
  misc_feature (1546)..(1546): n is a, c, g, or t
aaaaagattcattgccatttgtgggggaatgttgtgattgtaaggcaccattcagctgtgtatttatgtgccatttttccatgttggcatttttattatgcttaataaacgccgcgcggcattatttgcactttccaaaaagggaaaagcttggataagtgcatatgcacttaataaattttacaattattattttatataatcacaaaagaaaattattttattaataatcacataaaatatggcatttagtcatatgaatagaaaatgtgacatagacattggataataaaaatttacaagtgcttatgcactttcatccaatgccactacctatgagcatattcactgaatagggaatataatttgtatacattttatgtagcgaataaaatttttctgtcatagaaattttttatgctggttttttagaaaaaaattgtaaaaggaacatttattattcacaattgaacactttcacgatgccattatatatcatttttaatgaaaaaagattttatattggtttttgtttgttttgggaacatcaatattatgagatctcatcagtctcgggtctagaaaatttcaggttccaattttggggattaagtgttgctcggtctttttcctcctggcaaagactcgggctcagcaggccttgaagttagagtgctctgctatctttggggtttagggttttcgccgtttttgagtcctataaaattctcgatccgggaatgtttccgtaagttagagttctttgttgtcttgggtttaagaaaattttcagtcttgggtttggggctcaaggtttttgagtccctgaaaattttcaatccatgtaaatcttcgatgcaaaaaaattttcgacccagagaaattcttggacttgagaaatgacggcactatgaattatgcgcttggacagcagcagaagcagttgatcggttcgtggaaaaagtgatcattgtgaacagttggagcagtgcttccaatgtcaccagcacaaattcgatgccggccccaatttgttcaacaaaagcaacgtacgtttggagcagtgccaaataagcacaaatggccgcctgtgaaaacggattaaatttagggctagacggggttcatgatttttgaaaaaggctcggataacccatatttggaaacttgtaaatccaaacggactttcagttcgaggcgacattttttttttttgaaaaatcggcaattagcggactgactttttttaaatcgtaatcaagagttaacaaagtttgatttagaaaaaaaaatttttttttgccaaccgcggcaatgccaagcagaagagagaagaagagttctgacgatgtttcagtcaaatttccagcgcgagcttaaacaattttctttttaaaatgctagtttttcgataatttttcaaaaattgggctaagaatttagaaaattgaattcacgacaaattcctaggttttagaaattttgaaaaattttattccaggttgattatgggttttatttaacctttaaggngcaaggaaanttngacacaaaat

SEQ ID NO: 20110 - DNA, 2095 bp, Heterodera glycines
ttacctcatgctttcaatgactggtgttcctgatggtcgcaaattgaccaaatattgcatatcatcctaaaaattttaaaaattattgttttcaagttctaaacgaagaaaagttttttttgttaaatattttcttttaggctcaaattcttaagagtcgatttcatttacagaaaaaaaacggggtactgtacatgatccccatatagtacaacgcattatgttaaaacaagactttttgctttaagctgccagtcatggtccttttcggaaatcttgttctggtcgtagtacggctttttgttttcgaaaatcaggtatctcgtccaaaaacattaagtgaccccgaccgaataacttctagtccagaagtgcgaaccattttgtgccaatcccggccattgatcccagaaagtgaggcaactaatttcagtactccgaaaagggcagaaatctcggtttggtttttttttttggtttctcggctgccccttaaaaaaggtccttgaatgattgaattcgaatccaatttttttggggtattttcaaatgtatattaaatttattaaaactgaccagcactgtcgtgtttgccacataaatgtccggtttgtgatatatttcggtgaccgacaacacagtgcgctcggttgggtggaaaatcacacctttaaaattttcaaatatttttttaaaaattattttttccgatttctaccgccaatttgtgctttttgggctgtgtaaagaatttcgttgcgttcaggccgcccaaaatcgtgcacaaccaattggccaaggtcctagtgaaaaatttaatttttataaatagtttaaaatctattttttaatttaacattctaaaacatttaatctttttttatttaaatcccgtttgtaaaatttttaaaaacaccaaaaattggctaatatgaacttaaaaatcaagaaaataattagaaaaaaagaaataattatttttataggagaaatgtttttcattttttattatctaaaaaatattattaattgaatgttaattcatccaaaataaatccaaaaaaaaaaaaaaatccatataaatatttcaaaaaatatttaataaatttctgtgtttactgtatccgcgccccattgccaataaatgcgacggttgtcagcggtgaatgaaattggcctgaaattttacaaaaattaatgcaatattttttttttaatttaaatatttcatgtacagtgtaagcgcacggtcatctggcggcactcgcaaatactccacccaattgtgcggctcagaggtcagtcgactggggtttgcaatgtcggaaagtctgaaaatttttgcgatatcgctttttgaagattattaaatttttctagtgttgataactttttttatataaaacatctatctaaggcatggtttgttatttgcatcaacttcgcgttagatacaaccatcttagtacagtatattatattacagtatcacttttgaaagcatgcaattccattgaagcattctccataatgaaactgactacagtaacacctaattttaggcattcattttatttataatattttaatacttgtaaaagatcagcgacccgtccatggcctcctgtacaaccattcgaattttcaattcattatcaacaacaattttggcgggaaatcgttcattgtggaaaacctttattttggggcacattttaaatttaaaataatttaaatttcaaaattttcttaattcaaaccattcgcatttgattgttgattaagtccagctcgtacacattgtgaaaggctgggttttcatcattcagcccgatcaaaacgcgatggtctcgcaaattattcccgatgatcatcgcctaaaattatatttattttttaaatttattttttttaattaaatttaaatatatttttaagcaatttgtttgtttcagtaattaattttgaactttgccctaaatttgatttaaatcattttttaataccttaatgcctgtcttttcgtttattgtgtacactaggattaaatggtgacggctaaatttaaacttagataaaaataatattttgaatt

SEQ ID NO: 20111 - DNA, 973 bp, Heterodera glycines
  misc_feature (888)..(888): n is a, c, g, or t
  misc_feature (924)..(924): n is a, c, g, or t
ctcaaaatttcagctaattatcttctaaatataaactctcacagcgtgcggaaatattgagttaatagctccaataatctccgacttattattttcacgaccatctttgtgaaattttcacattttcagctcattttcctcaaaatgtatctgtataaatttgctcaagtaaattgtaaatcggaaattagtagcgtttatcaactccatacttccgcaacacttatacagtttattttgagggggtaatgagctgaaattgtaagaattatacaagctggccaaaccaaaataataaatggaaattattggcgcttatcgactcgatccttctgcgacgcctatacaatttatatttccatgataatgagctgaaattttgagaatttcaaagtgatcatgaaatgtaaatagagaatctcacaatttcagctacttaatctctaaataaatactgcagcaatattgtagaaggatcgggttaataatattctctgatttattattttcacgaccatccttgtgaaattctcaaaatttcagctaattatcttctaaatataaactctaacagcgttgctgaaatattgagttaatagcgccaataatctccgacttattattttcacgaccatctttgtgaaattttcacattttcagctcattttcctccaaattatctgtataaatttgctcaagtaaattgtaaatcggaaattattagcgtttatcaactccatacagtttattttgagggggtaatgagctgaaattgtaagaattatacaagctggccaaaccaaaataataaatggaaaattattggcgcttatcgactcgatccttctgcgacgcctatacaatttatatttccatgataatgagctngaattttgagaatttcaaagtgataatgaaatgtanatagagaatctcacaaattcagctacttaatctctaaataatactgcag

SEQ ID NO: 20112 - DNA, 2797 bp, Heterodera glycines
  misc_feature (2308)..(2308): n is a, c, g, or t
tgccctgcttggattgtcgacgacgggattcgccccgtccctacgggtgctccggctggcgggagactgataccgatccgcgagactccggctgcgggagtttgaactgcttgaaattcgctgatgctccgggccaattcccggattctccaatgccaaaaggaaaggaattgggatcgggaggattgggggagaacgacgagggctctgtcgggaaagggaggggtcaagacggggaatgtgcgccttcgtttggccacacacgaaaatttgccgaatgtgatggagtgtggagggtgcttttccctcctttccgagtcctccaagccgtttcagcacgaatttattaaagcaaaacgaataatgaataaaagcgacgaattgatcgaattgggcgatgggacggggggattgtaggaattggtcacaggcagaccgaaaatgaagcggaggggagtggaaggaagagaagaaaaaaagagaacgcgaccccttggtcggggccgcttaaatagacaattttctaagggggcgggcaaaagggaatgcacgtggacaaattgtgagagggacagaaaatgggcagaaaattctagaagcgaaagtgagcacaaaggaaatggcacacaggaacacaaaatgcaaataggcagatgggaaagatagaaaatggtgaaaggaaatctttgtgcaatttgttaagcacaaagttggccagagatgagccagccgatgagaaaagaatttgaattgtgaaagggatgcgattaggcaaaaatgggacaaagaaacgggcaaaacgtgcatggtacgaaatggagcaaaaatgcaaatgagaaattggatgaaaagggggtaaaattaggaatgatcaattttagcggattgatgaatcgggattcgccccgaccgtctccaagtacgtccctcattctttttgcttcggttgagtccagtcccgtccatttcgtgcagtaggcggggattgacccgccttctcgtcgccagggcaagcgcgccctaattctatttttccaacctatttcgaaccttttaacatcgattctgaccgtttttaagcatttttgagtttggggactatgatcaatattttccctattgggtattgcgtacttcgataacagaattaaaaaaatgattttattccaagatagaattttaatgcacaaatcggtttaaatcaaaaaatcattgggtgaactggtatataaagtgaaaattggcagagaactttttgtaaaaatgtcacgcaaaacaacaaaaactcgaggacagtcacaggcggaaagtacgatccccgcccccttcaaatgttggttctcttctccaaaatttctttttgaaaatcaaagcaagaaaaaatgccttcgaccctccggcgaaccctgggaccgtccctaacactgagaacaaaaggcagaatgacaacaaataaaccaaaaactttccacaaaaatgacaaattttcatatccccattttcgcaaatgcataatttcggcttcattttcgttttcggccacgagttttgttggtgttgtcctcctcctccactggtgccgaggtcggtttaaaatcggccgcctcgcgccattccgatagaatccgttccatgcagcgtgccgagacgggcggcacccgtccaaagacattcgaagcggtcagtttcatctgcatctcaaactgctccaggcactgcttcttcagcttttctcgcttggccaccatgtagcaaagattacgcgcctaaaatgggaaaagagcaacaaaaaggacccattaatgtgtgaatttcattgcccccctcccctcgcgttttcccccaccccgcgtcattctatgagactgaaatttaccccacttttggggggtttcaagttcaaaaaaggctttttgttaggtaaaattcttttaaaaaaatctaggcttaaattttgtaattaaataaaatactttaggggaggaatgacggggaaaacgaccgggagcagctcgtccccccccccgcatcgtttcccccccccccgagaaatttaaaaaaaaaatttgctaacttagaaatttttcaagaaaaaaaattttttgagaaattttcagcgatttttcggaaattgttttgaaaaatcttaataattcaccataaaaaaatttttcttagaattttcctatgaaaaatctttctaagatttttttcttgaaaaatttctaagttagcaattttttttttaaatttctcgagggggaaacgatgcgggaggggggggggggaaacggcgggtggaaccgangctgctcccaatgaccagcgagggacatttgtcagcccattgctgaggaatgggaaaatttttaattttaaaaatttaggcagtaaactgtcttatttgtctaataaacatttattttcaaaaaacaaaatttgcgggattaactaacaccttccctccgaaaaccaatgtgtttaatttaatgcttttgaaagactgggacgcgttttttaaaatttctttgtccgccatttttcgtcacttttccccagtttttgccgcccctccacccaaaaaattgagtcgctttcattgccttagcgtcagtttggcgctgcaccgcgcgtacatcagcgacagcgcgtagatgaagcagtagccgaacagcgagaaaattccctctctgttctggtcgagaaagccgtgccgtgactccccgaagtcgggccgtaaaatccattgctcaagcgttgtaagccgaagcgcaatttggtagacgaggccgagcag

SEQ ID NO: 20113 - DNA, 830 bp, Heterodera glycines
accttcgtcattcatcggcaaacatgacgaacagctgatgctgccggtgccgctgcctccgtcacattttgctgtccccccgggggctaattttgttttttcttccctccgccccctcggcttattctatttttggagtgactcattccatccattcattcattttttgtcccatggcattcgttcgtcgttccgtcgacaaaaataaacaaatcgacggacgaaagagcaaaaaaagaggagaagtgttaaggaaacctcaaaaagcagaagcataagccacacaaccaccgccaacagcagctcaacaaacccttcacacctcaccaaatgcgtcattcattcgtttcgtttcgcttttttcgtttcttttgtcccttctttttttgccaacaaatcaaaacaaatggtgggaatggaaaagagatgggacgaaaagaattgtgtgatgtgatgagtaagcgtcattaatgttctttgttaagtgcacttgaattttgatgaatgattttttgagggggggggggagagaaagggagacggaagcattgctttccaacttcgatgagtcataacaatttcgcgtcaaaatgagtcatgtcgatgatgatttgtaagacggcttatcatttcctacatttgttaatcactttgttgttccactcgcttcgtctctttcattggcactttttttcattggcatggctttataaagtcagtttaataagcatttcgcatttaacacttttggcttttcaccctgccagttggtttttgcgtctatttctttagccttttcatcattggcatttaattggttttctttgcat

SEQ ID NO: 20114 - DNA, 1181 bp, Heterodera glycines
aaaatagttaactaaaatagtgagtaaaaatcccaaaatagtgaagaaatagtgacaaaaagtgtgaaatagtgacgaatagtgacatgattacagccaaaaaattgaacaaaacattttttaactagtgagttgccaatgaggtaacatttcctttataaaattctcttagcaaatatttaactttttaaatcaaaaattttgtcaagaaaaaattttgggggaagaatttttgagaaaattttttcatttcgtaggagtgtatttttaaaaaattttcggtcgattcataggggtgtatttttctgaattttttgtagtcgattcttaggggtgtatttttcgtttttattacatttttcttaaggatattttccaaaaaatgtcaaaatagtgaaaaatttaaatttaaaaatagaatatatgagcaatttaagaataatgagcaatttataaattcaaaaaaaaacagcaaaagctatgggtttaaataaaaaaaatacttttaaaaaaataaaaactaaataaccaaataaaaatatatttgaattgcaataaacataactaataaatgccaatttaacagaacagatccaccatcaacgaagaatgtagctgcaaaaaccaccaagtggaagggtttgggacaagaatttaattgtaaaataatttcagataatttaatagaaaataaatcctaaaaaaaataaaatttccgccctttcctccgcaggtccgccgtccttttcgcctggcccttcgtccgtttccgctcgtccgttgtcgcccgccgctcgtccgtcgtcgtccgccgctggtccgtcgtcgtccgccgctcttccgtcgtcgttccgctacgaccagagctcatgggcaacgcccgtctggaccggttgataagaaatgaaattgtaattttgtttctcaaaaagcttttaaacagattaaattttcaaatgataccaacaatgttggatttggttgatagggaaaaagttatagccaaaaatatgctggggccaaaacgtgagggcccaactgaagtaaaccgctttttcgaaacaactaaaaaccgggaaaagcggagaaaatggtggcaagggaaggtaggtggagggaagaggaaaaccatttaatttcattggagaaaaaggacgaagactacgattttagtttttcaa

SEQ ID NO: 20115 - DNA, 1961 bp, Heterodera glycines
cttgactttcttttacatatagaatcaagtttcataagataaaataatttatcattttcgaatatttaagacaaatttagaaaatgtgtaatcttattgaacagaaaatacccaaccaaaaaataaataaataaaatttattaaatatttatactttaataaacaattttaatctaaacatggagacattaatagaaaatttaacaaaaaaactaaaaatttttatattgttttcttaataattgaatgcaacaaattattaacaatcatgaccttatattaataaattactgattaccagaatgcactccaaatgcttgaatggtgtcaagaaaatttaaataaaaatgttttctttttaaaacgttttttgaataatattattaaaactagaaaaattaaatattcaaagcatatgaatatgtctaatttttaaatgatttcgcacaaaaactttcaaataaattacaaatttatgttataacatatatttttctgtaaataaaatatacgtatgtcacgataaataataaataaaaaatttgttaagaaataagtatatattttatgcaatttaaaaaaatttataatctattataaacacatattttttattctgaatgaaagaaacagctgatttagataaaaaataaagaattaacaaaaatttttgaaatatacaaaaattaataaattctcattgtaaattttagaaataatttaataacaaattaaattattaaaagattatataagcgaaaatatattcagagtggccaaaatgtcaccttataaggcatttgttatttaattttttcgcgctttgggagcttcgctacctaggctgtaaagcgattcaaattgatcgaattggttggagtgcttttttgaatttttaaaaaattattaggggtttttagtccacatcgaggctcacgacgggcgcttcgcacccgttatttaaatttgttggccttggacgggcgctttgcgcccgttttttaaatctgttgaacttacacgggcgcttagcgcccgttttttagcttgttaggcgcttcgcgcccgtttttcaatttttgttggcctgacgggcgcttcgcgcccgttttttaactttgttgggctttgacggccgcttcgcggccgttattaaattttgatcgactcagacgggcgcttcacgcccgtttctaatttttgttgttcttttcggccgcttcgcggccgttttttaaattttagaacagatacaaaagtgattagaagaggtacaacagtgatcagaagaggtacaacagtgcttaggagaggtacaacagtgattaaaagaggtaaacagtgattagaagaggtacaactgtgattagaagaggtacaaaagtgatgagaagaggtacaacagtgtgagaagaggtacaaaagtgatgagaagaggtacaacagtgatgagaagaggtacaaaagtgattaaaagaggtacaatagtgattaaaagaggaagaactgtgattaaaagacgtacaaaagtcattaaaagaggtacaacagtgattaaaagatgtacaaaattgttagaagaggtacaacagtgattagaaagtgggcattcaaatagatcatttatggtaattaaggaattatttttaatcaaaatagataaaaaatcgatgtgttatatttctcattttttaaaatataatacactttttattaatgaaaaacaaattatgaaatgtataataattgaatagttatttaaattgaaatgaaaaaaattttacaattaaattttaaaataatagctgaaattctttaattaaatataataaataatttaaatgaaaatcattattcatcaaaaaataatttaattaaactaaaaaaatttattattaataaaaccaaacatttaaatttatttaaagtaatgaaaaataacccaaaaaatacaaagaaaa

SEQ ID NO: 20116 - DNA, 2144 bp, Heterodera glycines
acgggcgcttcccgccctttttttaattttttgggaacattcgggcgcttctcggcctcaggacgggcgcttcgcgcccgtcttttaattttttgggggacattcggccgcttcgcggcctcaggacgggcgcttcgcgcacgttttttaattttgttgataacattcggccgcttcgcgcccgttttttaattttttgggggacattcggccgcttcgcggcctcaggacgggcgcttcgcgcccgttttttaattttttgggggacattcggccgcttcgcggcctcaggacaggcgcttcgcgcccgttttttaattttttgggggacattcggccgcttcgcggcctcaggacgggcgcttcgcgcccgttttttaattttgttgggaacattcggccgcttcgcggcctcaggacgggcgctttgcgcccgttttttaattttttgggggacattcggccgcttcgcggcctcaggacgggcgcttcgcgccatctcaaataaaacatattttgtagagaaaaatattgcggattttatgaatatttaaatattccttagcattttttttggaatgagttatgaactttttaataaaaaaataaatatttccagaaatccaagcctaactttttgaattttcggcatttataaacctaataaaaaatataaaattcagcatatttttctcaatttttacgcttaaattgagatgaattgacggagagttatgaattttcaaaacttcctggatttttcgtggcccaatttttgatgttttttcaaaattttttaccactctccaaaatatccgaaactcaatataaagtgtatattcgtgccctgcacctcaaattaccccagaaaagtattttttggcaattttagaagcaaaaaaattttccatgaatttcgaaaccatggggtcccccctttggttttgcatttaaaaatccgtttttattttataactttttttatactcatgctaaaaacatgcgataaaacatgatggatagagcttaaaattctctacaaaaatgctcttgtaagatttttggctaaaatcaactcccgacgagttataggcccgggactgaaatgtcccggtcagagcaaaaaatttttctatttccggaaaaaaaccaaaatttttctgaaaatgtcaccaatcgatagagctcgaaaaactatgttttggaagtggtctccgtttttcctggaaaattcgttaaaaaatcagaaaattaaaaaaccaaaaaaccgttttttaggcctagctcgaaaatttctgaaaattttaaaaatccaaaaacacggttggatagagctcaaaaaaatacacataatcattttctatgtgcactggatataagcaaatcccgcagagttattcccgaaaaacgaaattccggttttcgagttggcaatttttgctcacttgtacacggaatacggttagtcgtagcaaaaaatgatcaacaccaattttgtagaggacacttgtgcggagtgccctcccagcggacatttttcgatcagaccaaaacccatagttttacaggctcttgaaaaaagcaaaaagccatttcagcgccgctggcgctcagttggccgccggaccggaatgcctatagttttcctgaatgcgccgtcaaaagttacccctgcatgccaaatttcagctccccccgattagcggttccggagatttttgttttagcaacgaaacacgatttgattttatagtatataaactagcgggtgtgtgcatgcgagggtggcgcttggaaagcgctgcgcgcttcttgagcttcgctacctaggcgcgttttagtctgttagggtctttgcgtcagccgacatgcacttggtttcctccaataattggagttgacacatcgcataatgcaatggaaaccggaagtgccctaacgttgcacatcatggccctcctccctcccttagtccaggcgttggcacgttattgggttgagcgctaaatggcaattcacctgtaggccctaaagagggctgaccggtccatgtcccggatccagcttctcaccattttccaccccacatagtgcagatgggaatgggattggcatctctcaaaaaacatgtgcccaactgctct

SEQ ID NO: 20117 - DNA, 1699 bp, Heterodera glycines
  misc_feature (1578)..(1578): n is a, c, g, or t
ggcgcgaagcgcccgtcctgaggctgcgatgaattgctaaattacatcaatttctagcgacgcggcgaagccgcgtccctgagcgcgaagcgctttccccacagcaccagaaaaaaaactgttcacaccatagccaactgtgcaccctagtttatatactactaaagaaacaaggcaactcatttccaaaaacaaaatctccttacggggcgtcgggaggggttcgaaatttcgaccttggggacaactttttgaggcgcatctgggaaaactataggtttttcgctccgagggccaactgagcgccaacggcgctgaaacggctttttcaaaattttttttgaagttgctcggattcaaaatttttttaaaggcctaaatgaaaaatcggcctcgtaaaggagcttcgtatggatgtttggcacattttttgtttcttgaccgaacccctaggccttaccagtttttctggaaaactgcgcaaaaatgggtcacttttttgggccatttcagcgccggccgaataactcgccagatattgatgataggaggtcggtgtaagcggcttttttgtacagcttgacgagctctatccaaccatgtttttagatttcagaaattttcagaaattttcgagctaggccccctcgaaaattttccgtttttaaattttatgattttttacagatttttccgggaaaaacggagaccactttcaagcaaccgtttttcatgctctatcgattggtgtcattttcagaaaaaattttcaaaatttttttggaaatagaaaattttggttgctaggcctcaatttcagttctggcgcaataactcgtcaggagttgattttatcaaaaaatcgtctaagagcttttttgtagagaattttaagcccaatctaatgtgctttatctcatgtttataccatgagtttaaaaaaagttataaaattaattgtgattttgaaattcaaaaccataggggggaccccatggttttgcatttcatgaaaaatttttttgctcataaattagccaaaatgcatttttatggcctaatttaaggtgctgaactcgaatatatacattattttgggtttcagactttttggaaggtggttacaaatttttgaaaaagcgtcactatttgggccccgggaaatccaaagttattccagaatttctggaaaaattcgatttttcagaaaaaaattcctaactccattctgaaaaagtattttataaaaataatatactcaaaaaatccgcaattttttgctctattttataaattttaatttagctttttatcacttttttgaaaaaagttatagaaataaaagtcattttggaatttgtgaccacaggggtgtgaccatgatttttgagtggaaaatttttttcacgaaaaatcttccaaaaatatgtctttagaggttatttgcgccgctgatcacgaatatgcactttatattgcgttttggattttttggagggtggtaaaaaaattttgaaaaatcaataatttttggcctagaaattcaacctaaattttaaaaattcataactcgcctcnaaatggtccaattcagctcatttaaagcattaaaaattgagaaaaatatggagaattttaagttattttttgagttgccatattttaaaaattcacaaaattaggtcaggatttctcaaaa

SEQ ID NO: 20118 - DNA, 978 bp, Heterodera glycines
taaccccgatggtaatccgttccggagagcctcctcaaaatttttcccattaccgtaagagctgcgaaaatgtgaaataattctcagaaaaatggctatctcttttaggacaattttctatctcgtaaccccgatgctaatccgttccggagagcctcttcaaaattttttccattaccgtaagagctgcggaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccattaccgtaagagctgcggaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccattaccgtaagagctgcggaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaa

SEQ ID NO: 20119 - DNA, 2119 bp, Heterodera glycines
tctagagtcaaacaaataatgtcgaataaaaatttttaatttgagcggacatttaaatgaaagggtgcaatgggaataaacaaacaaagcaaacaaaaaagcaaaacaatattagcgggataaatacactgcaaaaggaaatctgattcattgtgcgacgaatcttatacaataatatcactgcgattttcttcacaagcattgagaacaatcaggccgaagggattgggctgtactcctcgaggtaatactgcagcttatgcgactcgtctattttcccaccaatttcactgtcgaccgtttcgaaagggtgcaaatggcggcgactcgcgcgcgagctcaaagcacatttgtggatcatctgcaggcatggcaaatagtccaagcctgtttcatcggtggcgtaaattctgtcagggtacgacctttggagtgcagcacaacaaaccgcaatgtttggctttacgcttcggaaaatacttaagaataaaggtaattgtgaaaacgggtaataaaccaatccaaaatttcacaccaatcgacgtcaacgcgcagcaaactcagcaattctatccgaagttcgtccatttctgcgactttcgttgtccagtctctggttggcttttctctccggtagtccaaatcggtcatttgcttcgcccgccatgaaatttcatttgtcttcccgcatgttgagtcaacagcagaagcccgctttgattggagtacgaattctttaaagtcgatttgtttctggccatttcctgtcggcttttcaatgattgacagcgaatgttggccatccaattgcaacgcgttcaaaatcgcacgaaaatcgccacgtttttgttcaaaaagattgctcaaatacgagttctttctgatttttccagtgaagccaatgagccattgctgaataaagatgacatttctggatgtaaaaagacaaacccgaagataggcattgaaagattggaacgagggcattttatcgacatgaattgtggaaaaagtttcaagagccggctctcggttgagcatatttgttctcacaacttcgtaatcgttgcaggtgagcacaattggtaccagcgaatttgcacaaatttgtttcaaagttgaccaaaaattagtgtccggcaaatagtgaaggtcacactaaaatgagaattaaaaaaattagcaaagcaaacaaagcgacctcgtctattaaaatcaatgtgaatccgatggatattttcctcttcaaatttgtcggcgagttccgtcgtggattgaacaagtcgcgaatgtccggcatttttgttcccgctttcatctaaaagaaattttactggacagacataaattcttcgaacattgtatgtatcggatgcccctaacaatttctgctccaaaaattgcttgtcgcgtttctcataaggtggaatttcgagcagttggaattcatttctttttgaagcacaataaacctaaatggaaaaggataacaaataaatttcttcctttttgtaaatgtccgaccattgccgttttcccacaaccggtcggtccagtcaaaatcacagggttttccggtggctcttcccccaaatcgtccaagtattcttcgtcttcctcctcttccaaatccgtccgccttttcttcccttttcgtccattttctccttcaatttgttgcttcttcctcagcctttccatccatgaaagaagccatgaattgagtttggcataagcatccgttgcgaaaatggcctcctcgtctttaggacaaaagagtgaactccacagctgagaagcggcttttgctttcatcatagccccgtttttgattgcattcaattctttgggacttaacagcgaattgtcctccatcgttttcttaatttttacattttaaaatccaaaatttatttgaagacgaagattatttattacatcatggtttttgtttttgagcgactggtccttaacatctgtattctcgctgtcttcacacttaattaagcataattaaaggggcaacacaaaattaaaaccaaatcaaattttggcattccccgaaacactttggcacgacgggacataggctccgttttttttgatggcggttttgtag

SEQ ID NO: 20120 - DNA, 2100 bp, Heterodera glycines
  misc_feature (18)..(18): n is a, c, g, or t
tgatcgggcgagagattnccggaccgccacttccgtttttccggaactcccggcgccattttttgggccggggcccctccgggaccgggactttttaaaaatttgtggaatcttgattaataaatttaaaaaattggttttctattttagctgggatttaagccaagccatacaaacgaactctttaagttttcaaagttttttacggcacgattttttcaaaagaaattttagggattaaggggggccggcgggtccggtaggcgccgccgtgaaaacttgtaatttttaatgcgatttgtaaacagaaccaaaaaaatgaccaaattttgcgattctgagcagttttttaaagataataaggattttaggagtagacgggaaaatttttgtgaattttacatccattttaagatattttcaacaaaaattgaaactttttaatattttatgtgtattttggggtatttttaacaattggaattgtacaatttccaaaaatcatttaagttgtatacttcaaactttgaactagatatttcgccaatgaattttatattttgactttttgtcagaatacgggttaggggagcagaattggcgggattggatgtcagattcggattcttattttaattacaattcaaagaacaaatagaaaaacaaaaaaaaacgaagcagaaaaaatgtcgactagaaacagggctcggatcgaaaaattttcaaaatcagaacatcgggtccaaaaaatcagattttggggtcgaaaatcagaacattttgcaaaattgcttcaaatcagttatttttacaatttttcgatcaaaaatgtatcaaatattatatttttcgtctcccattatcgattttaacaattttggggagaaaattagcaaatcatcaattttagcgcattcggaatcaaaaaatcagactttttaaaaacgctttttttgcgtcgcattttttcaaaaaattttggaggatggacagggggtccggcggtgccgataggcgccgccggaaaattttttgcgatttttaatcgatttgttaacagatttttattaaaaaaataaccaaattttgtcataaatcttatattttattgataaaatagtgacattatgccataaaatttcaaaattgtaagtttatttaagaaatcaggacaaagttgggtcactccctccaaatcaggacaaatctgataaatcaggacagatccgagccctggcttaattttaaaatttacaattgcagatggtcatgagatctgtagagaatttcatatttacactgtataaatacaaaaggcttattgataaaaataatatttatattattatttggaatcatttttaaataaatatttaaaatcaaattaaactgacaatgaaatcgcccttttggattttaattaatttttgaacttaacaactttttgatgtcctaagtttttgaatttaaaattatttaaataaaagcaccacaaatatgtgaaattcatgctgaacattccccttgatagaccagttttattggtcagatcactttcccctccctaattgcccccgccttttttttgtctcttttgtttgtttatttgtgttgctcatttgtcagtttttcgtgtgcaaaaaggtcacacttttgcacatattttgtatggaaatatacaaaatgaatggacaaacaaacagaaaaatgttttttaatgacacattctcacagcaaacacacactttttatacgcactgtgagattaagcatttgcaaaaaagaccccgggggagaatggggggcggtgaggggaatttttcatagtcaaccaaatccaaaaaattatgatcgatcattcgataacacaaatatttctattcgtgaattaatcgttaacttttaaaaatatttaagagccattatttgttatctaatttattggattttatttaacttggatatttaaaaaattatttttgaaaattttgcattttgcttttatttttcaattttagttcaatagacttcggaatgatagaattttattttccaatctctcccttttttatttgaattatttattttttcattttaaaa

SEQ ID NO: 20121 - DNA, 2346 bp, Heterodera glycines
taacaaatgcaatcaaaacaattgatgtggaatcgacgtatagggagacatagaagtattacaacgcttctacccccaccaaatcaagtctgggctcgatcattatctgttggatatgattcatggattaacatcactgggttttggatcaacatccctgaccacttcataatagcgtcggaaggtaaaaatttgttttatgctaaaccaatgtaccatcaaaatagcctaattcacaatcaacagcattacattggaacatgcattgaaacggcaattcggatgtactcacgcgactgggaccccgtggaggaagcgaatcgtgaatggtttcgttccctccagctcggcccaccaaattccgatcgcgaaacatcatcccgtcacctgcgctagccaatgaacaaccattcaacacagaaagacgaggacgtcttgcgtcggtgattggaggacactggtaaattcggcgcagttcgtggacgtgaaaggtaggtcatttttgagaatgaatagcattaatttttgatcaatttagattaaccacacaaagatttctttcaaaattccatcacttcaataaggtaaaacggtaacaagaaaaactcaaccgaggggaggactcatctaacattcttaatttcaagataccctgcgcggcggtgatcggaggtcaactggacgatgaatgaaggagacatttcgttgaaacggacggatgattcggtggcattggcatttccattcatctcatccccttccttcaattttgtacacgtttgatttcctcatttctcttttccttttgttttgttccttctcaattgtttcttctcaatttcctttttttgtactggaattttcggctgctctttctttaatctacccctcaaaattttgggcaaccaaccctgtacagctcttccaactcggcccttcgtcttttgcaccgttccttcgcaccactctgggacggaatgaactctggttgatttcctccagcccctcaggccaagtctgttcataaattgagcagctggtgcacaggtggttggattgggaaccgaagggcgaaaccgttctcggactggcgcagcatcatcgacaaacttcgaggatcgaggacgatcctatggaaggggggagctgtaagggattggcacaccctcaaaaacaattttcaatttccctcagcagtcggactttccattctttattatcacattttctcatctcgtttatcccattcttccccgccccttttccgttcgcttcacacttttccttcccccagcgatcagttagtcagtcgtcagtcagtcgagtcgttaagcctaaccgatgagtcgttcgtcgatgtatatttcaatcaccatttatccggagagaataaattagtcttataacaccgaggctttttggggaatttcaccatcaatcctgggcccgggattccgttccccaaatcgtcctcccatttattcttcgagcggtgtgtcgactgggggacccaacacgcctccctcactttattgttctgctgatggagaataatattatacctatcgaatgatacaaaaaattaatttggttgaatttaagcaccaaaagtctaaaatttcgcaattttttcactatctttatttttttacatattttgaaatttaagaaatttctttgtgaaaagtttaaaaatttttctttgaaaatgtacccttaaaaattgttttttttcaaaaaagcgatatcaaaaattaatttttaaaactgctaaatgtaattctaagtatatttgggtcattttaatggcattttgtgcctatttcaccctttacgaagaattatttccaaaagaaaataaccatttaaaaatttttatttacatattttgtacattctgcgtttttataaatatttcgggatttttttatacatatttatgcacatattttaccactttttgtaatctttttttccagccctactgatcattcaaaattgaaagcattttggcatttatttatttaatctcgacagatcactgtgtctgctgctcggcttatggcccaatcgccagtgatccatcggatgttcagcacgggaacgcgcgagcagcaacagcagtcactcacttttgacgaattgggcgtcgacatggagcagttcaaggaatttttggaggccatcccgacaatcagtgttcagactcccacttttcccaaccgtaaaagcaaattattattattattattaatttaataataataataatttagtaatttagacagtttttataaaactctctattagaagggccatcttctattaaagtggctggctcgtttg

SEQ ID NO: 20122 - DNA, 2537 bp, Heterodera glycines
  misc_feature (2442)..(2443): n is a, c, g, or t
  misc_feature (2455)..(2455): n is a, c, g, or t
  misc_feature (2466)..(2466): n is a, c, g, or t
  misc_feature (2479)..(2479): n is a, c, g, or t
cgtttttatagttaaaaaaaattcaggcgggcaatggcatttcctatctgatggaccgcggcttttttcatcgtcggctccacgcccgcgcctgtatcgttgacagtgccggcaaaacgttgcgcatcactgacttttggacgggtacggtctcaacactcctgttttattcaaatttcatttgaacagagaatgaccccggggacattcatttgttccaaagagacgcctatttgcccaacactgtgcttccgtccgctgttatgtaccgggacggatggaggtcatcatcttttatccaattgaatattcacatttaactttggcattttgttaatagtttagatgcagcaaagcatagatgaggacagttttgaactgtctttccatcctttttgctatgtttgcattgggtggagcttatccaaccaatcattgcagtgaatgcaaacttctttgctttaacaaaggcgttaaagcaaagattccaaaagaaatcaataaagttgagctctgctgtgcagagaactgttacattcatgagaatgtaaagaagctcacttacgagctgcccaaggagatcctcctaaatgacttcaaatgcgaaggtcatttctggatggattcgaaacacatgttcaaaaaagacattttatgtccagcagttgatgagtgtgaactcatcgaatgctatttttgcattgaacagttagcgaatccaacctgttatccattgatttcatcaatgttagcagggggactttgcttatcattcataagcataagctttgtggctttttccatattaaaagtcctgttttcaggactttatatggtcatttggctgataattcaatttatcaggccaataatttatttagctggcccaaatcggcctccgaaagataggaggccaagggcaacagcttctcaaaattggacatcacgccgtgtttacagaacaatggcgtttgttgtccttatggttaactctctccagaatttgactggagcagagaccatagcagttatggccaaatcggaaaaatgcattaaaaatgcgacaagcatgagatgcattgtcgaaaactcggcaacacttacgttgctgccagctggccaaacaaacactcttcttctgaaaacagaggaaggtgttctccttggctcaataaatgttgtgcttaaggctttagctttggaatgccaaagctttactaaagcctggctgcgttcatatgcaattaatgtgtggccggcaaaaggtgccctaaaatgggctcctgcgaaggaaagtattgtggagaagttcgccacaatacttcaattcctgagctaaaagatgccaacgattatcctggcaattcattttgcctggacagcacagccttttggggcaacaaatgcctcttaggcggcagtgcctgcctattttatcgttggtttgctcgagaaaaatccaagacactctatgaaatcatgggctgtaattcctgggaatttattgtctatacaataattcgcctagaaacttttgttgaaaaacccaagtcaactcaggtgttttttatccaggaagaaccctgagatggaacaacatcagccttactccgatcggagtaacttttccgcccgcccccgtcttaaactcagattttgtttttgacgggagcaacatggctctaaccagagagccattaacaattgactttaactgtaaaagtcggcaagaagcaattgatttcaattgcagtcttggtgttcaggcatgcaccgattgcatacctgaccattcatcaggtttagtgaactgcaattgacgttcacataaccttgaaaaattaatggaaagtccagagaggagacttccattaaacatcaaaaattaccaactcagaaatactgggagaaaggtaattgccttgacaggatttagtcctgtccaattaaaccttcaaatagaaggtttccaaatggctttggaacttcaccaaagcctttgcacaattttgccgttgaacatatctgggtgttacagatgttcaacgggagcacaattccgttatgtgtgctcaacaaattttggcaattctcttgccgaaattaaatgcgatgatggaacacatttttcgacaaaatgtgattccaacgcatcaatttaccagacaattttggcttttgataaagccagaattgacacaaaatgccaaacaaaatgtttggctgaaaatacttcttttgttctaaaagggacattacactatgtccagcccgaacaaatagaagattacagtccaaatcactccgaaagagtgataaacagccaatccagttggccgaactggaattttggattggaaggcgaccctttggttctttgattggcatccaatcatcagttgccttcataatgattatttgtgtagggcattgtttgcctannaattttcattanactttctcctntctatagactttnggaattaaatttcctggtcttaaccgaaaaaggtttaatggtaatgtgcctacagtat

SEQ ID NO: 20123 - DNA, 1401 bp, Heterodera glycines
ctgcaccgaaggtactcactcggcctcttcgcggcctcgtggtgggccttcgccccccccccccctcccacgcccttcagagcacgacaaatatttcaacaaaaattttgaaaaattgactagagcaatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaaatttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacagacaatagggaagctactcccgaaggattcggtctccccataaatctgggcgcatcggttcggggggactgccccgaaaacccaaaaaaaatcgattttttcaagtgtccgtttggggtactaaagcaattatggggagcaaaaatccaacgcagaattaaag

SEQ ID NO: 20124 - DNA, 2159 bp, Heterodera glycines
ttttaaatgggatgccatggaggtgttcggcagccataaatgccggaaggggtaattcgtcccaaaaagctcccggaatgcggtcccaacactgacggtatccggattccggacaatccgtcagtggatgatatctttcggaagacaattctatcagtgacggacaattcatcagtgaaggacaattcgtcagtagactgacgttccgtcaaaggacatttcgtcagagaattaaaaaaaaatttgttgacggattgtccactgacagattgtccataaccgacggcggattgtcttacaacagattatcctgcattcccactggcgcacatccagtagcaactttttccaaaaggcccaccgcttactgtatgccaactagctacagtatattattgttacaaaaacccatcccaagctacagtacccttcccctgctgccgccgccgtcctccattttcgttgttgctgttgttggtgttgttgtgctttcctttttgtgccgcatgaagtcgatcattctgtcctgcaaaatgtccggctcggaagcagcttcatcttcctcatttcgtgactctgtcgaaatggagcgaccaccgccgccgccagcagtgatccatcgctcttaaaaatgcattatcccattttaaaatatttcttttatctccgaatgccgtgccagatcgtttcataaatccgccaattttagcaaatttttcgacaaaacatggcataactttgcttaaagtcaatcaaattttaattcttggtaccattcgatagcccagctttttctctattagcttggaaaatttcaaaaaagttaccaaatttaacataagttatggcagaaatagtacttattttcatacaactttttctaaagttgatcaatttttatttttattttgcgggctaatagagaaaaagctcggctatcgaatgataccaagaatataaaattttattgcatttaagcaaagttatcccatgtttgtcgaaaaattcgatataattggcggatttatgaaagaattggcacctctgaatgctaagactttgcaccactgtttttgaaaagggctgctgctggccagccgcgcattgaggcccagaaaattaggcatggaaaatttgagactcgacaagactcggaccgagattgacctccgaaaattcgagactataaacgggaagggatcgggatcccattaggatttcccgagacgccgatccgttttttttattggaaaacgggaggatcgagatcccgacaaaactgggactcgaatttcggtgtcgggactcaaatcccggcaaaactagttgagggccaagtaaggaaggacaaagcagaaaatctgtgccacaccgttcggtccccatggatatttaggcaaacggcaaaaaatattaaatcggcaattcggatcggcggaacttgaaccctggcaccgtgccaagaaattcttacataaaatcctccaatttaaaacctcgcaccttcggcccaatggcattatgccaaaaaatccaatttcaaccctctctcgtgtccatgtaaaattgtccaattctctaagccagagattcggtggggaaggttcttagttctggcctggtcaatgccagggctcccagatgtgaggctttagcctcattttgtggttttttgataggtcaatgaggctaaattttcaaaatgaggctttgaggcgttttgtggtttttgagaaattttgaggctttttgtggttttttgagaaattttgaagatttttggggaaaattcgtcagattttttaaattttgattaattttgataaaatggcataatgtttttggccatatttgtcgacaaatctgttaacaaatcgcattgaaaattacaaaatttttcccggcggcgcctatctgcaccgccggcccccattattccccaaaagttttttgaaaaaagcgccgcaaaaaaatcaacttcggtttttcatgcttagaatttcacaaaatgtttatttcgaacaaaaaattgctcaaattgatcatggcacatcaaaaatataaaatttgaacattttaggcgtgtttagataccttttataaaaatgaggcttttttgcctgccaatgaggcttttgaaattttgatctgggagccct

SEQ ID NO: 20125 - DNA, 2562 bp, Heterodera glycines
  misc_feature (2507)..(2507): n is a, c, g, or t
tcccagaaaaatggctatctctttttttgataaatttatacacatacaaatgctctcgagcatgatagggagggcggtgcgcaatagaccttttatttttgagggattttaaaatttatactcaatcccagaaaaatgtctatctctttttttgagaaattttatacctcacaaaagcgcttgcgtagagacggagggctgtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatgctctatcccagaaaaatggctatctctttttttgataaattttatacacatacaaatgctctcgagcatgatagggagggcggtgcgcaatagaccttttatttttgagggaatttttaaatttatactcaatcccagaaaaatgtctatctctttttttgagaaattttatacctcacaaaagcgcttgcgtagagacggagggctgtgcacaatcgccattttatttcacagaggcgccgggggaaaaattgagaattttgaccatatttttagcagattttattaattctttatttttggtttttcggaaaaaattggttctattttcattttaatgctctattacaaacccaaattattaaataattgtaaaacattatgccaatttatcaaaatttaaaaagattctgaggattttccccaaaagcctcaaaaatcctcaaaatttctcaaaaagccacaaaaatcctcaaatcctcatattccaaaaaaatcctcattgacctatcaaaaagccacaaaatgaggataaatcctcagatctgggagccctggatatcatagtgattcaaatatgtttcacattgcaaaactttatcttctcaatattttactcagatccccattcttaccggtgcatatttttttgcctatgccgcgggttgagaaaaatttcgggtcgggcactcaaaaaatttcgggttcgggttgagaaaaacctcgggtttcgggttcgggttggcatcactgccgcctacctacttgcaaaattaaagaaacttttttttggattttattgaaaaaattagagtgccacgggaccgggaattttgggcaaacccgggaccgggacctttttgggttgaaaacccgggaatttttggctgggaaaaccgggaccttggtactcagttgtccgctaccaggtcccggtcccgtggcactctagaaaaaatacatacataggtatgtaaaatgaatgtagaaaaactttgttaactgataatatttgtttttacagttttttccacttttctgcaatacaataaacaacaaatgcaagcagtgacgcgtccacccattgttttggagcgtggagtttccgggcgtgtaaaatggttcgatttcagtaaaggtttttcacattttctcgcacgttgattcaccagaacggttatgtttcttgtccaggttatgggttcatcacgcgggatgacggaggtcaagatgtgtttctgcacgcatcatccatcgttcgcaaagtcaatatgtacttcgtgctgattgagggccagcgggtgagtcggactgattttgagctgaccgagggattgggacacggagaatcaggggagtacaacgatcctcgaattcaggtagaattcgacgtcatcgatggtgagaagggcagggaagcggccgctgtgtcggggcccggcggaattcgcgtgggcaccgccatccaatacaacaacactgcgcgcagtcagccgttgccggtcaatgccaacaattccgccggacggatgttcatcgccggcagatttcggcgccccgttggcaaggttttgttcggtgttaaaatgcgcttttttggtcccctcacttttacaccaaacaaatcatttttcgggctatcaaaatggacttctaatggactcgtatgtccgtacaaatgtgtcctgccttcggctgattccccgccaaatttgttttccccatcagccgaacaacaaagccaagtcggccgtcgcttcggtccccgcggtggtcaatggcggcgacgacagtgcaaagtgtccgccgctctctctgtccagcgtcactcgcaaaggccgtcgcatgttcaaagcgaatgatggcgaaaagggcaaaaacagcgacaaaaaggaaagtgccagtgacggcgttggcagagaaaaggacaacggaggacgggagggcgaaaacgacggaaatcgtggggaaaaggagggggacgaacggggcacagaagagtggcagcagcgaggcgtgaacgacgacgacgacaaatgatttacgattgttttattcgaccccgagacattgacaatttccatccgtccacatattgttgatacaaatattccaataaatcaaacgaagacgcngtggactaataagatcagaacctttcataatatttcttttattaaaagtgcaaat

SEQ ID NO: 20126 - DNA, 699 bp, Heterodera glycines
  misc_feature (21)..(21): n is a, c, g, or t
cttcgttcaacggaccttccnggggaacatcagcaccctttcagtgagcatgtaaaccatcgaagtccaatcgacggcggaataagaaacaccgtaataggcggagataatgtgggcgatgatactgcagcggttggagaaagggttgtaggacaaaacgcatgtgcgattgttggttgggtctcacctgtattcgatccattgcatggcatttgaggctgaaagcatgacgaacctgtccaaggcatgccaatcactcattttgctccccccccccaaatgcgctcacatccccaaaatggcgtatctcttcgcgtacatccgcgtccgcccttccccgctttgctccgtctgctgctctccgcctcctccgtcttctgtccgcgttgtgccgctgttcccattgtgttgctgtgcctttgtttgatttgcgtccgttagtctccgttttgcgtccgtttccacgtcactgtcttcgtccgcggaaaaggccattccgttgggaaattgagctgaaaaggggaaaatgctgcagaacgaatgtgcaataggattatttgcaaaggttcgtcttttaaatgggtaaaaatgaaattgaaaatagcaaaggatgagtggtcggtcggaggaaaattgaaaagaccaaaaatacacaaaaagcaccgaatctgaacggaaattggcaaaaatggggggggg

SEQ ID NO: 20127 - DNA, 1375 bp, Heterodera glycines
cgtatgaggcgattaagttgttaatgggtcgagttggccagcttcaagcggatcataaagtcattttggagaaaagtggtggaaaagcgatgaaaaggactgacattagacgaaaatctcaaaataaaggcaattaaaaaataaatattcaataaaaagtggggttaaaatccaaatatatttctgttgttaaactatcaaagacgtggctttttgggaacaaacaatgcttttgaatggggggggggtgactgatcagcagaaatctaatggaaaatcaatctgaacgttgtcatattttgtaattaattccccacgccaaaattggaattaatttttgggaaatttcccagcccattgtttatcatctcccattcctccttttataaattcataaataatcaatccacaataattaataatcttttttaaaactcataaataattgacaaatttttctgatatttaccaatgcttcttggaatagaaaagccgggactgggacctgctggattttcaaccgggatcaatcgggaattttcaaggaaaaaagatttttattaattatttttttatgaaaaccaatttcttttgtttttaattcatgaagccaaaagttaaaacaatttttaaatttagtatcaaatttaaatttaaattattttcaaataattcattttttcaatggtttcggttgtttaaataaaaaagaagaaatttattattatttaaattgtttaataaatttcctattctattaggggatagaatacaagcaaaaaagaagaagaagaagcacaaaagacttaaccactaacaacaataagataaattatagtgcttattttcccggttggtccggcaaatgaacttttcgaaaaccgggaccctgggagaacaaagaattccctcccgactcggtcccgagtaaatcgttttaaattgagcaaaaatcatatgttatttgaacaaaacaaaagtaacaatggaatgaacgaaacgcaggcgaaatataaaggaaatcaaagagaaacaattaattaatttattatggaaaaagaaaacccaaattttgtgagccaaaacaaacattctgttggcatttgcactgggagaaaaaaggataaagacaaaaagggataataaacgatcaaaatgaatcgaatcacagcttaatcaacaacagatggaaaagggaaggaccaaatgaagagaagcagcggagaattttaaaaaatgaacataaaatataaatgtcccgagtagggttcggaccccgcccccgctgggggcgggacaggttttttggccgcacccccgtccccgcgactctgaccaccgcaatccccgcgaccttcgcccccgcgggggcacg

SEQ ID NO: 20128 - DNA, 1628 bp, Heterodera glycines
  misc_feature (1605)..(1605): n is a, c, g, or t
ttttagattgctctttttgtggcgcggttttccaaaaaactttttggaaacattgtgggaggaggtccggccgtgccgatacgctgccggaaaaaatttggaattttgagtgcgatttattaacaaattttgtcaaaaaaatgattttgactgaggatttttcgaaaaaatgtttaagatttgaagaaaaagttcgaacattttgccaaatatacctaatttttaaaaaaatcatgagtttttgtcacttttttaacaaaagaccacaaaaatcctcaaatttctcaaaaggtcacaaaaatacgcaaatcctcatttttcaaaaaaatcctctttgaccctctaaaagaccacaaaatgagtaaaaatactcagatatcgcagctctggtttaataccaagaaacaggcattgaccgagtaagaaaaaagctatggcctaagaaactgggtatggtcattcatgggacgcatacctaatctgccacgggacgcatgaaaccgactaaaaccaaataggcattataaaagtcatcctagacaccccaaaccaagcggaaaatgcttttttcgtgtttatctgtgcgtattaagtgcgcaaaaatttatgcatttgcctaaaaatggaagccctagttatcattaagctttttaaatattttaccagaaaataacaaatttatgtatgagttcgccccatatccaaaaattatataaaaatatctggcaattcaattttaggttcataaacacaccgagtcaaaaaacgagacatgtgtcaataaagagagagtgcagagaaaaaaacatctctctttttggcgtactatttctttatctctgttaatagagaaaaactgaatttacttcatcctgtttaactttttttctgcttgttaaatccgcttcaaattttgcatgtcgatagagaaaaaattctgcatcgaataatatagaagatttttgcaaaaataaggctcattaaaaagttataagaaaaacaaaattttaaagcctcataacttttctcttgtacaccaaatcgcttagcatttgcttagaaaaagcttctccccatcaagggctttcgaatgataccaagattgtccaatttggttggcaaaaaccttcaaaaataattcccaaatatcgtcattttttaatattttggacaaaaataaataaaaatattcatgttgcacaacggactcgaaccaccaccctttgtccctttactatcttacaaaaaccacttcgccacacatgcaaacctttttggaactgagagccaaaattgaaacggtgtgtaaattgtgcgcagttctcaatttcattgtatataaatccactccttcctcaattacatattgcatttttgtgttttgatgtatcgctcaactgcgaataaatctgagctctattgcacgttttttgggaaggttcgattggtccaactgatcctcgtttttgtcattgctctgttttgctcaaatatttgcttgcttcgtcctccctcacctttggctttctctccgtcttctcaaaatgccttctgtttcttttgtggatgtccccgttaattcgccgtttacctttgagaatctcnccgttcgcgtcttctcaacaaat

SEQ ID NO: 20129 - DNA, 1823 bp, Heterodera glycines
agcagttgatacaaaaggcgaagagaacggtcaagccgattactataatagtcgacaaaaatctaaaattcagatttatgagaaaaccacgcaattgggaaacgccgctaagtccacagtgaataaaccaaaagtttattcaaacaaataaaaagggacaggtcgaacaataaattaaatattgattggaagtggggtcacagaggaaaaaggagaaaaatgacaaagtgaacagaagtgagcgaaggagggaagaggaggggtatttaccgtcaaatgaatacaaacaattataaaagagaattggtagagacgggaaaacgatacggtatcatagcggaatacaaaatcaagggattaattgacttcaatttttgttcgttttcgtcagtgtatgctgaagtgccaggacccgaagaagtggatgaagaagcggcagaacaaacgttttggccacgcgcagtcgcctcttttcgctgccactgtcgctgttcagtccccccaaatcggccgactgttccctttcctgctgctgctggccgagttggacactttcagtcgacatttttgcctaaaacaaatattgggggttgacgatttattttctccttttaagcgcatttcctactcaaaatgaattatttgcctttttagacaattcggggctggcactccctccgtcgcatcatcctatgcgaacggttgtgctccgccagagtctttcggcagggaaagaagcagttgatacaaaaggcgaagagaacggacaagccgattactataatagtcgacaaaaatctaaaattcagatttttgcgaaaaccacgcaattgggaaacgccgctaagtccacagtgaataaaccaaaagtttattcaaacaaataaaaagggacagggcgaacaataaattaaatattgattggaagtggggtcacagaggaaaaaggagaaaaatgacaaagtgaacagaagtgagcgaaggagggaagaggaggggtatttatgcaaaaatatatgaggggtcaacagtgaatgtgtggagcactatgggtcacggtaggggtcaactgcgtctggccaactgcgtctgagccaactgcgtctggccaactgcgtctgagccaactgcgtcttggggccaactgcgtctgagccaactgcgtctcagttaaaaaatcaaataacaaagacattagaaaattctaatcaattttgaaccggaaattaatgaaatacatgcattattcttagcaacgtttttgttttaagctggtgaagcgggtccgccatgaaattgaactgccaccgccagtgccgttaacgcttcaagaattggaacttcctgaacagtggcagcccttgaagatcatctgtagggcttcgatttttaggtgctaaaaactgccaaaataagtaggttttaggttctaaaaaacccccaaaataggtgctaaaaatgggaaaataggtgccaaaaagttccgaatttggggtgtaaaatcgaaaattttcttcaaaaagcaaaaatattatgccaaatcattaatgagatagataattttcaaaataaaaaattctcgccaagaaaataaacaaataaattttggagatgatttttgagaaatttttcttttttcataggtatatttttgaaaattttcgagtcgattcttaggggtatattttttgaaaaaaattttcggtcgattcttaggggtctgtttttcctttttattgcatttttgttaacaaattttgggcaaaatgccaaaataggtgaaaataagtttttttaaattttttttaggttttttaggtgct

SEQ ID NO: 20130 - DNA, 978 bp, Heterodera glycines
tatattttaggaaatacggtaatggcaaaatgcggcgctttgttttgctctgctttaagcggcgctgtgtttgttctcttttctttcattccatcatcataatctgacatttttgggtgagcagcagcagaagtcgtcggaaaatgggaacaaaacctttctgtctgctccgccttttttgctcttccctcacacgttctctcccccgttctctctatcttttacaggtcagtcaagtctcgacacctgctgctcctgctcagatcgctactgatcaggcaggagacgtcactgatctgatcacacgcatacacattcttagcctatttatcgcatttaaaatgaccaccattttcacacaattttcgccctctaaattacggtacaaattttaccgattgaacaacaaaatcagtttccaaaatccccaatcacaaaatccagacagagagagatgtgctctctcgagaatttgttttccatctgctgaattcaattaattttcaaattaccccgagtcggagactgaaaattttcacaatttcctcgatttaaaatttgtaaaattcggttgaatttccgagcccctcttttcccgagactctcgactattaataatgattgactgagaaacacttatgggtcgttagatatatttacttgctccccaattagcatttattgagcaaaaaaaatgtcttctgaaaaattggtattcattcaatgctacattgtcgagactccaacaaaacaaaaacattggcattttctgcagggcattctcgagtcagggtccagtgaaaattgaagatcctaatcatttgagacctcctttcaatctcgttctccacccataaacggaacgcatccccccccccccccttcccatacaaatttgtggcattttgctcggcttgttgattggtcgcaattgccaccaatttcggcaccacagcacaattgtgctccttctctccc

SEQ ID NO: 20131 - DNA, 1208 bp, Heterodera glycines
  misc_feature (124)..(124): n is a, c, g, or t
gaatttttttaaaattatttcaaaaaataaaaattttggccatttgtttgcctctaaggcgtgtgaactgttcaattgaaatatttaggaatttgactgagtccagcagctccttttttgcgcncatccaaactgtctgagtgcaatttatttaaataattattttataaagaatatttatttatatttaaataataaatttaaatataaatcattttggtgctgattattattacttcactgataataccggtcattaacctgttgcgcaattagctcacggtttaacattgccacgcgcgtgtaaagccgccgggattcggcacttaacaaaatttgataatcatgccagattatttcgaaaaataataatttctttcttttgaacataaaatttcaatttaatatgcaattcactgttatgaatagagagagccgtgggttaagttttacgtattttgatccctaaaaatccctaataaaaaatgttatatgccttttttcatgccgttttcgggattttcaagccttttttcaatttttggtgcctattatagtgcttttttcgtgtttttggtgccttttttgcggtctcaagttatgaatttagcaaaaatatttaatttataaataatttaatacgaatttaatttaaattttgtccctacaaatttcgaatggccaatgcgtcttcggcacgtatcacacactcacggaccacatttaatcgttcggcaaaatcacttgctaaaagaaacaaaaaacaagtaaacaatgaaaattatggcactttaatcaaacaattatttcaaatttatttactttttttaataaaattgggtttccacttcgtttaattgtttaataattttttaagacttttatttttttggcttttcccacccaatctttcattgacttcatatcggctgtccatctgttaaaattgcataataattaatatttaaattaatgtttaatttaaataattttacattttccaccacattttgggcagcgcccaaaatttgatggaaatgcgcgcgactcgacagctcacgaaccccccaaaaagcacaaagcgactgaaaatgcttttgccaattaatttaaaaattacgatttttattttattaattaaacaatttttatttaaaaaatttacttggagaatatccgctgaattttggatgtcattatggcgtaat

SEQ ID NO: 20132 - DNA, 2262 bp, Heterodera glycines
  misc_feature (74)..(74): n is a, c, g, or t
cacgacagagacgggggcggatggtcgccttttgattaatgcgggaaagcccgactcggacccggaagtcttgntggcagaacatctcacaaatgttcttcagcctcatcaaattggcggtgtcaagtttatgtaaggggttgagagaaaaggcacagaactatgtggcatttaaagcgagtcagcttttgctttcttaaccaataccaaggtttaccaaaaaatcgttactcgattcggcacttttgctgtttagggccccgaaaaaagttcaaaggagcgacccttttgtagagatttggaattggttgaaatagcggtacttatcccttttgtgacaccctctaaatttttttctacgataattataggctctgaaaaggaatctgatgcatgcattttacgtgagaacatgaaaatgcgtgttaatttaaaataaatttcttgttcgttttcagcgcaaaaaattaccctaaaaaattaaaaaaaaaacttttgaaagggattcttgtttttatttttgttcttagaagcaaaggcttttctgaaattggctctcgttaaggtacgacaacatcatcgaatcgcttgaaacgttccacaagtctgcagggttcggatgcattttggcccatagtatgggtcttggcaaatcaatccaagcgatcacttttctcgaaattttgtttgttgaaggacctaaaccttcgatatatttttttttgttttagcattcgaattaccggcaaaaggcacgtgttgcttatttgtccagtgaacgttctgcaaaattggcacaacgaattcaaccgatggatgccagaaactgacgcggagacggcgcggcccattcggcactttgaactgtttgtcattggtgactcagtgaaaacattggaaaacagagcgcaaatgatcggtgcgtaggaaaataaataacattcattttaaaattatttattcagagaattggtatcagtcggggggcgtccttctgctgggctatgaaatgtttcgtcttctcgtccaccaatgtgaacttttgggcgaaaagagtgcgcaacggaaaaaggcatccaaaaagcaaccgttgcggacgatgtacgatttggcggacgatttggccaaaaccaacgagcaggaaaaggcacaaatgacgcagaaggacgaattgcagaggaacatccgccaggctttgttaagcccgggccccgacttggtcatttgcgacgagggacaccgtatcaaaaacctgaacactgaagtgtcatgtgcactctccgcaatcaacacaaagtaccaggaaagggcatttttgaggaatttagaccaaacacaaaaggcgccgcattgtgctgacgggctacccaatccaaaacaatctgacggaatacttttgcatggtcgaattcgtccgtccctcctatttgggaagcaaaaaggactttcaactgatgttcgataagccaattcgtaacggaagctgcacagactcggccaagtcggacgtcaaattggccaagcagcgcatccacgtgctctgtgacatgctcaggggatttgtgcagcggtactttaaggaacgaacatttagtcaattttgttgaataatttgtcaaggcgttctcaacatttgctcaagaaaattttgcccgaaaaccgcgaattcgttgtccttttgcgcaagtccgaactccaacattcgctttacagagcttttcaccactttgcaagtgaacaaatcagtgttggcgaaagttcattcaacccattgaaagcattcgcaatttgtttgaaggtattgctgatgcttttatattttctgtttcttaatttagattgccaatcatccggacatgctttatgccgccttgaaaaagcaccagataaagtgccaaaatcgtacgattggttgtgattcaaataaaacgggtccatgccatgcatcgacttctgtccaattgtcgtccgaccatttcccttcggtaacttcttgaaaaatcatttatcattctaacattaagccttaattcaacaggcgcctattcatcgacagtctaaaaacccttcccctccaattggcgatgttcaccaatcttttgtcaagggctatgcgtcatcctctctgaatggaccaaactttagctcttctgtcgactattggcagccaaattcggaccagtatttccccactcatccgacgccaatccatcagtcgcaacatcgtcctacggatcagcagtctctttattttccccagca

SEQ ID NO: 20133 - DNA, 2129 bp, Heterodera glycines
  misc_feature (2121)..(2121): n is a, c, g, or t
ggcccctttcttcatagcatatgcgcagaaaaaatacctcctagcatataatttatagccctagttataaatattgagcaacctaaacatcattttcaatttactaaataaataaatatggacaaacaatgaaaaatcaacgattgcaaaaatcattgctttttaaaatcacttaacaaatttctgacggcaaattcggcaattttattattgagtttgggtttgaaaagatgagaaaataatttttttcccaattcccgaatagaaaaaaatcgttaattttttccaaaaatccacaaaaactaacaaattttcacgagatccgttacaaaaaaaacaaaattttttccgcgcaaatctttaattcaaattctttaaattttttaaattttccaggtccgtctctttcatacgcccaaattgtgcggcctcctcaaaagtgcgttgcccgaacggaccaacgaaattcttggcctacagcacatgaaagaggaatggctatcactaacctaaggactgaaggtggtgatcacaatcagttcctttggaatgtacattgttttcctttttcggcattttccagtgcttcatctcgtgccaatttcagtctgatgatgatgactttatcatgccgttcggttttaccaatcaattgactggggagcgattggcgtttaaaagtgccaacattttggtgcgactgggatacaattgacattgcattaatcatgaagaaattggaggcgggtcagtaaattgagaacaaaataaattaaattataattcccatttttgcttttagtcttatcgaggcacttccgacccaagtgatcagtgtgaatgtaactggccagaattcggtaattttcacaaaaatgtaaaatgaaaaaaatgtgtgattttgaaggcgagttcgcgggtgtcaatgtgcgactcgaacatgcttatggcctgcgcatcgaaggccgattcgcgcggatgaccagggtaaaagtatccgctcactttagcaataaattttttatgaaaaattcaagaagttcagcgattttttttaaatttttgaaaggactaccctgtcgcgtgtatgtacctcccccaccaaaacacccctaacccgccgatattttgagaggaaaaggatctttgtcagaaaaaatgtacaattaatcgtgcataacgaattcagagtatatttagaaaatttataaaaagcaaaatatttcaaatttctgtttttcatgaatttttcaagcaataattttcgatgaacaatcttattactcattaaaagtttagataattttttgacctgttatttaaaagtctgttgtctgaaagtttttcttctcagcggtcttcatgactgccttccatcttgtgtgcgattacgccgaagctgaacttggaccggcggaacaaaaattcatgcgaacttaccgctttcgcatttcgataccaccaaaagatgaaaagaagtggggtactagcctcgcttctgccgcctacatcggcatggttgcgttgttgacaggcagagcagtgcgcgccgattggtgtgtcaccggcgcactggatagcgatgaagagtaaatgaagtcgctggaatcccgcaaaaagtggcggcggcaaattttaaacttaagacatacataagaattgaacgggaaatccaagatggatatgttgatgcatgcgataatttaaaacaaaaatagatgaaatgataaactaatgtattgttatttagaataaacttgctttcaatttctgaaattttttgttttaaaagtattgcgagaataatttttaaaggaaaatctaggaatggtatttaaacataaaattattagaaatcaataatatttaattttttatctaattattatatttaattgaatataaatttactttattgtaaaagactatttttgaaaaaatttataacaaaatgataatgaacaaattaatttttgttttttcaaaataatattgtatatcattttaaatatgataatatttgtccgcttaaagaacggaaactaatcaatataaatttagaaaataaataaaataaatttaattaaaaaaagtataaccgaaaacttttgcttttccgancgtttcaa

SEQ ID NO: 20134 - DNA, 2094 bp, Heterodera glycines
atcgagaaatgaaagacggatggcttcgcaacgaatggctcccttcacttggtcttggcaaataccgcaccgagttcatggagtgtctggtgaggtcgctttgtgtgggatttagaagcccaattctaccccgactatgtaaaaattaaggaacccaaatccccccggggacgacatctttttcaatcgtttttttgttgttgttttttactatcaatttttccgtttcaaggttgatgcgcgaatgttggaacatttgagcaaaggagatctcggcgaaatgaaaatgatcgacagtttttaccggtgggaaaataatttgctaatgaaatttgcattcccggttattcattttctgtttggcttaatgtgtttgctctttcaaggacaagcttacactacggcattgtgtgcctgaagaaattgaattatgatcggaagcaattggaagaacggcgaaacgcatcggaaaacgtcaacagaggtgaaaaagagggaattcaatgaaatgcaattaataattggcgatttgcaagcctcgacgcatcctttgatgtgcccgctttggcacacattttacaaattccggacagtgacagcgcacgacggacattggaggcggagttccagaaactggtggccaattaccgtggcagaggcgagacgggagatgaaaacggcaaaggaggaagcggagagaagcagccgcaacagaagaagacgtgatctcacaaatgatctccatgctgtaattaaacttacccaattgatgactcaaatattatttgatgtttaaaatgtacaaaacataaatatattcaccacttcaacacgtcatttattagatttttggaccaggatttccaaggtttaggttcaacaggaataaagttgatacgctaacatttgttattaaaaaaattttccggctattcttttatttggcttattgtgtttgctctttcaagaaggagaaatttatactacgacattgtgagtctgatgaaattgaattatggacggaagcatttggaaagaaccggtttgaccctttttaagggttagtaggagtacccgccccattttgttcattttcagataataaaataggtaatttagggatgcgtttttcacgtaaaaacttaatcaaaaaacttaattttgcttatattttaattgttttaaagttttttcggtaaatattggtcatatggcactgaggccaaaatggccgaaatatttgatagtcctcggtctgtaattgaagaatccgaaaaaatatttttgcggcaaccaatccctgacgaagtgggtcagttccgtctcgccagttccgtctggagccggttccgtctggcagttccgtctttgtactcaaagggccggttccgtctcaaaaattttggacccaattaaatttaatttttatggccgccaattttatgtaaatacatattttttcctggcttctccttgctctaaatagcaggaaaaacactttcttttttgtgtttgcgaacaaaagttgggacctttatttacatatttttacatattttggggtttttataattaattaccagggattctttttttatgtaagaaaaatcgtgaaatatgtaaataaaatatgtataaaaaaatgctaaaatatgtataaaatatgtacaaaaaccccaaaatatgtactaaaatatgtaaataaaattttttaaatggttattttttaggaaaaattcctcgtaaagagtgaaataagcacaaaaagctataaaatgacctaaataggcttagaagcatcttttactatttaaaaatcaagttttgctatatctttttttaaaataattttttggagcattttcaaaaatttttaaatctttcatatgaaatttctataattctcaaaaatcctaaaaatgtgtaaaaaatgaaaatatgtacatgtgtaattttgggttttttgggggcatgttctgaaaatttccttaaaaaatcctcaaaaattgcaaaatatgtacgaaaaaatgcgaaaaagtccagaatatgtataaaaatatgtacatatgtaataagtagaaaaaccccaaaata

SEQ ID NO: 20135 - DNA, 900 bp, Heterodera glycines
atgatgggccaaatttaaatgctggccaagcgttggccaaatggttgcacactccgcgcactgatccgaagcgattgcattatttcgaggatttgaacggacaatcaaatttcgattgggtcaacagtttcaaagaggtggccacattattttaaaataataaaatttttgagtttttctaaggttaaatttttgaaaatttcctatccatatgacccgcggcatttgccttttgatttgcttaggcttttctcagtgccaccaccaccaattctccagtcaattactgtatttgttttgaaatgccaaattcaacgccaactgtgccatttgaattggtgaatgaacggacccaagaaaagctgacattgttgaaagaaagcgatgcttttgctaatgattggctgttgaagcgatgcccaattgttggggaaacggcggcggaggtcaaatggaaggacgaatatttcttctccgcacgtgtcgacatttcacttagtgttgacaaccattgcattgggtaagtaacaaagtttttgaataaacgctattttgattttatgggaaatatttttttttcaaatttaaaaacccggccaaaaatttatttactaaagcccgatgggaggagtggaattcccgcgggagttttgcgagagtcccaatgccgtacttttttggttttatcaagatctaagtcaacaaatggcattttcttttgtaaaaattgtacttaataatttaggccattgtttccaccggcgggtcaaacgtgaaattcatcggaagtgaattgattaattgagtaatgacagcaaatcattttgaatcactaaatgatggatgggaattgatttgatgctctctcttttttctgagtcaatgaaatttttattttcc

SEQ ID NO: 20136 - DNA, 1148 bp, Heterodera glycines
aggaggagtcgaacttgaagttcctttttgtggtgactgagcttgtagaccatttggctaaatggtctacgctcagtcacaaacatgggtctcgagcccgcttgtctgattttttttatgatacttgatgaaaaatcataggcaaaaacactgatggaaagcgcgactccaaattattaggcactagaaaatatggcaccaaattaatcatttgaagttgtaatcaaattattgaatataagttgaagcaatttttattaaaaccaaatcgttagttggatttgaattgaaaggcaagaaaaatttgtcaaatttggaaaattttctataaataaaaagggacactggtgctcaacaatccccaaaaacataaaagacataaatgcataactaagaacacaaattgatctttcgccaaatgtaaattatggcaaattcacaaattattttccgcctcattttggggacaaatacggattatgacaaattgggtacaaatacagattaatttgaaattcattaattattgccacccatttttgggggcaaatacaaaaaatcttttttgttgttttacgtttctttgtccgcgttaacgtcgagcatgtccacagaaaggtcatacgggcggagccgaacagctccgacatggtcacttccttgtcactctgaattttgcggataattaacggattaattgcaaattcattaattattttgcgccccattctggggaaaaatacggattaatggcaaattcatcaaatttagaccaattttggggacaaatacggattatgacaaatccaataaaatatttgccgcccctttaatatggaaattactttgtttctattattttttaaaattattcatagtttttaaatttaaaaagttccaaacttaatttatcattttcatgacttcctgcatatttaataaagttttcgtaatttttctgcattttttacaattttttttttaattttaattaaattttagggtaaaattatttttttttaataaaattattaatggaaccacccgttcaaaaaaatacaaattttctttttccgccgacgaccagcagcagaaatgcctaattctaagtgttcggttagccatgcaaataaataaaacctaataaa

SEQ ID NO: 20137 - DNA, 3643 bp, Heterodera glycines
  misc_feature (935)..(935): n is a, c, g, or t
tcaaaattggcggttggatgagcgccaacttggtgtgggacacggtacgcaataaattggcccgacggggggaacgtttgttttttaatttgtctttaaaatttcgaaattttcaatttttaacaaagaaataacacggaaacactcttctttttttaattttatcgcataattaggcacggggggcttaattttgatgcttaattaggttttttgaaaatttctcgtacacattcattaaaaataaaagaacacacttaagtaacaaccattcaaattttctcaaaaatacaccgctttgaatgtaaaatttaaaaaaaaattaaaatttgtttatcgaataaatttttatgcttatttttttatccctattttgcttttttaggcttactcatacatgaattttgatgctcaattaaataaatttattcattcattaattatactgattttttgtcgaacaagtattttaatggtggatttatcaaagaaatgacctaataatatttaaagaaataaaaaaatgacaattttttgatagcaaatttaaggaatgggaatttgaacaacgaaaaccgtccagcaaattcccacaaatttgaacaaataacaaattattggggatgacgagaatggacggcctgatgagtttaatgaattgcccgacaaccagcttttgcatgtgagtgatgtcccggctgtttaaaaattaaccaagggcgtacttgaaaatttttttacatgaattaatcactaatgttatgccaaattttaattcattaatttatcagcatactcaaaaaaaaaactttaaatcccagccaaaaaaaatattattggtttcatgtccttaaataaaggaatttgatttttggtaatgaaatcacaaaatatgaaaaaatttgattggcctgcatatctcatattcatttttnaaaaagataatatgacaaacagattggttcttaaatatacataccactcacattaaaacggcaaaagataaaatttcctctaataaaaataactaatcgaatattggattaagtttttatttgtagaataatcctcaaaaaaaatatatttaaataaataaaatttggcaaaaaaaaatgtgtcaattgttgaacgtcaaaactttgtttagctcaaacaggacatgaaaggctgcttaattggcacgagggagttgttctgcaacgaactgagggagtatcgcgtgttcgtcggattctggcaaaagcacgagtgcaacaagccagacaacgtgccattgggccagcgctgcaactttgatgcttattttaatggttcggtcttctcatgccaattgaattgcatggattgctctcgagaaaattctcgggttatttgggtgccgtggcacttattccaattgaattgcataatttccgctcgagaaaattctcgggttctttgggctcccgttttcgtatcgaagcgtcagcattcggtgccgccgagactcttgaaattttattgcttaaggaatttaacaaatcagcgcattataaaacgtcggcggaacgtttttttacatagctctttaaattgttaacgaaattagcattctttgttgtgacgatggcaattctttattatgtcaagtttacgaaatgttaaatttaatcgtctggcgccgttttgtccggcaccgctcattaattgcaaatatttccaaattaagtccaaatgggccaatcgatgacgattttttcttttaataatattgaatttttctcaatttcagaaatccatggaatttacattgcctatttctgtgagctcgatgaggaccagcagcaggacgagaatttgctctgtgacgtgtttctgccagaatttgacaatgcgccaactttggttcggcttaatgatctttagtgttcggaaaaatatggatataaaatcgcaaaatatggccataaaatatggaccaaaaatcgcgaaatatggacataaaatggcaaaaatatggacataaatttttccaaattaagcgtgtaatttctcaaaatttcttcaaatttgctatatgtaaagtaaaaccttcaaaaatggctaaatatggtattaaaaatcattttagaagaataaaagatgataaagctaaaatttactcatttttagcgaaaaatcaacccgaaaatcgaaattttgcttttttacgcttatttttgacataaatttaacaatttttaagaaaatttaaatttattcaatatcatctggaaaaattttgtgaaaaactgattttttgaaaaattttccgttttttgaggtcaaaacggccaatttatcttttgggggccgttatattagaggttttttggaaaaatgccaaaatatgggcataaaatatggacataaatgccaaaatatggataaatatggaaataaatcgcgaaatatggaaaaatatggatatggaaatacagcctagaagctccaaaccaagctaaaaatgtaacccacaacccccctcccaatttactcaaaaaccccgggactcaattaggcgaatcttcctcgtcccgctaatacatttctcttttcccaccttatctcccattcaatctccctcatccatttcacatccgttccccttattccgtttccttccgccacttacggacacttttcacgtacaaaaggcactccgatcacaccaatcggagagggagagaggaagagcacataactccataattcactcggcctctccccctccgtccctttcccccagggcttcttccccttcccctcagggcttttctcaccccaaggaattcaatcttcaatccctccagggcatttttcatcaccaatgaccaatggcactcctaaaatccaatcaatctttcccttttcaaatttcaatcaacacggcacttattttaaacaattatatttatatttattttcttattttcgttaataaataataaaactcaattcgacatttggaaataaaagggaaattaaaaagggaaattcggtaataaataaagggactttttcggacattttccctcccggcccggcacgttcccacatttctagtcattatggtgaattcagtggccacacaaagaattgcgatgctccaatttccacagtcataaaccaaactgaacctcttccctcaagatttaataaacaaacattggattaaatacaaatacaataatgaaaaaattcttatttaatattgagaaataaaacagatattattgtagcacctagtttcactgagctcttaggtcaaatttttaaagaaatatataatttattgaaatttaagctaattatgcgtttgatggtgccaattatgactttataagggaattaaatatttattaaaagcctcattttaaccactaatcaagcaatgtttaaatcaatttttaattttttttttttacatggctccaacggtgaaacacaataaatttttaatattacatttaaattttattattttttttatatatttttttcacccttttgcacttaataaaactttaatttcttttaattaagcttaaggctaatagttttgaatgaaatttatttctttagtattcctttcttcattttatatttaatttttggagtttgt

SEQ ID NO: 20138 - DNA, 2670 bp, Heterodera glycines
ggactcaaatttaagttctctaagggttaattaggaaaaattaagaacaaagaaaagacctcccagctcgcgatttgtcaacggagcaagcaaaagcaaattcaagtgaaaaattaaaatgaaaatgaaatgaaaatggaatcacaaaatatggaattagagaacgaatgtccatttgatttacattttttttcaaattctatgaagaaggggagctttatatccttttctatgttcaaatttttaattgataaacttataccaaaaaaatgtatcaatctcgactttcgacttgacagtcaagaacggaacaaaatgttctaacagaaccaaatattctaagttgcgctgtcccccattaccgtcacaaattttacccgctgcacccatacggtaaatgcgtcagtgatacaaacatcttgaaataaagctcttagctttaagtactatagtctaaaagtaaaattctataagaaaatcgttctgaatttaatgccgcttttgaatcaaaaatgttaaattctaaaattcggagtttcggctttttgttcgaattttcgtccggggttcggaatgagattgttatacgattttgaccttttctacgacaatacttaatgctacaaaattttattttaaaaatatttttatctttgacgcattttccactaacgcatttcccgggagcctctgcatctgcccgaacgagggtccttcagaaattgaattttcataaaaatttgccattttcttgataaccgaaggagggggcgagaggagtcgtcggatggttaaaaatcccccgaattttcgactcggctatttttggttaatatttcctccaccatatttttaatgggtttttttggataaatcactttcaaatcggcagaataatccaagcaatcaaaaactaagttttcctttgtgaatatttgtcatttttaaagtcttaaggcgacgcagaaaattctcaaaattttattaacttaaaaattgtctgtccacttttctttttgtttaattttgaaaataattcttttttttttaatttgaaagttctcctaaaattccttaattaaggtgtgatctgttaacaaattttctattttttgcagcattatttttcctagatttttagtggaggaggtccggcggtgccggtaggcgccgtccgggaaaattttgaaaattaaagtgcaatttcaaccagattttttaaaaaaatgagcaatttttgagaatttgaattttttaaatttaggattttagtttcgcgatcgattaattcaataaaatttctattttcttccaatccaaataataattttctctctgattacatcggtgctaggacaaaagagaattttctaaatttaacatagttataaaaaaatttcgaccataatttaatcaatgcgttagcaattggcaaattcattcaaaaccaaccataaattgaaagttgattcagcggcaggtgctccctcccaattgtcactgcccccagggtaagtaccaattttcttcacaatttcgatattttttcaaattaaatcattgtgcattttgtcatgtgtcatgtgtactcagctgcaaattaaaattgaaatttcctaataaatttgccaatgctttcattaaatatttaattcaacttccatttggaaaaaattcaagaatggctcgacttctgcttttagtttttggcttggccttcgttttcgccgttttggcttttggctctgcgcagcccccgccgcccttccaagggagcggttcgttcagagaaggtgaagccatcaatttaaatatttaatttgttatttttggcattttaaggccaattcggcgcccctccgtttggtggctctccgccgtttggtggcaattcggcggacgtttcagtctcggcgagtgattcgtcggaatgcagcggagaaggaggaaatggagtgcaaggaggtgaaacaaatgcgcatttctactctataattcattaattcaggtggggaatacggtaatggcaatggttacggtaatggcaatggttatggcaatggcggctttggcggaggcggtgccgaaggtggccaagggatggacatcgatgtggatgttcagcagtcatccgaggaggggaaacgacgccgtaaaagacatagcggattcggacaattgatcgacaaaatcaaaaactttgttggcggcaaagaatcgatggagaggggtaagccaaattagcaaaggaacaattagtgaacgattaattgacccgggattattatacaatttgcataattgtaaggttgttaagtattttttaaaacttttattttttaaacatttttcatttttttcaaaataaagtcatttttgccccttattttttaagaaaatgataaaaatgggttccgtccaaaacgcaactataaccctttgatgatgggagcaatgggagcatcgcaatatggtcaaattgatcatcaactaattgaaaaatacaaacatttgttcccaatttgcaggttcgatgtacggctcgccttatcagtcgaactcggcttatgggaataatcaacagtttggatatccgaacaatcagcaaaatcaatttgggtactctaatgaccagcaaaactcaaattatcaaatgcgctccaacagcag

SEQ ID NO: 20139 - DNA, 2416 bp, Heterodera glycines
acagctttggcttctcgacctgagaaacaattttctgtcttaagtatttattgagtaaatttatatataattttaattggatttaataaatccaaggtcccatttaccgcattggaaggactgaaaacgctgcgcatcgttgacttggagcggaacaacataaccaagcttggaacccattgggcaggacaattggaagcggaggtggatttgcggctggcacttaatcggatcgaccaattggcggagggagcatttgacgcatttcggcgctttgaaagagtcgatctgagtcataatcaggcaattaaatccaattaaaccgccaattaatgggatgaaaagtcaaatttaattgcagatcaactccatcgatgaaagggccttccgttcggtggtttccctctccgaattggacctcggctcaaacgctctcccccaaatccctcaaaatgcttttctccgcttttcccattcactgcggcgcctgaatttggagcaaaaccgattcagcgaacttccacaagcacttcagcctctgagtagccttcagcagctcaatttgaacggaaatcgaattggggcattggacgagaaagtgttggccgggtttaaggccaatttgagcgaattgtcgctggccaggaatatgctgggcaagcttatgtcatgaataataatttggcatttattatttttaagagcgcatcccatcacatgccattcaggtgcttattcatccattcattggcattttgtctcacttccccccaggggatggtctctctgcgctccttggatctgtccaacaatgccatcgactcggtcggcaaaatggcattcggctctttcgacggtctgtcgaccagcggagtttcgtcccttcagcgactttcactggccggaaaccaaattcgtgagctggtgcgcttcattactgtattatatatcgaatcccaacatttgaccacccattattaaccttttactctccaaaattcgcgaaattttccgcttgaggctttaccctaaaacagcacattaacaaaaatatcactaccatgttgcgaactttttcaaaattccacatattaagaatattataattaatataaaatttttcgagataaaataagaaatgcctaacttttttagaccaattccggcgcgttcatctacctttctaatgtgggctctgattttgtttttgtaacatggcattacataatgactggccattcttcagcttgtccaccttgaccttagccaaaatcgcatcggtcgcctaacaaaagacgtttttgaacgattggactctttggaatggctttcattggacgtaattagcccaattatcatttttacgttaaattttaatccagttcaacaaaatgcttgaatttccccgcaatactctttctccgctgaaccggcttaagcacctctcaatggagtcaaatttgttgcaaatgttgcccaattatgcctttcagtaatattaaattgcttttgctttttaattacccccttttttggtggcttgtccatcttcaatggctttcattggcccgtaatcggtttgtttaatcccggttcatttaattaattgccatttcctaattctcaggttgtcttcaattaatgcgaaaatgttccactcaacaagtgccattcaaattcggtggctcaatttggccaataatcggatcagtcggatggagacagccgcttttcaggccccacttggaaatgttgtccattaaacatgcgtcttttcctgttttagaatttgccgaatttggaacgcctttatttgtccaacaatcggcttacaactttgcccactcaagtcaattgatcatggataattagcaataatacttttctgtcatttcattaaattttgagtttagattctttcgtcactgaagaatttgcgacaattgagcttggctcacaatgacatcaatgaaacgcaggaaagcgcgtcagtccgacgctaatttgctcattaatgcaaatttatgcttattttcagtttcgccaatttgccccaccttgaagagctgacaatggcacacaatcggttgcgcactatcaaagagggtaacacacaaatcattaattatttaaaccgaccgattgatcaccttcacaattattagctttgttacgcttaatcaccccaggcgttttcgacaaagtgccgagtttgagccgacttgacttgtcgcacaatcgcatcgaagcattcgacttggattttcttgggccaactcaagtgtaccaattgcgagtgcttgatttgtctttcaatgtcattcgaaagtaaaataattaatttaaatttattatttaaaaattttcagattggaaattcaatcggccaaacattcgcttcggtcttggacataaa

SEQ ID NO: 20140 - DNA, 2160 bp, Heterodera glycines
  misc_feature (2098)..(2098): n is a, c, g, or t
  misc_feature (2106)..(2106): n is a, c, g, or t
gttaggccttcgtgacctttggtttggtgttctccgtgtttgtacaggtgctgctgagacgacttctgcttttggttggacgtagtgatggccatattctcccatcacttcttggatttggacttctttccggactgcttcggttagcacatccaggaatttggttgtcgtccagtttgccggatcctctcctttctttgtgaggatgcttcgtaggaatggtggagtcagcttcttctccagcatgaggaacacttgaggaccttcgatgtcctctccggcattgttcagctcccttgtaagccgctcaagttgaagcataaagtctttggtctcacggaggcttcggcacggcttgagattggccagttcgaagtgaagacttctgatgtgttcctccggagctccgtacgtgtcctttaacagctgaaggaccgtctcgtagtttgcgtcttccagtcggaagcccgctatgagttctcgcgcttctccgcccagtagattgcggagtaagttcagcttctgcgctttactgattgattgactgccgattgccgatttgaaggattcgtagaattcgggccattttcgcttttggccgaaaaatttatccagttgaattggctggaattggtagagcggtgctgtgaatgttggcattgtcattggtgctgccattgctggtggcatgggcggttgttgctgcggattggccaattgatccgcctttgcttccctgtcggctctgcctctgtgcagtttggctgcggcactgagtgttgcttcgagatctcgcaaatcccgaagtttggttgatgctgcgtcgtatcgttcggcgattttctcatttttgtcgaatttgatgtattctttttcgccgttgtctttgtcgtctccggtcaggcgggcgagaagttcaatccaagcgttggataagtctcgtagactgtccatctgcatttccgttgtacggatttccttgacgacgcgatcaaattgagcctccaagttgatggcattttcccagtttgacaggtccgggtcggggtgtagaaggagtgaggtggcgcttttggcattgtccagagctttgagtgcattgatgatccctttttgtattggcccagacattgcgtgcagtttggttgtgcgtgtgtgtgtgttgtggtgcacttgttgttttgtgtctttttccgggatcagtctggccttggtcctggaccttttgtgactaaacacctgcctcggaggacaaggtgtttgccttttgccttatggctaaactaaagcctcggaggactgttagtttgccttttgccttatggctaaactaaagcctcggaggactgttagtttgccttttttccttatttgtcaatggcctagtgcgcgaaaacaccctttttgcacgaagtacttcctcgaagggcaagtactacgtgcactaacactttcacacctctaccctttgctaagacgaagcacttcctcggagggtaagtactaagtctgctatgtccctcgtgaagttaggcctcggaggaccgtaactacacgaaactatgaacactagacaagccttggagggtcttgtctaggctctctaatttgctttttcctttccccctttgtcaccgggattcgtcgatttcagtccgtggttcacagcaatccacccaggagcgccaatttgtcccgacttgctctggggtcgggccaaatgaattccacggtgcgggggtcaggggcaggcagggacgaggaccggccaaatcaaatgccgagaattgattaagcaaaaatttattccggggaaaagcctcaaacttgggtaattaaacaaaaaatttgaaatggtgaacaaattatcacaaattgatcacaaaaatgccatcaccggggaattatcacaaatggaattgggcaccgggatgggacaggaaatggagggcaccggggccacagaacaaaaatcaataaccgggggtcaaagaatgatcacaattggggcaaatcacagcgaaatgggacagaagtgaagagtcaatcactgatcattgaatgagggggaccgggtaaaggacagacatggaccggncaattggnccgggggaactttgtagagaaatgagggggactgagagagggacggaagaggca

SEQ ID NO: 20141 - DNA, 1196 bp, Heterodera glycines
tgattttttatatttgcgttgtgtgatgaaaaataaaaatgttatggggcctcaaaaagaagaaattttgccttttttcactcaaaacaatcatttggttaaattaacatttttttagctcgggttcaaacccaaatataaaaagaaataaatttaattaatttaaatataactaaattatttaaaaaatcgttttttagactaaaaaataataaatgtaaatgttcgacccttctctatccaacgataccaaatttatatccactttttgagtaacaattcgcgatgttcccttgtaaacgcttcgcttttttttttgaaaacctaggtgttactgaaaacaatatttgctgaatttccagaaaaacctgtcaggtgttggaatttgtcaccgccttgtccactgtgaagacggaggagtccgaccggcgcgacatgggcaacagcgacggcgaaatgcacgatgtgcagcaccaggcgggcggtgaacagcttgaacacgttgatggtcgagacaatgaacaggtgctggttgtgttgcaatcgctatcattttactcatttttaaagactttttggttttggacagcgattttttttgaaactatgataaaaatttttcaaagattttttccttcaaatatttctaagattgaaaaaaaacttttaatttctgcgcgagattttggagtccagcctccgttctcattccaaaattacatcaaattatttaatatttatttaaatttaagttcgcaattgaaagtcagaaatcggtgagaaaatggcccttaagaaatgtccggcaaatttggggtaatccaatagcggttttgaaatgcataaaaatgagctcatcagaatcggtgggcgaccccccttttcaaaaaattttttcgaccccccccccccccctccatttttaatgtataattggcactttcgcagggcacttctgacgacggcgaaactggtgagccaccgttggaccaattggtgcacagctggcatgccgggtgcagaacatggccaacaacaatgacaacagcaacaagaacaacgacgaacaattaggggtagaaatcaattgtaggcccatgtacagaaaacaaattttgcgggcaaggggggggggggtacgagggtcggagcaggtcggtagttccccctcccctcgaatttttttttttaatttt

SEQ ID NO: 20142 - DNA, 1054 bp, Heterodera glycines
aacgccgccgaatggagaaagatttattaacaaaaaaatacagtataatgacgaaaaaaatttattaaaaaaattacattataataagaaaaaaagatggtaaaaaataaccccccacacccaccggtttaaaaaaattttttaaaatacagtacccgaaaaaaatgcgcgaaaaaattttgcgcgaaaatgggccccggacacctgccggtaacagctgttttcacaccctcaaaggtgtgaaaacacatgttttcacaccacccccggagcccgtggggtcactgtccataactactgaaatcatttgcgcctcgtacatttgcggtccatttcttcagagcctttttcgcacatttgcggccacatccaaaaacgacacttgcggcccgactttttcgacccgaaccaaaatgggcgctgatttaccgaaaatccttttttgttatcttaaaatttacgcgaactttattcaaccagggcaccgcaactcacatgagtcacgtggtccaccgaaaaaaccaattctgaattcttcaatgatttaccacaaatacaaaaaatgaaataaaatagaaaaaataaaattttttgggttgagaaaatttcgtaattttcgaaccatgtcacgcattgttgttgaaaattgtctttttttgcaggtgattgttgacgaaattgtccaagcggattgtgacaagcttttgttcaaacacacttcgtccgtccctctccatttggataagttggccgacaatgcaataactgacatagtttttcgggattggatcgacaatctcacagaatgggtactgtagttttttaaaccgcttttttcgaaaaatgttttgagaaaaattgggccggcggtaccttcagggaaattttgaaaattcaaatgtgatttgttaactaaattttgcgcttttgagccaattttctaagaaaaattattattagtttttataggcaacgccgcgggaaaattttttgaattttttatgtttagattattcataaatctttaagtcttattggctaagacaaataacat

SEQ ID NO: 20143 - DNA, 2181 bp, Heterodera glycines
ggaaaatttttgacggaagattattaaaaacatcgcccaaaatgaatcaaattttaaaaaccttgatatctttcgatagccctaagtgttttatattatcctgcaaaattacaaaaaaatttattaagtttcaaaaaaagttatgacctgagaaacccaaaaacccaagttttcttgaacatttttcgtcataactttctttaaacttaatgaaactttttgaaagtttgcatgataatggaaaacacttagtgctaccgaatgatattaagaaaaaaaaatttagttgcttttatgcagttatatgaaaattttttttttttgattttgatagttttttgaacgcccattttgatggtttttgagtaacgtcatcatagcaccgttgtgcctcggtagctcagtggtagggctttctacggattgggtggacgagacgcttgggttcaattaccacccgaggcctagcattttaccaatttctcagtgtactgttgtggcttcgttaacctcacctcggtgcagcaggtaaagttgtaccctgcggcgcagcaatggctcgctgcgattccctcttgcggaatgcattttgcccatccgcattccatgcatttttgcattgcatctacacattcggcttcaaactccatttgtttaaggattttcttacaaaaaattaaaattattgaaaaccaatcgactaaatgtgcaaaccggcggcagcgaaggctaaaggtttgtttcatatatatttttttaaataattcgtttttaattattaaatttgtgtccagacatttgcgccccccgacattgcgtctatgtccaaaatcggatttaaacataaatcttttcaagcaatgatagtttaaatggcactaaaagaaatcgtaatcttctagtttattaggggcattaattctgctgtttgattaattaatgcttttttcaaaaattagattatcaaattatcaagcacaatcacttaaataatgctgcttagaggcgatcagggattgaaaaatttaagtttttagcccgatttttgacattgacgcaaatgtatggcaacaataaccagtaaattatcaaaaaacaaaataattttttaactttaggattttctcaaattttttaattctttaaaaacttaagtgccgagtgaaaatccaaaaattcaatttcaattttgcccattacagttcatgaaatacacagtatgccatcaccacctctttgcagcagaccagttcataattttcagaacaacactgcgttcctttggcaccatcttttgcgtgacacctgaaccagccgcactccttgcacacttcatgtgcagtttggttgcaatcgttaatccattgtttttgttccgtggttggcttacaagcaattgatcgttacgaaaatgtttgccaatcaaaccatcaaaaatccctacctctggaggctaaaaaggatttgattgaatttaacctcaaatttttgtatggcagatctgcacccaaagaaagaaacggggaagaagctgcagacgacaaaattttgaaattttatatggaaattaacatctcaaagattctaagaaaatattgaaaaattggacggcaaattttgatgcaattaaaagaaaaagttttggtatgcctaacttaaatctttttctgggtacagggctgatttctgtaaaccattagccaacctccttgcagcagatgaattcatatccatcgccacagcaaatgccgccggcttttccctccgatttccaacactttccccacatgcagcccttcttctggcacatcagcccagaaatggtaacatttttcaagtccgtgtcgggaatgtgaaagatatttttgacaaatgagggcaatttctcgaggttgatgtccccaagttgaagacgacaaatactgtcaagtacaatgggatccgggatggtgacaccaaaaccaggagtctctatactagccgattcaacaacgagccaatgagcttaggagaattgccagagactgaagcactggaaaggggaggcaacaattagctgatcggtgtggccaaatgaggtggaaattgatcactttgtccacttttgccactggcagccgaaaaacggccgaacacaataccaacgaaaagcaagtgaagctggcaatttatgtcgaagct

SEQ ID NO: 20144 - DNA, 2791 bp, Heterodera glycines
  misc_feature (1746)..(1746): n is a, c, g, or t
  misc_feature (2007)..(2007): n is a, c, g, or t
caaaggtcaccggaaaccattcgaattggtcgtcaaattgcccattgtaatggcaaacggagtgaccgccgccctcaaagcgcaagacaatacaggcccaattgtcaacacctgaaaaaggggatgaactctgttaatactggtggcgcttatcgccactgctgggctacctcccggtctttttggaaaaagcgcgcaaaaaatgatttggaaagcaaaaaaaaaaaataaggtcgtcgcccgagggggtatcccccgccaagccgaaatactgacaatgagaccgtccctgggaaggagagaacagagggagacacttctttagaacagacaactgccggtgcctttagcttaacggatatctttttttatgaaaaatgcccttcccttttttggttgcatttgtttttttttgttgttaaatgatcaatttccagggtcggtgatcagtggatatttcggctagccactaataattgttgtcaaaaatcttttcaaaaacaaagggcacgccattgtcaggagaatgttacgaaccgtcctcagcagacacatctccgatcactttcacgtcgatcacttttttgccctcaaaaacaaaagtggcgaaatcgacggtgtaacagccgatgtccaccaggggacaaatgccattggaaaggtcgcgccgtttgtcgggctaaccaaaaggggacaaaatgcactaactgaccaataatcaccccatcggtcgactcaccaatttttgactgaaatccaccgagaccaatttggggttgcccatctgtccgtcgcgcaccgtttgtcggattttctgccaactcggaaagaaaccagaccaaaagccctgaaaatggacattttggcctggtttgttggactttgccgtctcggtaatattgcagaattgtactcccgacgaaaaatagcttggctgcggatccgaacccaaggaaaatgaaatttattttttgtcgggaccaaaattcagctgtattaccgccatctttgcattacttccatcacaaagagtttctttccctcccttcgattgatcgttttttgcaccgtttggacaacggaaagttcggcacttgaataaaccattggcttttcgcacagcacacttttgtggtgttcaagtgcggaaattataaggggcaaatgggtgctgttaatggtggcgatgtaaacgacgtctgacgaaaggaaaacggcgaattaattaattattaattaattaattagttaattgccaaccgaccgaaacacggccaaacccaaaccgaactcacccacgtcggcgtcctgcagcaactgctcgtagttgccataagccttgacctgttcgctgttcaggccaaccttttggatgaattgctgcgccctttccacggaattggaagtggccacggcggtcacctcaaaaaaggaattgcaaaagtgccaaatttttgcggcactttgttcgggtgttgacaataagccatcgcaagcacaaaatcattggcgatgttccccaagccgatgataccccagtgcaattcggcacgctttctttgggcggacgaaggcattttgtggacaaaaaacagtgaaaacttcgaaaaaagcgaaagaaagatggaataaaatgtttatttggcaaaatgaaggaagaaatggaaaattgggaaaaataaaaagccgacaaaataacaaataattgcacaaataaaaagaggggaaaaggcaaaaattgtgtanattggtgagagattctattaattgctaatcgcatttattaatcgtcgctaattgttttgattcgatttgatttttcaataaattttgtttaatggatgaaattcgctcaatttattgcttatgctgcgtgttcatttcgcttaatgtttacccatttttaaatgtggacattccccaatcaaattccaaacacagtgatcagcaaaacatttgtcacagaattaattaggtacagcagaatgcccaagggatttaattctntaaaaatgattatcctatcagagatttgtgccattttgcggcgcatttggggcaaaacgacggacaaaagttgcgcgaccaatgtttgcgaacgctttccgaccggacaaaacttctgcacgaactttgcgagtgcgaaccccagctgatgccctatctcattgctgaattcaaaccaattttcaggtctttaattgggcgtggattggtcaactaaagaaaatttaaaattgatgtgtcctgaaaactcggcttttcctttggtgaccccgatattcccaaaaattccggcccattctgtgccattcatccgtgtgtttggcatttcctcagggccatcgtcgatgcctttgcctctcatttcgatggaccacctaatgccgagatggcaatggcctcggttgatcagattttgtgccattttctcgcggtcgtttcttccctgctttgcttcgatttcggcgctttctttgagaacatttgcggcgtcgaccgctttttgtcgctttgtttcgcctcaattggccaaatgaatgcgaattcgatggccatcactttgaattgcctcggtcttccttatttttccattttctcatttattcccccattttcagtccgttttctctcttccctccgttcgtccgtcccttctcttccgccccttccgttcgccgtttcttccgtttctcttcgcgtcatcgcgcaaattattccgccgccaatttctccgattttgctgttttcgtttttgcaaaattcactcaattccgatttgatctgttcg

SEQ ID NO: 20145 - DNA, 443 bp, Heterodera glycines
aaaattcggaatagacaaaattttaaaaaatagattatatgacacattgaaatgtgatcaaaaaaaaaaagatcaacaagaagttcggaaaaatagataaaatgggcgtaaaattttaaaaaattaagattagacaaaagctatgaaatcattttttaaataatcagtgaaaaattctttatacaaaaaggtgaaatgaaacattgttgaagaaaaaaaacccaaaataattcaccatctgtcaagcggtttcgaacccataacaattggtcattaaaatgtgagagaagaaaaaatgccgtttccccttaattttggaggcatgggttcaattcccaatgacgtataaaagaaaaaaattgaaaaattttaagctatttttttgaaaaaattacattaataattatttgaaaaaacaagcaaattttcaaatttttttccat

SEQ ID NO: 20146 - DNA, 1192 bp, Heterodera glycines
ttttgaaaaattatacttataaattcttacaattagaaaattcttttcgagtctgattttttttaatttgaatttttgacggaaaatggcaaaaaaaaaatctttgacaatcggtttttgaatttttacccacccctcgttagatttacagttttgcgcctccccttttttatccatggattatgataaattttataattgaacttgtcaaaaaacatatataaaatatatcacacccgtgttggctctttgttgaacaaatcgttggcttttgggtggtccaactctacaaaaaatggaaaatttaaaaaatttttgtataaatctgaaccaaccgttgtcagccattgagtccatgatggtcatcaacttcttcagtctggacatggactcctgttcgttgccctttgacagaaaatcggtgccaaatccggggatcatactcttaaaaatggaagggggggggattagaaaattttgttgggaattttttttggtttaccataatttgaccaaacgggcccatcttgagaatgttttggaactgttcatacatgtcacggagcgtaaattgacctaaaaatttgtttaatacaaacgataaatgccaaaaaaatatatatgaattttggacgatttttgtgataaaatttcgaaaaaattatagtgaaaataggggcatgtctcaagcaccgaagggaaatgaaatttgaaagaaattaataagtacaaatgaaaaaaaagttgaaattaacactgccaaaatttttttgaaaattaaaaattttttcgcggaattgtccccccgcctggtcataggcctgacaaaattgcatttttgaataaattttattgaaaaaattcggcaatagttgaccctgtttaagccgcttgatcagctcctcgttgtcctccagccccatttcagtgaccttttcaacaaggccttcgatgtcgcccatgccaagctgaacagaaaaaacttttttttttcaaaaaaaatatggcatgggacggattagaaaaactaaccaatttttgcaggaatggtttcactctgaactgctcaaagtcgtcaatgtgttcacccgtgccgataaaaatgattggagaacgagtggcggcgacactaaaaaaaacagccgaaaaattaatcggaaagtggcacacattttcagtttttttataaatg

SEQ ID NO: 20147 - DNA, 1923 bp, Heterodera glycines
gatcttatcgatcgccagctgttttttgtttttcccacgctttttgctagtgatagtccaattaagttttttcctctgtgccccgcccctcacatttttggcctataaaaagggcacccttttcattatatgctcacttccacatttccattcattcatttctgctgctgcttaataaatatatatttgtgaaaggagtccgggggatttggtcgggacggttttcccctcccccttctgctgctcagcgtctgcgtcgtcgtccgccccgcgtcggtcttccccgcaggagtctctcactcctgcgggccttcgcttccaccggctcgtccgtcccttcccccacatttgggaaggcacggccgagaaagggaaagggggaagcaaacagctgattttgcccttggcaaagtcggctctcgcctccctcgctccccacaaaagtttttgtcgcctccttggccgcgacaaaattggagccccgtaggggtcagttgttccttaccgaaaggacctgacctccttcaatcggccgtagccgccgatcaaaaagtcttcgcccgccaaggggtgaagaacatcggctacagtcgccgatttactttctccctaccgaaagggaggaaggctcattcggccaccagtcgccgacttcttcgtcttgcccaagcagtggcaagacactcggccatcagcagccgactcttcgtcttgcccaaccagtggcaagacactcggccatcagcagccgactcatttagcctaacccatcaaagggaaggctcattcggccatcgccgccgactcattcgcctgacccatcaaagggaaggtttattcggccatcgccgccgctcattcgcctaacccatcaaagggtaggcacactcggccatcgccgccgactcattcgcctaacccatcaaagggtaggcacattcggccaccagtcgccgacttcttcgtcttgcccaaccagtggcaagacactcggccatcagcagccgactcgtcgtcttgcccaaccagtggcaagacactcggccatcagcagccgactcatttagcctaacccatcaaagggaaggctcattcggccatcgccgccgactcattcgcctgacccatcaaagggaaggcttattcggccatcagcagcctactcatttagccgaacccatcaaagggtaggcacattcggccaccagtcgccgacttctttgtcttgcccaaccagtggcaagacacattcggccatcgccgccgacccaagtctcacccaacaaggggagacacaaccggccaccagcagccgaatcttcgagtcttcaccaacaagggttaaaggactccggccatcagcagccgaacctcccaaagcaggagaatcaacatgagcgggccaatccgctcaaaaatcgggccttgtgccgcccgtaccaaggcctacattgaggcggccacggtcaatctcggaaaggacacgacagacgtgagcattcaagcagacctcacagcggagcgccgtggactccgccgagcgattcagcttttggaggattgcaatgacaaatggcaatccctcctgctcaaattaaatggagccgaccgccaacaagaggagcaacgctacgatgactttaagccatcgggaaagcacttcatggaatgggcggacaaagcccgaggtgcagtggacacgatcgatggagtgatcggtccagaggatgacgacgaaataactgagagcattatctctcagcccgccaatcctccacaaattcaacatgttcagcctcccccacctcgccatgaagtgaacttacctcccatctctctcccaaaaatcaccgggagagccaagggaagggccaaggttttggaggctcttccgttcctcagtggacaacctttccaatcgac

SEQ ID NO: 20148 - DNA, 1235 bp, Heterodera glycines
  misc_feature (21)..(21): n is a, c, g, or t
tcattgggacgctaaagcaanaggagactgggaaatcacaaactatgaatctacaaaccggaccgggaatcaaggcaaaatcccgacagtgccacaaacatacatttcagatcttttgctgtgtaaagacattttttttttaattttgaattggcataaaaaaaaattttgaatttgaatttaaatttgcttaacggtgtgagagttcggcggaactgtaactgctgattttgcttaccaaattacctactctttgattttgtcaaattttaattttcttaagttatacatataattaggttatttaaaatgatgaatgaaactggcaatgaggactggtttgataacgttgagaatttgcgtccgattcgtggagggagacgggcagatactttgaatgatattgcaactgggaaagcaaaggttttcataacattttttgctttactaaaagcctctgtttcaagatttccattgaaagagctgagcaaaaatttctcactgaattcgcaaatgcatccaaagggtccgacccattggagccgatgtaccgcttcacaatttggttcgaggaacatttcccaagcggaaaacaaaaacatttctgtcaatttctttataaaatttgcacaacttattgcttggtgaatgcctacaaaaatgatgatcgcctgatgaaactgtggctaaaattgacagaaaattttcccgagagtggcttcgctataatggaattcgcattttccaaggggtcttgtcgccaattggccaagttctacatacattggagcaccatgtatcagtccattagtacgttttatggtatttgaaattgaggaattgaactgcatttacaggttggtggaacaaagcacgggagaagttgcagctgggccaaaaaatgtgtgcaatgccattagatttgttgcatcgggcggttgacgaattggaagcgtcagtgatgaaagtgacgcgaagcggggagaacagcgaagagactgaagcggacgaggtggcgaaaaaaagattacaatacgcattgtttcatttggcaataatcaacgaatttgggaaattttaaggcgagagggtggaggaatgggtctttgatcgggttccttttgaattgccagtctcatcagatggttgctgtatctttggagcagtcacgcgaaactctcggcaaactccgtggccttggacggcgccatttcgctccaatcattcgcactgcg

SEQ ID NO: 20149 - DNA, 909 bp, Heterodera glycines
  misc_feature (866)..(866): n is a, c, g, or t
atttttgagatatttcgcgaggaaggagacgaagatgacgaacagccgaagaagacgacaaaaaccaagttgaagcttcggaaggagctgatcaaaacaatgtccattgaagaaggatttgcacaaagaatttccaatgacgaagcaaattaaattttgcggaaaatggggaaaccgaaataaattcaatcaaaatgacaatgattttcatatgtaaatattttttgaattttagcattgattgcatattttagaatctccttttttgtatttgaggaaggcccatcagttttgctttatttttttataactaaaggtgaataaaatatcgaaaattttgtaagaaccaagcaaaagaaattgagtttatcctttaggacaaaagaaggaatgaacgaacgacaaaattcgaattagacaatgagatatattagaaggaggattacaatgtaacgggacatatcttaaatttagtaaaaaataggggagtgggagcggaactacactccgaaaatggcaattcttgcgcttgagaattcctccatttcacctgccctgtcctttcattattagggcatccaaaaatatggatataaaatcgcgaaatatggccataaaatatggaccaaaaatcgcaaaatatggacataaaatggcaaaattttcaaaatatggacataaatggcaaaaatgtcaacataaaatggcaaaattttcaaaatatggacataaatggcaaaaatgtcaaaatatggacataaatttttcaaaattgagtttaaaatttcttcaaatttattagttgaccttgcatttatgttttcaaaattccttcaaattcgctaaattaaagtaaaactttcaanaaatggctaaatatggtattaaaaatcattttagaagaaaaaa

SEQ ID NO: 20150 - DNA, 1456 bp, Heterodera glycines
  misc_feature (1425)..(1425): n is a, c, g, or t
ccgaatttatttaaaaccaaaatttgtaaatatttccaaaataaagatttctgaggatttaacctccccccgtcagaaatttttttgttcagcatttttttaaaccattttacggggggaggggagggtaaaaattctgcgctccgacaaatggtcaagacaatttttagaaccacaattttttatttctcaactaaattaagcattgtatttgaaagcgcttgacaaaatctattattttcaaactaaaaaattttccttatctacaaaaaatacgggcaaaataaaatattcaaaaaaaactaacattttcttgtcttttggccatagatttcttgtaccttattaaaaaaaaacttttagaattttgaagaatacacagaaaacacttagaattatcgaacattaccaagaatatttaatttattggctagcaagtaaaaagtaatggttcaaaaattctcctggccggcgatattttgggttccccgaaaattctgttcccaaatttgctacagatttttaccgattgaaccttcctttctttctttcatccacttattatactgtactgcatccgaaacatgatcaaattgtgatctcttcgaatgtttggcgtacttctacggcattttccacttattgttttggtcccaattgtaatgtttgtgccatgcataatcggcacgtcggccgactcattttcgtcgtcatttcacctccggcgccaacaaattcactctcagatgcaatcagcagaacaacccatcggtagtattaaaagcttagatcaattttcataattaaaccgtcagaaattgccattattttataagcggcttggtcattggggtataaactacgttgaaaatttgtttgtattaaatgtttagagttttttttcttataaaaaaagttaaaaaaaaattttgattatttttttaattgaattctaaaaaatttttattaaagaattgttaaattcttaaaaattttttactagaaaaattgaaaactaaaaaatttcagtttttaaaaactttttccgagggcgggggcggggaactgtgctggatccttggttccaaatttttgacttttccagatctggtccatgattttaaaaaagttaagtcgaaaaggcaatacataattataaaattaatatattcaaactgtttttttaatactctaaaaaattatatcaaatttaggcattgtttctgcatatttttaaaatcaaaagatgcatatgtataaagaaactttacagaacatcgacatttacgacgtcatccgccttcaaccaatggagatgtgttcccatttcttggtgctgttttcttgccagacgatgctgaaattgagaggatttcgggcaaaaatggtcgaaacatttgtatcatatttgcataataaatttanaataggggcttaaattcaaaatttaattttt

SEQ ID NO: 20151 - DNA, 629 bp, Heterodera glycines
caacattgttctgtcgctgaactcgattatggagcatgtggacacctgtgttctgtaagccaacactttcctgacacaccaaaaaaaaatgggaaaaatcctttaaaatcccctatttttgaacattcctatcggaaattttttccactttttttttggttcgacaatgacgcgtttgagcaccagtgcaaggagatgaacccgttacagaagctgcgccgggacggcaccagcgaaaacttggccaacccaagcgacaagaaaaactacgagaagatcaattccatggtacacaacaccatactttaataattttttttatacgttttgttgggaaatcttttgggcctacagaagccggctttttatacgaattaaaaaatatcaaataaaaaaatatccaaattaaaaaaaatgtgtagatggcatacatgaaactcaatttttctcccggcggcgcctatcgtcaccgccggacccccccccccccccaaaaaaaaaacatattttttcttaaaaaattagccaaaatctcaaaatttggttattttttagtcaaaatctgctaacaaatagcactaaaaattacaaaaatttttcccgacggcgcctatcggcgccgccggacc

SEQ ID NO: 20152 - DNA, 860 bp, Heterodera glycines
  misc_feature (842)..(842): n is a, c, g, or t
cccccccctagctacgcccttgattttgttcaatttgtttatatatatatatatatatatatattatatatttttttttgccaacagttcaccaatacgaaagtgcgttcaacagcgggggtgcctcggaggcggggaaggacgagtgtgagaaggtcatgggcagcagcaaggagaacatggacaaactgctcgcgctctaccgcgaggcgagcacagacaagtgtgcaaaactaacaaaaaaacgaaataatttttttttaatttaaatttgaaaacccattttcaacaaatcacacatattttagcattcagcaaaattattaaattttaaattgcttacccaatgaatttttgtatacatttttaaagcaatgtctttttaaattgtactgttttcagttttctgtccagttcactggagacactgttcccccgcccggagaaggggccaaaggtgcgcaaggaatgagagacggacggacggagacggaagaggagaatggacacgacggatgacccccggggggacaatggacgacgacaacaaattttttgccatgttttatttgtttggacacatcgaatgctctttttttacgattttctgaccattttttgccttgatttttgattgttttttttcttcctcaaatctcagcccaatttcattcattcattctttgatcacatcgaatccattccaaatcattatttatttatttatccattccttgccaaaatgcgtgtgctgcacttttaactcattcattcattcattggactccgaatgatctctccgcccacaaatttatttatttttaaacatttttgcgctccgntgtgacttccttcactaa

SEQ ID NO: 20153 - DNA, 1741 bp, Heterodera glycines
ttgtggccaaaacatgctcaaattgcaataaagcaaacgagttatagtccagcgtgtgtggcactttacagatgtcgccccgttcccatctgcactttaaaaggaatgcacaaacacaaaagtgctgccacctggactaaagggagggaggagggatgacgtgcgagttagggcacttccggtttccattgcattgaaatatgcaatgtgtctgctcatttcacgagcgaaaccaagtgcatgtcggctgacgcaaagaccctaacacaatttcaagcttaacacgaacacgttacatataagataaaacttataagaaaaatcggtgaaattccgatcaattaattatttccgatcttatgttaactccgattaacttttttttgttcattaagccaattttttacatgttacatgtaaacggagggagttcattgtatatgttacatgttactacacttattagcccatctctattattcgatccaataattattccgaattccatgtaatcaaaaagtccgcgctttattgctcttaaaaatttttcagactattacaagtcatatgtaaatcaaaactccatataatttttttgttcattaatgtaaacggagggagttcattgtatatgttacatgttactacacttattagaccatctctattattcgatcaataattattccgaattccatgtaatcaagcgctttattgctctataaaaaattttatttcatacttttacaagtcatatgtaaatgaaaattccatataatttatttttgttcattaagccaattttttacatgttacatgtaaacggagggagttcatttatatgttacatgttactacacttattttttaatttctcttttgttcattaatgacaaaattagttatttattacatgttacatggaaacataacttcctttggtccaccccaagttacatataagataaaacttataagaaaaatcggtgaaattccgatcaattaattatttcggatcttatgttaattccgattaacttttatgctttctattcaccaaggtatatccaaatcaaggttaattccgattcgctcttatgctttcagtttcctaaagttcatccaaatttttttgttatttcagcgcaaaattgttacatgttacatatcaagtaagaaggtgatgatgattactgttacgtgttacatttaaactcacacaggagcctctctactattctgatccagggcgcgaagcgcccttccaggcccaacggaatttaaaaacgggcgcgaagcgcccgtccaagcacaacaaaaattaaaaacttgcagccgctaaccttcacaagccgaccttatctaggtagcgaagctcccaaagcgcgaagcgcttttcccaagcgccaccctcgcatgcacacacccgctagttatatataactaaagcaacatcgagtttcattgctaaaacaaaaatctcgggaaccgctggggggagggactcgggagtgtggcattgcttaagcaactttttgaggcgcatccaggaaaactatgggcattccggtccggtggccaactgagcgccggcggcgctgaaacggcttttcgtttcagtctcactgttacgaaatttttttcttttgctttgatcaaaaaatgcttgctgggaggattttaagttgaagtgtgccctcagaagacgcttccaatcatttttctctacgacctactgtat

SEQ ID NO: 20154 - DNA, 3669 bp, Heterodera glycines
ttgcgaagccaatagagaatgctaagagctttcgaatgataccaagtttgttgaatttggtcaacaaataaaaaagttatgacgttttaaacttggctcagaagcaactgctggccagacgcaactggtccgctccgctttttgtgatgtcatcatttttgcacttttcgcgcaatgacctagcactctggcggcaccgttggctctccttttctcgagtttatattaagcaaccatcgaaccatctgcgggagagtccatcgaacaacggatggtacacaattcgataattaatcaattgctggcgaccgttttttgagcatcccgaaattctcatgctctttggaccttaagatatctactcaaaacctcctctcttggtatcatgacaactcgtaaaatggcttaggctaggcctaggcttaggcttaaacttgtaaaaaaaaaaaattattgtgttgactttgtcgagttgccgttcactcatcttttttcttttagtacataattagtatagtcttttttattttctatcaaccagggccctgcgggccctgtgaaagcgccggggcgctttcaacgctggttctagtgggagatataatttggggcgtgcaaaaagcatctattggccgctaagcgatcctcatagtttaggaatatgagaatttggaaatgaacaaataattaatttaaaaacgatattgttttaaatttaatttaaatgcgacatttttatttatatgcttgtgatttttatgagattttttgttaaatgttataattctaaaataaataattttcgagttgtcgctcttgctgctctgaacaaactgtgtgaatactcgcctaacagcacttattatggttaaaattaatacaaaaatcctttcgatcttctcttcctctttctgttcgtcttccacttctgtcttcttccactttatcttccactttctgtttctcttccactttctgttcctcttctgtccctcttccactttctcttccactttctattcctcttccactttctcatgctgttcctcttcctctttctgttcctcttcctgttcccctttctgttcctcttccactttctcttccactttctattcctcttccactttctcatgctgttcctcttcctctttctgttcctcttcctgttcctcttccctgtcctctttctgttcctcttatgttcctctttcatattttttagttttaaattttgtttgttttatttaaatttttatcgatttttaattttccgtaagccatgaatcaaaatttattctgttaaattggatcagaaacttttttttgtcaatttttatactgttaattcttggtcatccaaagccaacaatgttacattgttggtattagttgaaatgttaacatgtttaaaagctttgtctaagctattgctttatgattagacaattgctaaagaagttatacatgaaaattgcgaattttaaattaattttcaatttgttacaagttttgtccaaaaaaggatcaaatttttacttttgagttcattcggtatgcataaaaaacatattatttcactctttatgtaaattttttattttatttcctaaacgtaattatcaaaaaaaaaattaaaaagtttgataatcagaattaatgggatcgaactttaacactacaccaacaaagaaaggcataccaaccacttgttcaccggattgcttgtcttgtacttgtaaatacttatttatcttaaatattatttagatttatttattatattatttttttattattatttacctattttatttgattaatattaaattcatttttgaatttgtttttaaataaatcttatttcattaatttaaaataactaatattttatttccataaagttaattaaataaaaaaacaaagcaaaaaatagaattatatataatattttttaagattaccctgaagcagtgggacccgaacccactataaaaggcaggcacactaaccacttgaccactgggccgcttgccaccatgcattttaatgcccttttcccttcctttcttttattgcaaaaagctcgaccaaaagtgcataattttatttttctttataaaatatttagattttattttattttaatgttatttttgtatttatttaatattcaagttattttaaatttaattaaaaaaaattattattttataaattaaaaataaattattattttattttttaattaattaaaaaacaataaataaatctaaaaagaaaaaaagatgaattatttaaaataaatattgaatagaaaacaaacatcagcaatgggactcgaaccccccgccatgacagaaccaaagtcaggcacactaaccacttgaccaccgggtcgcttgcctcttccccgtttaattcccttttccttttccttcttttttggaagaaatcccgaccaaaagtgcttgtcctccctttttagagcacttcccggacccggaccaaaacaaccctggtatcattcgaaagccaagagtttgtagatgtgcacaaacatattaaagttttgatttgaccctttttaagacatgcaaaaagcgttcaaaaatgggacacccaaaaaaagtgcaaattttgactcgtttttcgaacacagttcgaacaatgcttaaccgattgggatgccgatagtttttccttatagccagtacaaaaccctatcgaatgataccactcgcgccccgtaaaactcgctagaaagccttaaattagtttttaagcttggatcatgggtataaatttcttatatacggaataaatttttgataaggcatttaccgctctcatctttgtttttggtatggcattttgccactgggctcatcttcctaatccacataggaatgatgcaacaagtcttaaatttaattgttttaaatcatttttaaatgaacaattaattaatagggatacattttatatttttatcatttttttcctgaaattttgaattttaaaaaattgattgatttttgatgaaattggtgtatgaaaaataaagaagattaattaaagcgctacaaaaaaatttaaacctttaaactcccataaatttgaaatttttagttgacttcataattaagctcattagcaaaaaattttctggataaatcaatatcttttaaaggaatttgcatttgaatttcttaaaaattttaaactccagaatttctgatggccaattttccttaaaatttatcaattttctcgaaaatatttttaaatgcaaaaatatttaaagcctgatcaaaaagtcctcacaatgatcagcaaagcgatcagcaggaggaatagcaaaatgcaccaaaggatggcactgggcacaacgactttagtgccagaaacagccgattccggggacgaattcgatgatggcccatgccctttgagctgtttgaaaaattggcgcaagtgttcatagtcttcgatatccgatcggttggccaaacaaaaatgaaagccgacgacggtgaccaaaagaatggtgatcagaagagtgttggccatttttgattagaaattgtttaaaaatcaatgaaaaaacagactgaaattagcacaaaattagatgaagaaataaatgatcaaattattcttttaaaa

SEQ ID NO: 20155 - DNA, 1832 bp, Heterodera glycines
tgcagcgtgtgcttcttgcagcttgcttttcctatataatatatcgtcattaaattttattatgaaaattttttacttctattttttgtgataataaaatttatggtagtagtgaatggttagcattttatactcaagtctcttaattaattcaatccccttaattacccctaattacacttacccccttaatcacccctattttccaaaccctactccaattcttttttcaatgtttcatctcccaatcgatctttctttctcacctcgatgagttcaacgtaactttttttctattatgcttttcatcccactgcgacgctagtagttagtccagccatttttggcccctaaagttcgagtccgcttggctgcaaatcatttttttggtaattaaaagggttttggctttatttttatttatttatatgatatatgtatactattttgttgttacgacaattttggattatcaatttcagacttggcaattgttaccacaataatattttaaaaattctaaagtataattattcatacaaaatctattgggaaaatatagcgttaattagggttagaagggatcggttatcccgacggcgtgggtcccggaatcccatcccgcttaaccctggtcttaattatccgctttccatcgtgcccagctgtaaatgtcattcaatcagtcttttgatgtcagtagtataaggcacattatacggggcctagttgttcccccccatgctcctgccaaaaccttaagctataaacccacctaggcagatgttataatcactagtttaattgctttttcattttcttttgttgtgaaattttgctgcgcggcgttacacaaaaaatggtgccatccgcgctccaaggtaaaaatagttttttatgttcataatctgtcaatcaaagttctcggtcgagaaaattttgctgcgcggcgtttcattttgcacaaaaaatggtgccatccgcgctcctaggtcgaaaatggtttttaggatcgtaatctgtcaatcaaatatgggcgagaaaatttaaagcgcggcggagatgcaaaaaataattgccgtttaccacagtttttatgttcataacctgtcacaatataaagaagtcggccaccgtagcgtccattaatttcactttggttgaaagggaagcgggagtttgtgcccctcggggcgcttgccctaaaatattcaaatttttccatcgatcatcttgatctgtcaacgcggcacggcagcacggcatggcagtgggaggagtcagcagcggcaccattcgcaagttcacttctcatcatttgcaattttggtccgttttcaatttgtcaacagcggagacgcatcccaaattcacttttcaccagttgtcattttcatccactttcatcatgccttttattgcccccggcactttcgcgtttctttcaaaagactatggggatttttcatctggggagttcgatccaaacagagcataagacccaaattcacttgcagaattttcgtaatgcatttattttgcttccattatctttgattgtttctttgtagtcaatggagaagagtttctggacggccgatacggatccaaacaaccaacccctccttccaacccgcgtgccccatcgcctagcttcccaatcccggtcattgttggtaatttcaatttcagttttttggattttgcaaatatctatcttggcaggaaattgtccacaggatgaaaattgttgggggtttccccaaatatcttgtctgattttttccattttagggcggcagatgttccccggcgacgatgggtacgaatcg

SEQ ID NO: 20156 - DNA, 2126 bp, Heterodera glycines
catttgattagcagataattgattcttatgatcagtcgatgtgtcgttagccagcgacgatttaatcggagttttttgtttggataacaaatccattttgcgtttgttcaaattgtccagaaactgtttggctataaatccattccgcgcattgaccatttttggttccattcccatgattaaacatttgttaagtcgacatcctccacatttccgctctacaaaaagataaaatttcttaatattttcattatctaattagcagtctttatttaaattttttaataataattatatatacttatagcagtccattaattatgttatttatatttcattcatacattttgataatttataatgaaaattattaaaagaattttactgttgtatggagttgacatttcgcaattgccgcgttttttgcacacgtacggtatctgcagcataactgtgcgacgaaaaaactgtttacacgctgaaattactgaaattattaaaccacaaatttaaaataaaattttaaaaatatcgattttttaaataagaatttatttcgttaagaagtgcttgcgccattaccttcgcaactagggatactgtaatatttgaaagaagacaatccgccacagatgagacactttttgggttcattttttgggatcatttcagcttttggcattttgggctttattggaaaaaaaaaatttataatttaatttttttaaaagaaaataataattgtaaagaggcaaatattatatttattcataattgccttaatgaatttttttccaaagtgattggttttttaatattggaattataaattataatataattaaaaattacaaacgcattaccatagtaaaatttttgccatattgatttgatttttcttgtattcccaatttaaattaataattctaaagggaagagcacatcaaaatgattttaattatatgatcaaggtgaaatttttcggtcaattgatttctttttcagatgactatttttatatgatttgaataattgtaaaagaattataaaatacaaagtgaatatatcaatttttataatattgtagtggaaaagtaattacgaaaaaagtgccaaatttggtttttgtgtcagcaccgttttatttttccttctcgagtcaaattttctcatgattatagtcccccaaatttttagccatcggatataaaaatttacggtcaaaaccaaccactgatgaaaatgacttgcattatttttattttttatttttttactaattttccggtcgaaattatgtgagaatttgtatttttacaaaactcaaaaaccgattccaggtccgaaaattcgaaaatgatttaaggattcgttaagcctaaagctgcatcgtgaatcgcgctcacactcatcgtcactgtttacgaccacaggataggtcccggaaattggtgttctttggatcacgttcccagtcatggccaaaatttttccaaaaactcgaatcccgatacagaattatcaatcacggctggatcgggactcaaaagaagaactgttaagaatggatggaacctagccttgaattaatgagggaggttgatgaaaggaattcttattagaaaagttatgtttcaatgaatattgatgaaatttcatttaaaaaaaagagttggatttatagcaaaaacccaaaaagtaacgaaacaacagaacgaacattaaaaaattgtaatctgaaactcgctcataggcatcgccggttatatttgaattttttttttttgaaaaatctgaatgaaaaaggcccagggcatttaagagaaaaaaaaacaatttatttcataaaactcataaccggcgcgctttttccaaaaaactttttagggacaggggtccggcagtgctgaggtgccgtgaggaaaacttttttgaaaatctgaatgcaatttgttaacagattttcacgaaaaatgacattttgagtagccaattttttttgaaaaaaaacaaaacatttttttggaggggtattatgaccattttgaactgattttcactgaatttgctctttgaaaatcatcaatgaaaaagaaaaatcatcattgactccttgaaattatcaa

SEQ ID NO: 20157 - DNA, 1728 bp, Heterodera glycines
agaagaggtacaacggtgatttgaagaggtacaacagtgattagaagaggtgcaacagtgattagaagaggtacaaccactgtcgaaaatgtacaataattgttggagaggtacaaaaattgttggaattgtacaacaatggttaaaaagggtacaatcatggttttaaaattaaataattaaggaaatcgtttataaaaaagtaagattaaaaattgaatgtaattaataaatttttaaaaataaaataaatttccttttatttattaaaaagagagtttgaaatgtacagggattgaatatttatttaaattgaaattaagaaattaatattacaaattctaatttaaaaaatacaggagttctttaataaaagtaaataaattattattttaatttaaaacatttttcacaaaaaaataatttaatttaaattaaaaatttttattttttatggattaaacaaaactatttatatttattaaaatgaaaattaataatattatatttatttaatttgaaatgaaattaaacatgcaaaagtaatcaaaaaatgcacagaaaaataatctacaccggccgggttcgaacctgccgcccccccccccagaagatgactcagaatccccaatcacacagggattctgagggcttaacgatgtaataactgaaatctgatgtcagattagtgatcagcaccctcaaatagccctaatgacatgtttttggaagatttttgtgaaaaaaaattttccactcaaaaatcctggttacccccctttggtcccgaatcccaaaatcacttttatgtttgtatctttttttaaaaatgtgataaaaaggtcaaataaaatttagaaaatagagctaaaaattgcggacttttgtagtattttaattttacagtatgacttttcagaaccgagttatgaatttttttctgaaaaatcgaaaatttccagaatttctggaataactttttttgtttttgtggtataaatttcaaataaatctcataaaattctcccgattttttgctatttttaaagctttaattcacttaaattgaccagtccttcattgagttatgaattttcaaaatttaacccaaatttccaaagaccaaaaaaattaaaaatattttcgaatttttaaaaaattccaaaaattatgaaacttaaaatagacatcatattcgtactcagcacctcaaaataccccagaaaaatatttttcacaccctttttcgaccccaaaaaaatttttgaaaatttctagggggcctagctcgaaaatttttgaaaattttacatcatttagtacaccattcgatagcatttaaaatgctctacaaaaatgttctaagacaatttttcgctaaaatcaacccctgacgagttatgggcccaggactcaaatgtcccgctgaggccaaaaaatttttctatttccgggaaaaaatcgaaatttttccgaaaaaaataccagtcgatagagctcgaaaaactatgttttggaagtggtctccgtttctctgggaaaattcgttaaaaaatcctaaaattcaaaaacccgaaaaccgttttttaggcctaactcgaaaaattttgaaaattttcgaaattttaaaatttggaaaaatcgggcttttaaagctctacaataagtctgctggccaccctgcgctcaggtcaaagcctggcgcggcattcgcctggtactgaagtg

SEQ ID NO: 20158 - DNA, 992 bp, Heterodera glycines
atttttgattatgccggtcttgaccgtggacatttttgattatgccggtccctgaccgtggacatttttgattatgccggtccctgaccgtggacatttttgattatgccggtcttgaccgtggacatttttgattatgccggtccctgaccgtggacatttttgattatgccggtcttgaccgtggacatttttgattatgccggtccctgaccgtggacatttttgattatgccggtcttgaccgtggacatttttgattatgccggtccctgaccgtggacatttttgattatgccggtcttgaccgtggacatttttgattatgccggtcttgaccgtggacatttttgattatgccggtcttgaccgtggacatttttgattatgccggtcttgaccgtggacatttttgattatgccggtcttgaccgtggacatttttgattatgccggtccttgaccgtggacatttttgattatgccggtccttgaccgtggacatttttgattatgccggtcttgaccgtggacatttttgattatgccggtccctgaccgtggacatttttgattatgccggtccctgaccgtggacatttttgattatgccggtccctgaccgtggacatttttgattatgccggtcttgaccgtggacatttttgattatgccggtccctgaccgtggacatttttgattatgccggtccctgaccgtggacatttttgattatgccggtcttgaccgtggacatttttgattatgccggtccctgaccgtggacatttttgattatgccggtccctgaccgtggacatttttgattatgccggtccctgaccgtggacattttttattatgccgttctagaccgtggacatttttgattatgccggtccttgaccgtggacatttttgattatgccggtccctgaccgtggacatttttgattatgccgttccctgaccggggacatttttgattatg

SEQ ID NO: 20159 - DNA, 2112 bp, Heterodera glycines
  misc_feature (26)..(27): n is a, c, g, or t
  misc_feature (2024)..(2025): n is a, c, g, or t
  misc_feature (2055)..(2055): n is a, c, g, or t
tttttttgtgatatgaaactgatccnncaaggtttagggttgctgatcccgaagctgacatatatttgaccaattccgactcccgaacttaaactttaactgaaaattttttgcccttttctcaagttcggtcgggttagggtttagaaattggtcaaaatagatgtcagtcattcgagattagggattctaaaaaatattcaaaagatcacgaaaatgtaattgtcatggtcaaatttgaatttaaaaaagctaaatttggaacaaagcgtcttggatttggacgtgtacacacattattccgtccattgttgcgtattccgcctcggttgggttcatccgcacccaatcgtgccgatttgacagttcgctgagcaaagctgcggcacagtgtgccgcgtggtcgtccatgttcttctccacttggcttgtcatgcccaccgtccgttgggcaattttgctcaaaattgggtcgtatttggcgtcccagcccaattctcgcttcagcttttggaaggcctccgattcgttgccattctcccatcggtggtcatccgacaacatttcgttcacctgcttcacttgactctccgacagacgaattgtttccccactaaaatttaaaaataattgtaattaataatttttaaaaatatttcttaaagttaaattgtgttttttttgaaaatgtgtcggtcttcttaacaaagttcgttatgtttgaaaaaaagttttccgacggcaccgtcggcagactaagatcattaaatttcaaaaactgacactaaaatgttaaattggtcatttagatgcgaaaatatgctataaaatattatttaaaaaatttttttttaaatctttaaacttttgaccaaagagcgatttgcggatttttgtggtcttttgatcattccgagtcaatgttgggctcccagtgtaagtttatttttaatttagtaatcataacgccaaaactttgcacttaaatcttttttaggatttaccttgtaaaaatagaagagccgatctttttttggcaaaatctgttaacaaatcgcactcaaaattccaattttttccggcagcgcctaccggcactgccggacccactcctcccaatgttcccaaaaagttttttggaaaaccgtgccacaaaaaagcaatttaaacgcgaaaaatttaagagattgtcaatttatttaaaataatagaaatcgaattttctatttttgaggttttaaatgtgatttgttatagatttttaccaaaattacctattttgtgattttgtgccattttttaagaaaaaataggaattattggggtccggcggcgctgataggcgccatgattgctttaaacgaaaaatatgactcttaattgattttgtttgcaattttttatgttttaaaaaatgaggatttttcatttcaaatgaggattttttttttgagctattttagtggcaaatgatgatttttatgactgaaatgaggattttaaaattttgaaatcaaactgaattaaaaagtaacaatttaaattattcattacccaatttccgttgtcatttcgttcgttaactgttcattcattttttcgttcagcttacacggcaatgcgacaatataatatgcaataaaattctcaatctgaagattaagcttaattcaaaaaagattatttattcaaccattaaccaaggtaagatatacataagcatcccatcgacttaaaattgctttaccttttcaagcaatgacccgaaatcatttgtgtttttgaaattctcattcacccattctcgaatgagttggtcggacgattgtcgaacaaaatgagtgccaaaaagacaggtggccttttgtaaattcatcttaatggaatcggcgcagcattgaatgagctgaacattaagcgtttgatcgattggaactcgggcaaatcaattattaagtttttttgctcgaagacaatttctgtaaaaggatggtaaaggataacatttgtaatatcgtaacatnnaacaccatcggcaaaatttcttgcccatgnaatgtcttctatttgtctgtgccaaaagagtgccgtttcggtacacttcgggccgaa

SEQ ID NO: 20160 - DNA, 2931 bp, Heterodera glycines
  misc_feature (2920)..(2920): n is a, c, g, or t
attgcgccattccgccacccccacgcattgtgcaccctgtcaccaccattgacgatgccaatgaaaagggtggttgtgatgcaggtggtcggcatgtgccagctgcggctggcacaaattgcggttgctgttggtcgggcagtaattggtgctgctgctgctgttgttgctgtctagtggcggctaatgccaacgcggctgtccataaacgggcctgaattggccagaaaaaaatactatttttgggggattgtcaatttattagacctgatttttttttttttgaaaaaattttgtgattttaggggaggtctatttattaaaatttaattttttgtattcaattttaaattggctgttcggaatatggaagatttcgaagggtgctatttcattctctccttaattctcgggaaattaacccaatttacttaaaaatttattttaacaattaaatgtaaagggacaggaaaaagcatacaaatgcaaaattgattaatcaggaaaaagatgtcgcttcttcttcacccccaattgagtgagcggtgcgccttttatagaggagcacccgcaggggaagggaggggcgggatgaatcatcactagggctggcaaaaatatgcacatgcatatttttttcctggactgtgggaggcctgaaacgcacgaaaaccatgtttttagcgtgttttgaagcttctaggatgactttccatatgcatattttgcatatttgtgcatatttcgcgatttatgtgcatatttgcatatttgtgcatattttggcatttcgtgcatattttatgtgcatattttggcgtttttccaaaaaacctctaatagatcggcccccaacagacaaattggcctttttgacctcaaaaaccggaaaattttccaaaaaaataattttttagcaaaattttcacgaaaaatattgaataaataaattttctcaaaaaatggttaatttatgtcaaaaataagcaaaattttgtttttcaggttgatttttcgctaaaatgagtaaattttaagctgtatcgtgtttttttctcctaaaatgatttttaataccacatttagccatttttgaagattttactttatgtttaacaaatttgaagaaattttgagaaattacaccctcaattggaaaattttatgtgcatattttgcgattttatgtgcatatttttgccagccctaatcatcacatgaatttaaggaaaaatgatttcaaaataaattgatcaaatggatcaatttgggtcgctttggcccatgagataattattaaaatttaattttattttcgtctctttttaaattcacaattcgaaatttggaagattttaaaggccgctattttcctcccccgggcatcaaaattttattacgctaattagggcgcttgcaattttcctgttattaactgactttacctgaactgcttgaaattgttgttgttgaaccgcattctggtgttgttgctgctggcattgttgcgcgtactgttcgtcaacatggtcacggttattgtccactgacgaaccgttggaagcggaggaggaggatgaagttgtagaaaagtcaccgaccacctgagcgattaaaaataaattgaaattaaaaaacaaaaaaaaaattatttgtgtcgccacgctcactttgtccacggcaccggcacaggccccggccaactcagttttcaaaaatcgcgcaaaatagccaaggttgttgtactgtagctttttttcgcgcactgacgcatcatcctcatcaccatcatctttttgaagttgaccatctgctgatgactcctcctcatcagctaaatttgctaatgaatgttgtcaaattaaacggtgaatttttcgagattgataccattttatgcgccaacattgtgaccaaaaactagactctaactcaagattaaatcgagacttaatttttccatatgcttaatactaattaatactcgagactcttctcagagctttaaatttaattcatgccttcaagcgggaacaactgtggtgggaaatgtgtgaacgcattcagcggtgttgtgctgctgaggattgtcatattgttgttgtccataaacaaattcaccttaaaaaaaatattaaaatgaaaaaaaaagtttaaaaaattgaaaaatgattttcttactttgttgttcatttgctgccgattgatcggacccatttgttcatcatccgctccttcttcgccttcgtcatgacgcttgttgaacgctgaattgacaaaatatgatgtctctcttgatctgattacgggctattgatcagaatcagagaaaatgctaattgaattatccctgagttaagtgatcggacaatactgattgccaaagactaacaaacacataaaactacaatgatcagcagcgatttagacggatcagattagcttagggaaataaattagactatctagcagataagataaattgactaatcagtcgctaattaaggctgaatgatcagattaagcggcatacaaatgataatggtttaaattcattaatcaatctaaatttgattatttctctgccccaccttgagaatgttgtttttgttgctgttgttcaacagcagcagttgtttctgctccagctccatgttcttggccatcattttttgtctgcataggctcctctttgattcggaccggattaaagctttttcgacgtgccgacgatgaagcggatgccgaagtggaggaaagtgcccaattgttattgcttttgccaatttttggctgttcgttagcaactacaacaatggcattggcaccaccattcaaaattggcgaaggttggcacgatgccaaagcaattgccatttccttctctaatgaaataataaattcttgtttttgggctaantttaaaataat

SEQ ID NO: 20161 - DNA, 1051 bp, Heterodera glycines
  misc_feature (1045)..(1045): n is a, c, g, or t
ggagatgaacaacaggaggtagcagcagcggaaggcatgaggacaatgttgagggggaaacgacggaatgcggcgggagacggtcagcaacagttgcacaccgaatggacatggcgactgatgaggtaggtggtcgacagcaggaaggacatggcaagaagggggaggaattaaaaatgccatgctgtttgttgtacagtgccagcactgatgaccaactgcgtgccgtgttcgccgagctacgcgagatgagtctgtccgggatggacctgcacttgcgctgtctgtccaccactgctgaactggcccaatttgtggccatgctggtcgcccagatggagtgccgacgtgactttgatctggcacagagtttgttggccgccttcctcaacatccatcacagcgcattgtggacaacaaaacccgacggtaggcatactgtatttcaatggggtgcttcgaaaatttcagaattttttatcagcttacccccccccccccttcccctccaaaaaaattgagccagttagttccctctggccaattccgtcgtcggatgcatattttttgggccatatcttttctcaaataggccacattttatttacatatttggtggcattattgaaagctctttaaacagctccattagccattaaaaagcattcggaaatcggaattccgaccccaaaaatatcggaaatcgttaagtccgaagtcggaattccgtgacatccgtgcaactggcttaaaattgctgcttttcaagaaaattatggacgtccgaaaaattgtggatggagctgtcccccccccccccctcgcgtttttttaccgtttcatttataattggcattgaaaatgccggagggatgggacgagggacaggagaaatgtccaattcgtaatttactatgttttttttgtctaaattgtaaagacagcatatagaaaagctcagaaataaatgaattgctttctttggcgcctcaacggaacagcaaaaaaaaaaaaaattggtgaaatttttgtttcccaactaaanatttta

SEQ ID NO: 20162 - DNA, 869 bp, Heterodera glycines
  misc_feature (42)..(42): n is a, c, g, or t
  misc_feature (53)..(53): n is a, c, g, or t
aatcctcaactccatgactcgatttgttggtgtcaaattgtntaaattggttnttattaattacttgcgccaattaccctccattaacgagaattgtgaagcccagcttcttttgtcgttgttgttgttgttttttgttatttttgttgttttacacatttaaatatttgttgattttttattgaaaagaacagtttcaaataatttccattactaaagagtaaaagtgatcagaatcgcaccaaatttttacatggataataaaaggaagaagattaatcgtttcgtgtatttcattagattttttaaatatttttttcaaaattgccaaaaaataaatatttctctacatttttttcggcattaaaatttgattaagtgagcaatcaatttttcaatacttttcttttcccttttgccatgtgcaatgataccctgaagacgtgcgatcatctcgtccttctggcgtaacagccggtctttttcttccaattgaaggtccttttcttccagcagcacatttttttgtgccagttgaaactctttgtcgacgatttgacggtccttggactcgagctgtttgaccataaggtcggtgatgtcacgtacggcccgggcactctcgcgtgccgccgcagcgttgtcgcgcgccgcctcagagttgttgcgcgctgcctgggcgtacacatgtcccgtctcaattagcatggacttaaaaatgtgaatgtaataataaatcaattttgcggcgttcacctcgccttcgtcgttttcctcatcggaatcagaacattcgtcccgatcaaagattgcaaaagcattaggctcagtcggtggcgaagacattttgtgtgccctcggatggaata

SEQ ID NO: 20163 - DNA, 448 bp, Heterodera glycines
tcccttcccttcccttcccttcccttcccttcccttcccttcccttcccttcccttcccttcccttcccttcccttcccttcccttcccttcccttccccccatccccgtgccccatccccccatccccgtgccccatccccgtgcccccatccccgtgccccgtgccaactttccttcgcctttttaattttcattatgccaatttcacctgttacaacgtcagacttattcatatctttttgtcacttgctttgacgttttatgccttttttggaagatgaggtaaccgaccaaatgaattggggggaggggagggacagatgacactgaccaactaactaatgaactgccgctgcccgccgtttcttccaatctttgctttagtccttccttcgatattactttatgtttgatgggattactgtaacatttcggttttattttga

SEQ ID NO: 20164 - DNA, 2405 bp, Heterodera glycines
tttcgcatctaattgtacattaaattttttcttctccaaattgtttctcatcagttttaaaataatttttcttccattcttttttcgaataccgtatattctttaattatcgccccgggggatttttgttcaacctcctcagaaagggggggggggataattggagacaggggaattaatggagacaggcgataattagggaatatacggtaactcctttttttattttttctaaattttgtagatattcgttatatttgttacattcgatagcgctttaagtgttttctattagtctgcaaaattatgagccattttgacaaaatttattaatatatgtgattaggtgacgaaaataaggaatattaatgtgtttgatattggaaaatgtggtgggggtcggtttagtctggccggtttagtctggccgttttagtctggccgttttagtctggccggtttagtcagagggtcgttttagtctggcaagctgtttttgtcctacattgatccaattctgatttgtttctcgaaaattctttaaaattaacaccataacagatttatcaatgtgttaacaacaaaaaaataacaaaacattgaaaaatgaatacgggcatatttcataatttcgagaaataccaacgagaaaattgatgatattatcgggattaacattggcatggtaattttgatcattttggtgagcagggttaatgttgttgatggtattgtaaccctgtaagagtcgaagaattcgtatcaacggcacgatattttcgcgttttttgaggagggacttcaccagcgatgcatcgtgcgatgtctgcatcaattgacttttctcatatcgaattgtgttgatgaagcggaaaacagttggatataaacaagcaaagcccgttgagtgaaaaaaaaattagggtttactttgcctgaagctataaaaaggcggtgccaaactgaaggtttcgctttgtttttattttctaattgggatattcatttatattgtagctaaacatagatattttaagtttttccttatttataattgacaaaaaacagttgtaagaattatgggcgaaaacggcttgccagactaaaccgaccctctgactaaaccggccagactaaaacgaccctctgactaaaccggccagactaaaacgaccctctgactaaaccggccagactaaaacgaccctctgactaaaccggccagactaaaacgaccctctgactaaaccggccagactaaaacgaccctctgactaaaccggccagactaaaacgaccctctgactaaaccggccagactaaaacgaccctctgactaaaccggcaagactaaaacgaccctctgactaaaccggccagactaaaccgaccctctgactaaaccggccagactaaaccgaccctctgactaaaccggccagactaaaccgaccctctgactaaaccggccagactaaaacgaccctctgactaaaccggccagactaaaacgaccctctgactaaaccggccagactaaaccgaccctctgactaaaccggccagactaaaacggccagactaaactgacccagtccgcactgacccggtccgtatatatcagggttaccctttgtccttatttgtaagatttgtccttattttgagggtccaaatcttacaaatttgaaatgtccttatttgtaagatttgtccttatttaagctctttgtccttattttcatcttattttttggattcagggagaaatttagatttttaatgataatttttgaaagaaatgttttttgaagcgaattaatatgcaaaatgttgacaagattcagttaaatattcaaatttttctctcggcggtttcttattctcttaaaaaaattagctcaaaatcgtaattttgtcattttttgaacaaaatcgttaagaaatcgcattaaaaattacaaaaatatttccggcggcgcctattagagcaggggtgtatctgttcttatttctaagaaatgttctgatttggggtagtgtcttattttcatttaaaagaggaaatttctgaaaaatttggctaattcctaacaaaattcattaaaaattcttaaaattttcccccagcggcgcctatcggcaccgccggccccccaaaactcctattttttcttaaaaattagcccaagatcgcaaattttggtcattttttgacagaacttgttaacaaattgcattaaatttttaaaaaatttccctcggcggcgcctatcggcaccgtcgaactctcttccctcatccatacccaaaaatttttcggaaaaatgcaacgaaaaaattgttaaaaatatgttttctttaatggtaaatgcactgaaatttaccaattgcttatgtttcga

SEQ ID NO: 20165 - DNA, 1436 bp, Heterodera glycines
atcgaattttcactaaaaaagttaagcctacattttttggtatatttaaaaagcaattaaaaaatttttaaaatttaataattttcctgcaccgaaggtactcactcggcctcttcgcggcctcgtggtgggccttcgccccccccccctcccacgcccttcagagcacgacaaatatttcaacaaaaattttgaaaaattgactagagcaatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattattaaaaatttttagatttttattcatctccctttttgatagtgaaagcatctgagtgcctaaaataacttgtaaataaaatttggtgcgtttcagagcagtttgtgaaaaaatatttatgaattaattttgctaaaaaaataaaatagtgaagctttaaaaattaataaaaaattttaaattcagaattactggagttagcatcatagcagtgcttttccttgtctttttgatgccctcgcaaaatctggttcgcttctgatcagtttataaaaaaaaagttaagcctaaaatttttcgcaaatttaaaaagcaattaaaaatttttagattttttattcatctccctttttgatagtgaaagcatcagagagccttatttaacttttaattaacatttggtgcgtttcagagcacgttctaaaaaatatttatgaattaattttgcaaaataataaataattaatgaaa

SEQ ID NO: 20166 - DNA, 2648 bp, Heterodera glycines
atttaaaaaaattttcaaactgaaaaatttcaacaaaaaatagtacaaaattttaaaaaaaatttgcaattttttaagcgattttttcaaaaaatcttttttcttaaatttctttaagaaaaactttgcctttttttgaaaatttctgtttgaaattaaattagtttctgacccccgttgcgcccggcgacaattttgctggcgcagcagcattactcagttgatcattagaaatcgccggcaaaatgttctgtgcaccggaggatgcctgcttaaagtgtttattattgaattcacattttttatttcagtatttaattgaaataatatttataattataattcatttaaatttaatttaaatattagtaatgtccttttcttattcactttgtttatatttaaaataaataatttaaattttaaaatatatttaaaactttaaattattattttttcttcacttttgcagccgcgactaaaccacgtaatcccccgccaaagagacctccgccaccaatctataaatgacaaaaagttgcttaatttgtacaaaaaaatgaaaaaaaaaatgccaaaacgggtaaaaaaggtggcaaatcaaattaattaatttgaagcagaaaacgggattaatgggaaaatttgaaaataattggggagatttggggtcaggcacattcaaaagaagtttttaaaaaaatttcgacggggggacctcgccaataaggccgccaaatcgggtggtaagttggcgcgccgggcgcaacagcaaattggctgcatagcggcgccttaccatttccaactgtgcacaaaatttgggaaaataaaatgggaaaaaatgattttaaaaaggaaaaaattcaaaattaatgaaaaacatcagtttcggattttttgtcaatgacttttttttctattgacttgggataatttaattaatatgttcgcgcttttttcgcactatttgacatttcattttatactttttggagctttttgtgacctttttaaggttttcggaaaactccgaaaatgcaaaaatttaccaccttatttataaggttttatttttatttgtcgaaatttttggcatttaaaaaatactcttttgaaattttcgaactgccatttattgcgcgtttgtttcgttctaaaaattcgcaaaattatgttgactgatgccctattacttaaatgctgatgtaaatctaaaaagcgacaaaaaatagttaagaattttcttggaatttaaaatgttagcaattaccttccgttgggtaaggggatattagcatttccagtgtacggtagaagaaaattattacggtatgttaattaagtgcaaataaaataaaaaacaaaactccaccacctcaacgcccgactttcgtgctcgccaattctccaaaatcagtaggcctgcataaactttgccaaccgtcaatttttggaagcaaagatctgaaaaaatgaattttttaaattttttaattatttttttacccccatttggcggcaccaccaaatcgatcatatttttctttgctttcaatggccaaattttgcgcaatgtctgtcgcaattcttcatccgcttcatccatttcttcgactataaaaatttttttaaaaaaggtaaatttttcgaaattctttgctttatccacctggcctcattttgatgctcaacgattcgcgaataagcgcaaaaagtgtggtgctgaaatggacagtgccatcatcagaaactggccttaaaatgaataatcaaaaaaaaatttttttaatataaaatgaggatttatttactcattgtcagggtggcgattttgaccgtttttttgtggggggagcatttgtcccaattttggcccacccatgttaaacatttgaaaatttacaaagtgccaattttttgtgcattgtaagcgaatttgtctatcaaaaaatataatatttgatcaatcctatgcgtttttgattgatttacatgacacaaaatgtgaaaaattatatggccccttttgtccccattttaaaaatttttcccccattctgaagcgcacggcacctcccatttaggatttttaagatctccacggtggatttatttaaaaaaaaacacataaaattatattaattgtaatgcaatataaaggctttacatgttcatacgaatcagatgcttgtaagcaagacgatatggacattttcggccaaatcccacgggtggggcgatgttacgcagcatttcgtacatatccgtgtaatgaatgcgaccactgtatgaaaattttttcattagataagcacaaaaaaaaataattttgtcctaattaaatatttgatgattttttttgaataggacagttttgaaaagcaaaaattttttgtttgaaaataaatttttgaaaaaaatggcacaaaaattggcgtcaaggcattagcacaagaatcccgaaatcaatagacaaaaaataattctcgaatatactcgaaaaagttgaatttcgcgttttctcatagtaatttcttttttaatgccaatatttgctcttttcttgcatttataaaatcccgagactttaagctttcgtttgataccaataatataagcattgaccaagtaagaaaaaagttatg

SEQ ID NO: 20167 - DNA, 2025 bp, Heterodera glycines
atgcaagtaactatttttcataaaaaatttatatattttaataattctttttaataatttttttttaaatattttagagaaataaaaattttaaaatattacaattcaaaaaaaaatagacttagttttatatagctaaaatttttaaatgaaaaaaataaaaatttaaataaatttcattttaattttaattttgaacatttaagatttacaaaaaaagtaactatttttcattattataaatttagattttttaaatatttaataaattaaattttcaaataaaaacattttttaactcaaaaaaaaggaacaattgtcgagtggtcatcgaaatgtacacgatgtgcagaagaaaattcgccaattggaactggagaaggaggagctgcaacatgcgctggacgaagctgaggcggcgctggaaattgaggagagcaaagtgcaacggttgcaaattgaggtaaaaaaaataatgaatcaattataattaagtaattaattaataatcctctgttttgtccacttactaaattttttattaaaagaatttatgaatagattttaatttgttttgctcaacgaactcgattttgagaaaaaatagaaaataaaatttaatttacggatatattttaatatattttttgttcgaatccaaccaggttcggggttctgagttggatgaattttaaatattgttgttcaattgaaagtttcgaacattttttgcaaaaaattggccgcactcttttatttttacattttttaaacaaactttcataaatatttttattgaatatgaatacattgtacccctaaatatattttaaaaaagtttaaattatgaataaaatcaaaaatcgaataaatttaaggttatctccataaaatccaattaattaattaatttcaaaatttcaaattgaatcaattaaggttggccaaattcgtgcagaaattgatcgccgagtgcgcgaaaaggaagaggattttgaaaacacaatcaaaaatcatcaacgagcaattgaatccattcgtacatcattggagaatgaacagcgaggaaagcagcgattatgcaggtaattagattaatgatgatattaattaaatagtataatagcactggctaataatatttaattaatttttaatggtcgcagtaattagacataattaattaatactctataattgcagtcaaagaaaaagctggaaaccgacatcaatgatttggagttgggcttggacatggccaataaaacaaatatggaagcgcagaaaacgatcaaaaaattgattggccaagtgcaggatcttcagctgcaggcaagtgaaccacaaaatttttttttgtcgtgttaaaatttgttgccactagtgattaagttgtccaggcatgttttgtgctctttctgattttgggtgtctcgattatcatggagtggtctgatcaaaatggttttctagtattcccgttgatcactcactgatcaccggcatttttacttgaattacatttttggcggagaacggaaaaatttgctagtttttttcataattttttttcaaaatggttcattcaggttgaggaggagcagcgtcggcgtgaggaacagcgagagaactttttgatgagtgaaaagtgagagaagaattaaaaatataattaatattttaatttataaattattcaacaaaaaaaaatcttccaaaatttaaattatttaataaaattaaaaatatttgtttcaggaaattgaacattgtgctgtccgaacgcgatgaacttgttgtgcgccgagagcaaatggaacgggataaacaacgggtggaagccgaagtgcaggaggaacgggcgcgcaagacggagctgcaaatggacaactcacagctgagcgccgcgcgacgccaagtggacaatgacctacaattgacgaaggcaaaaaatataaaaataaaatttgaataaaatatatttcaaaattgaaaaaatgacaattttaaaaggctataaaatga

SEQ ID NO: 20168 - DNA, 966 bp, Heterodera glycines
tataaaatatgtattatcgtaagcttattagaactattatattatatttagtaaataattgcaatgatccaaattgccaaatttctttcatttaaattttaacaaataaccatgatcttcgtactactgttgacataagtgcatatttgacgattttttgcaaatataatccgatcgctgctaacagaaattattaaagtaaaactttataattaattataatcaattaatttaattcattttctaatattcccaaaaaaccaaaaactcaaaaaattgacaaataaatttttataagatttcaataactattcgtgcaaaacattttataatccgaataatttaactacaagaataattcttattcaaaataaaataaattcagaaaattttcaacttgatgtatgcaaataaatagattcattacaaaaaataaattcataaattttattttttatcgaaaataaaattgtaatccattgaaggagagaattaaaatatattctatatttttcaatcaacttagttgaaatgtaaaaaacaaaaaattttgattaatttaaaaaattatagtaattccccattaattatataataataaattattgaatttttaaaaatttaaaataattaaataaactatacataaatatttattatacgctgttagatttcgccagtgattgatttcgccagtgagtgatttcgccagtgagtgatttcgccagttggatttcgccagtgtgtgatttcgccagtgagtgatttcgccagtgaattatttctctttttctcgccgtctgtatttgatttcgccagtaattgaactcgccggtgattgttttccccagataaggcaaaattcaacccatggacaaattttaactatataaaattaagaatttttattattaatttcccggccccctgatcattgatttagttttctttgaaccgagttccatt

SEQ ID NO: 20169 - DNA, 2654 bp, Heterodera glycines
  misc_feature (92)..(92): n is a, c, g, or t
ccaattactcaccatttgatactcatcttggcttctatggcaccgcaaaaggatcgcagccctccgatgaggaggaggacgaccaatatggngggaaaaaacatcggtgttcgccaggttctgggcggactgtgcgcgattgtttttcgcaaaataacattttcaagcaaaattaggatacattttttgactcagttttttgccagtccattttttggtatttttttggccgagttttcttggctttgaattttacaggttttagtgtgttttattcctaaaaatttcggagctttttttaaagtttgtcctttttagacagcattgaaccgcttcctactgtggctccggcgcatgcgaaatgagttgaaggacgactttggctcaatccttctgttactgctcctctatttgctccaggtttgtgaacttaagtgaacacaatgcacgaaatcaaaaacaattctcctttctccatttttgccatgtcaatagtgaaagcctatattatagggcattaaaattaaaaattttgtccattgttaattttccgaattttaactcaaaaatggtcgaaaactcaaacaactattaattttctctttccataatttactgtttttagatgtcaaaaaatatattcattgtttttacatgttttttggatttccagggcgttcccctcggtttgatcgcggccattccgctcattttgcagtccaaggaaatcacctattcccagcaggcggtgttctcatttgcttattggccattcaggttttacttcgaaattatggcaattttcttttttagtttttttaaaaaattaatttggtcctttgtttgccctcgtttttttacatttcccgttttcagtatgaaattgctttgggcaccgattgtcgattccatttactttcggcgcattggacggcggaaatcgtggatggtaataattttgcattgaccgattttgcatatttcgttataataatttaatcctgttctgatgtaatgctgtttcctttttttatttgaaattatttttcataatttctcattcaactagggcgggggttgctaattttcttaattatttcactaaaattacaaaaaaaaaaaaattttcaccttgacgcctattatcgacatcgccctcaaaatcggtgtttgggtcaaaccttcgcaaaatttatgtcgactcccccccccccctttttaatttatgcatatcatcttacaatgtgttcgtctcgactttgtgtcttaaatttgtttttcaaatttcaggtgccttgtcagtatttaatcggtctttttctgctcgtcatctcctaccatgttgaggaaatcctcggcaccgaggacaaaacggggagcagtgagttcatttacaaccttttcaatctcaaattaaattacataccaaaaacttgacctttcttaggaacctaaaaagcaacaaaaaagatttaaaaatttaaatccaatttagtccatcatttagaattgttgcactaatctgttcattatttttagaatttgacctggacctgtatccaggcatgaatttttcctgggcctggatttttgtccaggtccaaaatggaattgtcaaggcttttttcgaactctaattactgctattttatgcaaatttctacacccctaaaacctatttgttttgatgggtatacataaaattgcattttatttcaacagaattgccgcccaacgtgtactttttggtctgcgtgtttttgcccctcaactttttggccgccacgcaagacattgcggtggacggatgggcactgacgatgctctcgcgcaaaaatgtcggatacgcgtcaacgtaaggcgaatttttaattggaaaagaattgctcatcagtactttcattatacaagttttttttggtaacttaaatcaatttgctttattgttagaatcaggcatttttgcgccaggcccattactaagagagaaaaaaatttggatgggaatacgaatacttttttgttatttgtctccgaaaattcttcaaaattttaggcgcattgcgtggataaattagtatttttaccagttttttgccgaaaaatgatcaattttcagcattctgggtcaatttttgaaaactattttgatccaatgatgcttacaggcgccatcaatggaaattttaacggaatttgttaagaaaataataaaaagtttaaaaaattgcattcatttttctaacaataaatcctttttaaatgcctgtccaattttaaatggcttgctccttttttgtgcttgtctgtgttaagtgttttcaaaaaaattcacgaatgtttttgtgaatttttaaaccgttattcgcgatgaattttctctgtaaaatgtgattattaacaaaaaaaaaatcaaatttgtctttttaaaatgtatgaccactttttttatttaattttataattttttgtatcacactttttcagttgcaatgttgttggccaaaccatcggcttcttcctgggcaatgtcgtctttctgaccctgcagtccaaagagtttgccaacaaatggattcgctctgtgcccagtgacaaaggactggttcaaaatgacggtaactttttttttgaaattttaaagctacacttga

SEQ ID NO: 20170 - DNA, 1417 bp, Heterodera glycines
gcctcgacttgctggctgtgacgctataaaccgtggcgataaaatgataacaaatcggcccgctttcgttgcttttggtctcgccgcttctccgccgtttgcccaccgttcgccgttgttaccgtaattctcgctctgttcgctaccgtactcctccccctcaatgtcttcgtcataatttgctatttcatcacttttctcttcattaaattcgtccgattttgagtgttcgattgactttgactttctttgtaaatcagccaatcgcatgccgactttgatgccgtcattgaccaatttggcaatttgctcattcaatttgcccactttgctaccgtacgccgttgtttcatcggcggaattcattgtcatatatttttcatttgtaccaattgttgccgattttgtgggctgaataaagcaaataattattttttttaataacaacaaattaccatttgtttgagcgcataatccctccattttttctcttcctttttcaactgattgtgctccctttttgccttttgtatttttgaaattgttttttgccaacttaaaattaaagaatatttattttgatttactttatgaaattgaatatcgtatatttttcattccaatttccttttccctcttacggtattgtccgtgttttgtttttcttttccaatatgccactcatcaaaaagcgtgcaaatcctccaatgggactgaggccaaatgttcgttttgcttcaagcaaattgtatgaatgacttttcgaaattgcaatattttggcgttttcttgccaaaaatcctttgttcaaatgccgctgatttccggcaaaaattgcttcccttttccgcactttggcaaattcgaattttggcattgcgctgtaataaccggttttacttgaatctaaataatgtcggcaatttaaaaaaaaactcaaattaaagggattaatttacagggaccgagtttgcatatattttttggcattttttagcggctaattaggtagtttaagaatcacactcctaattatacaatagtaaactgagtttcaaaaatttttcattaaaaaattatttcattattcggcattttactgaccattcacactttctttttcccctgaactgctttcgtgtcctttttcatcatgtcctttttctgtccttttctgttgtccgctttcttcgtcactttcgctttcgactcgaatttctcccacccacttttcgcttttcagcatatttttggtgccatcaataattttggcatttttgagcccaatttggaattcgttgttcaacagccgaacgatgcatttggccatccgtggcactgtctgtgcgccaaaataacattcgttgaattggtccggcaccatgcctaattggtctttgttgggatacctttaaaa

SEQ ID NO: 20171 - DNA, 1718 bp, Heterodera glycines
gatgaatttttattttgttgcgctttgttgattaaatttgaaaaaatgtcatattttaagtcaaaaatgagatttacttcaattaaaaaacggcttactttcaatcagtcgaaaaaataataaataaaaaattctcaaaaaaaataacataattcggctggttggactatgaaaattcaaaaaatctcattgaatatttcacttttctaattgatttaagtaaatgagaaaacaaataaacatattatttctcagagcttggtgatttaaataataaatatttgttttaaaattaatttaagtatttgaatatccaattagtcccaattttttaaaatatttttttttaattaaaaaaaacaacatttattaatgcctcacccgaaccgcgtgccgcagcgacagcagcggctgcagcaatttcagcccgtgccctttcattttttggcgatgtttcaccgccgtgttcagcaccaacttcatggatttcacgctcaatccgttcaaattccaacaaacttccattggcggaactaaaaatttacaaaaaaaaaaaaagaattacaataattaaaatttacattaaatttacccagcaatttcctgcgatgttcgatgctgctgacgtttggctggtgaagaagtaactgaaccagccgacacagagcccgaaatcatttcggcaccagattgttcatcggaaatctgaaggacaattaagaaaaattattaaaaaattattaaattaccatatttcctataataaaagcccctgaattagagcacccctgaaataaagccccccttttgaagggagttgaaaaatatcccaggggttctattatatgaaatacgtttaaatctaatccagggctgtcaagttttttaaaatatttatgagcaaattagacctcccgtaaagaagttcttcaaaaaaaatgttttgaagggcatgggtccggcaatgccaaaaagcagtttatggacaaacttttttttgaattttcatgaaaaatgtaaatagtttgtccaaaataactaaattgaggattttaaagatttctttttttttgtttgattcgaatttctttccaatttcaaagatttcagaccatctaaataaggacaaatcaatcttggaaataagggcactaggcagccccctgctaattctgatcataatcacttctactttggagacagatgaaggtgccctttgctgtggcattatttgttggccctccattttttcttcacgctcgaaaatctttatccctctgttgtgctgatactcatcctggtcaaaatcttcttcatcttcaacatcaataatgttcatcggttccgtcgaagtgtctaaatttcatattttttaattacaaattttacattgtagattctattatttaggatttttttaggtcctaaaattctaaaaaatttcgaaaaagttttaaagaacatgcagtaaaacaaaaaccaaaacacccgttaagaactcaaaattttttgaaaatttaattcctaataataatttattcttcaaaaatgttttttctttaaatcccaaaatcggtatattttttcaattgcctatttttaccctcatgaagcaaaaacaattcttcgtcctcctcttcctcagctccatgcactgctcggacacgttgcagttcatgttgctgtttttcgtcgaccatttgtcgctgctttctcca

SEQ ID NO: 20172 - DNA, 2466 bp, Heterodera glycines
tattttatggtcagatgatacaaatacgtctttttcttcgttaaaaatttgtttagacaattgtcataaaataaggaaggaaagggttgaactcatcggacgacaccggcaaaagagtgaagccgactttcacgtgaaaaagaccaaagggacgacgacacttattccgttggtcagaaggccgtcagtgaattggccaccctggagtaatatttggtcggacgaaaaacgccataacttgtcgaagttggcggagcattgtaacgcgtggagtacgagccggtcagcgtggacacggaggaggggcgaccgtaagagcggtgggccgaaatgttggcacggctggtggacccggtggactgcagcctgttcaagaatggccaaatgttatgcctttgccttgaatttgcccctccttttttggcattccctttggcaattaccccccccccccctttttcggcgccgcttttcccccttttacccaccaatatttggacaatgtgctcactgtcatacatcttttcttgaacaaatcaacggcatcctccgttggcatatatcttgacatgtttttgatatgtgttcactgttcggttcaaattgtgctcaactcacttcacatacgaacgaatgggcgccaatggcctttcgatggaccgttctctcgagacggggcgcgagaagatgccggagttgtacgagttcaacttgctgaatgggagtggtgcctaattgggctttcattgccccccccccaacccctccagccatctctttgtgccggtgtcttttatgccgtaataatttggtgacttctgaaatggcaatatgccatttgctttctgttgctttcctttaccatttccgtttgcgttttgatgctaagtcccgtctcaatgttgccgtaactgtagcggacaaaaggatctgcaaaaaggagaagcatttgtcagtttcgaagtgagtctgacatttgtccgtgtaatggggcgtcggccgttggacggcgatgttgtgaaagggcggcgttctgtcgagggcggacgaatggagaccacggccgaacagtgacaaggacgaatctgagggaagtggggaaatgcaatcggaagaaaagcaatgggcaggcacttgatctgctcaacgatcgggccataaatccgccgccatagccttaagagagaattacggtcacaaattagtccatttgattgtttggcgacgaaaaatgaaagtgaaaagccgacagtaatcgccgcgcctaccgtaactgggcagggtgaaaccgcccgcactattcgaagtgaaagaggcggatcgtctgaatgaagcaaacggatttgaatgcaaagcaccaattgacaaacgtccgacggtaaccgacaaaagtgccggcacgagtctcagagcgagaacgagaacggaccaatggcgaaacgtggtgatgggccggcgtggtgatgagatggtccattacgccggggaccttccgcttcaaaaatggcttaagaggaggcgagggaaaagcgacaaagcttggaaagatggaaaatcactggcaaattgacattttgagccaacaaatcgtccaaattaaaggtgggcacagaacatcagcggcggatgcttttgctcggagacttggcaagggaagcttcggacgcctccgtcgatcaaaattccccactctctgctaatttcccgatcaatcgccggcttctcctcccactcattcctcgccattctccgctttcccttcttagttcaaaaagcgcctctttgttcattcattcatttcgattcattgattggttggacggatgaaacaaatgctccttttcctttctttcccttttctctttttcctttcttttcaatttcccttttcgtctcgcttttctcttatacattccttttgcctcaagggcattttggtttcttatgtatgtttaacttataactagggatgtcaaaaatatgtacaaaaattggtcaaaatatgtacataaatatgtaaaaaaaatccccaaatatgtaagaaatatgtataaaaacccaaaatatgtacgaaaatatgtaaataaaaatttttaaatggttattttttgggaaaaaaccttcgtaaagtgttaaataggcacaaaatggcataaaaatgacctaaatatgtttagaatcaccttttaacatttaaaaaattatttttggaggggtacatttaaaaaaagtttttttttaattttttcactagaaatttctaaaaattttcaaaaattctcaaaatatgtataaaaaaataagaaatttgccaaaattttggatttttttttgaggatttccaaaaatttccgtaaaaaacccgcaaattatgtaaaaaaatcaaaatatgtaagaaaaagtccaaaatatgtaccaaatatgtaaggagaccgaaatatgtaaaatatgtataaaaccccgaaa

SEQ ID NO: 20173 - DNA, 1061 bp, Heterodera glycines
aaaacgtgccaggtgatttcgacagtgagtgatttcgacagtaaactatttcgctttttttcactgtctgcgtgtgatttcgacagcgagtgaattcgacaataagtgatttcgacagtattaaaaaaattgtgaattcgacagtgagtgatttcgacagtaacgataattttttttaaacacgagtatttgaaaaattggagtctaaatgaagtgatacagtggtggaaaaaaattttgactcaagaatcttgagtcaagatgattaaaaattcgtaaaaatttaaatttcgactgaaattttgctgattataggaaaagtcttgactcaaacatgaataaccaacttatagatcatttaaaaatctgagattattcacacttgcttatatttttatcctgatcaaaaaattcttttacactaacttgatcagatcactccttcatggtgatcgggagacataaaaacgttgaaaatagtggattcgtaaaaactctgggaggttgggaaaatccccaaggaaaatttcgataagcccattttaacgagcacaatatttactaccgaattttcttaaatggtatggctacgacttgacataaaaaattataaatcagaaaactttcattcaaattaacaatagaatcaggccattaaatcaataaacaaagtcttaaaattagtacataatttcttaccgttcaaaattaatgatattaaaattagaaattacatgaaaaaatatatcgaaaataatcaactcaaacgtctgatttatttatcctataaaagacattttattaaaccaataaaaattcatttataaatagtacaaacaaaaagaaacatcaaaggaagtagcttttgaaccaaaaatgctaaattcgaaaatttggactttcgactttttgttcgagtttgggtccggggtttggaattgaccgaaatggataccgaattcgtggtcagagccctcgaaaacgcaaggaactttatgacaaaaattttcactgacgcattttctactgacgctttttccactgacgcattatccgggcgc

SEQ ID NO: 20174 - DNA, 1147 bp, Heterodera glycines
tagacataaaaatgtactttatttgccaaagaaaattactaaacaattactattgccgaaagtacataattttgatgttatcattgttcggaataaggatgtactaatgtacctagcaagctaaaccaaacctaaaattaattaaactatctctagaattagaattctgatgaatggaaattaaaagatagcctgaagattattttcggtttaaaccttaatagtaacaattgtgtaaatagcaatgtatatataaatgttaatacaacaaaaaactatcaaaattatgtttgaataaaatatgaatttttaatgactaccgcacaaatttttgaagttaatgcagaaggaaaaagcaaatgccgactatttattattgaaaacagaaaagtgtaacaatatctaaagttaaaaataattttaaaattactaaaaatttattttacgatcattagaattttaaattataccaaaaaaaaaatgcaattgtattaattaatcatgaaagcagaataaatttaaaatatatatagtaaaataaatgataaaaaatttgtaaattcacataaataaaatatattaacaaaattatcgcattagataaaataaaaattcttgtgtataatgtcatttcatcgtaattttttgaaaagccccaatttcccgcacccaacgggattggggtagcaattgatgtcaaagtaaaaatatcaaagaaaggaaaaaaatgtaaaaataaattaaaattaataaataatgtgatataaaaattattagaaattgatgtcaaagtaaaaatattaaacaaaggaaaaaaatgtaaaaattaattaaaattaataaataatgtgatttaaaaattatatcttatgcgtcaattatttttacttttttaattaaaataaattcgaattttaagccagcaatttattaaatcaaaaatttattttacagggtgaagtatggatttggtctaatgaattcaataatatacgagaaaagagttcaaaattatcaaaaacaactatcaaaattctagtgataaaaagctattaaatatacaaaaaaaaatcgaagaatttcactgtaaaaaaataaatattttaaaaagaaaacaataaatataaatatgtaattaatataatag

SEQ ID NO: 20175 - DNA, 1137 bp, Heterodera glycines
gaaatttgattataaaagcccccatttattccttttatggcgaatctgaaatttcataaatgtggtaatgacagattggcatttccaattttggcacttttctgccggtggcacctgttaggctgaactgagctaatgcgaaaattatttgtgctctacttatgcttttatctgaacaaaaacagatagagagacttaagatcattttttacaaatttgaattttttttttgtttaaaatgatgtaattaaaattgaaaatccaaaaattcataagtttaaaagtgcaagtcgccgacaaggcattttttggcttcaaaatgccggattaaatgatggtaggataacattttacaagtcatctgaatggtggtattttcaccttatgaggggattctttttaatttttaatttttgaacttcgaatttcactaaaaaattcattaaaaaaataaatatataaataaaacatttgaattaatttcataattattttaattatttaatgaagtttaaattaacagaaatttggtttgaataattattaaaaaagaaataagaaaaatagaaaattttgtgatttaactattttatgtgatttaaataaaaaataaaaattcttaaataataaatacattaaagaaaattattttctttaatttaatattattattttaaattcattttaattggcttttcaagtgaaagaaaaagaaatagaaaaatttattttaaacaataaaaaatttgtactaatatttgttgataactaaaatgaactaaaattccaaattcatgctttacagtttaagccacaaatgggccaggctcattagcaactttttttggtcattatttcgagaattagagaaaatagcggggtattaggtgttaatggctccttaaaaagttaaaatttacggatacatttctcctaattcccataagacagcttctgaaatggtaaaccgaaagattagctgttaaatatgtctaaaaaccttttttaagagccaaaaattgtacacaaacaacatttgagagagaagcgttaattaggtaaatgctaatcatttgattaattgggctaattagtaaaggtcagatttataaagacacaagtgcaaaatttagtctt

SEQ ID NO: 20176 - DNA, 991 bp, Heterodera glycines
  misc_feature (174)..(174): n is a, c, g, or t
agctcagcccatcaacacaaaccgcatatattgacaacaaatggtaacaaaattcacaaatttattgtaacccactgtttttaattctatgagatttcagttggcggtcacttaccacacgccgcccgaaatccgacggaagacgaattagtgggaccgaataaacgaaacatntaaattgaaaattaataacggattaccaagcgagaagcacatgtgctacagacgttgttttatttaaacgaataaagaacaaacggcggaaaagagggcggggggatacaattacaacatcggattgcctaggggaatattgtatttctcataagcatgcttttcgaggtgacttatgtcatgtgtggcaccaataaagtcgatttccagacgaaatggcccctcaattctgtccatgagagtgattccaatcgagctcaaaagttttaggctcacagggaagtaaattcagaccgattcgttacctcgccgcccgagggtccaacggatattgaacatcaattgcacgcccttcgactgtgaaaacgaagcgtgaaaagggaatcatttcgaattgccaatgggggccgccgtgggtgtgcagcaaatacgtgtaggaattgccccaagtgatgtccataaactgcggaatgtgcaacatcactttgtaagtgcgaccatcgccacggcacttaaaagaaaaaatattgaaattgcaaggatttgttgcttagaccttgatcagaagatgggcgtaccgccccccccgaggggacaaaaagtgttttttggagccaaattaggaggcttatgaaagcgtcgtgtaaattacatgatgtgcgggaggggacagagcagtaccattaaattatgtaaatatatttgtattgaatttgccgaaattttcccgtggatttgcaaaatgccaaaaaaattttggaattttttttttgaaaaagtgaatttgtaagctgcaaaattttgaaataaatttaat

SEQ ID NO: 20177 - DNA, 1284 bp, Heterodera glycines
cgaatgtcccccgaaaaattaaaaaacgggcgcgaagcgcccgtcctgaggccgcgaagcggccgaatgtcccccgcaaaattaaaaaacgggcgcaaggcccgtctgaggccgcaaagcggccgaatgtcccccgcaaaattaaaaaacgggcgcaaagcgcccgtcctgaggccgcgaagcggccgaatgcacttgcttatcacttatcaaacgcgcatgcactagcaacgaagtcctttgcgcgaagcgctcatgtcagcgcccgcccatatataccaaaagtatactgtctacaccgagcaattactgtgcaaagcatactgtctacaccgagcaattactgcgcgacacgctagtttatattaccatagagaaaagttggctttcgtcttaaaaactaatttgagtcgaacggccgtcgggaggggtctgaaagtggtggaagggtcttacaactttttgaggcgcattcaggaaaactataggttttccgctccggtggccagttgagcgccagcggcgctgaaacggcgtcaaaatttttttgtccgtctttggtggcctgtaactttgcgggaagaagcgggagcggaaaatgcttgctggtaggattttaagttggaatgtttgggaaaacttggcgcttatttggcggggctatctgtaaatgccaatgctgcagaaaatggcaaaatttggcacccaatttcggcattttccgtttttcgggactcgctgggggttaagcggagcgggttggcgccgcttgagcatttgtgtagtttttaaagctgcatccgatggcgttttcagattttgaaaattttcaaaatttttcgagctaggccccctcgaaaatttttcgtttttgaattttattattttttgccgatttttcccaggaaaacggagaccactttcaagcaaccgtttttcgagctctatcgattggtggcatttttgaaaaaatttcaaaattttccggaaatagaaaaattttccggaattgagctccccatttccgttcaaggcttataactcgtcaggcgttgattttagcgaaaatttgtctaagagcatttttgtagagaattttaagctctatctaatgtgctttatctcatgtttttatcatgaatttaaaaaaagttataaaattaattgtgattttgaaactcaaaaccataggggggaccccatggttttgcatttcatgaaaaaattttgtactcataaattacccaaaatgcatttttatgggataatttgaggggctgcata

SEQ ID NO: 20178 - DNA, 1913 bp, Heterodera glycines
cttctaatcctatttccctcttctaatcactgttgtaccttttctaatcactgttgcacctcttctaatcactgttgtaccttttctaatcactgttgtacctcttctaatcactgttgcacctcttctaatcactgttctaccttttctaatcactgttgcacctcttctaatcatttttgtaactcttctaatctctgctgtacctcttctaatcactgttgcacctcttctaatcatttttgtaactcttctaatcactgttgcacctcttctaatcatttttgtaactcttctaatctctgctgtacctcttctatttactgttgtacctcttctaatcacagttgtacctcaaaacgcgttaaaacttgacttaaaatgcaattttaatattccgcatacaaaaaagctaatatttgaatctattcttgcaatttaaacagatttaaataatgttacatttataaagtaaaattgcctattacttttatttattttgtttccgaatttagcaaccagaatttcttgaaataattttatatttatgatattaatcatttttcgtatcaaaaatatgactatcattgtctttggtccaattatttgctgagaaaataatgtatcacttatttatattaaaatgaaaattataaactaataaagaattaaaatttttattattctcaatacataccaaaacttgttggtgcacagctagtaaaataaaaccaattattaattttattaaattaatgcatgcaaaacgcgttaaaacttgacttaaaatgcaattttaatattccgcatacaaaaaaagctaatatttgaatctattcttgcgattttagcagttttaaataatgttagatttataaagtaaaatttcctattacttttatttattttgtttccgaatttagcaaccagaatttcttgaaataattttatatttatgatattaatcatttttcggatcaaaaatatgattatcattgtctttggtccaattatttgctgagaaaataatgtatcacttatttacattaaaatgaaaggtcttataaactaataaagaattaaaatttttattattctcaatgccagagtgcgagtgtgtgatcagaagttgatcagagtgggagtgagtaatcgtaaaataaatgattagagtaagagagaaagatcaaataccgattagtactagtagtaatcagagagacaaaatgaatgagtgagtgtttaaagaaagagtgcgtgacacaaagagataagaatgagcgggtgatcgcagattgatcaaaaaatgatcaatgtaagagtgtgtgatcacagagtgattagtggcatgtgagtgatcaaaaaagagagtgggtgagtaatcaatgattagagtgaaaaggaataaatgagtgctcatattgtaagtagtgatcaaaaaaagtgaccagatgtaagtgaatgcctgagtataggaccagacatgatccgagtgaaacgtaaatgaatgcatgaatgatcgaaaatgctcagaaaggctaatggtactcaatcaaagattaaataaccagagagagagtgagtgatcagaaaatgaccagagtgagactgtgtgatcagaaaatgatcaaagtgagtatatgagtgatcaaagtgaccagcggtagctatatcttaatgatttgtagacagtgtgcatatggggcttgtgagtgagcatctgttgatgtatgagtgaccatgttaatgtacgtatgcgtgcacgtgcgtgtgcgtatgcgcagtgcaaaaaaaaaagaatctgcctggaagtgtaggtgaagttgcatgttaggtgcaaatgtgtgttatgtgtcctgtgttttcggtgacagtggcagactacacagatataggtgaaatgcgttttattt

SEQ ID NO: 20179 - DNA, 2276 bp, Heterodera glycines
  misc_feature (55)..(55): n is a, c, g, or t
aattcgccggtggattcctcccattttgcgtacttcacccaattcgctattgcanttcgattcttccggatgttgtcctcaaattccttgcgacgccttctgtgattctccgccaattcctccgggtcggtgatgcgaacttttggcggtggagggatcgccttaacgggacgaatttgttatggtaattgttgccgaatcaaacttaaaaaagcatgtttaaaagtcggccatacgaaactcctttcctcgccgcccccttcccatccaatgaatttttattggcaaaatcggagggtattttcctgttgagtgagtacaagccaaaaatttaaggaaccatcaaaagaacgtgcaactcacctctcggaggcccaactcaaaaacagacaattgagctcactttgcgttcggcaaaagcacaaaaaaacatacatggaacagatttgtaagtatttctacgtgtgccttgcctttttttgttgattttttataattttagcttgtagtcactaaaaggaaaccaatcggagattgactcatttccatgtctttgattgcctccctttcctccaattacctccaactcgcgctccttcgcttcacgcaaaagttgctcggcagtgatttgaacgacggccgccgccttaagaggaaaaattggaaatgaatggaagtcgggcactgactgaccttgttcttcactttctccgccttttttggcaatcggatttgcttggctttctcctccatttctatccaaaataataattaaaattaattaattaataataatccgccgcatcgtaaaaatattttctgttttgaaaacaacagataaaataaaaagaaaataaattgtcgtctcatttttacagattaactgaaccaatcgcagtaaagccttattaaatggatgtccaatgtgagaggtatttaaacggaaagcatcgcctcattcgccgttggacgttgaagacgattgctgtccaaaagagggggccattttcgggttcatcggaacatccctcaacataggctccaaaaaagaaaattgcggaacgcgagaaacggccattttgctgaaagttgggatttgaaagaacggaagcaaaagtctaaattccactctaactattgtagcaatttctccttctccctttaaaaatttgcttatttgccgcttcttcctttacatgtgcattggagagagcgttttggttgaactgtgttggacactttcggccgctgcgagcaacaatttctccgcaaaaacttccatggcactgccgatagccaccggcacactggccaccattctgccgatgtcttcgtcactttgcattacttttttcactctcgtctaaaaaaaattagggaattaaaatagattattaaattttattaattggataaattaacactaattgtaaaattgtatgaatacctaaacagtaaaaaggtgaaaaatcatcatcaaaaaatgctcatttaaactcgttttaacacaacaaattaatgaatttcgaaaaatttcaacgatatttccttcgaattttgggtcaggcattaaagatgcgaaataatatcatttttatgatcaggatcctgaaaactgtccgaatacatcttttgattactttccaattttctttttatgtcgaaaaatggggatcaattttactattatcgtgaagttttcaattgtttccaaaatgttttttcagtaattacttctttttccacaatattcccgtgccaattaccggctgtattcgtgcctgactgtagcggcgctttcgaatacgactgatttttgaaaattctccgtcctccggcgtcgaagtgctcgccacattttgctgctcatcctcgtcggtgctcaattctttgttgtcagtctgaaacaaagccaagtaaaaatgtcaaaattggttttgctttttgcctttttcgtcgcattttccactgtgccttcatttgtttttctgacagaattcagtgatgaaatgattaattgtgttgtcgggtccgacgcactcgaagacgatgccacttcttgggtgctgaataaactgttgatcgaaaacgaaagacggccgaactgctcagcatcagcagaacttttcatcataatcttatagagtttatacggaaatttctgttaaatgctataaagaagcgaaaaatgccaaaatgcgtgggcaataaacatcaaaaataagggatgaatcaaaaatatcactttttctcacccgtcggacgcgcgtatgtca

SEQ ID NO: 20180 - DNA, 2290 bp, Heterodera glycines
attgagtttcgagtcaaaaatactcgactagagaatctttattattaagctgtaactgtaaatgagtgattaacaactctcataaagaagtcacagctgatagcttcgaaaaagcaaacgatttttatgaattttaataataattgttatccttttattggacctatcccaatggcaattaattaattaatcgatttgcactaattgggcaccattttcgcaatgttttttttgatgctgttgttccatttgttgctgttgtgcagcagcagtttttgttgcttgtacagcttgaacttgttgctgctgttgtcgctcaacctttggcggcacggcagagaaagccgagcgaacggtggggtcatatcgtgtgccgtaaagttgcagcaaattttgcatgaggaactaaaattaagatttttttaacttagtttattttttaatttattttttgccaaattttgcctgcatttgctgctgctgttgggggttgaattgttgaagcattgatacttcaactgctgctgatggttgaacagttttgttgaatgtaggcgaactgtttttttgcttttccgcctttttgtcagccttagggggaaaaaaatttttagttttaaaaatttgtaaattttcatttttttttaatttttaaattttcgttttccatccatcaaagactcctcatgttctgaattttcagatttgttctggcttagaaataaggaaactgaaaaaaattctcaggtctgtcagatttctagggttaggcattagaaaagtattaattttcttggcaaatctctttaaaaaaaattttgaggtcaaattcggaatttccaagacctgtggatactgtaaaaaacaaatttcaaaagagcatgggtttttttgttggcttaactcagcttattgttagctttatcccctcattcttctctttacataaatagcagcacatccatttttaccaacgatttcaaatttatgaattatttattcattcatgtgctctcaccagtgtcattaacatttcaccataagcagcagcagcaaaagcattttgctttgttggcacatcagcagcaaaagcattggtagaggaggaaaagcatggtccagtggaggaagaagatgaagcagtgccgtcggtgtttgtgcaagtgccgactttggcattttcttctgctgctgctgctggtgtttgtttagctgccgctgtttgaattggcactgcttctcctttcatttttggcgttgtgttaccagccgctgaaaacggcggcgcttttggcgctatatacacagcagtttctcgaatttgcgatgcactttttggcgttgtgttgtcagctgacaaggacagctgcggcgtttgaattggcacagcctttggcacaatcggtgccgccggcgcaatgctttccgtcaattgaattggcacaacctttgtggtcagcaagctttgcaacacatgaattggcacaaccattggcgttgtgaccgctgctggtgccggcatcgtttgagtggttggaataatgccgccaacctttggcattatgtgctcaagcatctgctgctgctgcagttgttgcagctgcaactgcatttgttgtgtgttgtaaaggtgatgaaccaattcggacaaattgcccggcccgttcactaccgtacttgttgctgttgtcactggcgacggtggcggcggcgtttgttgttgttgctgcattacagtagtggggaatacggtagaaggtggccgcggcagcagcggcggcggtggtgtttgctgctgctgcttttgttgatggcactttgtcagcaattcaaattggcgcccaaatggcattgccggtggcgtcgtccccgccgccgctgtgcatggcggtgacgatgacgttgtgccaatcgtattggtactgttgatccatggtgtgccgccaatcagtgcggcatatttgggcatcggcgattgggttggcgtgccgccaatgctgtagcatcgcttgatcgcctatacgggataatttgttagcaaattaatccattaaaatcccagtgtctcaattccccgacacttttgtggccgtctttgccccgattttaaactctccgcgttttttccccgaatgttcgggattttggattgattaaaaattatccgatcgctgataaagccggattttcaagtaatccaactctaacaacactgatcaagaagcacacattctgatcagattggacaaccaataggaactcggcaatgatcagaatttaagccctaaaa

SEQ ID NO: 20181 - DNA, 2152 bp, Heterodera glycines
accaataaaaatttcaaacaattttaaggaatgaaaacgcttcgcaaccaagtgggtcgccaaacgatgccaatggtggtgaattttggccgggtgggtaaaaacttttttttttttttttactattttaaattttcaaattatttcagactggggacgggcaaatacctggacaagtcgggggccgccaatcgtcgatgccaccatctgttgtaccggtgaatttgggcagcatgccgccgtaccaggtacaacaacaacaacaacaacaaaaaaatttccttccatttcttacaaccatttatttttgaaaagggcctgcaaacgcagcagcgcgaggtgatttatgatgtgcctgcgaacggtgtgccggaagacgacgatgacgccgacagtttttgaacagcgatgagccgacaaaataatgagctttaattctcataaaatttttataaaatttgggaattttcacaatgctttcacattaaacaatatttggcaaataaatgtaattcaaaatgacaaattgataatttataggagaccattagtagaagaaatttgaaatgtttttctcgtagatcattaggcgagattaaaaaattttgaattttaaccatgtgatataatctttttgaatgattaatgtgtgatatagtggagaaaatctgtcggtacatcaaatgagcaatttgagggtcacatccattatcgggaattcgggatgctttggtgcataataaagctgcctcccatttggagaaaaataaagatgttttgcaaggtcaaaagcgcaccatttaaattcatccctcccgtctcgctctctcatttgctcaatattttcacatttatttattctctacattttgttatatcgcaatagcattcaagtacaccaaatttacttcaaattaaaaaaaaaatgtccgacagcccaaccctgacgcccgaaacagaaataagcattgcatgggacatccttgaaaatgacaaagatgtaatgatttttttttctttcttcaatttgaattcaaatcttattgatcatttttgcagtggtacaactggttcactccaacgaccgtcaaacaagcgtgcgtcgaggcattggcatttgcgagagaaggaggactaaagcacgagaacattctgaaaataatcaagatgattgaggagagagaaaaccacgacaagaaatgaaatgtcgatcgatgaccgatttgttaatggtgatgtggatatatgatcattttttgggacatttaaaaatttgtgctaaaatttgtccaaataaataagtggtggtgaatgttttgaaaggggaaatttaaaattgatttaaataatagttaaatatagctcatgttctgcaattttattgattgaccctaaacactcagtgaggtggggatgagtttaggcctataaaaatgaactgaaattgacttccgcgcattttccgttttcattcttgaaattttccgctaaaatggccattaatatttcggacaccaaatcgcttttcaatcaaatcctcgcccagtccgatatcaccataaccacaagcggcataactgtcagtggtccacgcctatcgaccccccgttttttaccgtttgacgattgtggacgctgccgcgtttgcaaagcaaccgaggccgaggtggacacaatggtgaccaaagagggggtcacattgtggtgcactcgtatcaacaaaccccaatttgtgccgttcgatgtcgtctacgacctgccagggcactgctttttccgcgtgaagaacaaagcgagggtgttcaatgtcccctacggagacctgccctccgggacgtgtgccaaaaacaaaccgactgaccaccaacaacaacaacaacaacaacaacaggacttgaagcgcaaggcaaaggtagcacttgacttggtggaggctggactaatggcagatgctatgcaggacggcgcacggtggaagaaggccaaaaccgctatcaacgtgcttggcaatatcctattggctgaatcgttggacaatacttccgctcctccgctgaaaaatgatgccgtggacatcaaaaaagaagaagaagaagaagcaaatgtggcggaagaacacaaagaagatgaccaacaaaaagaagacctcgga

SEQ ID NO: 20182 - DNA, 2430 bp, Heterodera glycines
atcccagtgtacacatattttctcgtaaatggccaaacatggtgagattttgaaggttttcactgaatttccctccctcaaaggcccttcggtgcctttctctgcgatttgtggctatccatcgattatgtgagtgagcgtttaattttgattgttcggctaataaatacctctctaattgttaggcgtgctgtttagcgtccatttacacagtgttgggcatcaccggcgacaggtcaaaaccataacaaatgcaattcaattaactgacaaccaaatttatttaaacttattaaatgttcgttcattttcaatcctttcaattattctgccattatatttaattaattttaattaatttaatttaatttaatttattgagcaaacaaaaaatgcacattatgtagaagaaaagagaacgaataaaaaatacaaatgaaatatcgtaaaaataaatgcaatgttaaaatcacaggcgattgattatatatatttgtaaatgtggcacaaaaagtcctactcagaaaatcattgcctttagtaaatccctctgaattccttttgaattggccaaaactgaaaaaattgtttctcggtaatggtaaatttttgagttttttatatacgtccttaaattcacttttaattctcgcgtttcgacgtgtaattttatcaaataaaataaattaaactttgagttaattaattaattaaactttggtcatcttacggtatcgctttcaggtatatgtcggtacggtacccggccatctaccgtaattggcgcacaaaacagcgcgtgcttctgatcatcgccggcatttggctggtgcgtggcgtggcattcaaccatttttcaattgcctaattagccctcattagaattgtccctaacgtgttggcatttcctttcgcttttcagtgcccttccgttctcttctccgtgtccatctttggctacggttggttctccggcagagggcgcattttgcgagaagacgaatgttacgtgcagttcatgaccaacgcataccttaacatggtgacacacatttgaagcggattttaattcaattaaaatgcatttcaaaattttaaataattttatttaataaatcagggaatgtacatctcctactattggtcgactttggtaaatatttttgctgatcagtgagcgaattccatgccaaatttaggttctgatgctttacctttactatggcatttacacttcgtgagtttggagattaaaaagaaaataaaatataaaaacgcaaaaatattttaaataatttaatattttttctgtcacagtgccaaacaattggccacaaaaagtgatcagaagcggcgtcggttggcactattggcagaaatgcgggcaacgacaccggcggatggcaccggaggggcggcggatgggcacggcacaagtgacaggaacaacaacagcaaaaacaacatggaggcccaatcagtgatcggcatgtcggaggcgggcggaactgcggatgattctgtggaatcgtaagcatacggaggattaatcagacaaattgggacgagaatcccggggttacgatattttggggactgacatgtcgagaatcaatcagcacatagggaaaaggcccgaaagggtcaggaaaggatacagggaaggattttattcgaaaattttcattggtaatcttttgaacagtcgcccccaacggcgcgtctccgtcactcgattattttcactgcgaaatggccgtcttttttcgttgaaaagcattctgtcggggggcgacgagcgattgaggggaaaaggaagaaaatttaatgggaaaaacggcacaaaaacgcaggaagaaagtgcggaacaacagcagcagcaaaggtaaaacagcagcagaacaaatggaaaataaatattaaaagcgaaattcaactttagtgccggaaaagggaaatgaatgaaattttgagaaaaattttcaagaaaaacaaccggcggaatttaaatttaaaaatgcaaagaaaatattttagattcaaaataagtctcttttctgaactttccattgtttttgtgcttaggtccgtcactctgaccacccccgtggccatcaacggctcttcttcatgtgccgaagctgcggcggacgcattgccaacgccgcagccgcagcaattgcaagcggtgccaacgccgacgccccctccggcggagttttggccaaacggcgcgtgcaaccgcaaaagggaggcggagacggaggacggacagtcggcgaggaccacggcatttacaccggtgatgctgggcgaaagtgaggacttcttcccgttcatcgacgactcggcaggcacatcgttgcaggaggggagcaaagcggaaaaagaggaggtcaccagggtacggtaattgctcaaggcatactg

SEQ ID NO: 20183 - DNA, 1882 bp, Heterodera glycines
aatcctaaaattgcacttttccttctgctgctcatgcggcgctatccctttgttctgctccgtcttcgttttgtcctccatttcctcgttcgattggtgttgtgtcgaaaaattcggctgctgcgcgccatccgccgtcatttggtaacgatttttggtgtcaattaaaagcagcgattcgatgctgctaaaggcatttggcattggcattggcatttatttgtgatgggcacggaaaatcgaaaagaaggcaattaattgagaaaaacaccaaattttggaaatgagaggaagggaagggaagcgaagtgagaaggacgaattatgtgtgtttgggtgggcggacacaaataatcgccggagggcgagggaggggagggggtacggtagaggcggggaacgagagggacggtacggtaggggcgggagtttgtggcgacacgcccaagcaaagggaaaccgagcgaatgcccggggggacagcagaagtaaaacaaaagttatttttgcttttttttcttaatccaaaaaaacaagatattgaatttgcttcctctttttggcgcatatcataaccattaggaaatacggcagaggcaatttggccatgagcgagtggattattgtccatttgcatgtcgagaatcgagtcgagagtggccgaggaatggccataattagtagtgcaccccctgaattcattaaaaaggaaccattcttaattttactagtcaggcgatgaatgaatgagttatgcaattcagcttctcacctccttcagcatcccttcctcctccattaccaattccggcacaatttctgccgttgtccgatgattttggcacatttccctccccccccccccattcatttggcccttttcatccaatttcattcattcactcgcccctctctccgcctgctctcctgcctgacaaattgccttcgaaattgtctttagccccggacggacattcatcagagagtaatttatcgctggaggggaaatatgggattaaccattaagcggaagaatgattaaaatattattgtgaagaatggtggggataatgagaagaagcagcagcaaaaacatggaatcaaatgaaagaattcgcggccctcacaaatgaaaattactaatcgtttcatcgtttcgtgtgcctttctttgtccgtccttcggttgcatttgctcccccccccccccccccccgacaatttgcggcatttacaacccctcggggaaaggtaaaggaattgtcaaaacatttatagatgaattgggtgctgtgggcttttagcgttgattcagtggtgggatgactgacatccgttcaacgcggcgtcgtcggcgccgacagaaagagacgacgacggcaaattggagaagacaatcattttacaatgatccttcgggggtggggaaccgatcaaaggcaaattgggaaggttaagtttatggccctggggaaagttttataattgttgaaaaagggggggggagacaccgcaacccctcgggggaggaggaggaaatcgccagcaattaattggggaccgaaaccacggagattatttgaaaaaataaaaatgaatccatgataagttttttgagaaaaattttcaattcttagggatgtattttctaaaactgctcattttcttaggggtttatttttcgttttttttttacatttttgttaatgatctttccgaaaatcctgaaaatagacgtatataagtttttcgtgcttatctgtgcgtattatgcgcagaaattttaggcatttgtctaaaaaattaagtccgaattgataagacgatgaaaaaaacggagagatgaatggtgagaggaaaagaagatacgagagcgaaagagc

SEQ ID NO: 20184 - DNA, 2432 bp, Heterodera glycines
ataaaattttttaagttggcccactgcgacgtttttgacccattcaaagtgttaccggcagagacaggacatttccaagttgggggagcttttccgttgcatgggcaaaactgtgtgaaattggtgccgtcctccgtccaggacgttgtggcaattcaatgggcattgggtaaatgaaaataattaatattaattttataaaattaagcaatttaagcgcattggaatgagcaaatgccatcctccgtcaacggcgcaaaggaaaaggaaacgacacaattcaaattcggtcggcccaaattgggtctgttcgccggggaatcatgttctcagccaaaagaggcaagaaagtacatggctttttaataacattaattagtaattataggcaatttcacaaactctgcgctttttggacagcgtcggttaccacgagcccagcggatgtgccaacagcgaagaagaagccaaacgcatcgcggaattgccaaaattaatcggtaaaattccttctgaggacaatgaagcacattccatttatttgttaggccttttaatgccaaaggatcgccaatcggctgaaagtgttgcccaaattctccgtcccgccgccctgccaattgccgcatttagcgccgcttctgcacaggcgttggtcgacgcaaatgtgcgccgattcaccacaacagcgccgctgttcacggattacgtcaaaactttggtcgaactgctgaaaatgctcggctcggacttggtaaataaatattatttgttttgtttaacactttcactttactcgtaattaattaatgggtttaatcctttaattatggtgataattaattattgggactgatcagttttgtttttcatctaaggtttcaatcgttgactttggagatgacttcgcttacactccgctgctgcaagagaaactccgagccgaaggcatttcgactgccgaagttggcattcactgatctgatcactctcattaattaattacgcgtattccctttaattgttgtcgtttcaggtcgtgtctcttgaccacccaatgctcccctcaattctttccgcgagtgatgccaaaattgtcgtttcgctcgtccctcaccgcattctgcgcaatgcacgtcttggcgagttgcgagcattgatagaattgcacaaactttgggttggcattgacactgaattggacggaggcactgacgcggcggcgacggacggcgagggaaacgcggcggtcgattttttgccggaagacagcgaatttcgacagaatgccaaattgcaggtgccatgttggccattttaaattgctaatggtttgacaaaattacctcaatttgcattttcacagtttgtgacaatccgtcgccgtgttcgacaattgaaagagttcagcgcatactttctgcgcgtgttgcagtcgaaccacgcccattatacccttttgagggcgtatgccgagcaagtgttcgactgcgacgtgaccgttggcaccggcagaaactgtacagacggattactgtcagccgaaagaatggccaaattgcacaggtgccgacacacactgcatcattagtttgcccggcattttgtttagacaatcgaacaccgccgaggcagcaattttgttgacctatgcattggcgagagcgaccgaatggattcagtcgaaaaaggaattggcccaaaaatggtttcagtttcatgatttctttttgcccatttcccccttctctttcagcacggaacgtggttcatttgccggttgccacgatgccacccgcacggcactgttaagcttttcgccaaatgatcggctgcttagtagcggttccgtgcgaatgccgccgggctttatcaaacaattgagcgaaatgaatttcttcgaaaccccagagggcgttgttcagctgacgggcattggcattgaggcaattttggcggaaagggaggacaaagacggagccaacctttacaggcacggcacaacggaagaggagcgaattgtgcagaaattaatggatgaatgtttaggttgttggaataccgcacaacggacccacagaagcagaaaaatatcgaaaaattcgttgtgccacaaaaattacgccaatttcgttcgcggtgccgacaattcaggtggcaaaatcgaacaaagagttccatttttcccttttttcccataggcccttttgtggcgaccgttgtgagttggccactcgccgatcatccgacaacacttttctgagcatcccccaacaatatcccttttttattgcggcaatgttcgatttgaaagggccaaattgcgggcttagtgctgacgcaaagggagcagcgatgggccaagaaattgcccttcctttggcatttgtgcacgcggaagaaataatttatttattttatttatttatatt

SEQ ID NO: 20185 - DNA, 1953 bp, Heterodera glycines
aaagggaaataattaaaaggccaagggaatgaaaggccaagggaatgaatgaacattgcccacccccccccccccgaattgcccccaggggacaaatgtttttcaatattttcgctttttgttttccatttttcgcttttactttcagtacacccattgttcgttcgctgctgcttacctgcactgaaatacagcttgcgcctctgctggtacagctgctgcgccgccaattccgtgccgcccattccgtcgctttcccctccgtccgtcgtcgtcgttccctcgccgttcgccccattcagaatgccgccgttcgctatgccaatgtgcggttgtgccgtgccatgcgccttttgctgctgaacgccggcggcagctttgaccagcgcttggtaacggagctgacattccgcgatggttttgtccttttcctgtttggcgtagtggagaaattgcaattgcagagaatgaatctgagcaaaaagtgtgtggatgaattacgacgcgtaattaccctaattaatgtttaaaaaattaattaatttttaatttggctaaccaattttcgcttttccatgcgccagcaaacattccacaaaaagatggagctgaacacggagaggaagagcagaatggccaacaggataatggccaccacttcggcccgtcgcgctctgtccaactcggcgccgacgtcgcccattacggtggagtcttcctccctcggggcaaagggactctctgaaaagctcccggaaaatgcatttatggaaaaactgtcagtgaaagagtttctttggaaaccagcgacagtatatttacgtattgtccacctaaaacactgtatttactgaaatagaccccccccccccccgaattagaactccatgaaataaagccccattttgaagggatttgaaaaataaagccctcgggggcggctctatttcagtaaatacgttaggctgatttggggaccaagcgagccgaaggactatttccaaccttggcccctgccctgtcccctgccccttccccgttttccttccctttttttctctcccatattctcatttattcccctccggttttccttcactttaacttccccctcccttttccccctcccatactgaccaatttggccctctacacggaatgccacacaaaagctgccgtttccgctttttcctgctgcacattccaacaccaactgaacaatgcctcccgccaactcttccgcgtccttttcattgcccgtccactgatttatgatttaatgtgttttcctcaatttcttggcctaaatgcttacaatcactcgcccctccccgccggtccatcccaatttgaacaaatcgccatccaacggcctccaaatggcttggttggccaacaaaaaggccgactgaatggcacagcgggggccatggccggcacggactttgacgccattctctgaacggcaaaattgggaagcgatgccgaaaggcggaagagacctctccaggcaatgcgcaagtcattggacaacgcttcgcctttgcgcggaatgcccaaaacgggcgcaaagattggcgtatggccattgtccgacggtcggtcgaaacggaaagtgcggccgggacaatctttgtagggatgttttaattgtataaatggaactctgttctcgaccaccattcccgaatgccattgtccgtttgcaatgcttttccgcttaccgggtgctttcgctgcgcattttccgccgccttcggccgtttggacaaaaatttggtacccggaagggcatcggcaaaggcaccgcacccgcggcattgccaccgcaccgtcgctgcccagcacttcggcgcaatgccgcgagcagtgctcagtgcgtaaaaggaccgcgtcaccgccaaaattatcggcggagaaagggacgcgttcgatggcgagcctaagtgggca

SEQ ID NO: 20186 - DNA, 800 bp, Heterodera glycines
taataactttcctgcggggaaggcccaccacgaggccgcgaagcggccgagtgagtaccttcggtgcaggaaaattattaaggaagagagttcattatttatttgtcttttgcataattaattcataagtatttttacagaaactgcagtttaggcttaactttttagtgaaaattcaatcactcatttttcgagtagtgatcagaagcgcaccagattttgcaggggcctaaaaaggtcaaggaaaggcgtctctgcgttgatttagcagtagtacctatgaatttaaattttctatgaatttttaaagttttttgaaatttttttaagtgcaaaagtggtggtgtctgcaaaaaattttcaccgggtttaaaaaatctaggaaaattagtaagcatttgtagtgttccgatacgtatccctgcaaaatttggtgagcccctgatcaattacaaattatttatggacgatcaaatttttagaaatttttatttatttttgcataattaattcataaatatttttttcagaaaatgctctgaaacgcaccaaattttatttacatgctagtttaggcactctgatgctttttctatcaaaaagggagatgaataaatttttaaaaatttttaattcctttttaaacaggccaaaaagtttaggcttaacttttttttcagaaacttatcagaagcgccccaaactttgcagggatactgaaaggaaaagaattaacctgttttatcacattagcttgtcatcagtttttataaaaaattttcaaaattctgagtctccta

SEQ ID NO: 20187 - DNA, 2974 bp, Heterodera glycines
cataaacgagagtaccattttctgacaatgaaccgaattctccaatttcagcgtttgacttcgcctcgtgtcaatgcaaacacttcggggaaaactgctgccgatccttcagacgaatggcaaaagctgaaggatttgcttttaaaggcttcgcccgtcatcgttttcgttgtgtttggttggcgcgtggataatttttgccatcatttttctcttaagcgctgctctgttggtacgccactccgttggttctttcggctggcgctgcactgttggaaggagtaattcgaattcattttcgcttttcatttttctccagggattcagaatttcatcttctcataaattagggtattttcgactctaattataaaagattcaaaatccttctcaaaatgcttattcattcgggtctctctctctctaaaacgactcttttatttgtatttagggtaatttgttgtttttctccacaggtttcttcgttggtgatgggtttgggtgcctttctgcgcagttttttcccagaactcgtcgcctcggggctcgccttcttttccgcttacgttttgggcaagaaaaaaatggtcgactgaaaataaaccatcgaacggagacggaaaagagatattatgtgcctatgtaaattttactacaccgaattatgttttttttcaatttattttcatgaataaaatggctaattattttatttcgaatttacaattgggtaccgttccaagttttaatctttaatcatttttaattcgtcggttttgccatatttggtttttatttgtctctttttcttttagcttatgtgctcaaattttctgtttgttttccgttttcaaattgtttctcatcagcctttcctccgttctgccttttctttcacttctcatcaattctctgctcagtatttgataattcaaaatacacaaattaaattaaattaaacgaccataaattggaatgtttaatttccaaaatttaattttcacaactaattcaaaattttctttttctaactgccacaaattgtgcactttcagcattcgtcgcaaccactttgtctgctcatcgttctccacaaaaacgaaaaaaatgcagaatccgttggaaatgggcacctatcgcgtcgggtccgagacgtaccggcgcaactgtccgttggaaaaggcgtccaccgctgcgccagccgctggcgccgcttttggcgcgacgacggcggagaacgacgacggttccgcggacgaacagagttgagagagtttaattggcattttctagactcgttcttttttttagaattaaaatggccgcaatgattttttaatttcgaaaaaataggtaatccccgttagtttttttcttcctttgactcttgcatcagcttttcctattataataataatgtttttaatacatttttgtttttacgttttcaataaatgccaatgacattggcaatttgccaatgcgtcgctttgtttgccgatgcctttcctccctaaaagctcacttttctcaattttaccttcaaatcaatttccatcactttcaataacaaattgtttggcatgcatttccccaaaaaacaattttattatttttatggaataaaacattggcatgaatttacataatattttttttattttaaaaaagggttaatttttcaaaaatgcatttgctcttttgccttttcctcctccttttgtttgtcacaattgccaaatgtcctcagccttatcagcacaattttttcaaaccgaatgaaaatataaaaagtaaaaaataattttgttttcaatttttaatttgtttccatgtttagccctgagtccttcttcgtccggccgctgttcgtcctccgaagttcgtcaagcggattttgctgggtcggattatggaagtccgggaaaaagtaaacctaaaaaataacatttaaaacaattttcgacttttttcaggggcatgcatttcaactgagaaaagaaaggcgacgacaattttaacagcgaaagcagcgcaagaaattggcgaagtgtcgtcggccggagaaaatgtgccgttaattgtgcagcgaaaaactgtcgaggtgggaattgggggaggggtggaattaaaatctaaaaaaattattaaatttttggtggtgtcggcacaggacggatgggtgtacacggagcaaatggtggaggacaaatctttggttggaactgtgaaatatgacggggcgaagcagtgcttttacgacaggtgaaacagaaaaaaggccggacggtggtgcaaaaggtggtggaccaattgaattgatcacttcctgcgttttagcagatgatttacctaaaaaatcaccaaaagcgcaaattaccgtttttaaaaatttaatgaccggttcattgtcagtcggggacaaaatttttttttggcaagattgggtaaaaggtttcacattgaaaattgccaagccggaagagtttttgtttttttcatccccaatcatagtaaacattctaggtactgttcaaaagtgcttgacaaacattaatttacaaaaaatttaaacgaacaaaatgttaaggtctaaaacagggatggcacggaattccgatttccgaaaattttttgggcctcggaatgccatccctggtctaaaagcgtcattttgggtgcgcccccattctctttttgatgtttatgtgttccacaatcacattcagtttattggtgccgaccaatttggtgggaatgatacgcggacgaaatagcagcaacatgaagccaattcaagaggaaaatcgatgtgaaattgaatttccgaaaacaccaaaagtgtctggtacggaaactgaaatcagtgagttgggacgggaaagaaaaatcagccaaccaatttttgaattaatgccaatacattatgaaggtttgtgccgaatgtttttttctattggtctttcccgccaat

SEQ ID NO: 20188 - DNA, 3439 bp, Heterodera glycines
  misc_feature (55)..(55): n is a, c, g, or t
gacgaacattatgtctctgggttatgccccgaattgaataggtccatgatttcanagccgtggttgtgccgtggattgattacccgacacatccggcttttttttgtcaatccgactcgacttttctcgccccggtgtaatagcccttgattttaatcccctcaaaatcggattaaaatgagaaaactttttcagttaaatcaaacttttgccccttttggcaaatcattttctttccaaatctgtaggtctcccatcgccacactttcaaatttttttggcggatttatttaaattcagtgaatttttttggctaaatgaccaaacagccgatttcctccaacagccaaaccgtttgtcggcgccgtggtgtgccatcatacattgaagaagcagcggagaatgccaaaacggaagtgccaacaacatcatcgacaaacatggcacggcacaaggcagaagcaaaagtgagaaatggcggcggcagcgctcaaatggcggcgcacagtcagccgacgaagggcccaaggtgtacaacagcagcagaagaagaggaaagcagtgaaattgaacagtgagtagtttaagtactcaccaggatggcattcctaggccccaaaaattttcggaaatcgaaaaccgaccccaaaaatgccggaaatcggaattccgactccaaaaatgccggatgttggaaacagataatcggaattcgaaaaccccaaagaattttgagattttgaccatttcgtcagggactcagttggcccgaactaaaacgcaaattttgtgccaaatttgccgcttaattggctttctacatttaaaataattattttttaaataattattttttttattagcttcgcccatgagtacaagaagcagttgcgccgcatccttccaagcacatatgcaaaacggttgttgcccgcgcaactgtaccggtacggtagcaaagattttggcattttgaattatggcatttttaaaaatttaaattatttaagtacactgatctacatctcttatctgttctggttcgtcgtcggaatgtaaagccattttttccttcaactttaattattttgcttataaatccaaaaattattttttttttttttctaaaaaatattttaatgtttatattttcagaaaaatttttaattttttgtcaaaacaacaatttttcataaaatattgtgtaaataaaatgtttaaattatttaaattccattgatctcatcagaaaagttaaaagcactcgttatgatactgtgcattggcacttggtgaactgctgaaccaaaacatacagtatccttttttaaagcaccgtaccattgaaatttttctgggcgaaaaaaggaattaatggtccgccggtggtgtcgagaggcatttttaatgatttcaaaattttatgatgatttattgcttacattagtgttgcaaaaaaaaaaaaaaaaattttccccaaaaaaatcgttgaaaatttttcaatttttttttgtgaaattttcttttaaaaattttcccaaatttttttttcagtttggtaattcgcaagacgaagtcggctgttgtcgcaatgcgttatgtgcgtgcccattccgccaccgtttcgttggcatccattgaacagtcggcacaatttcagcaactgttacaccaaattgaagacgaccagcgaccacccgcgttgctaatgtgagagtaattaagcattaattaagcaatttaattttgtctttgatttatttggtagtaattagttgggaatgcatgagtcatttttaaaatatgtgctaattgagtgccttattaacttgcaaataaaatttggtgagtttcagagcagtttctgaaaaaatatttatgaattaattttgctaaaaaaataaaatagtgaagctttaaaaattaataaaaaattttaaatcagaattactggagttagcatcatagcagtgcttttccttttctttttgatgctctcgcaaaatctggttcgcttctgatcagtttataaaaaaaaaagttaagcctaaaatttttcgcatatttaaaaagcaatttaaaatttttagatttttattcatctccctttttgatagtgtaagcatctgagtgcctaaaataacttgcaaataaaatttggtgcgtttcagagcagtttctgaaaaaatatttaagtagtgatcagaagcgcaccagattttgcaggggcctaaaaaggtcaaggaaaggcgtctctgcgttgatttagcagtagtacctatgaatttaaattttctatgaatttttaaagttttttgaaatttttttaagtgcaaaagtggtggtgtctgcaaaaaattttcaacgggtttaaaaaatctaggaaaattagtaagcatttgtagtgttccgatacgtatccctgcaaaatttggtgagcccctgatcaattacaaaattatttatggacgatcaaatttttagaaatttttatttatttttgcataattaatccataaatattttttcagaaaatgctctgaaacgccccaaattttattacatgctagtttaggcactctgatgctttttctatcaaaaagggagatgaataaatttttaaaaatttttaattcctttttaaacaggccaaaaaagtttaggcttaacttttttttcagaaacttatcagaagcgcccccaaactttgcagggatactgaaaggaaaagaattaacctgttttatcacattagcttgtcatcagtttttataaaaaattttcaaaattctgagtctcctattattttatttttttttcaaaattttgaagggcggagggggggcgaaggcccaccacgaggccgcgaagcggccgagtgagtacctcggtgcatgaaaattattaaggaagagagttcattatttgtttattttttgcataattaattcataaatattttttccagaaaatgctctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttcgggaatagcttcccgatagtctgtactttaattctgcgttggatttttgctccccataattgtttgagtaccccaaacggacacttgaaaaaatcgatttttttgttttcggggcagtccccccgaaccgatgcgcccaga

SEQ ID NO: 20189 - DNA, 2448 bp, Heterodera glycines
gattttgggcgaatattgaaaaattcatatctagcctaagggttgatcaattttacaggaataaagccttaaaaatagagaaaaatcgggagaattttatgggctttatttggaatttctatctaaaaaaggaaaaaagttattccagaatttctggaaaaattcgaattttcagaaaaaaattcataactcggttctgaaaagatattctggaaaaataaaatacttcaaaaatccgcaatttttttctctataatataaattttatttggcaattttatctcttttttgagagatgttacaaaaataaaagtgattttgagattcgggaccaaagggggtgaccagtatttttgagtggaaaaatttttcaccaaaaatcttccaaaaacatgtctttaggggttatttgggccgctgatcatgaatacgtaatcagtttttacttttgacatcgttaagacctcagaatccctgtgtgattggggattctgggacatgttctgaggggggggggggggcaggttcgaatccgggcggtgtacattatttttctgtgcattttttgcttacttttacattttttaattaatttgttttgtattattaataataaataaaaatttttaatttaaattaaattattttggttaacaaatgttttaatttaaattatttaattttttatttaatttaatattgttttattaattattttaaattattttctgatgaataaatgttttatttaatttgaattttcgagaaattaattcctttcaatttcaataaatattctatattataaatttctaactttatttttaataagtaaaaggatttttttaatttgataaatttataatacatccaataatacaattttcttatttatttcattttaaaccatgattgtacctcttctaatcacttttgttcaaattttaatcactgttgtacctcttctaatcacagttgtacctcttctaatcactgttgtacctcttttaatcactttttacctcttctatggaaaaattttttcctccaaaattgcttaaaaatgacttttctgggctaatttgggctgctgatcacgaatatgacctttactttaagtttcagaaagtttgggttcgattaaaaatttttttgaaaattcggaattttttggcccctgggaatttggtgccattttcaaaaaatcataactcgggatagggtaggtgaatattcacgatcaaatgctttaaaaatgcgggaaaatacgacaaattttatgctttttatttggtatttaatcaactaatataaaaaaagatattacgaaatttctgaaaattttcgaattttcagaaaataattcataacccccttcagaataggggaggggtactggcaaaattgaattatgaaaaaatccgtaatttttagctcttcaaaaaagttatttacaccatttatctaccttgtacctcttctaatcacttttgtacctcttttaatcagatttgtacctcttttatcattttttacctattttatttacttttgtaccttttttaatcactgttgtaccacttttaatcgctgttgtacgtcttttaatcactgttgtacctcttctaatcacagttgtacctcttctaatcacttttgtacctcttctaatcactgttgtacctcttctaatcacagctgtacctcttccacacatcttccaacaattttgtacctcgtcggagctcaacaacatttaaatacgggggcgaagcgcccgtccaagttcaacaaaatttagaaacgggcgcgaagcgcccgtccaaggccaacaaaaattgaaaaaccggcgaagcgcccgactgaggctgcaaagcggcctaacaagctaaaaaacaggcgcgaagcgcccgtatgagttcaacggatttaaaaaatgggcgcgaagcgcctgtataagcccaacaaaatttaaaaaacgggcgcgaggcgcccgttcgaggccgcgaagcggcctaaaagtcccagataatttaaaaaaaattccaaatctccacaacaagagctaacttctaatcattgttgtacctcttttaatcactttttacctcttttaatcactgttgtacttcttttaatcactttttacctcttttaatcactgttgtacttcttttaatcactttttacctcttttaatcactgttgtatctcttataatctctgtaaggccaacaaaatttgaaaaacgggcgcgaagcgcccgactgaggacgcgaaacggtctaacaagctaaaaaacgggcgtgaagcgcccgtcttgagccctcaatgtggactaaaaaacctcctaataattttttaaaaattcaaaaaaatctctctaaccaaattcgatcaatttgaatccgcttcacagtctaggtagcgaagctccccaagagcgaa

SEQ ID NO: 20190 - DNA, 2069 bp, Heterodera glycines
atttttcaacggatctggttgcagtttttcgttatcattagaatttgcccttttgttaccgaaaaaattctaatttttttttggggggggagggggaaatagaaccttcgaaaataggtcaatttcaatttgtattgacatttgtccgtcttccaggcgacatacctcggcaacatgttgaccatcatgggcaagggcgacgcgtccgtcgaccgtccgttggaaggttttaatttatggaaattttgcgactgaaaccagagttctggtttttgtattcagcgccctcggattagctctagaagtaattttccttaaattacaaaaaaaaatgttaaaggaccaatgttcgttacgattacgactgattttgggcttcgttccccgggacattcatttattgaaattttgccaattttttcctaacctatgacacctgaaattattggtccaaaagccaaaaatattatttaattttttttttccattttcgattcttcggccaaaaaggaggccctttaactttggttaccctttcagaaagtttttaaaagcggctattgatcaccctacgattttgtagcggctttttggatgaattatacacaaatttcaaaaattgcggttgcatttttgccattgtattttatttttacgtctttttcggcgcttttttattaaatattttgtgtgcatatttttcccattttttatgccacaatttttccccttccccctttacagtgattacgcgcgcgtgggcgccaccgtcgccagaggcacggcgccgatttttacttaccagccccaggcgcaatagttggccatgtgcatgtgccgatttggccccatgcatgcggtggtttttttactgccagattttatttgtttgctccgattttaggagaattttaagaaaaaagcctaaaatttaatggcaaatttagttggatttgagttttttcattcaaaacttggaaaaattggggctttggaagggatgtgcccaattttcaacgaatctggttgattttttcatgttatttggttgaattctgccaacatttttaaattttgttaccgaaaaattacaatttttgggagagggtgaagtaattaatccttaaaaaacgtatcaattttgtgttaacatttctgcgtcttccaggtgatatacctcggcaacatgttgaccatcatgggtaaagggcaacacgtccatcgaccgtccgttggaaggttttatttttttgggactgaaacccaccggccaaacaattattttatgccttttctcacttcgattcctcggtttaaaaaggaggcccctacaatttggttgcccttttcaaaaaaagacatcataattgttgtgccattcatgaaaagaacagccttttttaaggaattcgtcgctcggggggtgaggttattctcttccggagccaagtgtttggttacgcccttggataaattccaaaaaaaaatttttttttgtttgcttttttgccattgtattttgttttggcactttttcttcaatttctttgtttgtgttcatatttttcccatttttatgcaacaatttccccttccccctttacagtgattacgcgcgcgtggggcgccaccgtcgccaaaggcgcgacgcgccacggcaccggcgccacttggccagcaacaggcgcaacagttggcgatgcgcttgtgcgtgtgccggtccgtccgggttcagggccgagacgtgcatggggtgagtttttagtgcaattttgataaaaaatttcaaattttcatcggcaacttttttttttgcactgtttcccactcctacttccgttttatttattttgtttgagaaccacgacaaaaaatgccgtgctttacaatgaatgagagagggcggacatattttttatccgaattttttttccggaattttcccaaaaaattttatatgttcatacatgtacaaggggcgcgccagtcagacccccatacgtcggacgtttggcgcagggagggtgcgccaggaccaatttttcttacgttggccccttttttccccc

SEQ ID NO: 20191 - DNA, 1621 bp, Heterodera glycines
  misc_feature (41)..(41): n is a, c, g, or t
  misc_feature (49)..(49): n is a, c, g, or t
tcaaaaaatttggaaatgtatctcatatgcaatttcaaccnaataaatntgaagaaattttgcactcaattttgaaaaatttatgtccatattttgacatttttgccatttatgtccatattttgacatttttgccatttatgtccatatttcgcgatttttgccattttatgtccatattttggcatttttcaaaaaaacctctattagaacggcccccagcagctaaattagcctttttgagcccaaaacccgaaaaatttttcaaaaaatcattttaacgccaaaatttctcgagaatattgaataaatttaaattttcttaaaaattaataaattatgtcaaaaataagcaaaaaagcgaaaatttcgcttttgttgttgattttgcgctaaaaaaattaataaattttagcttttatgtttttttcttttaaaatgattgcacgtaattgccgaaaaaattcgagaccaatttccgaatgttgaccgactaattgcaaaacgaaagccgtctttgtcaaagcgccttaccgagtcaaaaaatttggaaatgtatctcatatgcaatttcaaccaataaatttgaagaaattttgcactcaattttgaaaaatttatgtccattttttgacatttttgccatttatgtccatatttcgcgatttttgccattttatgtccatattttgcgatttttggtccatattttatggccatatttcgcgattttatatccatatttttggactccctacattatatttgaggcatggccaaatctcactaccgtatttgctctaattatccccaaatctccattaatcccccaatatccaattatcccccagtctaggaggggtttgaaaaataatcccaattggaaatgaacttatcgcaccaattgaaaatggatttgatgctctcttttttctaagaaatgctttttgttgattcttacatttatttaattttcttttttgtgagagttttttggtgccaatgtcaatcccgcaaaacattctcagttttcccgaaacaatgaaatgccaattattattattattttttttttctatccgcccaactcaaattcctatttttaatattcatcgccaaaatggtcatcagaacagcaaacaaaattatcatcaaataaaacagtcggacatctctcaaattatcactccttcttccgctgatcactgggcccgggagtcgagaactctttttcatcgctttgatcttgcggagacagcggcctaaataaaccaaatttgaaatgaatgaacatttaaagtactgtacggaggacactactgtaccctcctgtccatgctctattcaaaagtagagtgccacgggaccgggacctggtagcggacaactgagtacaattgagtaccaaggtcccctgggactattcccgggtttcccaggcaaaaattcctgggttctcaacccgaaaaggtcccggtcccgggtttgcccaaaattcccggtcccgcggcactctattcaaaagtaaggcaaatctttttgcttacccaatactatcatgataacgacggaatatcgcttcattctgactgtccaaatcttgctctgtttccattgaacc

SEQ ID NO: 20192 - DNA, 1969 bp, Heterodera glycines
tctagagtcatctgaattaaaaaagtgcttcccacccttttttggtgcgtgggttatttatatttttaaaaaatgtggaatttaattataagtggaaatttaatttcccgcatcaattagggggcgcaataattgccggaaatgccaaaaattattggcggaaattttgtttcaattttgccacataaaaagatgtgatgcaatttgtttggaatttaattaagtgcagaagatttaagatatttttaaactattaattgaattgaaattatcaaatcaaataattatatattaattaaattaattaaataaataaattttgaaaatgtgaaaattgaccgctttttagaagcaaaatcaaattcataagcaatcttataaaacaataataatcgattatatatgtttaaatcctaaaatttgctttaaaaattcgttaaaatatctggtaaaagactaaaaaataaatatttttttgaaaatttttgtcaaaaaattgttgctccggcgaattttttattttcttaatatttagacatttaaaaaaaaattttttttttggtacaagcaaaaatatgtgcaaaacttggaataagttttttatttgctaaaaagtcactaattcttaaatcatgatgaaaaatgtgtttttcgggtctctctcgctaatttttagctaaaaaattatcaatcaatcaatggtaaaaataattaaatttggctgcttattcgagattttttttgatattttggcattaactcaattaatctgacttaccttttggttttgattgcggtttgttcaaataaataaataaataaataaaaatcccgaaattttttattattttaaatgaaaactttttttttaaatagattccatttaaaaaataaatggacacccttttaaaattaaaaataataatttaactaaagaaattcaaaatgtaatggattgttggttgtgactaaaaataaatattatatatattccatctttttaatggtgcaaattattataaaatgtaaattcatacgagcgacaaaagccggaagcgaagggagagggcgggggaggaagaggacatgcccgggggcaagggctttacagctttacctggcaaaaaaatcgccgacgcggtagggggggattagcggaacaaaaccaaacggggaagtgcaaacaaataattacacaaataggcgtgccaatgcccacctgttgatggatcgaatggtgccggatttgtgtcagcagaacaggtgaacagcacagagagaggtaattagcttttgttcagggttcattagagggaggctttagcctcatttggaagcattttgagtggcaatgattttgttgtaaatttttttgcgaggttgagggtggcttttgaaattttgaaaaaaaaatgttttcatgctaatttgctttctgttgggattggaacagattaaaattcgtgaaaaataaaaacaaagaaatgggataaaaacaaaaagcaaaaaatattacaaattttaattttttttttctcattcttaattaattttatgacgcattctctctcaattttttcccaattctccttgactcttctgcctgatctcgtactttttggtttttttatgattttgaaaaaaaaagaaatttttggagcaaatctgttcataaatcaggctaaaatccatcaaatttttcccgcggccgccactggaccaattttttcgggttttgcatcattttttcatgtttttatttaaatgtgaataattttcaattttttttaattttaaatttcccatgtttgatcaatattttttctaaatacaaatctccacgcaacaaataaataaaaatccacaattttttcttaattttgaaatttttacgtaaaattaccttaaattttcaagtttaaaaaaactcaggaatgtttgtcaaaaatagggttgaatgtatcaattt

SEQ ID NO: 20193 - DNA, 951 bp, Heterodera glycines
tataatgaatattcgtttataggaaatataaaattgtaaaaatgattttaaaaacaaatatatttaatgaatatacagtgttaacagatataatcatataattctctcatccgctttgatcagtttcgcccgtttctgttcattctgttgttgaacagtaccgagaatgttggtgatcaagaacaattgaaaacacagctcgtagccattttgatgggccaccatttgtctgatcagttccattgatcgttgttgatgatcaggaaattttgaagaaggaaaaaaaaaattaattgtataaattgcaagtataagaattaaaattaaaaagtcaaattattaatttccttgaatatataaaaattaaataaaagagaaataaaattttttattataattggaaaacaacattatacataaacaagatggataaattttataaaaaaataacaattttaaataggaaaataagaattgataaaaaatcaaaaattaaaatgaattttaatttttcatttatctgagtcagaaaaccctttaaccccgcttatttaaattatgcccacactttaccaagctgtgccaggacggagttcagttcggagcagtacaatgccaaccaatcgtcaaaatgaacttgttaccgtcgacaatcgcccaggccttacagtacctcaatcttggaggaattttcttcagactctttcgatttgtattgcatattttctttatgggaaagagaagaggcaaaaatcgagagatgaaattgaggagggaacctatcccgtggaaaagaaaaccatacaaaacaaagcctcaaaaaatcggaaaaggctaacacgtacgcactcaatcccgctaacggaaagatggccgtctccggaacaaaaaccgaccataccaggaaaaatgggcttaaaagtgagagtgttggcaatcattgaatggaac

SEQ ID NO: 20194 - DNA, 1473 bp, Heterodera glycines
  misc_feature (48)..(48): n is a, c, g, or t
  misc_feature (136)..(136): n is a, c, g, or t
attaatcacaatttaatgagtgtgacgtgtttgcctggggcccggcgntgtcgcaaatgcattcgctgttccgtcggatgtgtcgcgttgcggcatccaacagaccaagagctggcaaaggacaaatcacaaactntaatggcacttttttcgtttgtcaccaaccctcaaaaaattttttattttaaccctttttaaggcaatttgaggcactgattattaattagtatttttacgccaaaaatgtttatgtaaaaattttgtaaaaattaaaaaattaagttccaaaaatcaggtagaaggttgacaaactagaaaaacccgtttttgctaacaattaacccatttcggcttcatttattctgccgattcgctcactcattatggccccatcccctcacattttgccaaggcatcatttgttatttttggttttatttcattcgttaattaaaaaattgactaaaaaataatggtcggctcacagcacagcaaattgtcataaaaccattcgaaacagtcgcgggagcgacccaaatttcgggaacgaccgttcgaataagttcagacggaaggtcaattagtcattgccgacagaagggatcgaacaaaaggaaaaacaagcacacaaccacttggccacacttgggacactaacagtacaattaaagaccattttttaccattttcgacttctgggaacgtcttcgactcaaaaacaataataaacaaaacggggcattattcgagcatgctccaccgtaacattcacaaatggattactgtgtttttaatttacccgaaatccctccgcttgtgtcatcgtaataatcgttgagcagtttgtccgggtcgcacaccaaagtggcatggtcactgccgcattcgaaccattcgcgcaatgagtcgggaaaagtatgaggggaaaatgccgaaaattttagaaatgaaaattattattaatatttttgaatttgaaaaacctttgttggaaatgagggcgaagattggggaagggaaaaaaggaaaaatgataaaattataacagaaaaaattggaaacatttgctaaatgagtcaatttttataattaaaatctttgaattaattttaatgaaaaaagaaatgaaataattattcaaaaaaaaacatttgcgacagaaaactcacctttttttacacttgctaaaagagctgtggaaaaataaatgtttatcttgcaaaaaacaataaatcagttgcaatccctcggggaaaaagtgggggggggggggggggaaataaataatgaaatccgcttgaggcgttgaaggattgtgtaaatttcctatggaaaaaattggaatgcccctaagaatgagagaggtgcagcagacaaagtttaaagtaaaaaaaaatgaaaaattaaatttaaacaaatcattttaacattaaattaattaatttattaattgcggatttgggttttattttt

SEQ ID NO: 20195 - DNA, 1542 bp, Heterodera glycines
  misc_feature (106)..(106): n is a, c, g, or t
  misc_feature (125)..(125): n is a, c, g, or t
  misc_feature (1485)..(1485): n is a, c, g, or t
tttttgttttgtaaatttactcaaacacaaatttttctcatttctggacaaaatcgttaataaattacactcaaattttcacggcagcgcctttcgcggaccgccnggacaccaccttctccaanagttttttgaaaaagatgagccgcaaaaatttttatgtttgaggcgaggcgaacgaattgatgaatcacttttggcaaacatttagtccaatttatgaggcgcatacgccgaatcaaatgggcaaaccgccgattaatgagcccactctcatcaaaaccatggtgggatgaaccaaaagccaatcattggcctttcaaagcatttaaattcttcaaagcagtgacaagaaaaaaaatttaataattcgcaaatgggaaatttgcacaactgttgagcattgcttttataaatttgtttgtttttgtacacacactcctcaaaaaggcaaaacaacaaatgctaaagggggggggggtaattagggtattaattgcactgataagggcagcacagatcaaaaagttagcagaacaaccgacaacaaacaattaccaaattaggcagtaaattaaggaaggctaatgggttggacagcagaaaatggattggagcaaaacataaaaatgcctaaaatggaatggctaattggggggggggggtgatttagatccaagcaatgcgtggcaattaggaaatatttttaacagagagatcaactgacaaatgaaaatttaagcacgaaaattttttttaatttataaaagtctggtttcggcgatgattacatggtgaaattgtcattttaaaaaataaatttgattattcgattattagacatttaaaatcaaaaagaattcgctgtttgtctcttctgtgtcatacagggataactgattttgcatcaacacggtattttctgatgtccctatcttttcaaatcatacacagagaaagagaagcgaacccacgactttaaaaacggcgattcaaccactgagccaccactcgcagagaaagaacgtattaattgcactaaaaagaccgccttaaccaaccgagccaccttccgtagagaaaaagcgtattaattgccgcaaaacgagaaaaaaataaataaattgtcggctcagaaaccgttcgtctccacgacaccgctcgagacagccgcgggttcagccctattcgggcaacgaccgctcgagacggctcggaatgataaaatatccatcattgccgacaaagggaaacgaacccaagagaaagcaaacgaacgaccacttgaccacccgaataacatccaggcgaaatcagaataaatatgactgaatgcaaatttcgagatgcttacgcttttgcacaaaaatatatgggctgtacaaaaggacatgttaatccgtaacactggacgtattatggacattgaccctttttcttgattgatatcgaagaaaactatttgtaagacgcataaatctattngtccgaacatttagaatataaaattcatcaaagcgaaaaaaaaatcaatttcaaaac

SEQ ID NO: 20196 - DNA, 2420 bp, Heterodera glycines
ttggctttcgaccagggctggccgtgattgaatttccaatcacgaaaatccgtgagccgtgataacggggcttaaaaaaaaatccgtgacccgtgaaccgtgatcacggcaccccaaaatccccgtgatttccgtgatccgtgagccgtgatccgtgattataaaaaaaaattttctaatgattttttatttaaatttatttaaaaaacggaatttaatcgcgggaaaattcccaaaaaatgttttaaagaaaccaaaacatataaaccgctttttttgcggcgaccttttccaaaaaatgactaagtttacgatttttggcaattttttgaggaagattagagctttttgtagaaatctccaaggaaaattttttatttttaactaatttattaagaaaatttttcaaatttttcttaaatttaaccaaaaatctatttatgtagagaaaaaaaattcctctaatttgtaagctaacttttgatgctgaaaaaatcttttggaccaacatgctcagtccttcatgacgatctgaacaccctaaaagatactgaaagtcgggaaaattttagaaaaattcttagagggttgggaaaattttctgaaaattttgattaggcctgtcgttttaaatttaagcgacagagagaaaaaatagggtttttagcagtttatatgccaaaaatggtcatttttctgccattttggggtcaaaatttcaaaaatacggtaaaatggggtccgtctgccggtggtgccgacaggcgccgccgggaaaaattttgaaattttgagtgaatttgttaacagattttgtccaaaatatgtccaatcattggttatttattggtctatggacgttttaaaaaataaagaaaaataattttcaatgttatgaaatttcttgttaattaaatttcaattaaaattatcaaaacaaaatatataaattgtcctatcccaatggggaattgaacccaagggacagacaacgaaagacagaaggtttaaccaccagactacatatatatgtttacttgctaatttgtaagaagaaaagaaattatttatttttctcaaaaatttcttcacaccactttcctattttcgtctcaataaaaattccctatataaaatgccaatcacggatcaaaatcacggaaaatttgaaaaaatccgtgacccgtgatccgagatcacggcacccccaaaaccccgtgatttccgtgagccgtgatccgtgatcacggccagccctgctttcgacccccccccccctcgaccaacaagggatttttaatatttttgggttttatattatttttaaatttctttttttgtcaagaattttttagtttgtaaaacaatttaaacaattttcccttaactaacataaaaaatccaatctctagatataaaagcatatcttggaggtttttgagaataaatgcatatttggccatttttttggcaaattttcataagaaaaatgcgaaaaatacacccctaaggatcgacttttggaattttttaatacccccttaaaatcggaaaatttttaaatttttgtaagagcttttgaaataaaatttttctatataaaaatgtacttttgttttagcatataataaaaatttagaattttgaaattcaatattttttgtaattgtctaaaaaatgctccttagcccattgttttaaaagtcaattcttaatttatacacaatttttggcattgttgagggttaagagccatttttggcaatttttaaggcatattttagtgcatatttgggcatttttcgggtttttaggcatatttgagggatttttagtgcatattttatgcgcatatttggcattttttagtgcatacaacttataaccctaattttttcaacctcctcccacctgctgctgctttcaattcccaatttttttttttgccttgcttttcttcatttccactttcctgttgtttattttgcttattcttccatccctccttttacagtatcttgatcagtgttgccctgcctaataccatctccgtctaccgtaccgtgccgtcctccgtcgcgtgtcatgcctttggtcggcgcctcctccacctgctccttctcctcctccttcaactcctacttctccctccccccgcgtctgttcttcgtccatccccgcgcccgtcggcttttttaatgaaaataaaacctttatttttaattttatttaatttaaaaaaattcattaaagataatagtgcaataaataaaatatcctttcagttaaaaacaaattaattttgtctaaaactttatgagtaacttatttgccaaaatggataaaaaaataagaattttaaatcataaaatttttttgtggtaatgataattgaccttggcataaaaagcaaaataaaa

SEQ ID NO: 20197 - DNA, 2463 bp, Heterodera glycines
  misc_feature (2330)..(2330): n is a, c, g, or t
  misc_feature (2360)..(2360): n is a, c, g, or t
  misc_feature (2414)..(2414): n is a, c, g, or t
tgcgaaggtcgtcatttctcaagatgggagaaagctcgtggcattctacacagcagcatatccattttccaatcacttctcctgccgattgtcattgatggactcgaattttcgtccagtgagcaaatgtacatgtgggccaaagcgagcgttttcggagacgaagaagcggcatctgcaattctgcggacgtcaaatccgaaggaatgcaaacgcattggatcgcgaattcggttgttcaacaccactgcttggagacgaataagcatattcgtcatgacctgtgctaactggcataagtataagcaaaatgaagacctgatgcgccatctcttcaattttggtcccgatgctgaatttgttgaatgtacagcaaatgacgtgtactggggtgcaggagtggcgctttcggatgttgaaaaaatccgcgacataaaccgatggcctggtaaaaatatccttggacggattctctcagccttgatgaagaaattcctgcgtaagaaatctggtgaaatgaacacaaaaaaataaataaaataaaaaataaataaatccaagattttttttaatattacatataataataataataatttaattataattatattaaatcctatatattttttcaaataacaccgcaataacaaataatttattacagaaatgtcggcaccaacagcaccaccaaatgttcgggacctgagcgaattcccgccgttggaaaagttaacattggaggatgtaaggaaaaagaacaaaattgcctcggcaagcccaagtggaaactcaaatatttctaaggaaacctgtaatagtgcaataagtgtggatttagttgcttcggcaagtcatataacttggggaggggaaaaagggaacattgggcaagaaaaaggggaaaagaatcaaaaattaaataaaaatgttgcttcggcaagccaaagagtgtctgaaaattttgcgaatcaaggatttgacaaaaacccggatgaaatggcagaagaaatgatggaagaattttcaagttttaatgtgggagaaaacgaaggaaaaattgttgaatacctggtttgccaagtagaagaaaatatagtgattggaggaaaattgaggacaatgacaacaaaggctggccacattttgtagcaatctcaaatgaggtggctgaaaaagcaagagagtttaaaaagaaattgcaaatgggagacatagttggagtgaaaaaatttgagtggaaaaatgattaccgatacttagcaaaaagagaaactgacaaaagtcatttcaacaaaatgtggtatgtgcaaaaaataaacagtcaagcaacagtcattgacctcggtcatataagatatgcaattctgagggaacatccgggtttggtcttaagaatcagagaaatggtctcaaatggtgtcacgaaaaagctttgtgctatcattatttctcctggtctgcagttgagttcgagatgttatcggcgtcagctttctgagttggaattggagtctctccaagaaggacagttgataaaagtttggactgcttttgttccagagcaaacattagtagaaaattcgttcatacttccacctcaaagccaatttcgactggggactgaaaagcagatagaggaaggcaaaggagttctctccattgtcggaaatcatgcgccgtggccataccaatcgaactctcgcaatgtcttctttccgcttttgccagagatgactttgccggaaattgagttgtcagaacaaatcatgacctcagcgattgcctacagttttgaagatgaggaaaagagaatagttgaaggcaaatttgaaggaagagcagaatggcagaacgacactttttggttgaggtttgctgaaattgacacagaaaaaaatgaaaaaattgaaagaagtttggaccgaagaagcgaatgtcatcttcagaactgcgttggatttgccgcactttgcttcgggctatgtcaagcaaattgacattgagcgaatcagagaggacggaaagccgaaattcaatttttggataatggccaaagtcacaaatgtccaagagagaaagtttcgtgatgttcatgcaaaattggaagcagcagaagaaggtggagtctttgttgtacacccgatcattccgattggagtgaaacacagaagagattgctttgcttctaatttgccatcaaaaattgcaaatttggaaacaaaacaagggaaaatgatgcgtgcggtattaggcagaactgaggagatcattgaggaaaatgtggaccaaaatgcttcggcaatacaaattaatcacgcattgatganaaagtaaatgaaaagcagcagcagacagcnaaacttttggtgagcaaggagtcgcactttgtttttcagcatgctcccaccggngtgtggcaaaacgtatggtgcccgcatttgtgcagcaattcttttgtcg

SEQ ID NO: 20198 - DNA, 1422 bp, Heterodera glycines
gatggatgcgcgtcgttttgtgtggactgttagcaaagaatgcagtgagagagtgataaatgagagtcagagagtgacgatgagcaaatgtaaagagatggggagagagggtttagagagagagagagagagagatagatagagagaattggagaaagagaaagagagtggagagagagagttggagggagggtgagagagagagagagagagagagaagagagatagttggggagagattataagagaaaaagaaagagagtgatattgagaaattttaataatttcccgtcaaaatcggttaagtacataataatttgaatataaatgatacagttttcattttaatggcttttctctttgtgttaattatcttgaaaacaaagaccgaaaatcttgtgcatattatgaaacaaaatccgtattaggtattttaattgctttaatttttcggttaaattttttatttagtccaattttatattttctttcattcaaatttaatcagattgccagtaattggctatttatggtccaaattgagcatttataattgttagtcagcatcgccggaccaaattttcaatttgaaaaatagtcataaaaattatttttatgaagaccaaaaaaacccagaggtctaaaacactcgagaattttcaaaaatttttccttctacagtatattaaaaaccaattaatttgctatattttacaaatcaactttttgtttggggaaggctaccgaaaattgggccttttcttttatcaatgatagcatggttatatgtttttcattatttgacatttgataccgtagggatttacgggaatttgttaaaaaagttttgggttcggattttttttcatgcatattatgacagtttatcatcatttttaatgtgaaatcttcaagggtaaaaggtttgttttacaatttttcaaaatacaatagacattaattaaatttcattgactatgaaaattctaatgaccctttttaagaatacataattaatccatcatcccaaattgttcctccatttgtaaatggtcgatcgatcaattttcaaggtttttgcaattttctgatcactcatttttggattcttcagttttaattcccaataaattttcattttttcattttttttctttctccgttaattttttaataacgccaaattgtttttttttgctatttttccgtcaatttttttccatcctttttttgaatattttcttcctttttcctttattttctcttttattttataatattttctaattatttctcttttattctcttcatttcgttggttttcttccttttcttcccatttttctccaaatttttcatcaaatgatttttgggttaattttttattttccgttttaatttgattgatttcaattttaaaat

SEQ ID NO: 20199 - DNA, 2421 bp, Heterodera glycines
  misc_feature (2283)..(2283): n is a, c, g, or t
ttttcgggactcacattgacattggcataattatgatcattttgggggacaatgttgttattgacatcattataacgttggaagagtcggagaattcgagcatcagcatcacggtatttctttttcttttgtggagcggattctcccatgacacaccgcgaaatttcctgatcaatcgccttctgctcacatctgatcgtgtcaatgaagcatcaaatagtcggatgagtgcaattaaaaagccgctgaagtttgcgatggaatgcatcggcgaagttgttggtccgatcagcactatccaaggtgcgctgatgaacactccattcgtgtgggtggaacagaggcgccgtaattggaacattgaaacgaattctgcccatgtagttgtccggaaacctaaaaaaaaattcataaaattcgtcttcggacttaaccaattgaaaacgccattaagttgtggcggaatttgtgcttgaagagcattaaggccattttgaaggtggtgcacaggcaggaaggccaatgatgtgatcatcttagacttctcagcgaaggcaggatcagtgttgtaaaccttaatgagtttgaatgggaacggaataataaaaaaattctaaattacatgggtgaggcccagggcccttatttgcttctttgcaaaagtgccgtccgcgtaaatgtctttcatctggtgggtccaatctgccgtagacgctcttccaaaaatgagaatccttaatagtgtaaatgaccatcatttaacggtttaaacgataaatgtcttaccgttggggtccattctgtccgtgaatttgaaaaacgccagtgtccgccaacaggaattgctcctcgtcaatctcagtgcgcttataaacacgataggtattcggaatctccaactgctccaaattgagaggttcggctcgcggtgcattttcatcacggcgcaaacgtttgattacctgaaaaacagaaaaaataacaaaattgttttttttgggtatatccactcgtacgaaacggccgtacgaaaacggcctggcccgtttttaccatacccaaaatggtcaagttaatcagtttcgagagaagacgctcgatttttcgagcttatgggctccatttttatacagcgcttgtcagaaaaaggcagtacaaaaccattgttgcatgccctctagctgtgacaccgttcataaattttgacccatttcgaaacttaactcagattcaaacaaaaagtcgaaaaatctttccatttcatcgaatccctccgtacggccgccattcactttttaaagaaaatagtatttttttggggtcgcttatcacgaaaatggtattcattttggccatgaagtttatggggggggggggacacgcggacgaaccatggccaactgacgacgaccaactgaaccacctcgaccgcactcgtttctccgctgatgcgcagtcgaactgaaatgttccgctatggaagaacccaacagtatttttgtagcggcgctttgcattaaattaacgaatttttgttcgttttttttcatttgatcactttttctgatcagtttgggggccaaaaaagctgaaaatttacaatagagaattgacaattctctacacgataaatgtgattacttatagtttgaaatcttcccttgacagattttgtaaaattattgatttgcctatgatttttcattaagtaaggtacttttccgttttgggcatacacctcaaaatattaaaatacatccaatctaatagatcatgttaagggctttcgaatgataccaagaatattagattttatgacaatgaaaaaagttatggtccaaaacttgggctggcgccgaaacgaccgaaacgccctctcccttatgaggcgagggtctggggttcgaatccggttgactgcggattattttttatgctgtttgatgaaaaaatcatacatacatttattttgcaaaattagaactcaaattcgcaatcagcgcattctttttaaatttttagcattttttactgttattttgtttgtttttggaaaaaattggtgtcatacgattttcttaaaattccatttaggagacagggggattaatagagattgggaaaattagagaaaatacggtatttgtaagttaaatgtgaagctggaccgactctatcaattcatatttgcgttttcgaaaattttcagaaattttcaagctagaccctttcgatttttaattttatctttttaaaccagggttgccatctcacactctcttncccagtacatgcaagtacactatgggtcaagcaagagcccggaaattcaaatttgcggatcctgttgcaggattggaatcaaaaatttttgcagggccggatccggccggattaatctgcaaatctgcatcatgcatt

SEQ ID NO: 20200 - DNA, 2176 bp, Heterodera glycines
  misc_feature (35)..(35): n is a, c, g, or t
  misc_feature (63)..(63): n is a, c, g, or t
ccggataacccccaaaaatatcatttattattttntttttttttctcttattaatatatttcnaaatccaactcatactgtttttcgcattcgatagcccttaaagtttctatatctacaggcaaaaaagtcaagaaaattttattgcttttcaaaaaagttatgaccaaaaatcgtaaaaaaaaaattcgtacatgactttttttcaatcttcatcaaattttttgttatcagtcgaattgattatttatttggggtaaagtaaaactccccgaaatctcatcatttgcaaaatattctcctttgtccaacccctcgagcccattggcaacagttgaagctgaacttgttcaaaattgttttaataaaatgtgattttcgtgtttctttcataaagtactatccgtaaaaaataggaaaaatcaaaaaaaatcagggctctctctattcatatacaaaaaatattcaccaattcccttttcatgactataaaaatcttttgtttaccgctttgactcattaaaaaaataaagtttccaacgcaattaattcttctgctcttttgtgtgacatcattcggaactcggccaaaattgtgctaattgctgccaaaaatgaaccgacggtaaaagaattttaaaagtcacaaattcgtcgtttatttgccctaatttactttcattatttcagttggatttgcaacgacgtttggatggacattttcccatcctttgaccgtcctcaactcggcctcaaaatggcacttctttcgccacgttcgatgcgttggtggacaaacatttcaatggcaaaagcgaattgactatttggagaccaatcgaaattagcaaggacaaaggaccagaaccgaaactatctgtgtggatggatgacaaatctttgccatttccattgcccgaccgtccgttgcccagcaaaatccgttttaagcaccttcagatgtggtaattaaaaatcagagctatcgcaataaaagcattcatcccatttttaggcacatcgatcactccgtcatcgcttttcttcgttcaaatcatcaaattttcgacaaaagaggcaccaatttatatttggcgattccatcatcacactctacgaatggccagccgatttgggatgtttttgttcgtgaaatttggcccattttttctgaaaacattcgccacttgcactttaccggtgatgatcatttggacaatttgcttcgtcgcacttcgccgacaattctcatcgatctcaaccaattgaattcaatccattcatttggtctgtcgcccgctgcgtttggtgatggttttgatgtgccaaattcaacaatttctgctggccaagcattgtccaaatggttgcactctccgagaaaagatggccaacccaagcgatttcgttgtggcagaaatttgaacgcacaagcggacttcgattgggtcaacagtttcaaggaggtgtggtgcggagggaggggggagcagggcaaaatgtcgccgcaaatttttcttttaattttaaaaaattattaaaaatttagttatctagcctaaatcaaaaaaaaaatcataaataaattcgaattttttttttattaaattcaaggaaatgtaaaaaagtttcaagtttttttttctgggaattctgcaattagttttattaacacttagtttctaaaatgagttgaaattttcatgaaaaagcggaaattttttatattgttttccatacattttttaggggggggtcgacccccccccccccccccccccccatcatctgtcacaaagggggctagcgaggggacgagaaatcaggaatcattaaggattgaacgggattacaactacatacaatattgatatcatataatacaggctgccgctcgtgtgagcacttctgattgctattgacactattgacgatgctcttattagtaatgaggacggtactataaaccctgaaatggttgccggtgctttgcttgatcgcgagaagcgagcagcaaccagcaatgtgcctttgcgagaagagagtgatagcgaagaagaatatcaaagaaaattggataacttttttttgaaatgagagattcagatgatcttctacttttcaaaaactaattgccaaacatttggaggcggagctgacaaactgagcaaagatg

SEQ ID NO: 20201 - DNA, 1105 bp, Heterodera glycines
gggataaattttctaaaaattcaacaaaaggactaactattatttcttcccgtgtatccaacaagagaagcatagaatgtcatttacggttcctgatttactcattaaaattccaaaagccgatttgacggatagaatttctaaaaattcaacaaaaggactaactattatttcttcccgtgtatccaacaagagaagcatagaatgtcatttacggttcctgatttactcattaaaattccaaaagccgattggacggatagaatttctaaaaattcaacaaaaggactaactattatttcttcccgtgtatccaacaagagaagcagagaatgtcatttacggttactgatttactcattaaaattccaaaagccgatttgacggataaaatttctaaaaattcaacaaaaggactaactattatttcttcccgtgtatccaacaagagaagcagagaatttcatttacggttactgatttactcattaaaattccaaaagccgatatgacggatagaatttctaaaaattcaacaaaaggactaacaattatttcttcccgtgtatccaacaagagaagcagagaatttcatttacggttcctgatttactcattaaaattccaaaagccgattggacggatagaatttctaaaaattcaacaaaaggactaactattatttcttcccgtgtatccaacaagagaagcatagaatgtcatttacggttactgatttactcattaaaattccaaaagccgatttgatggatagaatttctaaaaattcaacaaaaggactaactattatttcttcccgtgtatccaacaagagaagcatagaatgtcatttgtacgctttcgatggcgcacaaatgggaggggtaggaatttggcgagatgtgggggtgctgatgagttcagtggttggtagagggccggcgctgcttggtggtgctgggctttgagttgtggacgagtagtgcgagtcggcggggtgggggcggctggcgcaatggtgtccaagggagggactggttgtgccgaaattttgggggagcttagtaggatcaatcggggatggtggaattgctgggggtcaagt

SEQ ID NO: 20202 - DNA, 1460 bp, Heterodera glycines
aaattttatttaccgccatcacaaaaattttccacgcgtaacttttcgggtggcgcactcggccagcaaccatttgggaaaaattgaaaatgcgcacttccaattcacagaccaaatccaactcagccttctaatcgtttttaggggtcaatgataattagtaaaaagaattttttctttaaaaattaaaaagcatttttaattgacaattagagaccggacgggatcgggatcccgcgggatttcttcgggatcctgcaggattaaattcgggatcccgaccttggaatccgtcccgaacgattttttaaattcatcgggattgatcgggaccgggatttcatcgggatcccgaatcgagatccctcccgaccattttatcaatcccgcgggatcccgcgggattgaagtcacgataatttttggaaaaactcacattttttaaattaagaccttgaatttaaattaaaaatttgcttatttttctttaaaaatccgttaaaattccaaaaaattttcacggctctcaaaatacttgtgaaaattttcaaaatttgacgcaaaggttggccattttgtgaattaacaaaaattatttttttttaattccttaaagaatattttaaatcttattaggtagtttcatgcacaacaatctaagaattttgtctaaaaaattagattagaaattgttgtctacgtatttttccttcggtgcataacggcaccgccggactctaaaaatccttaattttcctgaaaaatttgctcaaaatcgctaaaaaaattggggtttttgggcaaaatctgttaacaaatcgcatcaaaaattacaaaattttttccgtcggtgcctatcggcaccggcggcctcatcccctaaagtttttgaaaaaattctcagcaaacaaaaattttaaaatgattttttgattcagattcgggatccctccgacccctgtcgtccggtctctattgacaatttgattaattacccattctttattttgtctgacactttccaagtcgtaaaatattattttttgcttgcagccaaatgtttgcttaatgcttgcgattagtacgcgaagtggtccgaaataagcgttgttggcggccgttacaaacacaaatttcgaattttcagggaatttgacctgtaaaatttaaattattattaaaatattaagtaaattatttttttaattattttgcttgaattttgaaaaatcaaaatgaaatattaataaaaaaagattagcaatgatagcagtcgaaatggattattaaataaaataaataaataattaaaacattagcattaggtttaaattatttaaatttaattgttttatttaatttttaatccatgcaccttaatcttttctttgattgcgtatttgtccgacaatttgtaccgttccaaaagccacgcaaatgaacagtcgaactttttgcca

SEQ ID NO: 20203 - DNA, 2303 bp, Heterodera glycines
aagttgtcatataaactaaaaagagaaaataaataaatttaattatttattatgtttaaaaataatgtaatttattatttttcatatgtcgttggtctctattattcttattattagggtatcaattattaggtgtcaaaacgcccaaaaaatccttttttcttctaatagtggcgattctatttttcagacacatcaaagggaagcttaatgggaggggggggggcttctattagaaggacacggtaattagttttagttggtacaaatggttgtgggtatttttgctggttttaatcacttttaaaccaaaagggcgaaattggaaaaatgaatttttgcctttttattagaatttggtttcggtggggaacttgccaatgaatgtcatattcatgatcagtgagtgatagaaaacccccgaaaagatgttaaaaatgaatggcatactgtaatgcaaactaaaaaacagtaatggaaacagaaattaacacgactcattgtcacttttgcagagattccctcattcgtccgtcccttctcacttcccaggacttggattggtttttacattacagaccatcgataagaaatacctaaaatatatgtttaatctactaaattgattgcatcatcctcttttacagaaatttacttctttttttagtagaatattaccacatatgttttggtcattcttttataaccaatggcttcgtttctcccagctaaagtttcatttgcttttgcacgatgaaaggctttttctgtttttggacgattttatgttggcttctgcgctgattacatttgtgactttcacattttttggaatgcgtgcttcttacggaagatatgcagctttgtctttcttttcaaaggtatttatcgctgtttggttttttcagccataaaattattattattttttcaattctaaacttttttctgatgttatttaattcaaatttgtcaggtcagattgctattccggcacggattggttggtttctccaggaaatgccttcttttgttttgccgactttcgctgtctgttggcagttgacaatacgttttcttcctcccgtcaatgccattgttctcctaatgttcattgcacattattttcagaggtagtaattggcaaatattattttcctggtatcttctgtcaaatccgttttaggtcattcgtttacccttttctgattaaaggagggaaagccattcctgcccctctcttctcgctgggcttcattttctgcacttggaacggcttaattcagggcttttatcatgcaaattgtgctgtttattcttccgaccatttttggactcttagcgctttgattggtttttttccattccaatttaaagtcactctccgtttcttcactttatttgtaggtttgccacttttcgctctcggaatgttcattaacattcaatccgaccaaatccttcgagacctcagaaaaccgaatgaaattggctacaaaattccacatggcgcaatgttcgaatttgtttcgtgtgcaaatttttttggtgaaattgtcgaatggtttggctacgcccttttcgcccaatcgcgagtcgcgtgggcattcgctcttttcaccgctgcgaatacaatgccacgagcgaaggaacaccacaggtcggagagaacggacggagctgacattgtaaaccaattctcttttcaggtggtatttcgagcacttttccgattacccgaagaaaagaagcgcagtcattccctttttatattaataaatttcatttgaacatgcaacgaattttaccaagggggggggagtacaaccaatgaattgttcgtaatttcaaaacagactttaattgacataaaaacacacttagttaaataaaatattgtaatcaataattgaattaatttttatttttttatgtcagtgcgttttttaatactttcgtccgttgtttcactcaatcctttttttttaatattaatgtcttaaggaaaaccctccttcgaacagtgtgttccgatgttgccagcaataaatcctgcaaattccgatgggattgttttagccgcgcttccgtaagtaattcttgtccgataaagatattttaacctgaataacataagtttttgggtaatactactgacgataccccctttttcgaaaaatcaaatattgaattctttttcgacaaaagggttttgagggtcggcgaatcagaatctgacattaatttcacctatgtcgaacccctgcacaagaagtcatgcaaaaattcaaattttgacttct

SEQ ID NO: 20204 - DNA, 1463 bp, Heterodera glycines
tgctatattatatttcattttgtctatttcttttcccagtattctctggcctattttagcgcatctcttcttttttataattacctctttttctcaaattttctgctgattccctcgtctctctctctctttctctctcgcgctctctttctctccctagcgctcgctttctctctctcgcgctctctctgtctctccctccctctcttcccctccccatctccaccttttctccccccccccccactatttctctcccttcctttccctctctctctgttttacccactgtctctctcccctgttatgtacccctctaccactccccctttttttcttctgcctcgtccaatgccatttatctcaatttcgtcatgcctacggcattttagcggtgtgtgcgtgccaccgtcggccggggcgaaagtgggagaaaaggtgggaggcggcacatgtgatgagtgatgacttcagcggctctcggtggtcggcaatctcacgaatccggcaaaaaaataaacaattatgccctaaataattgacaaagtggcatttccgcactccccccccccccaacaattagtgtgggtggataatctcctcccattttttgatggaattttaatcaaatttttcattaagaaccaaagattatacagtttttgcgggaaaagaaaattgatgtttgaaagggatttacagtttaataaaatgggattagcttaatgattttgtgagttttgcaaatttaattcaaattatggacaatgaattccatcattgttaaaaagcgtggaaaataacttattattttttattatttaatatattctaaatgattattttattattaaagaattctttttaattattatttttatcaaatattaagaattaataataaattaacgaaattaaaaatattaatttcctcccccgccaaatgaacaacaaaaatttgtttacatacaattcaatttgccattatctaaacctatttaaatattttaatacttttttttcaataattctttcatcaatataaatgtttttttttattaacttatcccatttaatttttttgatttataaaactatgactaattaattcaatttaaaaataaataataattattccacgaattcttatcatttgttgttaatcagcacaaattactacttgtatattcgccaatttccccatgacaaatgacgcaccaaaaaaaaagataatttgctgtttacaattaaatttttgccccaaaataattcgacaaaatcaatttaatttaattaaatttcaaaaatgcatgcatgggtttttcgcggttgttcccgcaatttctctcatccattttccccccaacgatgaacaaaaaatgtaaaaaatgttcataggaaatgggggggggggggggaatcgatcgggagaacacagagaaaccccccgtgggggacgaaaa

SEQ ID NO: 20205 - DNA, 1721 bp, Heterodera glycines
  misc_feature (177)..(177): n is a, c, g, or t
ggacgaaaaataatgtgaaagaaagcgaaagcggcggcggatgtttttgatgattctgctgactaatgactgcgataatgatgatgatgcatcatcatctctcgtctttgtcgtcgtcgtcctgtggtcggtcggttggtcccctcccaaaaatttatttggcgaataaaccaaacncaacaaatttttgtgcttttatacttttttttttgtcgttatgcatttcccgaacttttcgacaaaattatttttttctcatttgtcagtttaattgaccgcaacaaattattttattttttatatttttatttggttaattgactcaatttgcaatttggatattaattttgagtaaaaatggagaaaggttccgcattttttgatataaatttggtttaaatttctcatttttagaatatacaaatattatttactcactttaaaaattataataaaatgaattttcatttgattccatttttggtcccattaaatttttgagatttgcttaactgtcctaattttcttcgcaaataaaatgccaaatttgggtttcgctaatgctaatttttttttttttttgcattttttaatttgggaaattcattttcattgaaagtgaataacgttcaaatttattttcttttagttttttgaaaaaataatgaaaatttccgtaaagatttagaatttcaaaaaaaaatccaaattcaatactttaaaaccaaatatataaaatttaaattaaacaaaaatatataatttgaaattgcaaaataaaattctatcaaatttgaaaaacggtttcaatttttctccattttccccgagggtatcatttttcagtgctatcatttcaaaaaaagaaatcggctattttgaaaaggtccaaagatcgacggaagaagcggctgctgcttttccttttttctgcttttctcttccttttttctttctccgcccgccgcataattttatttttgccaaaattttatttgcctcctttttttattcctcacaaggcattctaaaataacttcttttttcttaaatttagaaaaggtttattttcgattttttattatttcgataaataattttattaaaatacattaatttaatgaaaagaaattgtttaaattaaatttcaattaaaattatataaaatttccattatcactatttgcttttatattataaaaaattattaacatttaattatcaaatttaaaaaatatataatttaatacccttaatttgtttatgatttaaaaatttttttctataattaaattccaaaaaatttaaaaaattttattttaaaaaattttaaatattctcaaaattaattaagttttcctctcttttgcatgtgcattttaaaaatttattgcatcgcatcaaattgcataaatgtttttttctatttttgaaaatggaaaaattccgccattccgtcgtcactttggcattcattgccaattcgttttgtggtgggcctatgacgtgccgtcaaacccaacattatattactctacatcagcatcactatcatctttgttgttcctcctcctcttgttcctcatttgttccatgttggcacacattttttgccggcattcaaatgccaaaagtgactcaattttgaggttgaattttcctttttaattaaaattaaatgtattggagtatataattttttttaaataatatttttggca

SEQ ID NO: 20206 - DNA, 2314 bp, Heterodera glycines
  misc_feature (10)..(10): n is a, c, g, or t
ataataaatntttttaaaaaatatttaataggctaaatttttaaatttttaaccatgtaaaaggtaatttcaaactgtttttagtttatttctatattttttaaaaagatcaaaatattttaagtaattttacattattttggattttttttttgggaaagttacaccctttttttgcggcgcgctttatccaaagagaatttgagaaactgtggggaaggaagggtccggcggtgccgatatgcgccgccgggaaaaattttgtaatttttaatgtaaattgttaacaaattttgtccaaaaaatggaaaatttagcgattttgagcaaattttcaagaaaattaagtttttttttgagtccggcggtgccgataggtgccgtcggaaaaaaaattgaaaatttctatgcaatttattaacataaattgtacaaaaattgctaattttttgaaaaaaaaactcaaaaaaattccgaaaaattccgacttttcatcaaaaatttcggaagtcggaagtcggaattccgaggccccaaaaattttcggaagtcggaattccgaggccccaaaaattttcggaagtcggaattccgaccccaaaaatgtcggaagtcggaattccatgccatccctgattcctttgtttcccaactctctcgcgctctcattcttttttctctgcattccatctctctctctctctcattcttttttctcttgcgttccatctctctctctctctctttctatttttctttctcctctctctctctcattcttttttctctgcattccatctctctctctctttctatcactctctgtctctctctttctttctatctctctttctctctctcattcttttttctcttgcgttccatctctctctctctctctttctatttttctttctcctctctctctctcattcttttttctctgcattccatctctctctctctctttctatcactctctgtctctctctttctttctacctctctttctctctctttttctttctttctctctccatatttatctctctctttatcctgtctctctctttctttctctctcaacaatatctgtccttctctggcgctctctctctctctctcaacgctctctatctccttttctcgccgcagggcctccgtttcccggacgcgtacgagcgcctgttcttcgacctgttcagcgggcgccagtacaattttgtgcgcgcagatgagctggagcacgcgtggcgaatattcacgccgttgctgaagcgcatagagggcgaccgggtcaagccggaacagtacgaatacggaaggtgggaatttgggggtttcagttttacaaatttattatatgccttcttttcccgcttcaaaggtagggtggtgaagtttttcaacgaaaatttaccggtcccgagttttgactccaagcaagcttttcgagaccgaaatttgctctcttgaccgaaactaacaaaaacgacttttctctaggtgacgctcgaattgactctcgactatttagggaaggaggtcttggagagaggaggggggggggggctgccgacacgaaaaatttaaaaaatttggaaaacaatttttttccttaataatttatgatgaccgtccctctcttaggcaatgattaattgagataattagtatttagaatatttactctaaaataatcttttctaattgttttagaattttaattttcaaaaaaaaatttttttttttttttttgatttacccatttcaaaaaaatatcggtccttcataataaggggcatctcataagaaacgacgactttttgcaaaaagccctggattttaatgagtcagtattaaaaattttaaatatatccctcccccccatccccattttgaagtcgtggcccgtcctccagcgatgcgctgatgcaaaagcacggctttgtcttcagcggcacttacaaatggccatcggtgaacccggcggcaaacgggccaaataaactctgatcggttgtgatcaattgaaactgattgattgattgtcttttcatacatttatccaaatgattaatttcacatttttccaacgaatttttttgtttttgttttgagaaaattgttcacacatttatcttctaaagccagtagcacttaactttttgtttttcctttttttgtttgtcatttctgttttattctcatatttttcacacaaaacaacagttcacattaatttgcacacagtttacatgtaataaaagtgatgaaaacgattcattttatatgactgaatttaaaaaattag

SEQ ID NO: 20207 - DNA, 1256 bp, Heterodera glycines
  misc_feature (1199)..(1199): n is a, c, g, or t
cgtgggggtttccccgcgcaggttcgaatcctgccggctgcgaaatatttttgtgtttttttaacagttttttctcctcaattaacctttcattttcttttgaaaaaattaaaaatgatatatagaaattaatatttatttaaaaaatatttttctttttaatttttagttataattcaatttttttaatttcgttgccttttttcgcgaaattttttatttatattcgtttcaattgtctttttaaaaatgtatttagctaaaagcatgcttttcataacgcagtcgtgtccgagtggttaaggagacggacttgaaatccgttggggtatccccgcgcaggttcgaatcctgtcggctgcgattttttttcttaaattacgactaatattatttaaccttttttaatatataaacatacattaaaattagaggagtcaattaattttttagatgtaaaccgacaaaatttgatgcatttttcgttttcatttatactattttttttgtctatttttcaaaatttcccatagcaattctccctataaatgtacgaataattatttttttagtttatcgaaaaatgtgtctccattgtgaaagcggctgtttcaaagatgagaaggacggggtgcacaagtgttgtgacgatgcgtgtgccgcgggatgcaccggcgaaggcaccgaccaatgcattgtgagaattcattttcatttttgattttatttattggctttttgattttttgattgctcattttctctaatttgtttcagctttatttgtccctcttcttaggcgtgcaaaaagttcgagcaggacggccgctgtgtgacggagtgccgcggcttcgaccgctacgatccggcggagaagcgcatggacccgctgccggaagcggaccgacgcttcgcctacggtcggcactgtgtgccaacatgtccgccgggcgctctgtatgaaggagcgcactgtgtcacgcgctgttcacccggcaaataccgtaacgcgacggaccattgcgtactgtgccagggcgaatgcccaaagggtaagagcattgcgagaaggttattgtagtggaacaaaagataaagctataccatttatgctaattgtcaaattttgtaaaaaaataaaataaataattccgaaaaatttaatcaaaaatactaatgaaaaaattaatcattttatngtctaaatgacaaaaaatgataaagcgcattaaaaaactgacaaaatacttttaaat

SEQ ID NO: 20208 - DNA, 1154 bp, Heterodera glycines
aaataatttttcagtgatagaatctgctatcgaaacgacagaagtaagcccagtgaactgaaaatgaaaaaggaatggtaatcaaaaagatattcagttggatccattggtgatcattagagaccgcattttgaggcatattcctcgcattagttccgatatattaagcataaaaacgcattttccacttggtttgaagcttctacgttgacttttattatgccttttttgccgttttggtgccttttttggcgttttttccaaaaaagttccattaaaaatacaataaatcgggaaaatacacccctaagaaatgagttgaaaacttttcagaaaattcacccctaagaattgaaaaattttctcaaaaattgatcaccaaaatttcattttttttcttgataaaaaaatttttattaaaaattttccttattcgaataactattaaaaacacttagacaaaaactaagttttttgaataagttttacgtgttttgctccctaaaaatccttaataaaaaaattttaaatgctttttttcatgcctttttcgttttcgtgccttttcatgctttttttcaatttttttgttgccttttttctgcggtctctagtgatcatttgttaaattgtttgttttttaaatgaatttttcgtctgaaagatttattaatttgtatgtggcatcgattgttcgcggatgccaatgatcgttatgggaaagaataaaaagtcatggggatggatacgcttgaacagcaaaaacattatacaatatggtcaaaacgaccagaaaagtctttgggagaacaggaaaatattttaaataccattgaaacaataatttttaaaaaatattttccttttcgtcatcactgagttcaaataatttgtgggattaaggaaaacatatttgttcaattctaatcaatgtttattttacatagaatctatcaattaagtgatcaatcaagagttatctctgctgtttaaatgcgtcaattggttgcactttaattgttgccactttgttgttgttgttccttcgtccgttgacaaaatatttactcataaggggtagaaactcacattttttgtgcataattttgcgcaaaaggaggatgcccataacaaaagcctaaaaatgttaattt

SEQ ID NO: 20209 - DNA, 915 bp, Heterodera glycines
  misc_feature (874)..(874): n is a, c, g, or t
aaaagtttctcctcataaaggggtttagtaacgataccatgaatatctaatattggacgggaaaaccctaaaagagctcaatgagccgaggcgggcactcctaagtttttaaaagggaaaaaccagataaatctgaaagcattacaaagtccttgatgaattacatttaaaaatccaagacaaaagtcaagaccgaaagcatttgattagaaacagcttcttctcaacatccccataagttgcctttgggatggtaagtctatgacctattcccacagagtaagagttcctgaaacattggacaattcaaaaatgacttatttctaccgtatttcaagcgaaaatgatagaaaattgactaattttatggtactcaattttgaaaccctatgacgctctgcgggtattagttctgtctttttgtatattgtagagaattttatcctctttctgataggcctactctaatttttcataaaaattttcccaaccgcctaggaattgttttcgaaaattttcccgattttcagtgtattttgggactcccgatcaccatcagagagtgatctgatcatgttggtccaaaagacttttttgatcacatcaaaagttagcctagcaggaattttttcagaattcttggcgcccacaaaacattgaactctcattaactaaaaatttgtttccatacttttgcaccgccaaaaattggtcactttggttgagcacccgtgacttttttatgaattaggtgatcggaatgtctttttccatttactagagtaatattaagggcttattctggcactgagaagatttctattcaaacgctcacctcttggaaaaccggtttcagaaaaattcttctttttgnttccatattttgcctgactgtatcacctttcacttttgatt

SEQ ID NO: 20210 - DNA, 2019 bp, Heterodera glycines
ttttctgtaaccgctcagaagattttcgtttatccataagcaataacaataatttaatgtaacaaattgatcaaaaccgtaaataaaataagaaaaagtatcgctaaaaagaaaacattaaataaattcacttcaaatcatcattcattgaaacgaattcttttaattgattaaaaaactgtaatcctttccctctttttacctttggtaaagtttcttcattactttggaaacgccattccatttttacacgtcattcaatttatattatgtatttgattagagaaatgtttaaggaaatttaagcttttgcattcttttcaaatttactttgacttcaataaagaagaaaaatggcttcatctggctttagcgtctatggtaaaagttctttcaaaagttgtagctttgagcacccttagaactgaatccaactgcaataccatttacggaatttcagtctatgtttacgtaggagcttttttgtacatgggtttttctggacataaataatcgacagagcgtcttaaatcgcaaaatcgatggagaaaatgaaagcggcagaaaattatcgatgtgtcggtctaaattatacaccgaaagctaccaccaccaccacaaatcggtgtgaatgatgtgtggttaaagaaagctgcgcagttaattgggaagaaggtaggtgcatgtgtgtacatgtggttggattgattgagacctcaaagtcttgtttagttgcatttaacatgagatttttcatttttatccgatcaatccatcataacgcgcattcactaacggattcgtagcgctttcggtccggctaccacatcaatttgttctctgagtgataggagtctaacaaacgcataaattgaacgtacaaaagtgcaatttatttagttggcaacattccgtacaacgcaaccgaagcggacattggcaatttgtttagtcagtgcggagtggtcaccaatgttcggtaaatattttgagttggttttgatcgtctattattgcattttttaagcattgtgtacgaccgcgagaccaatcgcccaaagggctttggcttctgtgaattccaggtgattgcatctttcaattgttggtcatgttaagccctctattcatttaggaccaacaaggagctcagaatgcggttacaaatctgaacggagccgagctcaatgggcgtgcgctgcgtgtcaattggaccaacaaataagaaggttgtgcttgaactggacggatgatgatggatggattgtcatttttgaggatcgttttgacaattttcatttttctttgttgattggttttttgaaataaaggaatggttcgtttcacttagttttgttatttcctttgttgtagttctaaacaaactatcgaactgaaaagcaagacaaatttacgagctatctgtgtacgggtgcacacatcgagttaaattttaaaaaccatactgtgtgtttaaacaacatttaggttaaattcaattaaaatggtacgtttaatttcatgtaagagagctgtctcgtttagggactgacaaagatactcaaattgtcgatcgcaattaggcatttttctgtgacgttttactccaatattatttttttggatttagagtggttttttggttattcatattttaatcttcttcatcagttttattgggctttcatttagcactgaaagcaatgatacgacgcttgttatcgagtttattcgttttatttctttttgtcaattttgcctcatcatattttattcacattgatgcaaatgaagagcagtgcttctttgaccgtgttacatccggcactaaaatggtaattccaacaaaaaaagatttggcgttgggaatatgagagtctcatttcgttagaattaattctgactgtttatgtgaaagcccaaaattcgaaaaattccactataccaattaacttcactttttagggattgatgttcgaagtttccgagggaggctttttagacatcgatgttaaggtt

SEQ ID NO: 20211 - DNA, 3048 bp, Heterodera glycines
  misc_feature (3028)..(3028): n is a, c, g, or t
cgcaaaaaaataaaaaattttcaaaatttttaagaaaattagaaattattttagcttttttgaaaatctaaccattaataaaaactaaatttgctgccttttaagaaaaaaatcaagaaaaaacttgaaaaaaaaattttttccatgaatttcttaacaaaaaaattttttttttaaatttttctaggtaactaaaaaatttttgattttttttaaattaaaaaaaattatgcgacgacattatgtccggcgacgttttgtcctgctctctgaatgatcagtcataacaatgtatttgtttcggacagtttcaaacacaaaagatcaaacgcaccacgcaaattggtcgccgacagataaatgaaagcggccagcgatggaagccaacgatggtaactgatccaaatccgctccccaaaaagtcgcaatacgcaatcggacattctgtcatagacccactgaatttgctcatcgtcccgtcgttgggcagtaataagctcagatgcatcagcgtcagcggaaaaatatgacattttttgctactttttgggtaaagttaaaagatagaaaatccgaatttaaataaaaaaaaatttaaaataataaaaatcaccgaatacatttcaattggcgaaagagaggagattcacgaacacgataaaagatgaagcaaaaatcaggggcattgtaaagcgatgaaacaataaaaaagagataaatgagttttagaagaaataccattcaaatataacaaaattcaaagtggtaaaataaataaataaaaatatggcaagctctgaaatggttttgtgtgacttaacgcaacttcatatattgcgactcgcccctttcattttgaatttcgctgcgcgtcgtttgcccgtcgcttccctttaaaagttgggttttaaaaaacaaattcatttgatgctctgatcatgcatttgagtgtgtgttgtcctactttgtactcaatgttccattcgtaccaacacccgtcactgtcaattttgcgatgaatgttgaaagtcacagttgtggtgtcccgaaaatggaaaagtcgacgaagcggaaaaagagcagggaacctaaaatctattcacaatcagtgccatttgggtaataatcaatttttaaagcaaaagacggtcgaaaatgacagactgacggaccaagagtgcatattctccgtaaatcgcaacggatgagtgctcagacaaatgtccttgaaaagattcacttcaaaatgggccgaaaagcccatcagctgaaaaacagaagcgaaatagtaagaaaaaggagacttcctcagtattgctactcacttcacaattgggcggcaactcaaaatgaactttcgattgtcgagaattcgaagacccctggaaatggatagtcacaattagtccaaaaggaattcgaattgtgtcgacctctttattagggtgggtaaagcgaaaacaaggctccacatttccggccaagtaacaaaactgatccatgcacacgacgtaagaacggtcgaacgcacagccaaaaactctaaaaggaaatcaaaacataagcgaatattctgataggtaactgactttttcgatcgtcccacgctttgttcctcacttttgcattggtcgagcgcggcgacactctgatgaaggtgaagcgattggatgggagctgaaattgaaggaaatgcaaattgagagacaaacgaatggtcaaactaatgaaattggtgtatgtttggggaatgcaaatggttcccggcttgagaatgggcgaaacgccgtcgagacattccgggcacaattcattatcaccgaaagagccgagcaattcactgagaaaggacggacgaatgaaaagggagggacgaagagaagaaaaagactgtgcctgatgatcaaatcgggcctttccaggactttggaatcgacaaaagtggacaaagaacgcatgtcactgtgcacaatttggacggagttggcccacctgcccaaaaacagcgtcatctcttgcaattgggtagctaacccacctttcttcgttgcagtatttcaggcttaaaattgcgttgcgatttttttccacagcaatcagtttcattttccaattctaaagtgaatgaatgacacttgaatttcaataccatttcaaatgtacgaggcagcattgttcgctgtgctttttctccctctccaattcgtccctggcgtttatggctgcttggaccaatggacccctcccggcgcccaacacaaaaacgacaatccctccactttccttaacaaaaatcaacaattcgctaattctatcattatgtgatcaccatttgtcgttgacttaattccaataacgcggctttgattgccatctggtaatgttcgtacttggcgttgtcctgttcaaacgtctgataaacggcggagtccaaattgtcagaaagcggttgcaagggcgtctgaaggaaaggttcagaaatttaggaaaggaaaataataatccgaagcacctgtaacaggtcgaaataaccagacatcggattttcacttttgcatatgttttcattcgacaagatgagttgttttgtggagaggaccatctgtttcaactcacaattagcgaagtgatcagactgaacggacgacgagaaaaggacgacactttgacgacagtttgacaaaaggtaattgatcagcatacgatggacactgtttaatgggattaaaattaatgaaattaaaaatcaaatgcaaactttggaagtgttggagacgaagtattttcatcggaaatgaacagcgaatggtccaaaaaaagtgaggaaatctaaagggagaagggatggaaatgatagtgtggataaacggggagagtagagagggcaccggttcagcaagccaccggcgaagggacaaattgttgtgcaagtcgaactccgagtcgaggtcagcggtaagcgaaagtgcgacggacaagcatgacgaattggcacagaagagggcggaaatcgcgccatatcgtccanaatgtcccacgaccagacct

SEQ ID NO: 20212 - DNA, 2205 bp, Heterodera glycines
  misc_feature (2158)..(2158): n is a, c, g, or t
tttccatttatttcaatcggctagtgctttaaggttttctgttttgactttgcttttttttccatttattccaatcgaccacgttaattcattctctatacatttagtgtcttatttcatgaaattatattaatttaattttaaataaagaggcaaatttttacagaaaataaatagacgctgactaattagctaacatttataaagaaagtagaaatttgattaaatgcatatacaatatacaaaatattacttttttaaatttgtataaagttcctattttgtctttgactttgcttctttttccatttatttcaatcggctagtgctttaaggttttgtctttgactttgcttttttttccatttatttcaatcggctagtgctttaaggttttgtctttgactttgcttttttgtccatttatttcaatcggctagtgctttaaggttttgtgttttgactttgcttttttttccatttatttcaatcggctagtgctttaaggttttgtctttgactttgcttcggctagtgctttaaggttttgtctttgactttgctttttttccatttatttcaatcggctagtgctttaaggtttgtctttgactttgcttttttgtccatttatttcaatcggctagtgctttaaggtttgtctttgactttgctttttttccatttatttcaatcggctagtgctttaaggttttgtgttttgactttgcttttttttccatttattccaatcgaccacgttaattcattctctatacatttagtgtcttatttcatgaaattatattaatttaattttaaataaagaggcaaatttttacagaaaataaatagacgctgactaattagctaacatttataaagaaagtagaaatttgattaaatgcatatacaaaatattacttttttaaatttgtataaagttcctagtcgtatgtgctttgcgttggttaattggcgtgggtgagtgtggtggttgggccgtttttgcgatattgtggctggaaaaaagaagcgatttcgctgtggggagcgcggccgtctgggtttaagtgcttgcttgcgcttgtgctcggcattgaacggtgatggctgctgctggggtgccacctttgtcgtggcctcagtttctccagcgattggcagctgtcgaaatgaataaaacatgcagctcgtctgtgtgttaaagaaatttggcgagttaattgacttgtgtaaatgttgcctaaggcacaaatgctgtggggaactcagcactggggatgctgaacctaaagttggtggtggtgttggtatacgagtgagtggcgtattgccatggttgacaagccctatgagttcgtggatcggaactccttgcctggggaccagtgtgcttgcattcgaaaaaacacgagacataagcgcccgaaggcctttggcctgaggaagtgtcctaaccgggaaatccggagtgctcgtgtgagtgcctgtgcactgccctcggagctgtgtccagcggcgagatggttcttcccaagtccgggaagctcggatgcctggccagcgctgtgtcattaccacttgctcggtcgccttcgccgcccatgcgcacgcttgcgctgaacggagttgtttctgctgaaactatccgtctttacaagacggctgtaatagcggcgcttggcaacgctcgctagcagctatctggttgatcctgcctgaactgatgtgttcatttcaaagattaagccatgcatgtgtaagtttaacctgccagacagggaaactgcgtacggctcattacaccagctataatttacttgaccttgacttcttacttggataactgtggtaattctagagctaatacatgcaccaaagctccaatctccccagagcggagcgcatttgttcgccacaaaaccaagcgccctccgggcgtccagtgttgactcagaacaactaagctgatcgcacggtcttgtaccggcgacgtgtctttcaagtgtctgccttatcaactttcgatggtagtgtatctgactaccatggtgatgacgggtaacggaggataagggttcgactccggagaaggggcctgagaaatggccactacgtctaaggatggcagcaggcgcgcaaattacccactctncacgcgaggaggtagtgacgagaaataacgagaccgatctcttatga

SEQ ID NO: 20213 - DNA, 2125 bp, Heterodera glycines
  misc_feature (19)..(20): n is a, c, g, or t
actaaaatccccccccccnncccgaatgtaaaaaatttccagtaaaatttggcatttttttaaaaaattttaacaaaatgcattaaaatttaaaaaattttcggggcggtggcgcctgtcagcaccgcctggccctcatttgaccttagtttattgaaatgtaaaccccaaaaattgcaaaaactagacctttttggggcgaaaggcgggctacaaatcctattttttccttttaggcgctgtgattttaaaaatcacgctggaaaaatttttttggcccgaagagcaaaaaaaagctcttcggctgctgcccctcccattacgattttattatatttacatattttttcaaatttaaaaaactttataaaataaatttttttttggaaacaatggaatcatgattttctcaaatttatattctcataaaattcttattattctgcataatttcgtttcatacgagctttggaaaaagcgatgaaaacgttgctaagctcttttatgggaattttcacacatgcttcaaccagcgagggcaaattgtattttttggctaaaattataatttaaaaataattattagatttttttgaccggcataaagcacgtcgatggcatttttgccattcactccgctcaaatcatcggtataaatgaagctcaacatcgttttgaatgcttcaacatccacatccgggatctcaacgggattatttccctcttttagagaggctaaaactgttttgtattttaatttaaaaatgtaattttatctaaactctttttgccgggttctggagttgccaaaacgggaaattcttcgtcaaatcggaacattgcgtcgaacacatcggaagcaactctcaaaattggtttatgtgctggcaaaagctttaaatttaaaaagttaaaagaattaattttaaaatggaaagaagactttaaaaaactaaaattattattattaatagattataaaatggcaaaatttaataaagttaaattaaaaatgtaatttaaataaaacccgcctcttgctcatcgccttgtccgaccaaaaagtgcacatccgcatcaacacccgtgctcaacaaacggttcatccggtccgacaatttgtccatattcaaaaaaacaaataattaacggttgaaattttcacgacgaattaaaagagttttttaactttttaataattttttcgaaaattaatctttttctgagccatatattgtacaatatgcaaataaaatcaagctaaaaacattagtgtatttcatgatttttcatatatatttacctgttcggatttatattttttgatgttattttttgcgaatacatatgaaacaccatgaaataaactcaatatattcagagacagtcaaaataatcgatttaaattacgccagttaccgtatatactctttttatatgccagtctccattaatctgccggtctccaattatatacccccttctgagaaggttgaaaaataatctaccagtctccatttatgtgccagggggggggggaaatagaattatttaataatttatttggcacattttccaaaaaaaaattaaactcaattcaacagtaagaggggctaataaataaggaaccgacttttagtgacgaaaaatcccgaaatagttaactaaaatagtgacgaaaaagtgccaaaatagtgacaaaatagtgaaaaaagtccaaaatagtgacgaatagtgacataattttcagccaaaaattgagcaaaaaaaatatttattcactgattgcagttacaaatgaggtgcatccctttcttacattttttagcaaatattgaaatttttaaaccaaaaattttgtaagaaaaaaatttgggggaaaaatttttatgaaaattttccaattctaactggtattttttgaaaaatttttaggtcgattcttaggggtgtatttaaaaaaaattagggcgattcttaggggtgtatttttttgtttttattgcatttttgttaaggattttccaaaaaatgtcgaaaaagtgaaaaaatagtgacaaaacgccaaaataatgaattttcactattttagtgacaaagcgccaaaatagtgatttctagtgac

SEQ ID NO: 20214 - DNA, 1834 bp, Heterodera glycines
attttgcaaaatcattgattttatctatgatttatttttatcaagtacttgttttttttccaaaattttaagtaattagtcgggcgtaaaagacacacgcacagatgttgtagagctcaaaatgagcatctgaatgagctattgaatgtctggaaaagtcaaatttttagttatttacgattttttgaaatgtaattactagctcttgagggtcatatgagatgggggtggagtttgagcccgcttggctgcagttattttttttattaattcaccggaaataaaatttttacgataatttttttttcaaaaaagtcaagtacttgataaaaattacatgaacaaagccaacgtactgtcttttttgacaaggctcaacttttgttaaaggcgacccatttaaactttgtatcattcattcaatagcccgtaggattctctaattgcattcattaattcaagaaaatttgtttttcaattatgacctaaaattaaaattttcatccatcttttttttcaaacttgatgttgtttttacggcaattgtgaagattattggtcccacaaaaaaaaagaaaaaaaaataataaaaaaaccattttaggggttatttgatgcgctgacaaatgagcacgaatatgaaatccatttttgactttgtttcgaaccccaaaccctgattcgaacaattttttaatttatttttttgcttaaaaataaattattttttaaaagtcatctaaataaaagtcttccctgaggttttcaaggtcgctgatcacgaataaggtatccatttcgaaccccggaccagatttcgaacaaagtcgaaaatttaaattttttatttttactttatgtatgttcgaatctacataaaatgacttatttttgctgctaaaattacctgtgatttattttctgctagttttaatcaattttagaataaaagtgcgaaatcgaaaaattgaattatcgactttttgttcgtattcgggtgttcgaaattggtcgaaatggatgtcatattcgtgctcagcgcatcaaataacccctaaaatgtgtttttttggttttttattcttttttttgtgagaccaataatcttaacaattgccgaaatatggggagagagaggcacctgccgatatcgaatccgcaataatgttgcagcggatcactataaatccctaaaaccgaattccgttcttttttgacatcaaaatttgggctgacaatagctgacgcccctctttaactgtcgtgctttttcgccgccagaagcatccgttccaaagggcagcagaaacgacggcactgtgccaattccaaacgaaaggcgacaccgaaggaaaagccaaagacagcgcatttaaatggatcgtatctgctggcggtggatgattgtccttaaatgtgttcattcataagtaaggttggacggacattcacgcgaaaatggcattaaatgcccggggcaatgcctttttatttgccatctctgaaatgcttctcacaaattcattcatttttcgacctaaattttaccgactttcaattttatgtgtaaattatttaaataatttttctttgtttaaaatgaggaaaattcgcgtacaatgacagcgcattcgatggacaaatgataaagaatgaatgaatgaatgactaaagagggggattaatgccccgaggggcgttggcccctaagcctttttcactgctgctgaactcgccttcgcctttcttcaacactcaaaatgcttttccgtcgacgagagaatgtgccaaaaattatttacctttcgaaacgaaaagcaccgaaagtgaattt

SEQ ID NO: 20215 - DNA, 1329 bp, Heterodera glycines
  misc_feature (54)..(56): n is a, c, g, or t
  misc_feature (58)..(58): n is a, c, g, or t
  misc_feature (60)..(60): n is a, c, g, or t
  misc_feature (64)..(64): n is a, c, g, or t
  misc_feature (66)..(67): n is a, c, g, or t
  misc_feature (70)..(70): n is a, c, g, or t
  misc_feature (91)..(91): n is a, c, g, or t
  misc_feature (98)..(98): n is a, c, g, or t
  misc_feature (113)..(114): n is a, c, g, or t
  misc_feature (125)..(125): n is a, c, g, or t
  misc_feature (179)..(179): n is a, c, g, or t
  misc_feature (210)..(210): n is a, c, g, or t
  misc_feature (229)..(229): n is a, c, g, or t
  misc_feature (233)..(234): n is a, c, g, or t
agtcatcgttggcaaagcccccgggttccaactgctccattaagcgacgcatgnnncngnagcngnnacngcacagccaccttaaacaccngccggangccacgcaggcgccnnagcgaaggcancggcggcaaagcccccgggagccaactgctcacgggagccacgcaaggaacggnagccgaaacggcacagccaaccgaaacaccngcaggaagccacgcaggcncccnngcgccggtagctgctagtgcacagccaatagagactcattccccgaatgccacgcatgcgcctttagcgaaacgatcgttggcaaagcccccgggttccaactgctgcacgggtgccacgcatgttccggtagctgctactgcacagccaaccgaaactcctgccggatgccacgcatgcgcctttgcgaagtcatcgttggcaaagcccccgggttccaactgctcacgggtgccacgcatgtttcggtagctggtactgcacagccaaccgaaactcctgccggatgccacgtatgttcctttgcgccggtagctgctagtgcacagccaatagagactcattccccgaatgccacgcatgcgcctttagcgaaacgatcgttggcaaagccaccgggttccaactgctgcacgggtgtgacgcatgttccggtagctgctactgcacagccaaccgaaactcctgccggatgccacgcatgcgcctttgcgaagtcatcgttggcaaagcccccgggttccaactgctcacgggtgccacgcatgtttcggtagctggtactgcacagccaaccgaaactcctgccggatgccacgcatgcgcctttgcgccggtagctgctagtgcacagccaatagagactcatttcccgaatgccacgcatgcgcctttgcgaagccatcgttcgcaaagccctcgggattgccacgcatgcgcctttgcgaagtcatcgttggcaaagcccccgggttccaactgctcacgggtgccacgcatgtttcggtagctggtactgcacagccaacagagcctcattccccgaatgccacgcatgcccattcgcaaagcccccgggttccaacagctgcacgggtgccacgcatgttccggtagctgctgctgcacgagcacgtgttgggtcgaaggacaaaatgacaaaaagtgcaaaatttgctaagttgactaaatccactcataacttttctcagacgcaaccaaattaaaacttaataaaattttttgaaatttgcaggctaatagagaactcttagggctaaagagtgatacccaagatttaaaatttggttgcgt

SEQ ID NO: 20216 - DNA, 898 bp, Heterodera glycines
catcgttggcaaagcccccggggttccaactgctcacgggtgccacgcatgtttcggtagctgttactgcacagccaaccgaaactcctgccggatgccacgtatgttcctttgcgccggtagctgctagtgcacagccaatagagactcattccccgaatgccacgcatgcgcctttagcgaaacgatcgttggcaaagcccccgggttccaactgctgcacgggtgtcacgcatgttccggtagctgctactgcacagccaaccgaaactcctgccggatgccacgcatgcgcctttgcgaagtcatcgttggcaaagcccccgggttccaactgctgcacgggtgccacgcatgttccggtagctgctactgcacagccaaccgaaactcctgccggatgccacgcatgcgcctttgcgaagtcatcgttggcaaagcccccgggttccaactgctcacgggtgccacgcatgtttctgtagctgttactgcacagccaaccgaaactcctgccggatgccacgcatgctcctttgcgccggtagctgctagtgcacagccaatagagactcattccccgaatgccacgcatgcgcctttagcgaaacgatcgttggcaaagcccccgggttccaactgctgcacgggtgccacgcatgttccggtagctgctactgcacgagccaaccgaaactcctgccggatgccacgcgatgcgcctttgcgaactcatcgttggcaaagcccccgggttccaactgctcacgggtgccacgcgatgtttcggtagctgttactgcacggccaaccgaaactcctgcgggatgccacgcgtgctcctttgcgccggtagctgctagtgcacggcccaatagagactcattccccgaatgcc

SEQ ID NO: 20217 - DNA, 2140 bp, Heterodera glycines
tccgttaatcattgaattcactcgccttcgtcaactcgaaaagtggtccactgcaatttgtgggcttccgtcgaatgtcttcgcgcgagtgccatcccttgcctaaatgaatagataatttgtgccacaaaaaagtgccaaagtgcgtaactgtgattcataatggcccacgtgccgtcctctgtccccactttggtgttaggatgtccgtcaaattcaccatggaccccgcgtacaaattgggcactgccctcctccaaatggtccgcctgttcccaacttggcaccaacggccaatcctaaaatgcccttacaaattaggggctttttgatctctgcgatttgcccatccgttcgaattgttctgtccctttttgtcttcccgtgcctgaaacatcgccacgtagtctttttggaagtgcatttgctgctgctcgccatccttcggtagcacaacaaatgcgcccactattccatcgctttggtgccccacggggaaattgccacggtaaaaatgggagccaaccgaatgggcggtgaagcgaagctcgaaactgaattttagaatcagaatctcgtgaatgaaatgcaatttgaattgaagcatcgtttttatgggataaaattcactcggatcggacagcgatcggacattgctggaggggagcaacgccgtcgaggaaccaattgttgttcattgtttgtccatggaaatggatggtcagactttggagaagaaggcggtttttgattcggatcaacacttcagacccatctttgaccaccaaagttgggccagggctaaagcgaaaagcgatgatcgaatcagtaaaaaatgctgatcagatcagtctctgtgccaatcgacagcaaggatcattggctgggccacctctttccgtttacggcattcagccatttgtgccgtccattgaactgaatcaggtctggcattgttcgctccgcactcagtgccaacttgcgcagcactaaagaccgattcgtttggcattggtgcggcgcgggcggagaaacggacaaaagttggcgatgttcgaggcacggacgcaattgactcttctctctctccgtccaaagcatctgaacaaacgcaaaaatggctttttaaatgacaaattgtccaatggcacaaagtttgcccctttttcttttttgtttttcttttgtttttgttaattttctccgacctttttcggctcgtagtcgttcactgacaaatcgccatggtcattctcaacactcatgctcagttttggctcgacactcagctcaaattcgaacaaaccctacgatggattgggcgaaaatgcaaaaaaaaggggggggggaaagcaaacatttggcgaagttggaccaattcggaggggcaattcgtagagggaccaaccaaaggcagaaaaagtgaaaaaagtggcaaaaaggaaaattaaaaaggaagggaaaggcatttgacgaaaaataggcacaatttagaatattagcgaataaaaataaaataattagcaaaataaacgaattaaaaatggggggggggaaatgaacggagaaaaaacggacgaaaatataaacaaataaaagggaatggggaagagggaggggggatactcataacattttcggaattccagcagaatgccgaaaacttaaaaatgagaaaaaaaaataaaaattaaaagaaaataattcaaaaatggaaattcacaaattaaaatgacaatttaaacacttcttttttgggcttagaattcacttaaaagtgagcaaataaaaggcaaaaggcgcacacttaggaggaaagggcgacctgaaaaagtgactttccaaaaagaaaaaaagacattaaaaaacgaacttttcttttataaaatttgattttaattgaccaatggacaaaaaatgagagaatttgataaaatgatgaagtgaatttgaagtgattaattatcgaaaaaggcgaagcgacgagtgatcactcgttgggaacatttgactgatcagagcaaatgccaattgtcgttctgctgaattcgaatgccattgagcgaatttggcgccagaggcgaaaagcgaactccgcagtgtttaacaaaataggaaagtcgtgccatcgatgattatc

SEQ ID NO: 20218 - DNA, 2673 bp, Heterodera glycines
atgtggtgccgagcgggaatagaggaggagggtgcctgtaaagcatgaaacggcggaagaagcagcggcggcggccacgttatgaagcagcgcagcagacgcagcagcagcagacgggaaaagagaagaacaagcggacgaagcgggcagagaagctgacgaagaaacgacggcattggaagaggcggaggaaggacactgaagccgccgggcatgaagcaatgaaagccaggaagacaacagtgctgaaggaacggcaccggaagtgccatcaaatccggcaccaacggaggaagaagaagcggtagcagaagtgccacaaaaactgttgcccgaatgcaacaatgttgacagatggccacatttttgaattgatgtcgacactttgctgcttaatgatgatgcagatgaagatgagggtggggaagaagctgctgctgctgttaaaattaaatttaaaatgggaaaattgttgttgctttttcttgcatcaaaagtccagaatgggttataattttttttaaaatgatttatcctgttcaaaaatgtttgcttgttttctctcccaactgatcaaaaagcaattttttgaataatttccttgatttcgaaccccccaaatgagtccaattgtgttaatttttgaggcagtcgttttgatttttaaaattttcagatggcatccctatattatcgccctcttccccgttttttaattgccatttccccgcccccccccattttctgctgatttccagtttggacggactttcatcccactctctcagcttccatgcaacaaattgccgatctcattcatttgtccgttgaaatgccaaatattttactttgaaaatgctcaatttctagccaggccagaaaaaaatacacatctccggacgagctctccctccggctggttcaattccctcatttatttatttacttttttgaaaacttaacattttaaattatttgagaggcccttgacgtaccgtcaaaaaaataaaataaaacttacccatgaccccacttagaccacagcaggaggaggaggaagcagcggctgaagatgatggctcgccgccgacgactgcaacggcacaattgttgctattgttgttgttgttgttgttgaagatgttgctactgttattcatctcgtgtccaagtcctgtgatcagggattagcttagtcgatcggaccaatgatcagagtaagccaaaaaatagtaaattgaaccaaaagtaaatattccccaccgccgctgatctgtcactgactgatccttttttatcacagacccgaaaaaacacctctctcacccaccaaattctcgaactcgagattttagaggctatcactaatggaattgtggcattaatttattctcaaccattggtttctggatttgttttatcttttttgccattttttgtgttgagtgaacctacccgagtccgggctggacgagctggacacacagtttttcggcaaatacatgctgctacagctgacagcagaagtgttaggcttgttcaaattgttgttattgtttggcaatgcgtacagcagctttctgtccatcaattgctggcacagatacaaatgcgtttccaactttttcaagcagttcacttcaccgggggtggtggtggcaaaggtggtcgaatcaattggagaaaactgaatttgtgtttttctattttttagtgtcataaaaatctttttgcctgatcagtaaaaaaagagagattttaaaattctcaggacaactccgagtcctggaactgatcaacaacacaaaaagcccaaattgtcgcgagcccatcaaattctgatcaatttcttggatagattgatcgattccgatgtctttaagggtatgtaaattcgaaatcttagacaaaatgccgaagtcgggttagcatttattacatccctctaatcgttgcaaaatagtgtgaaattttattaactcgagactcgagatcatagactatggacaaatatctcaattccgctctgccgctggcaaattgtggtgccgtgtccaaacacgcgggtgccgaagtgcgtcgggtggccaactgttcgtccaagcggtgtacaaacagcagttcggtgccatcatctaccgccgatggggaaaacggtggcggcacttcggaagcattggccaaaaatgcctgctttcgtggcactggtcgatgcaaaagttgttgaccatcgtcggcatggcaatggccatggcctgcatcatcatagtctccttgggtatttcccgataccgttttggcaccggaaccgccgccaaatctggcattttcttcaccatcatgctgcacttctgtgttggaattcgtcgtcgtcgccatgccggtggtgccgccatcgtcagcatgccattctccaccgtttttgacatattcttcgtcgtcatcgtcattgccgtctccgtccgaatatgggcgaccatgatggcatgccgtctccaaggtcctcaagctgttcatcaacaagccggagttgtgatggcagtgacgaggacctgctgttggtgttgctacggaagaggtcaattccatagccatttgctttatatatgtttttactcaaaggtttgtaaagattattaaaaaacatattaaacaagagttcgacatttgaaa

SEQ ID NO: 20219 - DNA, 1434 bp, Heterodera glycines
tggacctcggtccgagcttggctttttcctaaatccaaatttaggccattttctgcaaccttgagcaatttttaatccacattttggtccatatttggccatttttgagctatttagtccatgtttcgtgctttttagtccttccaccttttttgtgactataaaaatgtttgttttttcgattttcctctcattacaaaaaaaaaaaaaaacatttccaacgcactaattctgccctttgtgtggcatcattcgaaatacgacaaattgtgctaattgccccaaaaatgaaccggcggtaaggaattttaattaagttacaaaattgatttcatttattcaactaaactgtttccacaattcagttgggtttgcagcgatgtttggttggacacttttccgttttttgaccatgctcaactcggcttcaaattggcacttctttcgccccgtttcaatttgctggtggacacgcattttgatggcaaaagggaattgacaatttggagaacgatcatcattcgcaagcacagtgccacagcggtgccagaattagctgtgcgcatccgtcctggaaaaactgtgccatttccgttgcccaaccgtccgctgcccaacaaaatttgctttaaatccgtttggatttggtaattcaaaagcattcattatgtggcaataaaagcattcattccatttgcagttacatcgacgattccgtcattgcatttctcagcgccaatcagcaaatttggaacaaagtcaccaatttgcgcttgactgttccgtttgcaacagcagatgagcagccagtttggggtgttattatgcgtgaaatttggccaattttttcggcaaacattcgccacttgagcgtttgcaatggcatcctttttgacaaattgcgtcgtctcacttcaccttcaattctcaccgatctcgaccaatgaattcaatctattccggtgatttgttgcccgatgcgactgttgatgattttgatgggccaaatgccacaatttctgctggccaaatgttgtcaaaatggttgcacagtccgagaaaagatggcatgccgaagcaattgcatttctttttgaaggagccaccaaatatggaatgggccaacactctcaaaaaggtgtggccatattttcgttagccaactgattttgattgcatttaattaatgtccgtccgttttcccattgtttagaaatttcacaatgccaccatttcttcggtcagctaccaaattcaatttactgttcagcaaccgtcaacgcaaattgtgccatttgaattagcgaacgaacagaccaaggaaaagcggacactgatcaaagcaagcgcaaatgtttgggaggatcgctgggtaatgaaacggtgccaatatggggagacggcggcggttcaatgggcagcccaaaatttgga

SEQ ID NO: 20220 - DNA, 1711 bp, Heterodera glycines
atggcactgaatttcgatttccgacatttttgggcctcggaatgccatccctggttcatgccggggatggcactgaatttcgatttccgacatttttgggcctcggaatgccatccctggttcatgccggggatggcactgaattccgatttccgacatttttgttccgacattttcgggcctcgtaatgccatccctggttcatgccaggaatggcacggaattccgatttccgacatttttgggtctcggaatgccatccctggttcatgccagggatggcacggaattccgatttccgacatttttgttccgacattttcgggcctcgtaatgccatccctggttcatgccaggaatggcacggaattccgatttccgacatttttgggtctcggaatgccatccctggttcatgccagggcagcaggtctttgatgctgatctcgagcaccactatttggatagtgattaagctttgtgtgattttgcggtgttagctgactaaatatgataaatattttgcgggccgtcctttcgcccattctccgcactttccatggcaccacaaaagcaccgaccttctcagcgtccgatcatttggcgccggccgaacgatcttccaaaagccgagtgacaattttctgctcttaaaatgcgtctccaccaaacagtcgaagcgccgcgagagcagtgccaatttgagtccgagttgtgccggcacgacgaagcggaaaatgtgcagccaaacatcgttgcaaaccttgctgaattaatttgtgattgaactctgacaatcggaggagtacggcatttttacagggaaagaagcaccaggaccggcagaagatttcctgtttaaacagcaggactttcctcctgtcctggtacatctcggaattcctgtgcttctggtccgggttttcccaaattccgcgctttttctggcactgatttttggctttttcgaaaagccgtaaatgccgagccaacccaagaacaatcgaacactcacacttcatttattttgcgcttttttggtccgactttcggccaaaaaacattaaatttgcgcaaaatgaataaatatgggatgatgagaagagaaacgacgaataatgccgtcgttgtcacgagttccaacaacaaatgtttcaccgtaaaaggccacatttgcaacactccgccgaaagtgaggctaaaaaagaggacaattttgttgattattgggccatttttcaaaaattaaaacaatttaaacttttatttgtgatcaatttggaagacatggaacagataaagtgaaacatcgcccggtggggctcgaacccacgacctttccctagtgcagagtgctgtaagccactgagctacgggcatgccgcaacagtctgtataaagtgtaaagtcaccaaaatttccatttctcattctgtagtgctaggcttatcataggccaacattccaaatgctgaagcaaaatttgtgcttttttcactgggcttctcatttaaaattgaaataattcacaaccccctaacatttttttaatttccccctaaataaataataataatataatatattaacgaatatttcacaggaaatgaaatgttgaccacggacagtccaatcaatgaattgaatgaagcggaggagaaggagaaggaaatgcgcagaacgaagaatggcatttggtcaccaccaaacc

SEQ ID NO: 20221 - DNA, 2679 bp, Heterodera glycines
cttcttctcataattgatgttcaaatcacggcagaacaaaagtgcaattgttcataagccaggattcagcatacaggcacacaaagtacccgcagctatttccatcatgttgtaccgtaagatttaccgcattaaaaatcccggtcaacactgctgacggcaaaatgtcagaaatgatctttccaattttatccgtcagttgccaatccaacctgccatagggggtaggcaaagaatcggcaaaatgagtaccccactgaacatcatggacaattagagtccaatgtccagggaaatgcactggcaaaagtatgacttctgccggaacattagggttgtacccaaatgtcatatttttgtaaggcatgactctgtccaagccatttctccataccattgggtcaacaacgaccacttttcgttgtgaaatgctagccaaatatgctaaatatgtggcagcaaaaccgtcattgagaaactgagtcagatcattccaacaggtctcaatgtatcttgggccagagctcggggcaagcgatgtttcgccatcacgttcgtaaaggccaattgctgcccatttccaaattttacaggcaaaattccgcgtggttgcgaaattaatttgcactgtgctgaaatttattttttcaggcacagtgtccgaggttgccggaattggggcatttacaagattgatatccatttcagagcttttgctcatggaatcagtgagtctgcctcggcctgggcctctaatttttttggcaggacgccctccacgactttgagtcgaaacaggcgtcaaagcaatagcttcattggcaaacatgggttggccacactcggcgacctttcccctttttttgcacggcgaaccctggtcactttgagtgaccgcagttcgaggtgtgtcaatgagagacacactttcttgcgtagccaagattggcttcgctccggctttcgagggcctgcctctttttttacttccgatggaagacgccggcgtgcttatttgcaaagcacttaagcttggggtggtggtgccccggagagatgccgatacctctccattcccatctgcactcccgtctgggacgggtgagcgacctggactgacagattgctccgtccgccgctgatgacgctcttgtctcattttttcgcaaatttcgttgcttagaaggcatctgaaacaacaaatcagaaaagtatcgcaagtgtggcaaaaatatgaggtaattaaccaataaatgcacacagacgttaaaactttattaacaaaaatgcacaaataaagatcaaagacatcattcttcgccgtgaagtgtagtcgtcctgtgctgaaatccatcagccagggctcacacatcccattaagaatgcagatccaaaagttggtgcgacacgttccacgaagggatgtcagcgaaccgcttaggtgcgactcatgccacgaagggcctgtctgcgaaccacattggtgcgacaatgctccgaagggcctgtctgcgaaccacattggtgcgacaatgcccgtagggtctgtctgcgaaccacattggtgcgacaatgccccgaagggtctgtctgcgaaccacattggtgcgacaatgccccgaagggcctgtctgcgaaccacattggtgcgactatgccccgaagggcctgtctgcgaaccacattggtgcgactatgccccgaagggcctgtctgcgaaccacattggtgagacaatgccccgaagagccagtcagcgaaccgctttggtgcgacacatgccccgaagagccagtcagcgaaccgctttggtgcgacacatgccccgaaggccagtcagcgaaccacatatattgtcctttgtttgttccattctctgaatagccaggggcagggaactcctaacgacagacgctttgctgttgatcggaggacaatcccaccgtagccaacctcctgtttacaaaatgtgaccttcgaacaattagcattgctaattaatcaaaggacaatccttttcacaaacattcagctgggatacaaggccagaaaaaggcgctcccattgggcagcccagccacatgcatcgctaaggcgagtgcaagtctgcgcttaaatacatatcatggtcgctaagcagaccgatatgtgtgccatggtcgcgaagcagaccggcactgtgtcatggtcgcaaaacagaccgacacggttggctatggtcgcaaagcagaccagcctcgccatggtcgcaaagcagaccggcgtgtgcactacatatcatggtcgctaagcagaccgatatgttgccatggtcgcaaagcagaccggcacgtgcacaaatctcatcatggtcgcaaagcagaccgataagatttgaaaacaaataaaaatgtgattctcaaaagggtataaggacagaaatctttacaattgactcgattgaattttgtaatatttaaaaaataagtttaagtacatattaagtttaagtcaactgtaaagacttcttaaatgcataggggctttatacgtgccaaagtgtacgaaacttatttcctaactaacctcagatttgggttagtaaaactatttgcttagtgtacaccttgtcatgatttttgtatatgtgcatctgaaaatttttttattttattcaatcatagttaaatcgatgaattt

SEQ ID NO: 20222 - DNA, 2033 bp, Heterodera glycines
gggaatgtggcctatgattaacaaatgatatagggcaaaaatgagtgaataaaatttattattaacagtaaatactctctgaaagcgtaaaatcatgaaaaaatttataataattctgtaagctttatgattatttttttaaaaattattattttagaaattaaatgcttgaagcacgcaaaattttgaatttgttagtaattttgcaactctttttgggcataaatgtgctgcttttatcgtcgatttgctccactgaaatagtcaaaccaacagctgaaggtatttaaaatgcttttttctttttggtaaatataaaaaacaatttcttcggcacataaaaaagcttttaaaaataaatttcttcggcacaaaattctttcaaaataaagttttatttattgaaagttttcagagagtttagtgtgcttcggtagcacaatggtagtggtgctgccatgctgcccacggattgggcggacgagtgggttcgagtcgcacccgagccctaacaattttgcgcatttcttatcttacatttttaggttctaaaaactgccaaaattgttagtttttaggttctgaaaaactccaaaataggtgctaaaaatgaaaaaaataaatgccaaaaaatgtcaaatttagtgggtgtaaaatgacaaaattttattcaaaaagcaaaaaattatgccaaatcagtattgagacacactatttttaaaattaaaaattcttatcaagaaaaaaatttaaaaaatttgtagatgaatttttgagaaaatttttcaattaatagggttgcctttttggaaataagccccaatttctaactttgtcaattttccataaaagttgcaaacgcgtcaaattcaaacacaacgccagaaacaagtatcgcaaatgccatttttgaacccaaaaaccaacatcgtcggcgttggcgccgtaaacaatccaagaatcttggcagcaaatcggtgaggagcaaatcgtttcgatccaagtcaggccgacgtgtgtatgaggaaatgatgccagagaaagttgaaaaggaggcgaagaaaacaacaatgcaaaagtcagtttggcattttgtttatgtttttttttaattggcaaaaattcccaaatttcagaatcaaacaaaaatttaaacaaaaatttgtgccaacaacacggcagacattcgacagttccagcagtacagtgagtgtaatatttaaataaaaaggcccgactttttatgttttttacattttttttttgcccatattttcaaaaaaaaaatgtgtctaatttttgactccaaaatattatgtttgtttgtttggacctgatgttcgttttacgaaaattttttttcaaaatgaagattttcatagcgcaaaattgacctaaaaattgcgtacagtgaagatttgttaaagaatggtcaaaatttctaatttttccccggtcttaaaaaattggctctaactcataaaaattggtcatttttggtaaaaatctgttaaaattgccaatcaaattttcaaaaatcttcccggcggcgcctactggcgccaacggttccttcttcccaaaaaaatttttgggaaaataagtgcagcaaaaatagttttattgtttttctttttttttcatttggaataaaatttttcaaaatgctgatttttgaccccaaatgctgattttttgttggttggcaaactgatgattttgaaaattttcacctgccagccctgctgtttaaccataaatttaatcctcgaaaattctggcgccccaagtgtcaaatgccgggatttcattgtaatttaactcggacatatggcaaaattatatgatttaagctggaaaatttcctataattttcctaataattctttaaaatatatttcttttaaaaattaaataggtcaaagagcaacaaatacgacttgcactggaaatggttttggcaaaaaattctgatcaattagtgaaaaaaaaggaattgctcaaagcttatttgtacattgagctagcacttc

SEQ ID NO: 20223 - DNA, 1792 bp, Heterodera glycines
tcatgagttttgataaatttctggagatgaatttttgaaaagtttttcatttcttaggggtatatttttgaaaaatttcgggtcgattcataggggtgttttttcgtttttattgcatttttcttaataattttgggcaaaatgccaaaagcggccaggctcttttaaaaaatttttaggcttttaggcgctaaaaataaaagctagaaaataggcactaataactcgaaaagtagcttacaacagcccaaaaaaacatgtttttcgtgcgtttcacgccattggcctttgcctaaaaattggagccctaatcattaataattaaatcaataattaattattaatatgattgttaatttcagcggtttccccaaatctcagtgttacgaaaaattgtgtgttttgaagggcctaataatggagttggagcaaacggagcagataatggattcgtcaaattcaaattgcatcggagaatccgaacagaatggaaatggttggattttagatccaaaaattaaaaatttttcattcattttctttaccatgtttttaaaattaagtttagaatgtgtattttttaaatgaaaaaaaaaataattttggccatatttttgaataattttaattaaattcaattcaccaaaatgcaaaatgatttttcggaaaggatcagaaaaatggaagaacaacatcgggaagagaaggacaaaaatggtgggcaacaaaatatgaaaaattataaaaatatatttttatttgtaaatttaaaaaagttttttaaattatgtcataagtcacattttggaacggatcagcaccctggcgatatggaaattatcagtgaccagcaaaaggaacagcagcaacaaattgatcagttgagcatcgccattcaggaaaaatgtgccaaaattgccacgactgagaatttttatggtggaaaaatttggcacaatgccacaattaaaaacaaaaaattaaagagatggaaatagacacgagacaacgcatcggaaaaatttatgaaaaattttctttgttggacaattttgttggcctattttgtcgcagttccatgcgatttaagtcagtggacggtttattcccaaaggtatttgacatttcagtcccgggtctgcaactctttagggattggttgccgcaaaaaattctttggattctttcattacagaccaaaaggtaccaattatatatatattggctttttcggctccggacagaccacgggactaaatattcaaatacctagacgcatatttacctttaaaacattaaatttttaattgagttcgccaacaaagatatatttatttatccatcgtttgccctaattacttttcttatgagtaaccatttaattcttgaaatcactctcgttggcaaaaaatttctatttaattctgaattatttcaaaaaatttcattattataacaatgaaatagccaaaaaaattcgatgataatcaacaaagtatatttggtttataatttattaaaaagaataacaaacattctaaaattaatttaaaaaacacaaattttttttctcattttattttcaattttctgattaaattatttaaaaattatgcgaaataaattaaaaattattataaatgaatttatcttattcatgtaacttgctatatatgtattaaaatataatgctgaacaatttttcttaacaaatacaaaaatataaatggcaatttgtatcccccaatttggtgaggcacgcgacgggtcgcgattcgtagtcagcctcaac

SEQ ID NO: 20224 - DNA, 1660 bp, Heterodera glycines
  misc_feature (1581)..(1581): n is a, c, g, or t
  misc_feature (1625)..(1625): n is a, c, g, or t
  misc_feature (1628)..(1628): n is a, c, g, or t
aatgtactctacactccccgtttaaattgaaattgttttaaaaaaaatgggtaggcgaaagtaaaacgatcatgaaatgtaatcataacgtggttttgatgggtctaaatccaattactttgttggacgccgatgacgttctgaacgtcgaacttcgaattgtttgtcggcgacatcggcgatttgttgttgttggtctcgagcaatggtaccattttgatccacttcatcagcgaaacgtacgtggcgcttttgaacaagaccaggagaaccatgctgtgtgccgggtccatttccattttgacttttttggggaattggaaaaaaattacgcatttggttagtgtgcctacgcacaatgacgttaccaaggacggggactttaatttcccaaataacaccagaacctgagacaactttaccctgtagccaagactttttgttgttacggtagttgatgatgagcacatcgtcaccaattgcaaatgttcggtggcgagcaccatgtttgcgatcgaattgcttcgacatgttgtttgtgtagtcattttgattgcgatttgagcaagaaatgtcaggcttgagcagtgaccgttgtgttcgaggagagcggccaagaaaaagttcagctggtgtttgacctttcagtgcggcatttggtgtgttgcggtaggcgaacagggaattggtgatccactttttgtctccgtgtgaacactttttcatttgccttttaaaaatgtcaacaaaacgctcggcttgcccattgctctgtgggtgattcgtcggactaaatctttgcttgatacctttaatcctgcaaaaatgagaaaaatcttttgaatgaaagggtggcccattgtcggtaacgatttcacgtggaaacccgtatcgcgaatagagccactcgagttgaacgatgacattgtccgcagaagtgcttttcacttgaaaagtctcgggccatttactgaatgcgtccacgatgataagatagagattgccatcagaacatggacctgcaaagtccatgtgaatgcgctcatagactttatttgttcgaggccatggagagagtgtcgtttttggtggtgcttttgctgccatcgcgcaatcaacgcagtggcgaacccaacgttcaaggtcaaggtccatgcggggccagtagacatgttgttgtgccaatgccctcatgcgcacgattccaggatgtgtgaaatgaagggcggacaaaattcgctgacgcaaggctgccggaatgacgacgcgttcaccgaaaaggaggcaaccattcacttcggaaagtttgtgcctatgagtgaaaaaggcagataaatcagtaggcgacttcttgggccagccattacggcaaaaatcgaaaactttcctaagcgtagtgtccaattgagtgtgctcggcgacttcatccgcggtgacgggcagctggtcgatgttggccatgaagatgtagtcgacagcggccatttcggattcatcgagcgctgagttatccgaaattggaaagtaaatttgtcgaggctggcaataactcgttcttcccgctctactgtttcgcgttgntttgcccacagccgagagagaacgtctacctgcccaaaacattncgntgagatatatttgatttcaaaatcataattag

SEQ ID NO: 20225 - DNA, 1830 bp, Heterodera glycines
  misc_feature (121)..(121): n is a, c, g, or t
gaaaatttttgttttaaatttttggccaaagtgtttgggtcgtcgcaaactgtgacggcgtgtgcctgtgcgaaattgagtgtcgtagcgattggtcgctgcaatgccatttcgaacgctntgatccatggcaaatccgaacaaattcattgggccgtccggggcgacgtggcatttgagttgaagagggcagccctggtacgtgactgaacacacaaaaaatcccaaaatttcgaaaaagtgaccagaatatgatttggcctttttgatgccacttatgaggttgagtttacccaatttttcccataaaccaatctgaatgaccgacagacgggacccagagtcagccatcaatgacgcatcagtattgttaatcctgcagttgatcattatccattccgataagtcgtcgtccgtaatgttgaagaccgacattgttgtgttgtaccgttgtgaattaggccgggatgaagatgcttagcggcattcggagcggtagtgaccacggcggttgcactttgagcaagttggcgcccgtgaacaatcacgcacccaatgcatttgaccacaaaacctgcacggtgatggcggctttggttggcgctgaaaaggggaagggctgcgatttttgttgctttgtgccttcgccgatgggcgctgcgatatgctgcgctttttgagctgctgttccttcaatttctgcgacttgagagtgatggcgtttgttccagaaacagttgccaaagattgagatgtgttgcgcaatgacaaaaacgcacggcactcttcagtaagcttctcaaaagtgatcatttccggcggtgttttctttttggcttcctccaaaatccgaaaacagcgttccctaagttctctgtcttcatctgagaggccagtgaggaaaatgagggccttgatttcatcttttgtcaagtccattttcgaacgttcacacatggcattcacttggctagcaaaatctaatggtgactggaaaattgatttagctaactgaaaacactcatatcgacgagtgaaaatgcttttggtttccccaaacaaaattttgagcttatcaattgtctgtgccaatgtgaagtcggtcggcagtcttggaagtacacgttctgtatgacgagcgtactcctcctgaccgagctttccaagcagcagtcgcacttgcattgcgtctggaaggtccttgccatccacctgaagaacgggccaaaacggtcgagccatgcttgaaaagtgaaatccaattctggattatatgtgaattggccaagttggctattgatagtcgaataaatagtggaataattgacggaatttggatttgtttgggtattttggagaagggcttgaaaagcctccgtctgatttttaactaattgttgaagaatttgaccaatgtcagcggccattttgatcagttaagtgcttttcagtcggaccaatgtttgtgtgaatgaaaatgagtaaatgagagtgaatgtttatcgccagcaaatattgggagagttcgccacgcacagtcaataaaatcaataaacgacctttgttgatatggaagttgcacaaatgaggtgagcacagcggtcgcagtgacttgtactttcccaaatgtgtctttccttacaaccgtgcgttcagaggctttttatggcttgaacgttgccgcaagtcttctcggtttgcttggcgtcagagggttatgctttcgccgtaacgtttcaaaccgatgtgttacgggggaaggtaggtcggagaaattaaatgctaataaaatgtgcaggcaaattcccaattatagcaataagataataa

SEQ ID NO: 20226 - DNA, 2479 bp, Heterodera glycines
cagaagaaggggatattgatgttgactataatgtgttttcttttggatatcattaaaataattttgtgtttgtgtttattctttagtttgtttatttcattcaatatttacgaaaacttttttatgctaattattttttaagaatgtccaagaaaaatttccaagaaatttcaaaagacgtaaggcgctcgagaaatacccgtaattatttccggaagagcccagacttgggcaagtattacgaagaggtggaaaaacatgtgaaggaaaacaaaaaatttgggattaaagaatatgtccgcacgttttattttaaatgtccaccaaatgaggatcccgaaaacaattttaaaaaaatcctcaaaaaattgatgtccgaagcaataagccaagaagccgagccaggatggaaaatttcgaaaatttctgtcgatctgtactgcagtgccctgtcggaccccgtgatcattccggctcgccccttccaacaatcaaacccagacattgttttcaacgagttcatgcaccgacaacaatcatttggagagctgaatctattggaagagagaatttcgattaattgctacatatgcttttcctgaaaaataaattttttttgatgaaaaaggatgtttttatttaatgttttatacgcttgtattttaaaaattatttagctaattatttttagttttaaatgtactcgttcaaaaaatattttgaaactgctcttgagaaggaagactttttctggcctaagaacagagctgaggttgaagcgatgttgattgaatcatcccaatataaagtggccatacaccgggattatgaaagcccgttttccggctacatagaaatgcacgaacacacgtctgcgttttgttttaccatggttgagcgagatatgcgaattttttatgactcaggggcgggtactcctatgggtagatacacgttggtactacacggcatcgtacaggggaactatttgggaaatgattcgggattgggactccctatttttttcttctggttttactgggagggaaggagccagacaaaccgcaacggtttttttaggagtcgtctttttctggcaaaggtccaaatgctaaaggtcatggcattagcttggggaaaagaactgttgacttccccaattgaagtaaactaaatgttttctttaatcgtatggacaggtctttaacgattaaaaatctatatgtcattattattacagagaattgcttggctcttggtcgttgctctatcgggtccctccaagtctctttgatatttctcgtcgaattgttgcagaaaaaatgatggaagaatttttaaaactgccatcacactttcgaattgctttttataataaatattaattgtgtaattttttttttgccttagttatagtcgaatttatttttaattgtttaattttctaaaatttattttagtctcgaaaaatgaacacaatccgcgacattaagaatattgaattggtttgtggtagtcgaatttttgtggttcgtgctaaaattgcaagtgttgtgtctgcggaatacaatgtaaataaaaccaaatagaaaacatcagacgttttggggggtgttgcttttttcggcgtgaaaaatgtagaaaagggtgacggaatggtatgaaaaatgtttaaacacaaaaatttatttttttaggaaaaggttaaaaacttggttgggaccatttgtactttgaaggttaatgtgagtgtgaaagaatatggtggtaagaagggaatttattatgctttgattgatatttatgaaatttgatttgttttgtctataaatgaaatgttaattttttatttaaataaaaatgttttttctaaaactatttctgttgtctttcttggtaattgggggtcagtgttgttgttgcttgtcgaaagaagaaaagcagcagatggatgcaaccgaagggttgttgaagaagtaattaaagatataattaggttaactaatgaggccaaagacttttcattttctgctcataataccatggttgaagctcaaattattaaggataggaattcgggaaaatctgaaatcatattttggcatgaaaaactattaaatggagtaagaaaaatacattcacaatttgataaaataaaaaatgaggaaaagaatataaaaaatattaaaaaaggcatggaaaaatgtctagacagaaaggacccagatgtgccaagaattagccgaagatgccaaacaatcaatagaaatagctaaaaaatataggcatgaaattggacagacttatcgtaactcttattcacagccagatttaggaattggagatatggctaataaaataaaagaaataatgcgagaaaatcaaataaaatttgaaaagccaagaccctcagcagaatttagagacgaattcattgaatagaaaatataataaaaatatataaaagaaaaacagaaaa

SEQ ID NO: 20227 - DNA, 1956 bp, Heterodera glycines
atcaaaaagtaaacggacagaaagaggccaattttggagtggaatttttttaataaaatttgccaattaaattttaaaaaattaattaattttactgcgtttatttcaaaaagaggaaatcatttgcaaccattgggtaaatcattttttgattagttttccttggagaacagaatttgttttatcactaattagctaattacccaaacaaagaccagaaattgttaaatgttttttctcgagtcataacaagcgattgaatcatcaaaataaaatctgttaagaaattatgggacaatacttgctaaaaagaaaatttttacttatttgtagtcccaataaaatccgattgatatgcatgcataaaagcataattttatgctgaaacaaatagtttggtgctgagtcgttatataaaaaccatcaaaaagggcgtaatataaaaaccatcaaatgaaaatttccaacaataaactgcccataacttttgcaaagccaataaaattaaacattcttggtattattcgatagccctaacatttctctattagctcacctaaattttaaaaaatttggccaagtttgagcaaagttatggtcaatagtagtcaaggaatcagtttttcagacatttttggtcataacttttttgaaacttgacgaaattttttgaaacttaggtaatctaatagataacaattagggctatagaatgatatcaagaaaacaaaaaatcttaacaatttataacataaatttttttatttggcataaaataattttgatgatcaaaaattctgatcaaaacattcttagaacgaacaaaataaattgatctttaccattcgctagccctatgtttcctctattagcctgcaaaattaaaaaaaatttcattaggattcaaaaaagttatgtcaaaaaagtttgaaaaccaggttccttgggtactcttgaccataactttgcccaaacttggccaaattttttgaaatttaggtgagctaatagagaaatgttagggctatcgaataataccaagaatgtttaattttattggctttgcaaaagttatgggcagtttattgttggaaattttcatttgatggtttttatattacgccctttttgatggtttttatataacgactcagcaccaaaagtttcacaacaattcgtccgggtggcggcgaattcctccgtcttgccaaaaaaaagtgacggttggcccacccttaatattttttattgttcattttataaccaaatcaatcgcctattaatttggtaaatattgatcatagacccaagagccaaaaaacacacaaaaccattttataggtttttaaatgcagaaaacgatagaaaaaccaaaaaatcttgggcaaacattttaggtgttatgaccagcctgtttttcttagaccaaaacaattctgtaatattttgcgcatttacataaatcaaaaaatttgaaataaattgtttttgtgtctggacgtctgtcatgagacggacacctgcgagattggaactcaaattttttttgggatgagatcccgcgggattaatcccgcccgcattttgcttcagaatgtccaggcaaatgttcccgtgcgagtcgatgttcgggtggtagatgcgcgtcgtggctttgacaacaggcgctcggaacggataatctctcgggaagacgatggtcaattgaaaggtgccgccttcgtacggcgagtcgggcggtcctttgatggtcgccgtccagttggaaatgttattgtcgtccaccggccgcgcattttgttatgactttttttattggggatttttatgaattttttcactttaaagctccggcaatgcccttgacagaaaaaaacaaattctgagaaaacgaattgatatttaatctatttttttctgttccgttgtccgatttcgcgagattagaacaaatgg

SEQ ID NO: 20228 - DNA, 1507 bp, Heterodera glycines
ttccactccaaaaatgggcctcttttctgtccgttttactttttgtatgcgcaacattcattgatctgcgcaaccgttgaagaaagaacggagggcgaaatgcccaagggaaatgggagggggagaagagattgacgaattccattcgatgaattcgtctttttctgattaactttccctgttttttgtccctctcttttctctgcttctctctctctctccttcctctttttctgtgtccactctctccatccgcacactctctcccctcctctttctctccgtttatttttgccgtttttctcccttattttttttgtgtgaaagggtaaaatttggcgaacatttgacggcgattggccacgccctgcggggaaaagggaagagaaagacgtcgtcgaccaaatttctttcctcatttttcaaactatgcgcacaattcgaccaattaaattaatgtttgatggactcggctggcaattaccgccaaaatcagtctcttcggtcgttgaaaatcactaaattttaaggcatttggcattttattttaaatgcgggcgattgtttgccccaaatttattttcccatttggccttgatcatttctttgggggttatcccaccgatcattcaattcaaataaatccctcgacttcgccgaattccgttcaaaatattctcagattgagcgtattttcgctgtgttttgttagtgccattaatctcatttgtcagctggtggtcccctgaaaaaaactgatgacaatgagttcaatcaaaccagttaataatatcttcaattgaactttttttgtgaagtcaacggacattttgaaaaaagagattttgggacgacgaattttctgtcttttctctcttctttcatcccgcggttaagtcaattttatgaattttccaaaacatattatttatttaattaattaattattaaatcaattttttttattatttattgtctgtatgtgcaaactagagtgcgctgggaccgggaattttgggcaaaaccgggaccgggacttgccgggacctgagaagccgggaccgggacctctgtttttttcgggaccggaaccgggaaccgggaccaaccgggaatttttaaaaattcaaaaaaattcaaaaatttaaaaaaaaaattcaaattttaaaagcctcatttggcaggcaaaaaagcctcattttgggtcgaaaagcctcatttttacaaaatttattcaaaacacgtttaaatgttcaaatgttgtatttttgactgtccatgatcaatttgagcattttttttgttagaaataagcattttttgggattctgaacatgaaaaacgaagcagatttttttgcggcgcttttcacaaaaaacttttggggcgcaaggggggccggcggtgccggaaagattttgtaattttcaatgcgatttgttaacagattttgtccgaaaaatgaccaaattttgcgattttgagcaaattttcgcttgtaaattaa

SEQ ID NO: 20229 - DNA, 1855 bp, Heterodera glycines
  misc_feature (1843)..(1843): n is a, c, g, or t
gattgggtgatatatgccaatcaggttgtgctgagacaagacattgaccaaattcgaaaaaatttttaattttccaaccaaatcacttcaaattacccataattattacacaaaggtacaaaaatttttccggtcagtaaaaaattaatcatccaaattttttaataaaaaataaagggaatgttaaatgctgcctaataaacattaggtcactaatgaataaaatcgatgaaatagcacttattttagaaaccgaaaaaatagacattcttttaattaccgagacttggaccaaagacggggaagaaatcaatttttgcccttgggtaaaagagaattacaactatattttttcatcaaggaaatcgaaaactagtggaggtggttgtggtattctaatcagtcggattcaaaatttaattctgaaattttagttattcaacttcaaaatttacaatgcatcagatttgttttggtgtatagaccacccaaaacaacactcaagcaaacagaaaatttgttcaaatttttgcaaaaattttttaatgaaaattcagtgactttaggagattttaatttaccgaataaggatttggtatggaaaaatgggcatccctattcaatgagtaaatatggtgaaatattttgtgactttttcaatagattttcttacgttttggccacgaatgagccaacacggattaattcctggctagatttgatttttacggccaatgaaaaaattattactgattgtactgttaaaggaggcatattttcatcggatcatttaacacaattttttacattaattactcctaaaacaaaactgaaaacaaagatcgtaaactttcgttggttttgtccatcgaatgtgttacattttaatatagtcatagcatcaaggctaaatgccttgtcatatgaatgctttagcataaatcaaaaatattccgcctttaacagtatgttgttagaaattttaaatgagtgtattccaataaagcgtttaaccaagaatgatttgactcctaaatacccacaacatttattagcatccatcaaagaaaaggctaaattattcaggcaagctaaaactgacccatccaaaaaagcactatacgatagcatttctttacatataaaaatacaaacaaataaataccatagccaaattgagaaaaaggctatttcaaagggaagaaattcaatttataaatatatacaaaaattcaatgtcaatccctctgaaatacctaatctaatttatgaaaataaatgctatcataacagtgctgagaaatctgaattatttgccaccttatttgccaattcatttaataatagtgaaaccgacccaagcaatccatgcttgggtaatattatagaaattgatcaatgctttatatcggatataaattttaacatcatcgagacccaaaatcttttgaaaaaacttccgaataaaaatggcacttctcccgataatattagttataaaattttaaaaatttgccattcttctctgtcaactgttattactgacttgtttaggatctcattagacactggttcacttccagacatctggaaggaatcaattgtttttccgctttttaagaagggtgacaaaaataatcccgaaaactataggccaatttcattaacctgctcactctgcagggtaatggaaagaattttaagcaaaaatatttacaattttctattaaaaaccaaaaaaatttcggaatttcaatttggttttgttagaaataggtctacaacgagtcaactaataacagttgtggaagataagtacgaggcaataataaatggaaaaaanagttgactgtat

SEQ ID NO: 20230 - DNA, 2004 bp, Heterodera glycines
  misc_feature (725)..(725): n is a, c, g, or t
tttctctctgtggtaaagtgtttcgagattggttttccccccccgagctacaaaatgttgggcatttgttcaacttcttcaattcagtttttctccactttaatcgtccttctgtacacacattacacacgcgcaaagcttcgcctgcggcaacggctgattggccacggcggcggcgcaggcgccgcggggcattcgtcgacactaatgaaggcgcacctccacgaagtgattagtcataaaagtaattaatgacccctctctcctcaatttagttgggtctctacaacatttccatccccgtcactttggtcgctgccattctgctgggctatatgagcatagggtaataagcaaaattgctttttatttttataattttcgattaatcggggttttaaaaaataagaggggaggtaattagctcgagaattaatgtgtcgagaagcgaaacgcacccttaagctaaacattgttttgattttcaataatttgatctgtttttcttttaaagtgccgtccttttggccaagtgggaacgatggcctttgtaagtgaccacttttctgtcgattattaaaaacgggttaagccaattaaaattcgacgtcccaaaaaaggttcgacggcttttactactcattcattacgatgacaaccgtcggatttggcgacattgtgccggccaaacacgagttctttttgttcgatttattctacataantcgttggttggtaaatgaacggtggcacattttggcaaaagtggcgccgcttttcctttccagggttggccatcaccacaatgtgcatcgacttagttggcattgaatacatcgaaaaggtgaccactccgttttttgctaatagcccaatttggtcgggtcgagcaatggcacatcgagagtctcgggaaaagtactcaaagcattggaagaaattaaatggaagcttttgcgggccagcgaaaaacattgggccataatttctcttttggcattttcaaaccaaatgctgcgtttgcttaagattcactattttggccgtgccatttcgggcgctcgcttcgcccttgtcaatgtgggcggaagaatggtacgagtgcccgacttggtgcgctgtgcgcatgttctgcaccaaaagtatgggcaacgaaagccgacacgacaacggcgcaaacgaacggtttcggcatcgtcaacgcaaaacctttttatggcatggaaaggagcgtaagttagcgccaattgggggcggagtaattagggataattttatgctaatgatccttctttctaaaaacatattgaatttggtcagatacgcgcccaaagatttgccgtacattcgcttcatcgatttcggctctttggcaagcttcgagtcgatctcgatctcaagcctcttttctgcaatttttacgagtggtggtcagaagtcgcgtgagccaacattcgtttgagacagacaaatgatcaacggataatttgtatcaaagaaaatgtgcaatcaaagcaaatagtcaaaatacgataaatgaattaaatataaatgagcatatacataaatgaattgaataattaaccatactaatttggtgtgtgactatgtatgtcaaacttcaaatggattatttttcgaagcgaaagtctttgaaaaaaagaaaacaaaaaatgaggtatttatgtaaacaaaaaaacacaggagatagtgttgagaaaaagataaacaaaaagagaaaaagaaagagaactaaaggaaaaaagaaagggagggaagttggggtgaaaggaaggaagcgagagaatttaatgaaaagagagagagaaagagggagagagtagagaaagagagaatggtagagcgaagagatgtttagtaaattatgacatagagacaaaagaaagagacaggaagagaaaaggagacaaagaggagagaaacgagacttggatgaaaatggaatttattgattaaactactatcaaattttatttaaaatta

SEQ ID NO: 20231 - DNA, 2484 bp, Heterodera glycines
ttaaaaatcaatatggattggtaatcatttttacgcagataaagaaattaaactaaaaatgccctttggcatgattattgccggaccatcggggagtgggaaaagcacatttttaataaaatttattgctgagtcctcggagttaattagctagaccagcttcactgctttatgcatttggtgaaatgtcaagtattgttccaacactccaaaaatgcggtgtgaatgtgtacccgggagtgccccctgaggatttgattaaccgtctaccaaaaccattactgtttattcttgacgatctcttgctttcgatcgatgaatcttatcttagtgctctattcaccaaaaagtctcaccatcagaattttgcagttgtttttgtaacacaaaatttgtttgaacgaaggattaaagttgcgagacaaaatgcccaatatttggtgttaatgcgagctccaaattccgcactggcgattcgtaacattggagtgcaactttttccgggaaaactggattatttcctttctgcctatcgtattgcgactaataaaccctatggctatctcgttgttgatatgcacgctgcttcaaaccccctgctgcgattaaggagcggcatatttaaagacgacgaggaagaaggaaaaaagatcattttcattccaaaaatggccttttgtaaaattggagaaattgtacataaaaattttgattttattcgagtacttgccaaaaccaaatcgatgaaaaaaaggagacaaattttaaaacgtgcaaatggcgatcaattgttaacactaattgaaatagctttaaacattctttgttcacactttaaattaacaactcgccaaagaaagcgtttgctaccttacgcaaattttgttcgaagtcttgctcgtcgaaggaccgaaagaggggcacggaaggtcctggttcaaaccggaagtgggctcggaggagtttttgcagctctgctcactcctattcttattgatttagcacgctctgctataaattcaagctcaaagagcgacaattgatcattttatcatggcttcaaagtttattctcgtacccgaagaaatttatcatggtttaacaagcagtgattcgggaaacataaacttggattttactaagcatgcgctggaaagaacaaaaagaaagagggagaatgtgacagcaaaaaatattcattataaccaagaattgtctcgttatctccacctgaaagatgaacaccaaaatcaaccatcaaaagtagaaattaccaaaggggttgaaggactaatcaaaaagggagatgagagtgatgaagacgaacaaatgtttaatttgggaccagaaagatcacgacccctctgcttcactaattcgcggacagcgccgcgtctcatcaccattaccacgacgatgaggaaatgccattactaccagactctccacccttccaagctggaaataggggtcaaaaaaggaaagcaaatgagtactattcctcatgggaagagggagctaagcggcaactcatacagcaatatgagccggcttcttcctctaaaatagctaaaagacaaaggagaaaactgccgccagtctcatggcgaagagaagaaaaaattccagcagaagttcaacaggaagaaccatttcaaccagccccccaaccgtctatccccatacaccctcaagttaacagaaaacgaaaagcacagcaaaatttaaatgatgttcgagaagcaaaaaagagccttattgattcggaagagttaagacatcctcctcttcaacaagaggcttctcttcgttttaaacagaaaacgacaaacaaaccccgagtaacacaacccccgcattccacttcttcggccttggcaacaagaagtaatcctccgagggatttactggccgaggcagccgctgccccattaccggacgatgatggcgatgatttgcaattctcacaacaacccgggacctcggcgcagatccatcctctcccacctggacctccattaccaagtaaaaccaaaaaacggaaaaacagtaaaaatgaagaagaaaccgaaagaaaaaaatcagagttggctctagaaaaagatggtcttcgcaaactgatgccacaaatccgccaaaaaggcaaaagaatttgcctgatgatggccatgatttggaactctcaaaacaacctgagacctcggctcagaaccagccactcccacctgaacctccattgcctagtaaaacaaaaaagcggaaaagcagtaaagatgaagatactaaaagaaaaaaattccgaattggctcccgaaagaggttatcttcgccaactgttaccacaaatcagccaaaaagacaaaagaatccagttaacgaagtactctccgaagagcagcgtcgtcagttcgtggaggatcaacgtcttttcaccattccacattcacaacttaccaatgagcaaaaaaagacgacggctgcagt

SEQ ID NO: 20232 - DNA, 948 bp, Heterodera glycines
  misc_feature (923)..(923): n is a, c, g, or t
aaagatttaaaaatggattcggtccaattaatcagtaatcttgttaagtttaagcaaggtcagatccaaatttattaattactaacagtgacttgttatcaatgatctctgatcgatcaaaattttaaattttattcccatttgtatttatttgatcagtacgtcctgcctataaagtcgagccctcccccgcccccgttttctaattacaaatcctggacattttcggacgaatttttgcggaagttaaatttagttagcagcaggccttaaagtacagccaccaggcaagcacaaattgttttcaaaatttttattgtatcaaaaaattgtttttttccatgaaaaatctgttgctttagggtaggcttaatgttgctgttgttctttctgtttttcacctgcttatcaccaattttcacggtcaaatcgtcgtcgggtgagctgctggaaggtgccgggaacgcacttaaaaaaatgggaaaaaaacggaagccaaatcaattagtgatcaacctcggatcttttttccaacctaatttttcatgctaatagagagcaattagacgagcatttttactgataaaatcgggaatatcacatttacctactttttttcatcggactttttctcgcgctttttgagaattcggattacaaatgatgaatcattattgctgcggtaattaagctcactgcccttgttgagtgtatttgtctaaacaatttaattgattaattcattttttatctgatcatttctttatattttattacttgaatgatttgttgtgccccatttttgtcccaattccaattgacaatttgtgccaatggctcagaattcgatggattggaagaagaagcattgccaatgtccttgattttcaatgcgatatacaagcttgtcataaattcactanaattatatatgtgattgatttatat

SEQ ID NO: 20233 - DNA, 1797 bp, Heterodera glycines
aaagaatgcaaaataaaaaaataatttatttttgccaatgtaaaaatgtaaaaaaatattcataaatgaagaaaacatttttgacacgccccctgaaattgaaattacagtgcagcaaattggtaataaattcgtcaaacatttccattatatgtgctttaatctttaatacaaattttattaattcaattttttcgtgtttcgaactttaaatataaaaaaaaatgtttttttcccttaaaaacaatacaaatttcaaaaataattttgtaataaaaatggaaaaatcttcaaaaagtgaaaactttttagaaaatgcaaatgctgcgacctttgtgatcaatatcttaaggacagaattgtttttgtctattcagttgaatgaatatggagttaaagaacaaaggcaaaaaggggaaaagaaaaatttatacagaaaaaaagagtaaaatatttaccgaaaattatcgataatattaagaagaaaaaataataattttattaagtagtaaataaattaaatatataaaagaatttttcttctttttcggggtttaaaaaatttagtttaaaatttaaaaatgcttatttttaatggtgcggagttgttccatataaagaaggttatattttgacaaaaaattaatcataaaacttgctctaaagcaatttctttttaaatttttcataatatttaatagcactaaaatgttctctattaataagtaaaattccaaaaaattttcgttaactttcaaaaaaagttatgactaaaattagggttgcaaccccgaccccgccccgaccccgaaccccgacatttttggccattttcggggaaaaccccgaccccgaaccccgacgcttcataccccgacaaccccgaaccccgacccttaaccccgatcggggtcggggttaaatatacacccctaagaatggcattttcgtgggagaaaatgcaaaaaagttagacgaaatttgaatttttttaaccatttgccaaatttttattaaataaagaagatttgctcaattttggacattttgaatgtggtgtagaggttagtgccattgacattactttctgtcgtgagttcgataccgtttgacgttttcttctttaattattttctttgtgacaaattgtttttttttaattaaatactcatagaaatcgaccaatcttggcatattttgacaatacatatcgaagaaaaacaaaaatttaccgaaattcataaatttttttggtgaaaaatcttagaaaatagagcttaattccaaaatttagcgctgcctatcggcatcacagggcccaaaaagtcataaaccttattaaaaaaatttctcaaaatcgcaaaaatttagcatattttggacaaaatctgttagcagatctaaccaaattttcaaaattttcccggcggcgcctatcggcaccgccggacgccgtaccctttctccttaagtctttagaaaagagcgacgtgaaaaaagatgttttggaaaacaaaaaagtaataaaaaattttaaaatttcaagaaaaaaaaaattaattctatacaaaatttctgataaaaaagaaataaaaaaatataaaaacaatacaaatattattatggaaattaataaatattatttccgaaaaaatatttaaaaaattttgactatttggcgtaaggcaaaaattgaaaaaccccgaccccgaccccgaaccccgacacttccaaccccgacaaccccgaaccccgaattttccaaccccgacgtcggggttgcaaccaaagaattaa

SEQ ID NO: 20234 - DNA, 1601 bp, Heterodera glycines
  misc_feature (16)..(16): n is a, c, g, or t
  misc_feature (1507)..(1507): n is a, c, g, or t
  misc_feature (1521)..(1521): n is a, c, g, or t
tcagaaacaaaaaatnttagagaaattaaatatgcatacatttaaaaaattgtacccgtttttattaataatttttaaaaactcgaaatctttttcagggggggttgttgatggtgaaccgctagaactcaaatttccatttattttttttaattatccgagattttaaattttttttttggaaaaatatgtttaaatcgtgtaacattttcaaaaattccaagagggttacgattggcccagttgacgctcatttaatttttttttttttaaatgcacagaaattttttttgctattaataagcaaaaaatttgcgcctaaatcctttttttatctcaacagcagctgatcaagccattgcttatggagcaatacaatttgctcaagtgtaataaaactatggcacattcgctacaaaatttacgcaatgccatcggcacaatgaaaaacgcaatttttgagggtttgaaaattaaaacaaatatattaattaataatttaatttttttaaaaggaaaagcaattgcaaattctaaaattaatgagctaaaaactgtgttacaacaatcgcttctttcgttggtcgaccgaatgcaaattctgcaaaatgagattatgcggggaaaagtcgaaaagtttggccaagacaaattgctcatggaattggccaaaagttgggccgaatacaagcgccaaaacggaaaaaaatgtaattcattaatatttcaatttgaaaaattatttttaaaatttaagcgcatggaaaaggcaaaaataatgagaagggcagaaaaaatgaaaagcgaatccttcagctgttgtacaatttgttaaatgatggcaccaatggattagcatctgctgatctgaaaagtggtgcaaaaagtaaataaattaaatatttgatgggtgattttggatattcgtgatagaaaaatccggggattggcatcaaagtgaaaattgtaaggagttgttatttaaaattaaaaaccattaatttgaaaattttcgacgaaaaattatttataactttgcgcaaaagcaattaaatttttaaaagtttcaaaaaagttatggctagaagaaaacttaaaaaaaaccttgtttgtcgaacattttatgaaaaagcactactaaaaaatttacctaaaaaaatttgcaataaaaagcttgaatgtgaaaattttcgaatttttcctgacataaattttaattttttaaatttttttaatgacagatcgtcaacgcagaagaaaaggccgtggcattatcacggaaagacacattgtcatcttttgtgtgattggcatcatcatttgcattttcaatatttcactattttgttattgccaatgtttcgaccatcgatcagccgccgatgacatagaagcaacagatagtcaaaccacagtcgaaaccgatcaccaaggtgagagtgccaaaggtagtaaaaatgtatcaaatctgatcagccaagattttcaaaggtaaaaactgtagaantgaaatatttgatngggtttgatcataaaagatggccagagtgaggatgggtgcgaagggcttataaaattgtttcttgtctaaacatagccga

SEQ ID NO: 20235 - DNA, 2446 bp, Heterodera glycines
  misc_feature (2344)..(2344): n is a, c, g, or t
  misc_feature (2383)..(2383): n is a, c, g, or t
tatgttttgttgaacttttcacattaaactgtcatttcttcagtagtatgtctctctctccacccatccgccggggaaacgacggattaaaaagcgccgaatttcatcgtaaatgaaaatcagaatggaaaaaggcaatgcggggaaccaccacgaaaaccttgggaaatgtgatgaaaatgtgacaaaaaaagaaaaaaaaatcttaccgcagtccgtacatacgaagacctttgtccaaacccggacagtagcagaggaaaacagccaacaaagtctcgaagaccaagccgatgttcaacacccaattggacatgccttgctggacaatggaattccgacgagtcttcgaaatgatcagatcagcccattgcacaatcacttggagtagggaaataacaaactcaaagtaagcaaacaaacgctaccaattgacacaaaataagcggtttgacaagtgtgttcgagaatctttcggtccatgtaagtctataatttttttatttttgaaaattatcggtaaaagttggtttgtgcttaacccacccattcttgtccgtaactgtccacgagattgttaatcccacgagaatcccattgcgcacgcaattggtaaaggtcctttggaagaaaaccgttgtcagccattatccaaaagtactgaaatattgggggttatataaactaacaataagtttgatcatcaaaccgtaaagaaaccagccgaggcttgaatcatcccaatttgtccgtaggccaatgaaataagacgctcatttactaatttgtctcgaaccggatcacgtggcaggcgtttcatgatgtccgactcggcctcttcataagccaaactaattgctgggacctgaaaaatcgaaaaatcaaatcaggggtgaaaggcttattttgaccatgtcggtgccgagatcgatgcaaagaatggtcacggtaccgagaggaagcggaatcccgaacagaatgtacatcaggaacggtgagatctttaaaatggaagtttttaggaaacctaaaaaacacacacctccggaatgttagaagttaacgtataagcaatggattttttcaaattgtcgaaaatgagacggccttcctccacgccggtcacaattgactgaatgttcaaagaattaaaaaataacaaacaaataattataataataaatcacagcaaagttgtcgtccagaagaatcatatccgccgcttgttttgacacgtccgacccggcaattcctacaaattccaacaaatttatttcattacgctctccgactttttgcccacccattgccactccgatgtcagcctttttcagtgccggcgaatcgttcactccgtcgccggtgactgccacaatttgtccctgacgctgaaatccctcgacgatcatcagtttttgctgtggcgaagtcctggcgaacacaatttcatcgtggttactgatgacttcggccaattggtcctcattcctaaaaaacaaaaaaggaagaattgtaattatgggtcaattatttacatctcgcgcaaatcactcccatggattacaatcgccttggcttctctgaatttcgaatctcaaaccgttttccgttaacaccgacctcgggtcgacttggtccacagaaatttctttccgaacggcgatatcttcgacagtttccatgccctccgaaatgatgcccaccgatttggcaattgctttggccgtgatcggatgatccccggtgaccatcaccactttgatgcctgcactacggcacttcgcaacggcgtccggaacagcagcacgaggcgggtcaatcattgaaatcaaaccgacaaaacggaacccttcgatcggaaagttggggccttcaacatcgaactcaaatccctaaaaaacataaaaagcaatgggagaaccttaagactccaaaaaccttgggaaatttgtcgtggtccaagcgaaagtcgcaaaacccgagcactctttcgcccattccgcccaactccaaataggcacgttcgaagtcttcgcgcatttggtgggtcatctccacatccttaattaaaaatgtgtcaatctgttccgtcggtaccatttcccacctgtcctttaagcagcatgtgactgcagcgttgcaaaatgcgttcgggtgcgcctttcatcacaaccaaataaccggggtggccgtcgtcggtttcatggatggacaactgaaagcaaataaacagagttatgcgatgtaataaaagaaaaacttggtatttgttagtcgaattgaatggaatttcggcattttttcgatgtctaaaatttgtattgttacacaaaaatgctattanagtgatacttttgacgatattcaacacattccccacggntatttctgtgatttcagcagagaacttccgaagctaaattggaacgaaaattgtcaatgatta

SEQ ID NO: 20236 - DNA, 2617 bp, Heterodera glycines
tctcagtttttcctttcagtgaccctcgtcgccttttctttgactcattttcccgaggacgcttttgagcctgaagagttgcccttcttcgctttgattgggttgcctttcccatgcggcctaattagctgctctttctctcccctaattagcgttttttgcggctttatcggggccggcttcatcttcttctaccgtaatgttgtgatgttccttcgtcaaaacagtttcatcaggcgaaatattcagaaaaagtaaataagaagcataaattcattgataaatgtcctactgtattcagctggttactgtatccggtagtcattgcttttttggtgggtgtaccatttgcatatttatacagcacagtgcttgcttttgcaggtggcctctctcacttacccacgggggtacggccgtttcctctccggacgagtgagtctcttccaatcagtcccatttttaatggcccgtcaattagtacaaattcactcgcactgtgctcgacttcttctccaattgcacatggtctaaaggtgtccatcactccgttttggccccccacgggtgtccttccgaacttcttggcacatggacaaaccacgagggatacggcccttacaatgtgtttttggtgctctctctgttcaccttcactttcgtttgtcctctttttctctgccactatcttcctttccctctctctctctctcagctcgttctctccgctctttgcaacacaatgccaattccctgcggcatgttcatgccattgtttgtcgtcggtgccgcctttggccgactgatgggtgaaattgtcagttcgatgtttcccgatggaattacgggtggaactgatcaggtcccttcccttgcaaaagcaaatggccaattaattgccaattcagccaatctttcccggaatttacgcggtcgtcggtgccgccgcgctcaccggcgctgtcactcattccgtttcggttttaattgtccgccccaattttcagttgcttttctctttttcggttgcgatgatttgttgtgaaatcactggccagttgatctatataatccctctgatgattgctgtgatcattgccaatgcaatctgtgcttactttcagccctctctttacgacgtaatgatcggcatcaaaaatttgccgtatctcccggacattccgccgtcaaatgccgagttggccattcaaaaccggaaagagtgattgaattcgaatttgaagggtccatcattgtacggcagagaatataatggtctcgaaagtgcgttttctgtgccggctgacgcagtttaaagaaattcgctcattgctcatcgaaatgcccaaactccgttctttccccgtcgtcgatgaccccggtgagtttttagggaaaacggacaaaattttttggatatgttcagcttcgatgatgctgctcggttccatctcacgaaggacaatggtcgaattgttgaaagtacaaatcggagacgaagcgaggaaaaacgaagcggaaaaacgcataaaaagggcaatcgaaacgatcgacagacacttccgagaagcgcaattggaaatgatcggagtatgcgcacttttggggagggttaaagcaacacaatttagcagcagcggcagggaaaaagcggcaaaaaaggggagcggaaaagagacgcggaagcggacggtgggaaaaacgcggatggaaaggacgcggaagcgagggaaaagccaagccgcgggaagaggaaaaagggaatgatggaacgatcttcggcatcggacacggacatcgccaaaatgcaggcagggcaaggagcagacaaagccgcgcaaagagagggcatcagcaaaaagcattcattacccaaccatcggcaagtgtttcccgtggaagaggcggagagagaaaaagaagcgagagaaagcagcaggtgggagagaaagagagagaggagagggatgggggagaggaagagacaaagcgagattatggacaatgaaaagggagagaaagaaggaagggagtgaaatcgtaagcggaaattttgacagattcgtcgtggaacccgcaccatcagtgccgaaacgacgctgcttgtcgagtgcggtcggcccaatgttaggggcgactcggaacagaaggaacgcaatggcctcgtcgtctgcgattgagacgaaaatggacgaagagagagaaggcaaagaaaagaagaagagaaaggggggggggggtgaaatcacaagcactgattgattcagaatgccaaaatcgaccagaaaatgcgaaaaaatcgtcttgtcccgagttggcaagtccaatttggggctccttggaacaccaagcgccaataacgagtcagtccatttagaaattgaaatggcattttaaaaaacaaaaatagggaatttggcggaatatgttcggacagcgaagaaacgactgcgaatggtccatttgcgacacaaagaaacggaggaaagggcggactacgatttaacggaggacgaagtgattagggaaacaaaatgagaagaaagcaattggggaagggaaagcaaaaagcgaagagtgaatcgaataaattccttgggaaaggaaaagccatcga

SEQ ID NO: 20237 - DNA, 1773 bp, Heterodera glycines
aaaaaaccggtattaccggccggtaccagtaccgctcagctctattttctattaatttactgaattccaaatcgaagcgtaaattgcaatttttttttcatatcttttatttgtacaaaatgattatccgaaaaggttttctcatagatagaggagataaaatgtgaaaatgaaaagagctatttattctatgacgaaaagcaaggaaaatatgcattatttaatcgtatagaattaaaataattttaaaatacatacaaaaagcatcaaatatgaaaaaattggcaaatttcataggaatttttgttcgatcaagcccaaaaaaacaatttaaaaggggcagaaatgccttcagtccaaactcagtcttgattcggatttccgaatttaaaaatttttggttctaaaacaacgtaaatatctgttacggaaggattaatggcttttgtttccgtgtatttaaaccgattttggggtgtactatagtcaaccccccggaaaaaaatggcacaaatgatacaccaatcgattcgtctcgaggagctatgcacaaaaaagtaggtctccagttgcggaaatgtgtttaaacccatttttgaaccggtttaaagtgtattttttcttattgaaaattgtcaaattatttaaaatgttcttaatcttcaatcattagacaaaacgccaaatgtcattaatggccaggaaattgcttttggatgatcgaaatcagatctccgaacgggtcagcatttcttctcacacagtctcgccgccaaagaaattcacaaagatgatccgccagcttgtcagattgaacgccccctctggctagccgttgccgcaaaggtttccattgtgattcgattttgttggtcgacacgccctcctctttcacgaattgcatgctatgatttgcgcaccaatgctcgaagccgttctgtccaagattgttgtaaccacgccagaaatcggtaaacagagtcgaatcagggcgaatgtgtttctgtatcaaacacaacaaagtttcactgtcccgcctattatctgggcaaatctccagtcgaatctcatcactctcctgatcaatcatcccgaggatccagctgccttcaactactctgcccctctcgaatttcctcctccccaatttcatttcatcgatttcgatgactcggccagggcctcccatcggcccaaaattctcatacagaccatccaaatgaattgtgcaacattcccttaatttgcccttttttgaattccttttccattattttgttaatattggtcatgaaccactaaaaaggagcaggtgaagtcgatggtgcgctggtttttagcgcatataattagttgccctacaaagtcaatatgaccaataaataatgtagatctctttacatacctactatatgagaaccaatcagccacagtgttactactagtaatttctcccgtttccaacaaagaagacacgaattgcttgttcataagacatttttgttgcaaatgcatacgtcagaaggatggccttcgacaccatttgcttggatctgacaccctcaaaccaagtgttgtccgttagagcatgttgtggcccttcacagcgtcgacaacgaaaagaaccgattccttgatccgttcgaatggtcattggctgacgacatcgcctgcagatccgctcagttggcaaaagtcggtgccgttttgcccaatcaatcgcttgttcagggctttggacaatttcccttcccaatttttattaggttgtag

SEQ ID NO: 20238 - DNA, 1196 bp, Heterodera glycines
  misc_feature (951)..(951): n is a, c, g, or t
  misc_feature (1001)..(1001): n is a, c, g, or t
  misc_feature (1010)..(1010): n is a, c, g, or t
ggttcgcagccaagggggggccggtgtaaaagaggtggggggaggggatttgcggcaagtggggggtcgcaaattttggaaattttcttaacaaattcattaaaaaatccaaaaaaattttccggtggcgcctatcggcaccgtcggactccaaaaatcccaatttttctttaaaaactggctctttttcattaaacataggttttcaaaaataaaaaactgaaataaattttttttttttaaattttttcttgaaattttattttttcggcgcattgtcttttctatggcgatattttctggtgcaccgaattttctcatatatagtagttgatgacattttgcggggtttttcccctaaattaacattgaaatttttaccaatccggatccggcaatttgaaaaatagggattgaccggcttacaggattatgagagactggatccagaatagcatttaattaaattaatggggttttatacaaattttattttatttttaaaattaaattggtcgctaaattaaattgatattttttatagaaacttttctaatacaaaatcaaattaggtgataattaaattaatgtttttataaaaattagtaaatcaaatattagctaaaatggataccacaaaactatcacaatcagcatttatgcacaatataattacctaaattattttgttataaaattggtaaaaatttaattttctttttaaattgaatttaggtgcctaaattaattatcaaataaattttttttttttaaataaaaattgtttaatatttaattttcttttttaattgaaattaggtgactaaataaaattattaaaattttgaatttatttttttaaataaaaattggtaaaaatttttaattttcttttttaattgaatttaggtgactccaagtgctgatcagacggagtggtcctgtgacggntgcgcttcacaaatgagaagaaaaggacgctgctgcattatttttctggncgagaattnatcacttttctaattacctaacataaaaaacacaacatttttcaaagaccgaacaataaaaaaataaaaatggtcagacaaagacgacatttttttattcttaaattttttctgaataaaaaaaatattatcttttgcaaatttgactaattttgaaaaaaaaaaaagattttttttggggggggg

SEQ ID NO: 20239 - DNA, 959 bp, Heterodera glycines
tttatttcgattcatatttggtaccattttatcaatcccttcccgcgcaaaacaaaaaattcgttagtttttttcgcggtctttgagtctaatttaaaaaataaagggaattttggagctccggcggtgccgataggcgccgccgggaaaattttttgaatctcagtgcaatttgttaacagattttgtccaaaaaacgtccgaattttgcgatttttgtctatttcattaatttttattaaaaaattttcactaaaaaagtcgtaaaaatttacgaaatagaaaagaatttcaatttagtaaaaaaatttacgaaatctaattaaaaattgtaaaatttttgagtttttacaaatttcattccgaccctaaaacaaattcgaaaacaaaaactcgcgcgtctttccgtctatttccaagccggttttgaacctaaaaagcgaaatttgcctacaatttttttccaaacaaatcgatgtcagattccgtcccttcactccgggactggattttttcgaaatttagggcttcatcaaagtttcaatttttgctccctgaaattttttttcaaaattttttttcaaccccctttaaaatattgggacttccgcccaccacagttacagtatcggtgggggtcgattgggccccgccggttgtgccccgccgattgggccccggtacgattgggccccggtacgattgggccccaagggcctgtcacattttccatactgtcaaaaatgtattcaacatcccaaaaatttattcataaaattctttgtcatccatctggtaatttcgagaaacaccaatcaaaaattccataatgttcgccctcggcacttcatgtccttattgtttttgttctcacacctccaaaatttgataaaaccatctgcgctaagtttggcgaaaacataaagatgaccttcatgttcaagttttttgtggttcat

SEQ ID NO: 20240 - DNA, 1815 bp, Heterodera glycines
actgcttttgttagccttttgtcgctttctcgccctttttcctttctctctctcttcttctctctctcgctctcttctctctgttttccctctctctctttctccgtctctcactccttcgcttttctctttcttctttttacaacttttttctattctcttttttatttttcgtatatttctttaacatacaaattcaagtgcattaaaagaagaaaaaaagataacatcacaacccaaccacaatcacagcactaacacacgaagaaagtgagtgaattggtggtgcaaatttttcaaccgtttccttcaaattattaattcaatgaagtcattaccctaaaaagtaaattggaggaaaccacctttgagcgtgttccttcagctgacccaaacaatttataaataaagatgcgttttcttgtatttaatttttccatttattttgtccatccttaccatagcatataaaccgttaaaaccaaatgaatagcagtgaagaaacaacggaaaatgttgggatgggcggaaataaggacgaacggcagacaacttcaaaagatgagaccgacgaaagcagcagcgaaaatcaacggaatgaacaacgccaacgacaaatggacagcgaaaaggaggactcgaggtgagcatgggctggacaatgcaaaaacagtcaatgaaaaactgaaaccgaaacatcggaggggggggtgagacgaatttgaccaccgaaaactaaaactccatgctttgaaacccaagacgaattaacaaagaaggaattgggctaattgagcatatttgagggcaattaacgcaccaaatgtgtatttttccaattaacatttgttttcatttgtccaggttcgaatgcaatatttgcttggacatggctaaagatgcggtcagtttaccagcgacgatgccttttcactacgttttcatcaatacgttccatttttgccttaggtcgtttcgatgtgcggccatttgttctgctggccgtgccttttccaatggatggacacgcgtccctatcgccagctgtgccccgtgtgcaaatcggcgattagcaaagacaaggttttccatttttactgaatttatcggaatggacaaccaaataaaaaagccaattcacagtctcagtcacattccctctaaaattgcattttttgccaaggtgattccgctctatggtcgcggtggtggggacagcgacccgcgcgagaaaattccaccacggccgcaaggtcaacgcacagaggagacaaatcaggtggacaaaagacatttttaataaatacgcaataaatgctgtcggataatcattcctttcttggcttccatgcaaacctacatttcccataatcaattttcacagaaaaaattgtcattcgttattcatttttcatgcagggctttcccgggatgttccattggggcggcgacaacggcggccatggcggcggcggtgtgcaattttcgttgggcatcggtgtcttccccatttcctttttcgcctcctttttcaacacaaatttcggaggcgccgaccgaaggccggacccacgtgagaaacatacatccagtaaaatagccaatttccacggcggcgcataatggcaccgcccgattccaatttgtacatttattccaaaattatatttcaaatggcttaaatttattattggttaaaatttaattttgtttcatttaacttttttaagcgcccgtcggaagtcgtcaaatgttggaggagcaattgctgtctaatacggtggcttttctccctcccaatcccaacaacaatta

SEQ ID NO: 20241 - DNA, 1262 bp, Heterodera glycines
  misc_feature (55)..(55): n is a, c, g, or t
  misc_feature (201)..(201): n is a, c, g, or t
tttccagaccaggcctttggtctgatcaaaaaacttttgctggcaaagttgtagnccatagttggggcatttcgcttttggggtccaataagcgctgaaggcaaaagcaaaaaatttcgtaacagtgagactgtcggcaaagtcggtttttagcccgctggtactcagttgggcctcggaccaaaaaacctatagttttcncagatgcgccgtctcgagttaccccttggtgcaaaatttcagccccgcgcgcttagccgttcttctcaaattagtttttgagatgagttgccttgtcaatataacgtatatataactagcgggtgcgtgaaccgtcggctatttagctgggataaagcgcttcgcgcttcttgagcttcgctacctaggctgtgaagcgattcaaattgatcgaattggttggagattttttttttgaatttttaaaaaattattatgggtttttagtccacatcgaggctcaagacgggcgcttcgcgcccgttttttagcttattaggccgtttcgcggcctcagtcgggcccttcgcgcccgtttctaaattttgttgaaattggacgggcgcttcgcgcccgtatttaaatgttgttgagctcatacgaggtacaaaaattgttggaagatgtgttggaagaggtacaacagtgattagaagaggtgcaacagtgattagaagaggtgcaacagtgattagaagaggtgcaacagtgattagaagaggtacgacagtgattagaagaggtacaacagtgatagaagaggtgcaacagtgataaaagaggtacaacggtgattagaagaggtacaaatttgataaaagaggtacaaaagtgattagaagaggtaaaacagtgattagaagaggtacaaaagtcattagaagaggtacaaaagtgattagaagaggtacaacggtgattaaaaaggtacaaatgtgattagaagaagtacaaaagtgattaaaagaggtacaacggtgattaaaaaggtacaaatgtgattagaagaagtacaaaagtgattaaaagaggtacaacggtgattaaaagaggtacaaaagtgattagaagaggtacaacggtgattaaaaaggtacaaatgtgattagaagaagtacaaaagtgattaaaagaggtacaacggtgattaaaaaggtacaaatgtgattagaagaagtacaaaagtgattaaaagaggtacaacggtgattaaaaaggtacaaatgtgatagaagaagtac

SEQ ID NO: 20242 - DNA, 1676 bp, Heterodera glycines
aaaacctacaaaagagaattaaccaatttcaaaattttttctggtttagaaaatataatattataaaaattattgaaaaggcatttatatttttccaactgctgaaacgcaaccaattaaatataaaacgaacataattcaattgaaaaagcacaattattcgaaataaattttaaaatttttattgtagaaatttattaagactaaaataaattatttagaatggaagaaaaattattcaaaatttgtaaggaaattcgagttggccgtgccctaattgaaaaatggttgcaacaatttgaaatgtttggaaaaagaatgacgaaaaaagaaaaaatggagaaaatgaaaatatattggaaaataaaaggagaaaatcaaaaaataattgataaagaaattgcaaaaatgttggaaattaaacgacggacattttccacttggaaaaaataatttggagaagagaatatttaattttagatggaaatgaattttcaagaattttgaatttgtttggtgttgttaacaaattttattcaaataatttctctatttgaatttagttgttttttaaaattgcataaatttgttaagggtgattgtcattacattgtattttattgcctatgctcttgacttttctcgccccactcgccccgcccccccttctcattaatctgttcccctctcttttgttctattcattctgatcggggggattgggccaagtgcccgtccgatccttccctccccatctgtcccgtacgaatcgggggccgctcctttccctcatttactcattatgtaattgtgtgcacaccttcggaataaaggatattattccaaatttgggaatggtaatgcggacgtaacagatcatagaacaactttgggaaaggaactacggtaaccatattcaattgttatttgtttgccaaaaatcattctgtcctcaaatgaataattttgctgaattcggcactgatcgtttttaacaatacaatttgttttatcaatgcgcgcatataaggggaagggagtcccaatcaggggtgggcgaaacttcggcttcggcttcgaaatcttcgggttttttgagcttcgaacttcgtgcttcggcttcgggcaatttacccgaagtttcggaaaaaatacacccctaaagatcgagtttttggtgtgaaaaatacaccagtaaatttgagttttaatgtacttaattgtgattttatctattaatttttaatttcgttatgaaacatttcgccaatttaatttccttcaaattattaatatattctacatattctatattgctttttttatatttttgttgtctttttatattttattgactccaatttacattcttagcaagtaaatgccctcaaaaagcaaatatattaaatattttaacacttctcatgggacagctaacgtttagcaggagaaacgttgaaagaactcctttttcttcaacaaaatttgcctctttatggatttaaattcgaaatttaattgaattttattttgcataaattgtttgggttacaaaatattttttcaaaaacttcgaaaacttcgggttttttgggcttcgagcttcggacttcggcttcgaataaaaattgggcttcggcttcgagtactaagccgagcttcgcccacccctggtc

SEQ ID NO: 20243 - DNA, 1079 bp, Heterodera glycines
ttcaattatgaaaatccgtaatccgtaattacggaggtcccccaaactccgtaacttttgtaatctgtgattagacccagccctgattgcaatcgcgccaaatggggctgagtttgatcaggactgtgatcagtcgatctgtttgtgcgctcacccgataaatgttggtggcttcgtcttcaaccgtcggttccggcgtaacaacggattcccgaaagcgctgtttgtgcccggacgagggatggaaacgcaactcttcgcacggttgcacctccttaaatgaccaaatgctttgaaatgcgcaaaaaaaattgaatgccattaattcgatcaaaacggaaatggtaggggagaaatacggtacgttacaatttacagtcacttaaagaatttgtaaattttatttcttaaaacatttttaataatttcaagcagagcttggcactttgaaaatgcttggaccttccatgttggacatagacttgaatttctggacaaaaatccaggaaaacccaggctcctcgaggcctggatcaatgccttgatttggtttggataactttaaagaaaacatggtcactcgaattaataaattcaaaaatattttccaggaatccagtattttcatgcataacttagacctatgccaggatccaggaaaaattcaggcctggacccgccaggttccagtttgatctctaatttcatgtttttatagtaatgcaagataaccattaatttttaaatcagtctcaaaatctaagcactgaattatatagtaaaaaaaattaacaatatttccgggcgcatagattttttttataaatttgctggcgcttccataaaagcatatttggcctttcatccgagacgagattctcgaaatttaaatttcaaatcgcatttacccgattcgggcccaagcagctgaagccgcgcacggtgttgcacgcgcggacccgcatttgtacgccaccgctgcagaaggaccaggcggaccatgaggcccaaacggaagcaaaagctgaaattggcaaaaaaagtataatatgtttgttggttggcacatttgcgctgat

SEQ ID NO: 20244 - DNA, 863 bp, Heterodera glycines
tttttgtcccccgagggcactttcaaccaacagctgctggctgatcagtgtgatcatcggacaataaacaataaaataattgcatggagaaattaagaattaattggattggatcgaaaatcggtgactcccgagaagcggacgcgcaaaacaacaacaaaaatggggggaggggtgaagcgaatggatagggagggcgcaatcgaatagattttggatcggcggcggatggaaattgaacatttcgccgacgaaaagacaatgaaatcaatcccatccccgcgcagcggcactgcacaatacttccggaaactaatttccagttgaaaatggacaaaattaaacactggtggagcaatgttatattgtaaaaaaaggaatacggtaggctaccgtaattcgtgggaaggaatgttagggttattattgtcaaatgtgcaggaagcgatgtaaaaaactagaatttttattgcaaatgtatcaccataaacggagatactttgataccgtaatcggattagttattgtaaaagtacagtaaacggcggaataaggacagcattcaattcaaaataatctgaattagacgaaatcataaacttcaccatagtaaaatattaaactgttcatattataatgctttgggtttgccattaaaagaaaacaaaaacagaaaatttattttttgaaattttctattttatgacagaaagtaagcaaatatggacatttatagccttgttatttatgatgctttcgctagcatttccagccattctctggtttttgaatgatcgaattagcaaattaattaagtcattatgaatgtgcagagtacaagacgacatggaataaatttgctt

SEQ ID NO: 20245 - DNA, 3407 bp, Heterodera glycines
  misc_feature (214)..(214): n is a, c, g, or t
actgtcgactttttgttcgaattcgcgtccggattcggaataggcacaaatcgaccggattcgtggtcagtgatctcgaaaacacaaggaacttgtttttatgacaataaaattttcactgacgctttttttacttatgcactttccaactgacgcattttcctggcgcccccttttttgctaaccgcagaaacggggacccccgcaccccagnccccgaggacggagataaaaatacacccctttggatggactcaactcaaaaatgtcggaatcggaattccgactccctaattttttcggaaatcgaattccgaccccaaaaatgtcggaatcggaaatcggaattccgtgacatccctggtgtgaaacgcgtaaaaaaaattaaagcttatacttgggcgcaccaggaaatttttttttgtaaaaaactatcctaaacttttttttaaatatttaaaaatctgaaaaaattcatggaaacattttcttagaaactaggtacttaaacatcaatcttgtaaatccttggacaccaagtaaatgcgccaccagcagtgcccatgaatcttgaacaacttttgataccgcaaagttatcagatttaccaaaaaaggacgatatgcaaaaaagctttttatcggactcgctaagttgggccccggcacgtttgggccccagcgggattttgcctataacttttttctttgccaacaaatccaacaatcttggtatcattcgatagccctaactgtcctctattagtctgaaaaaatctgaaaaatttcgttaaggttcaaaaaagttaaaccaaaaaggttggaaaatctggttttttgaagttttttggtcataacttttttgaaccttaacggaatttttcagattttctcagactaatataggacagtttgggctatcgaatgataccaagattgttggatttgattggcaaaaaaaaaagttatagccaaaaccccgctggggcccaaacgtgccggggcccaactgaggtaaaccgtgagggatgtatggccaacagatttttttggattagctccgaaaaattaaatgggtttcgaaaatggcaatttgtaaaaattttataatttaaaaatttcattttatatacatctaatgaactttatttctcagcttaaatgaatcgtcatcgatgttaaatccgcttccaatttcaattgaattattagctgaacaattaaaaactttggaaaatcacccaattcaagaccaagaaaaagaaaagaaattgcaaattctctttttttatatgcgattttatagaaaattgatcggaaaacttaaagctttgcatactgaaaaaaacacacaaaattttgaggccagttcattaattttgtgaaaaataatttaaaaattctcatttaataattagaattttcatattaaatcatttttaagaattttattaaattaatccatttttattaatcgttttcattaaaaatgtgaaaataatttagaaatttcatattagataattaggtttttatattaaattattcaattgttattaatgatttttcattaaaaatgtgaaaaataatgattatagatttatgatttaattatttttttttattatttttattaaattaatctatttttattaaccattaaaaagattgttggtgaaaataagaaaagaaatgcccttcttttttggctttccattgccaaacaacaattcaatgatgcatttgacataaaattggcagaaattgaacaacaatatgttaaggtagaaaagtgcaaaatttttaagcaaatcgaaaaacgcagtttcgacttagtttttagattttctgggataacttatagaattccatatttttatgggttcccaattttaccgaaaaaatccaggaaaattccaaagctaagaaatcctggttttttcctgtttagcctggacctgaggcctgaacaggatctttttttttgacctggacttgtatttcctggacaaaattccaggtcaaggaaaatccagtgccgaaaaattgcaggcctgggtccaggaaaaacccaggcctaggtcctggtcgagctctaatttttaagtatttgattttcaaattttcaaaaagtttactacgagcaggaatgcatttgaaattacgcaaaaattacgtagttttccaaattaatttttaattttttctgcttatttatttatgtgcctttttgcgacctttttaatttttaactctataattaggcaattttttctttgaatataaataattaaattatgtgtaaattaagacatatatttccacaaaattggatgcaattgactgggccacagaatgcattggtattgtgcattatactgtagaaaatacagtaataccattggttggcgaagcttacaaaacgttagataaattcggtgaattggtttctgatttgtcaaaaaataagaaaaattttgcaaaaattattatggagacggctaatttggacatgaaaaatgcttataaaattactatacagaacgcattgtcacatcaaaagtaattaaatacaataatttgaacattcaaaataatttttttttcaagaaaaaaatttttctaagaaaattaaaataaaatccaatcaaaaatggaattatttttaaaaaaagtttatttaaaatgattattttttttaatgcaaaaatggggtaaggaagactcaaaaaatggggtcggggaacaaattgagaaaaatatatataccgtatttcctaaaatatccccccccctaaaatacccccccccctttttttgaagggtttgaaaaatagagccaccgggggctctattttaggaaatacgagatatattctctctcgtatatgtaattcctaaaaattgaaacctctctatttgtataccagcgtattcctaaaatataaaaatattatagtagccccaagaggagggacgaatatttcagtgaatacggtacatattttcttcttttgtacagtaggatgggtattactgtggcgtttgacaccattttcactgccgcaattcgacaatttgatcaaaaatatagcagcgcaaaaaatgttgttcaattgccaatacaaaatgtgcacatttatgcatttgtttatgaacgaatgaacaattttctttcatcgaatgtcgaaaatatattttcatcaaacgaaaaaatggaatattttttttcattgatgaagaaattttttcaaacaactttgaaacaattgaacaaatttgtggaagagaatgaggaaaaaatggccaaatttttgtaaaaaaaaaactaaccaattttaccaaaaaagaacagttgttctatgtttgtatgcagggataaaatttgggatttatgtttagggatgg

SEQ ID NO: 20246 - DNA, 1557 bp, Heterodera glycines
tgatcatttttataattttgagaaacggaatcaaaccattagatttttaagattttttttgctgcaaattttttcaaaaactttaggggaaccgggggggggagaggtcggctactaatcctttaggacactaatccgaatatttgcctttcgctgatagcctcacaaaatgttatgctaatactgtatcccatttctatgtattgaaatgctgttatgggcttcataactgcgggaatttgttcagccatcgctgggtcaactgctgaatggcacaaaaaaataatgaaaatgcctaactatttccaaaatttggattttaaaatcttaaaatttcttaaaataattttaaaaatgaaataagtatgcagcctaattattttattaaaattatttgttgaaaattatacgaaccttttacatattcagcaacatattcacggaacaaatactcgtacagaatgaaagcaaatttgcgtgacatttcccattgtttctcatacaaaatgttttccttaaagcacgacaataaacaattcataaaattttaattaaatccaaaaaatatatattttcagaaaaagaaaacgaaaagataataattatttttcacgaaataaacaaaaatttgcaaaacaaaattataaaagacgaaatcgtaggaataaattataaatcaaaaaaaatcaatttaaattatcgattatgaccttttttacagctattaaattaacattcagcaaatgatcttacttcggtcgaatgcatctcataccaatcttttcttaaataatacaaaaggccaaggtgtgcttcatatttttcagacaaaaattggtttttctcatcaatggttaagccgtaaattgcgcaaaaattggcaaaatgtttcgggcctttcgcaagcgcaaccaaagcgtcatcttcaatcttgtaataatgggatgataaaagtattaaaattagctaatttgttaaaatgacaacttacaaccgcagcatttacacttgggaaggcattgaaattgcgatgatttaataaaattagaaaaaatatacaaatgaaataataattcattgatgttgctaaattgtttcaaatttgactcaaataataaaattaaaaaaggcatagtgtaaattaaaataattaatgcacatcgaggtccaattacgaattgataaaaaaattttttgaattgaatttttttttaaaaaccgggggtgtgtaccaccggcactattaccatattttttattatacaaaatgggagagttttgtatttcttctctttctaatgcgctggatgcttgtgatacattatatgcatgcatagaaaaattgcaattaataaaatgctttttttgcgcgaatgaattaaacggtcaaacgtttcatttctgatcgataggatgaaatttttatctaaaaaaatttacaaaatatgtaaaaaaaaatatgcgggcgccgaggatttttttttataatgaaaattttgaacgattgtcttttttgaataaataatttttttgaaaacttacatatttttcacaaaa

SEQ ID NO: 20247 - DNA, 2093 bp, Heterodera glycines
agacagatgattttgaaaagaagtgatcggagcaatgggacagtgggagacggatcacagtctgagaattggggagggggtggtgatggggtctaaagttcgttgagaaaacgcagaatttgccttttggcgatttacccaaattaaaatgccaaaaataggcaaatcgctggaattccgtgactcaaaagtgatcggaaaatatttaaggaccgactaaaaccaaacaaccaacaaatatgattaaaatatttggtaaatgttcaaattgctttatcatccaacaagttgttgatcacattagttgattgattgactaaattgctctatcccgactaattcggctctgatcacagtttaaaatgcacttttttgcctgatcactcctctcaatttgttgtttaattatttgggcctcgttaaggcatttaaattttaatcgttcattgcctttgtttccaattgccaattgagtgcagccaaaagtcaaagtcagtcactgctcgacgcccccgcagggccaccgcccaatgttgatccaattaccctcttaattttcctctctgatggggctctttaacacgtgtaaatgggccaaatggggcgggggcaaaggaaaataaaaagggaaatttaattgtttatagtaaattatttatttttatgtattggctgaaattaacttcaaatttggaagaaaaggtgaaaataaacagaaaataacaacaacacaatgtgatgatggttgatcagaagacatgaaaagaaattcaaacgcattgagttaattaagcaaagggaacggacgaaggaaattttgacggggcatggttgggacaaagtgtcacaagtgattggccaaatattggacaaagcatcacaagtgattggccaaatattggacaaagcatcacaagtgattggccaaatattggacaaagcatcacaagtgattggccaaatattggacaaagcatcacaagtgattggccaaatattggacaaagcatcacaagtgattggcgccaaatattggacaaagcatcacaagtgattggcgccaaatattggacaaagcatcacaagtgattggccaaatattggacaaagcatcacaagtgattggccaaatattggacaaagcatcacaagtgattggccaaatattggacaaagcatcacaagtgattggccaaatattggacaaagcatcacaagtgattggcgccaaatattggacaaagcatcacaagtgattggcgccaaatattggacaaagcatcacaagtgattggcgccaaatattggacaaagcatcacaagtgattggccaaatattggacaaagcatcacaagtgattggccaaatattggacaaagcatcacaagtgattggccaaatattggacaaagcatcacaagtgattggccaaatattagacaaagcatcacaagtgattggtatcacaattgattggccaaatacttgacaaagtgtcacaattaattggccaaagggacaagcacagggagcagtttccaaaagctgttgctacagtgatgatcactgatcaggcgatgcttttgaaaaattgtgcagtgatcaaagagagcagttgaagttccccccccccactctatgcatattctctgtctctctctttgtcttcctctcgctctctctctctctctctctttgatctcctttttctccaactcttttttcttttctacgtcatcccttttgctatttcctccctcactccctctcctttccccacactctttcccccttcagctgtccattcccatgaccatatcgtattctctccaccattctccccccccccatttttcattcttttcttttgcccccccccccctttttttttgaataatggaaattgaatgaatggatgggatggatggattgtgattatttgatgatttatgtgcccatccgtccgatgacgcttcccttccttccttccctccgtccgtccgtccgtccgccgttcgttcgttttggctgactttttgcttttgtcccccatttcgcccccgcggcgttcgtccgccggcccttccaataa

SEQ ID NO: 20248 - DNA, 894 bp, Heterodera glycines
  misc_feature (61)..(61): n is a, c, g, or t
  misc_feature (70)..(70): n is a, c, g, or t
  misc_feature (96)..(96): n is a, c, g, or t
  misc_feature (107)..(107): n is a, c, g, or t
  misc_feature (126)..(126): n is a, c, g, or t
  misc_feature (149)..(149): n is a, c, g, or t
aatgctgcagatttatacctgctttgcgcgcaaatagtccttctagggccataaattttgncaaaattgnaaattaatgtccttatgacaaagtgncaatgtttggntaaaatttaaaaaaatggnaattaaaattttaaaaaattggngaaaaaatgggttctttataaaaaaaaggaacacagcccgccgggcagaagggttagcaattggaacagatttgaaacagcgcattttttagaaatagcgcgaaaatcgggatggaaacgcccgaaagccgagttaattcctcatccaatcccgaggctcatcaatcaacccttggcttaacattccatggcatgcagccgaacgaacatcaatcagtccctcctgctgtagtgcttatataaatcgcgctagaacaccgcagttcagcagcagcacaaatatatactccatgatcaccatcaaccacacaacccattccatgctttgtgatcatcgacggtccgtcgtccttgaatggatggggggggggcgtgagggtgaaacttgtgagcaagtgggcggtggggggaagtcactaaaaataacattcacggagccaaaaaaggggtataaaaaaattaatgggggaaaaaaaactttttcaaaataatagccccgggactagggagtgcgaaaaatgatttcaatatttctataattcgtactattatctactctcaacggatcagaattcaataaaactaacacacaccgtgtgaacaattggggaatgaaaagtttattgtgtataaaaatactattacataataataacccctgggagaagggaatgcgaaacatgatttcaaaattttcgaatgatttgcactctattctactcaaaacgtttgagaagtcaatata

SEQ ID NO: 20249 - DNA, 2297 bp, Heterodera glycines
ggggccacattttgttgtttgccctcggcgcagaacagcgttttgaacagccacaacacagcccagagagaggccggaaaatctgtttgtccttttgtttggtattgggcggtgtaaatggtaaaaaatgttgtgttcacaaactttcccctttttgaacgggttaaggtacgtacatatgtatgaatcagcattttacaaaaattatttgttgctttcattgtttttatttaattttattttcattgttttaaaattggcatgtgttcatattagggaggagatgcgaagccggcacaaaaatgacgcggacgcgaaacgcgcaacaacaaaaaatcgccgcgattacgcgacacgcgggcgcgtcccacccctccctggtttttgtactcggttaagtttagcactgcagcttgaaaactgaaaattgcgacctcagaatttttttctttcaattaatattttaattgcttttaaagttattcaattatcattcattagttttaacatttgaatgatcattcaaattagttttaaaattgtttaccattcaaattatttttaattaccattcatataaaattttaattgctcactcaaaacaatgtaaattaagtcaaatctgttaggtgtcagcagtccaaacatcaaaaccacgagcccgatcattcaaaaattcagcagcattagatcagctcaacagataaaacgaacgattcgattttttgcaaacggaaaaaatcgtgagaaaaagccgaccaaaagttggccggaagttatcggagaatagcagaatagggcgatggttggaggatatatgttggtgttttatctgcataatctgtgctggacgaattgtcaccccaagggcaggcaaacaaaaaatttcaattaattcttttgccttttaaaaatttgttttcaattgtctgaaaaagtgccattacattacacaaaaaccgggattcgatttgccatatttttttgatgccattcgccgccgtttttaatttataaaatttaaaaaaaaaattattttcaatttataaattgtaaatttcaacaaaacaaattccttttttccacataattatgtgcccagaggacaacttttgttcaccactgtctgctaaaaaaagtgcgcacaacggcggccacagtgacggaaatggactcccatttcttcatgaggcggcccgtggaaccctctaatcttaaaattcgggggggggggggggagacgatggaagttgggtccttctcctcccttctctccctcatcttctttttttttgtccggaccaatgccaaactaattgcagggccattgtgaggttttgaaaaaaaaaaaaaaaactttaactgactgcgaatgccgaatttacgaatattcaaatcagcccaaacatttgcccggtgaattgtttcgacccgagataaatgtaggaaatataatttggcagattttgacaccgttttttgttttctggaatatctaaattcccggtttccgcttcacattcctgattctcgcattttcgatgacctcgagcagcaccatacaaatttcttttttttaataatttaccaggcagcagaggagtgagtgattagcagttgcaaatttctttctcacaaacaatcaaattatgtttttttttttgatccgtaaattctttgtgcctttctttctttctttgcttttgtattggtttgtccccttccaacaatttttccacgtcccctcggggctggggtcagtcgtcgtcgtcggccggccattcattcatccattcattgtccgaacaatgtgatttttatttgcccctcaccccggggggggggggggtgggcttttgctgctgctgatttgttacggtaattttcccatcatttcgtcgaggcagaaaaagcggggggagggggggcaataaagcgcatccgttcgccaccaccaccaccagcagcagcagggcggaaaccgagcagaaactaatgacacacacaataaaaataggcctctaaaaattaatttttctcagttttttttgctggctaagcaaaaatttttgacaaaaattttattctaattttctaataaccctggcttaaaaattaagttcccgttgataaactgtttaatttttttgaattgcttattttttcttttgcaatttttgaagggcattttaaaggtggtttggtttaaatccgaattttgttttattaatttttttaaatttttatattatttaaaagcgaaaattttcttacatttcgcccgcatcatccgttct

SEQ ID NO: 20250 - DNA, 2165 bp, Heterodera glycines
  misc_feature (1252)..(1252): n is a, c, g, or t
  misc_feature (2048)..(2048): n is a, c, g, or t
  misc_feature (2069)..(2069): n is a, c, g, or t
attgcggattgcggattacggaaattgcggggtttttggacccccgtaattgcggattgcggatttccgcaactgagaaaatcgccgcaattgcggattgcggatttccgtaattgtaaatccacttgcgtgcagccctgctaactaaacaccggacggttacgagtttgcctggaaaatccggaatttgcctaatttttttatttaggggggcccgtgccgattattgcaggtaggcccgtagccagggaggaaatgaaaaatttaaaaattttttaagaaaaataggcaaatttttgaaaattttatgcaattcttaacagattgcattaaaatttctaaaaaaaattttcccggcggcgctaaacgacaccgccggatattcaagtgagaaacaagaaacaattaagtcacaaaaagttgacttaccatcacagaccatagtttcacctgaaaacgagaaaatacagtataccacccgaaaattgtagtacagtatttattcacttttccgtcatcgctgccgctggccatcagatgcgggtcgatgctgttgaattggactgtccagcagcgtttttcatgctcaccaaatgtccgtgtacattttgcggctaaaaagcccccaaaaatgagttagaaggaagctaataattcctaatgattcttcccctccccccttccttgaaatccctctgaaatggataattttaatatttagtcatattcgtgaaatgaaatttaaattaaatttttaccagcagtgtcccataattgcactgtgccgtctgaatttgtattttaattaatattcgtgatatttaggaaaataaaaaacagtaaaagaatacatattaccgtaatcactgcttgccaacatgtgctgaacaacaaaaattatgaaggcatttttatgataaataattttttaaaattaaattcttactttattgtatgggttccatgaaacattgctaaaaagtgtaacgaaatcagtttttgaaatgaggggggcgggaaggtgtgccgtgcctaattttggagttgcaccgaagctgaaccatcggctgatggacaaatgccggagtcgtaatgccgtcgttggtgcccgctgtcgttggcggctgatcagtgcctccgcaatggtccatcagtgcgttgaagtcgtacagtttgatcattttggtcacaccggcgatcacaaaaaagtcaccgtccttgttaaattcaatgctgcaataacacaaatgangaaaggagagatttttattaatttgttgaaaaattactaaaaaattgaatttttaaattaaattatagaataaagaataaacgcacgaaaaatttttagttttttcttaaaaatttttttagaaaataattttctgattttttttaaatctctgagtttgaatttaaaaaaaatattttcagttcctgactaagtcgccctaagcgatgggacctcaacaattccaaacatttcgatcaatacccagaaagattgactgagttttcaccggagagacatatatttaaaaaattcgggaatcggaattttctgaaaccctgctgatttatttatttattttttcttaaaattcattttttgtgcctcgaaacaattgagggcagattgtacgcgtcgatgttgtagttgagtgttgtcaacaccttcacttccccgtagcggtacatgttcttcaccaacagtgaaaactcgtccaaactgtccgccgtcgtcgtcgttgttgatggggctgcaattgttgctgctgatgctgtgccaaccgccgccgccggtgtttctgcttcttaaatggcaaataattattgttttgttcaatttggtagagacggttccaggaacttcggtttttcacaccttttttagctatttttttgttggaaaatttgggtgagggaggcctcggagtggtgccaataaggaaacccgaaaattttcagcataatgaaaatagttcggcaaaagggggaggctcaaccggagcaaagctgcatttctttagctataaatgattaaattntggttttttcaagtaaaaaanttaatttttttttcatttcgccttggtggcaatgtcatcactagggctgcgacttttagtgaccaaaaatctcgaaatagttaactaaaatagtga

SEQ ID NO: 20251 - DNA, 1108 bp, Heterodera glycines
  misc_feature (56)..(57): n is a, c, g, or t
  misc_feature (1054)..(1054): n is a, c, g, or t
gggacgcaccccatctaatttttgcatttttcagttccattagagcccaaaatccnnccacctaacagttccattagagcccaaaatccccccacataaatagactagtgatagtccaattaaggtactattacatccacatttatgtggcacccaaattttggaactgtctcgccctcgggtgggacttaaaagaaggtggaggcaaatgttaaaaattttcaagtcaaaattttcgttcttaaatttaatgcaatagttttctcgctttttttcacggttttgaatcgcggaatcgtgcgggtttaaaatttaaaagctgaaaagtttctatgatttttaacaaaaaaaatcatttgtttttttttcattttttagaccctgaaatagtgcatgaaaaggggcgggttagacgacgagggaattccttacaaagggacgcaccccatctaatttttgcaattttcagttccattagagcccaaaatcccccacctaaattgactagtgatagtccaattaaggtactattacatccacatttatgtggcacccaaattttggaactgtctcgccctcgggtgggacttaaaagaaggtggaggcaaatgtttgaaattttcaagtcaaaattttcgttcgttttcgaatcgcggaatcgtgcgggtttaaaatttaaaagctgaaaagtttctatgatttttaacaaaaaaatcatttgttttttttcattttttagaccctgaaatagtgcatgaaaaggggcgggttagacgacgagggaattccttacaaagggacgcaccccatctaatttttgcaattttcagttccattagagcccaaaatcccccacctaaattgactagtgatagtccaattaaggtactattacatccacatttatgtggcacccaaattttggaactgtctcgccctcgggtgggacttaaaagaaggtggaggcaattgttaaaaattttcaagtcaaaattttcgttcttaaatttaatgcaatagttttctcgctttttttcacggtttttgatcgcgnaatcgtgcgggtttaaaattaaaagccgaaaagtttctatgatttttacaaaaa

SEQ ID NO: 20252 - DNA, 3248 bp, Heterodera glycines
  misc_feature (129)..(129): n is a, c, g, or t
cagatttttatgaaatgaaatatttttttcaaaatgccaaaaaagtgataaaaaataaaataaattatttttaatagggaattttctctttttttaaatttgtgttattaacggaaacaaaatctagtntaatatatatatatttttttccttaagaattcagaattttcaaaagtgatttgattaataagacataaacaattatttaaatattttacagttaaaacttttttagggacaacaaataatttaattttaataaaactttttgggatttttaagtcccacggatagattcttcacatgaacccggttgaaagacatataactggccccggatttttttgaccagaaatttccgaacacaattttatatgtcaggcccactaattacaaaaaatgtattttttagtggaaaaaaaccaaaaaatattattaaattttaaaaaaatgatttttttttactgaattaagtaatttggtgggaaatttaaaaaataatttgagctaattttcagtgatatactctcctcctttttttccaaaaatgatctcataaaaattcttaaaacgtcaaaatgatggcaaaataaatgttactaaaaatattatatgacatatataaaaataaacagaaaaattaagtcgtgcgacgtcgcaacgacaaacgattgtgctcttcataagaaacccatgggggaaagcaaattggcgcggggctttgtccctaaattcgccagattgggaaatggtgccggcgggcatcaaaaaatatatggaaaaaaagctggacgagaacagcggtggattttggtaataaaacagggaattgaaattcttaaacgtcaaatggattaattacaatttttatatgcacaaagctttttggccaaatttggattttttgcactctttttgtcattttaatacagtaaatgcatcttaaataattaaaaaaaaaacaaaattacgaagcaaatgttctgtataattttgagactgcattttgacaatttgtattttttattttactttaaaaaaataaagaaaaattttgtcaagaggtgaaaaagttttcaaaaagcagacgttttccattttttcttccatttagggcatataaaaggcagcaaaaattatttattgcattgcatgcatttacacttaattaaacaaataattttttttttgcataatatttttatggcaatgcactaaaatacggttaaaatagcagggataaaattattttaatttttggccaattgcattgctcacaaaaattaaaattgggattattttgccaggattctgctggacgacttcatccggctgttttccaaaattcacctttgttttttggaaccgcacgcgatttctgaagtgcgtgagatgactgacagggcaattaggaaattatgggacggagtgatgttcgatggtgtgtggcagaggaacgaaacggcatggggaagtccgcagagcgcggcaagtaagtaaaaaagcctcgatgaatgaatgggcatgagcagtagggagctgctggagaccgagatttcccaaggctcgagagcgaggccagaaaaaagtcaagaaattcaagaccgagaaattcacaagcagcgccactaatgaacaggaggggggggggagggaatgaaaaattgaaaaaacccaaaaataaaaagggatgagtgagaaatgccgaaaactgagaccgtaaccccactgtgaaacaaaaaaaaattaactgaaaattccatttattctttgaaagtttctatgagaaatggaacaagtacagagaacatgtaaaaaaataaaaatccgttaaaattcgaaggataattttggaaaatatttaattattaatttatttaacaaatgtttatttatcctggcgcatgcataatttggagttaataactttatttaatatatttttttttacttcagcaaattttacgcgaaacccccagtactttgttcaaattgggtctcagcagccaaaaaaagtgctaatgatcatctcgttgatgcaaaagtacagaagagaggagggcaaaagcctaatgtcaataggctaccatgtttatcgtgtggtaaaatttggttagggcccggatttttagaggcaaaaaaaatatcaaaataatggcctaaataagggcgaaaatatatgggggggggcaatttaatgatttgcattttttttttatcttttattgccatttgattaaaaatttaacaaaagccaaaatatgtgcaaaaataaggggcgaaacgaaaaaaacgcaaaaacagggaagaagccctacagaaaaacaaattaaaaaccaaaaaatctgggcccaataaagtatgaccaaaaataaaataaactgatttttatctcttcaagactggacaaacatttctttatgcaagagatttcccgctgaattattgtgctcgaacttcggttttttcgagagcgagagaggtagttctaatcatgtttagtcaatgattaattgatgaaattcaaaaataaactcaagaaaatccttttttaaggacctaaaccttaaaaaattcaaaatttattttatacatattaataattttaaaacaattaaaattgcatgatttgaggatagatagaaaagataaattaataattattaataattaggatgcttatttttacggacgaagaatgttcaaaatagggcgaaaaaatggcaaaataaatgaaatatgaaaaaaagttatttttttcgagataaataattttggttttcaaaattattgcatttaaattcacttttaaaaaaatttcttgaaatttcaaagaaaattagaagtgtgaattcatttttgttgcgattattaaaaaataaatttcaaaaagctaaattgaggggcaaacgctaaaaattccaaaatagagaagcccatattttaggtgcgaaaccccaaaaataggggggggggtagcggtccaggatgacacgaaaaatgatttttattcccctttttgtggtatgttccgatttccaaaaaaccatgttcggatttctaaattccaaaatttttgaattattgccaattcaaaatcattcatttaatgtgcgggaaaattaatttttgtatattccttttactttattttgactttcatgaaattcaaaagcatcaaatttagtcattttattggacacaaagaaaacaaaaaataggggcggaggtagcggagaagggaaaaa

SEQ ID NO: 20253 - DNA, 1079 bp, Heterodera glycines
ggagtgggactcccattaaactcctgccgccctctagtttttgataggccttcttactcttcgattaaaaccgcactcaccgtcgaaactgttgaccagaaatcttcccaaaatgttggcctgggtggtctgccgccgcctaataaaggagaggtactcaactaacgttggaacttccaaaccgaactttcagggtagttagattacccccttttgtattataaattttttttttttttttgctaaatgaagcttctggccgaaatgaagctttcctttttgaatatgaccacaatgtgaccgtctctggtttagtggtttataccttccaatttttttttcttatgaagtttaattcaccaaccctgcaaaataattgtttttgttttttcctattcaaaatattttttaaacttttaacattaataaatttgatcttaatatttttttatttttttattcaacattaattttgatacatgtgacagttttggtagaaatgagtgaattaaaggaatttgtcacatcatgtaaatctgaattattagagagaattttatgtactaaaaatcctgaaaatatgctaaaaaacaaaaatatgttcgaaaatatattcgaaaataagtgttaaaaattggaaaaatccggtgtctttatgcataaaaatttcagaaaaatctctttctttattatttacgctccataattgcaaaacaaattcatttaagctgttcgaggataaaattgggctttttcagataaaatcattttttaaattaattgaacttcataagaaaaaaagaatggaaggcatagaccactaaaccagagcgtacctggacctttggcagtggacattacgacagtgagtgaattttttactattataaatggctttagtagtaattaaaaaatatatatttgaaatattgaaatatttacgaaatgaattttattatgtctgatcaggcactgaaataggtaatttgattccttctaaaaaaaattataatacaaaagggtgtaatttaactaccctgaaagttcggttcggaagtcccaacgtcacttgggtacct

SEQ ID NO: 20254 - DNA, 1295 bp, Heterodera glycines
ttatgtgattcccacaatttaaatgttatccacaacgaaaggcataactgtggaccaatgccataatgcacttacaattagttatttcccgagaatatgactttaaaatcgaaaatagtcccatgggtgtaaaaatggcgctgatcgctgccgtcggaaaatgttggaatttttgttaaatatagaatttgctccgaaataaccaatcaaattgacctaagttattttttcatatgagaaaggtggtggtctcaccgacgatgctgtgttgccgttgttcaactttgactggagaaaggcggcagcttttttgttagcaatttttcgcttgatttgctgtaattatgatatatattaatttgtttaatttttttctattgtaataaatcatagtgctgatcaagaccgaaagaaatttgagtgtcgtactgacctcgctggaaacgttgtagaatgcctcaatgtgctgaatcactattgggttttcttcatagaattttcgaatgcaattgcctttgggcaatcgaattgcgacgtttccttagacaaaaacacagataaattagacataaattaaaagaaagcaaaacaaaaacttttcagatatttgttttagtactgaaaaaagtggacagaaatttggtgcaaataaataatcaattaaccaaatcattaaattcggtcgttttgatatttattttcgttaaattcagaaagattgctatttttcagaagatgatttcctatggcgacgacgttttttgtgattaactcagttttggaataaaaactaatttttccttaaattttctgccaaaatttcaatttgacccctttttttaacaaattttcaaccctcggacaaacttacgtgcaactttgggcacagttaatccactcttgacttgcattgtcgtgtactgcttcaccacttcacaaacagaaattccctctttgacgtcaattggatttttgccaccggcaaaaaagtcggtaagttttttcatggctttttccaatttcgggattatctccaccagcagtttgaccaaaaagccgagcaaaactttgccgtagtgtacgcatttttgaccaagccatttgccccaacagaaggcctgcgacactttgtctgtcagcgcttcatatgccattatgatgctctgtttcaggtcatcccatcccctgaaaaacaaaggtattttgtaataagtatttaaaaatttggcgggcaaaggaacaagcagaggttgtcaacaaaagaaagtatactataccgtacggcgagactcaat

SEQ ID NO: 20255 - DNA, 2179 bp, Heterodera glycines
  misc_feature (2045)..(2045): n is a, c, g, or t
cttttgtttgtcctcagtgttctattactattgcgggatctgatcaaccaaaatgtctcacatgtttttgtgaatctactgaatttgtgtacttaggtatggaaaaataatcataaaaaatgaataatttttttaacttaatcagcatttgttgtttttatattccttaatttctaatgcattaatttatttgtattgtacttccatttatttaatcaacatcttttttattccttaatttgaaataatgttgtacaaccttttatttaatcaacgtttattgcttatgtatttcttaatttcaaatgctttaattaatttatttgtattgtgcttgcatttatttattcatcatttaacttgaaaatgtaataatttaattatttgattgtccatccatccatccatttacttaacatcatttcaaatcattcattcactgctcttcctcatcaacatctttatgaccatcctcgctaacacatttcgccatgcaattgggaataaattcccgtgtcaattcggccttggccttcaaaattttgttttaaaaacccctttaaaaatacaccttttttttcatgtcggcttccacgtcgcacccaaaagtaacatttaatcctcgaatgtacggcactgggaccgtatgtttgttgcaaacgaaaaggaaaaaattttttattttttaatgtcattaaaaatgcctttttggtagcggggattagcctcaatgtcgctcatgaggctacccgccacgcgctctcccaagagcaggcgtaataccgcgtcaattccagcgcgagaattaaacttgccaacagattcggaacattcggtatcactggccaatacccaacactcttctccgggtgcgcctgacacatacattaattaagcattaataatcagaactacacccccccccccccactaaaaataataccaaacaataggagaatttcagtattttattggttaactctcacatttgttcaatttgagtgaagcatgtaggctagtcagacagctaacccgcaccggagtgtaggctagacaatcagccaacccgcacaccagggatgtgccgagccagacaaaatccgattccgattaaatcgccgattccgattatggccaaaaatccgatacggttttaaaaccgattacgattatggcccaaaatccgattaattgcgattccgattttttttaaataattttttcccaaaaattttattcataatcaaaatcataaattttaagattgtgatgcaaaaataaaagtttgtccacattctgaggcaataaacgttttctcagatctgtcacaatcaacccagcggtggagaaaagccgttcgctttcagtcgatgtagctggggctgagaaatatttttttgatagcttagattcggaaacgaaatgtcttctgcacacagaagcccaacaactgttttgttttgcaaaaacgatcaagcatttggaaggtggatgaccaacgcacctgataggaaaattgcaacttagtaataattcattcatggttcttttctgctttaatgtcccaacaaattttttcttcaaaatttcgacttttggttcgaattcgggtccgggattaaaaataggtgaattggctgccatgttcttaaactgacaccattaacaacccttcaaagactttgacatttttgctaaataacaaaaaacttgattatatcggggagaattaatccggcactgctttgtgagaaaaatttaatttcagtcattatcagggcggccaagtttttattttcaaaataaggacagatgaggctaaaactaagattcggaccccaaaaataagattttttctaaaactgatagtagcgcgaaggaaacgcaataaaaacatgaaaaaacgacttaaaacaaaattttattggcataaaaacgaaggcctgtgaactgaaaattttgtaaatcagcattttgaaaaattttattcaaaatttaaaaattaataatgtttttgcggcgtgctttttccaaaaaacttttgngatttggggggggccgggcgggggcgaaaggcgccccccgggaaaaattttttaaatttttgtatgtggatttggttacaaaaattttgtattaaaaaagacccaaatttttaagattttcaaattattttttt

SEQ ID NO: 20256 - DNA, 2548 bp, Heterodera glycines
aaaagaaaccgcggtcgcgcattcaaattgccgcggccgcgaccgcggatcgcacaaaaaaagaaaccgcggtcgcgcattcaaattgccgcggccgcgaccacggatcgcgcaaaaaaagaaaccgcggtcgcgcattcaaattgccgcggccgcgaccacggatcgcgcaaaaaaagaaaccgcggtcgcgcattcaaattgccgcggccgcgaccgcggatcgcacaaaaaaagaaaccgcggtcgcgcattcaaattgccgcggccgcgaccacggatcgcgcaaaaaaagaaaccgcggtcgcgcattcaaattgccgcggccgcgaccgcggatcgcacaaaaaagaaaccgcggtcgcgcattcaaattgccgcggccgcgaccgcggatcgcacaaaaaaagaaacgcggtcgcgcattcaaattgccgcggccgcgaccgcggatcgcacaaaaaagaaaccgcggtcgcgcattcaaattgccgcggccgcgaccacggatcgcgcaaaaaaagaaaccgcggtcgcgcattcaaattgccgcggccgcgaccgcggatcgcacaaaaaagaaaccgcggtcgcgcattcaaattgccgcggccgcgaccacggatcgcgcaaaaaaagaaaccgcggtcgcgcattcaaattgccgcggccgcgaccgcggatcgcacaaaaaaaaacgccgcggatcgcggtcgcgcttcactcttgttattaacccaattaaatgtattattaattaattcacaaattatttaattaatttaatgttttaataatcatgcataccaattgtcattcattattttaaatagaattttcccatttcgaattattgatgcaaaaacatatttttggactcagatgtttttaagtggaggagaaaaattcaaggaacaaccaaactatagaggtaaataatttttaataagttttctaataaataattttatatttattttttcattcaaataatttttttgtttatttaaaagtttaatttttcttctttaatattaatgttatggccaaaaaatattataaaaaaatgatttaccttttttaaaacgctacaaaatattctttatttctaaaaatagacggaaagaaaaaatatataaattaaaatccaaaaaataaaacaacaacattgttgttgtttttttttaaatttatttttttggttgttctcctaatagcctatttaattaaatctattattaaacaatgcttatgctttagaaaacttcaaatttattctccgtttgtctaattacacattgacacaatacgaaatttcgaatttcttgagggtaattatgaacacaaaatcccaagagaaaccacctgctgaaatctacacatttctccatgatcattttgtctcattggcatcaaaacaacaatcatcatcaacatggatatggaggtgttatggcgttactcaaaaacaattaaaatgggttactcaaaaacccattcaaaataaaaatatttatattaactgatcagaagcaatcaaagttttaatatttgatttcattcgatagtgctaaattttctctattagccttcaaaatttcaaaaaattttgttgactttcaaaaaagttgtggtcagaagaacgcaaaaaacaatgtttttcaaacacattggtcaaaaatttttttgaacttaacaaaaattttttgaaattatttaggctaacagaaaaaattaattaaggcaatcggaagataaaaatcaaaaatttggttgtttcttaacaaaatgatagtcaaatatttttatttggatggtttttgagtaacgcccaatttggaggtttatgagaatgacctattaaatacagacacggacacggtggatatgaattgtcggaacaataaaagccacggcttctctaggccaaaattctcataaattttcttaattattttacagtggaaaaaagcgcgaaataaactgtgcatttgtcaattttggacgagtgttggcaaaacgtttgaaatttgttcatgaaaagtttaacacatttgctgatggtaaagaaaaagaatgtggcggcagagacccgcacacaacaaattattatgattataagcatcatcatgctttcatcagtgataacaatacaccggcggaagggtaattaaaagggacgcgacttttagtgacgaaaaagtgccaaaatagttgactaaaatagtgacgaaaaagtgccaaaaaagtgacaaaatagtgaaaaaagtccgcaatagtgacataatttttagccaaaaattgagcaaaaaataatttttattcactgattgcagttgcaagtgagctacatttcctttataaaattctcttagcaaatattcacattttttaaatcaaaaattttgtcaagaaaaaaaaatttggtggaagaatttttgaaaaaattttccaattcttagtggtgtattttaaaaaattgttttgtcgattcttaggggtgtatttatgtgaaatttttttagatcgattcttaggggtgtatttt

SEQ ID NO: 20257 - DNA, 1401 bp, Heterodera glycines
  misc_feature (1290)..(1290): n is a, c, g, or t
tttggttattttagagcaaagttataagcaaaaatttttattttgatggttttttaaataacgcacataatcatgatttttaaataatgacgtagcaccgaaaaaattagctgggttttagagcatatgcattcattcattcaagcaacaaatttaacgcgaaatttttcaggaagttggtagagccattgtagcagaattaactgattgttcggtggtgttgatgatgaaaaagagaatatatttctcgtgggatatacaaactctacatatatctgctttcctctcctcagcaatcttctataatgatcaaactgaaacagaaaatttaaatggttggacctacaaacaatacttggagattggtcccaatatgtgggtaggccgaagaaacaatgattcagttactttcaaattaaatcagcaacaggttaatttaaaatataattaatgtcataagacataaagtaaatttgaaacgtgaccggaattcgtaagtctaaatttcgcaattagcacttttgggttcaaaatcggtttaaatacatggaaacaaactaaagccattaatcctgcaataagcgatcatttaagcagtttttgaatcaaaaaagctaaattcgaaaaattgggctttcgaattttgtacgaattcgggttcacgagttcagaattgaccgaaatggttgccggatcatgttcagtgatctttaaacccccagggaacataatattagtatcgctgacgcattttctactgacgcattttccactaacgcattttccgggcgccaattgaaaatatgtttttttttacttaagtttccgtgcagtggcatttgccgaacataaactaataattaaaaaatgtcatttaggtgattggtcaaataagcgttcgtgagttgcgcaaaaccgccgccatcaatttgatggtgaaaaagagagtgtatttcccatattttgatggccaaccgtacagtattaatgcttggactgagaatggccaagaaatttttactgaagtagcattgtgggatttttcaaataataaacggtatttggagattgatccagaccaatttggaaatatgaattccaatgattggatttatttctatattgctgggcaacaagtaagtaaattaatcaaaaaacattaattcccaaatttacttttaaacaattaatttgttggttcgcatggcaactattgatagatgctggtaattgtatggtggtttcatatgaacatttgttgtgatagatttgattttgtgatgtctattntggcttattgttgcgataaactattttctaaatttcaccttttttgacaaaaaccgtgaggcatttaaacggcggtaaatattgatacttattagagaccggcgcggcata

SEQ ID NO: 20258 - DNA, 1431 bp, Heterodera glycines
ccagtcccgcagcgggatccgcaaatttgaaatttccggtctctaatacttatcaggagaatggatcatccaaaactgcaaaaattttctgatttaatttcagtgtccctaaaaatgagattgggaattttttcggaattttagacaaaatgcccgattaggttttttttttactgttttaggccctatgcacttgaactcgaaaaatagcataataacagcatctaaaacattttttctcagaccaagagtagtttgggaaaatcaaaaaatattttttaaacccgaagaaaaacttcagtaattaaccaatccaatctacattccacttttttggttcaaaatcaaagaagatggtttaatatacagtacgattaggatggatggattaccatatagtatagagaataccatagttaattatcttttcctttttaagttgtcgaaaatttgatgtaaaattttaagcactgtttggtaaattgaggaaaattcctcttccggattgaatgattgattcattcaccaatttttaacaaactgctgctgtgacgaacattgattcatttgagttcggctgtgataattaaataatgacctcatttgactttttaagttttaattaatttggcattttgttttatttttttgtgtctttcattttattttatgctttttttttactcttcgcccggacttaattttgtgatgcggattgtgtgtggtaatttgattgtgcttttaattgttctgtagtttaaatttatttgtttggtattgctgtggctttaagtaattgaaaaagtctttcttcgacattcttctccatcgccccgttttggaattcggcagagcaaaaaagaccccggcagtaaagggcaatttatttacgacgtggcgctcctgcaaaaaggtgacgatcaacgcggtactattcggggaatttgtagactataagtccgacagcgtctccaaaaagtgaaaagtaactcacaaactgccgaatttgtaaaagcgaaaagtaaatcacgagttggaaggagtgtaaaagtgaaaagcaaatcacattttatggaaaaagtggaaagaattcgacagttatcagctcggtaaagtaaaaccgtctacaaagctgagttttatcaaaacggtaaagtaattccgctgcttggacaaccgacattggcacttcaaattgaatttgggagagaaattgaaaaacggcgaagtaaagccaatgattattgtgagatcgccaaagacaactcgccagaggacagtgaatctcgggtttcagccgttaagtggagacgctgaccaacaaaagggacaacagatagtggaggaacccatgaatttggcagcaaatccgaatgccaacgaaggaaataggcgtaattctgtttcttcagcggcgacatcagtactcga

SEQ ID NO: 20259 - DNA, 1983 bp, Heterodera glycines
aaaaaggatgccgaggctaaaggctagaaagacgcagaagagaaggctaaaaaggatgccgaggctaagcccaagaaagacgcagaagagaaggctaaaacggatgccgaggctaaagccaagaaagacgcagaagagaaggctcagaaggatgccgagactaaagccaagaaagacgcagaagagaaggctaaaaaggatgccgaggctaaagccaagaaagacgcagaagagaaggctaaaaaggatgccgaggctaaagccaagaaagacgcagaagagaaggctaaaaaggatgccgaggctaaaaccaagaaagacgcagaagagaaggctaaaaaggatgccgagtctaaagccaagaaagacgcagaagagaaggctaaaaaggatgccgagactaaagccaagaaagacgcagaagagaaggctcagaaggatgccgagactaacgccaagaaagacgcagaagagaaggctaaaaaggatgccgaggctaaagccaagaaagacgcagaagagaaggctaaaaaggatgccgaggctaaagccaagaaagacgcagaagagaaggctaaaacggatgccgaggctaaagccaagaaagacgcagaagcaaagaaaaaggaggaagaaatgaagaagcaaaaggctaagcccgaagaaaagcctgaggcacctgccgaaggcgtagccgtagtgccggaagcgaagaaggcggaagagacaaaggaaaagctgaaagaggaagagaaaccaattgaagtgccaccatctccagcagaaaagaagagaaaagaggctgaggagaagaaggatgccgaggctaaagccaagaaagacgcagaagagaaggctaaaaaggatgccgaggctaaagccaagaaagacgcagaagagaaggctaaaaaggatgccgaggctaaagccaagaaagacgcagaagagaaggctaaaacggatgccgaggctaaagccaagaaagacgcagaagagaaggctaaaaaggatgccgaggctaaagccaagaaagacgcagaagagaaggctcagaaggatgccgagactaacgccaagaaagacgcagaagagaaggctaaaaaggatgccgaggctaaagccaagaaagacgcagaagagaaggctaaaaaggatgccgaggctaaagccaagaaagacgcagaagagaaggctaaaaaggatgccgaggctaaagccaagaaagacgcagaagagaaggctcagaaggatgccgagactaacgccaagaaagacgcagaagagaaggctaaaaaggatcccgagactaaagaaaagaaaagacgcgagaagaagaaggctaaaaaggatgccgaggctaaagccaagaaagacgcagaagagaaggctaaaaaggatggcgaggctaaagccaagaaagacgcagaagagaaggctcagaaggatgccgaaactaaagccaagaaagacgcagaagagaagaaaaaggaggaagaaatgaagaagcaaaaggctaagcccgaagaaaagcctgaggcacctgccgaaggcgtagccgtagtgccggaagcgaagaaggcggaagagacaaaggaaaagctgaagcaggaagagaaaccagtggaagtgccaccatctccagcagaaaagaagagaaaagaggctgaggagaagaaggctcagaaggatgccgaggctaaagccaagaaagacgcagaagagaaggctaaaaaggatgccgaggctaaagccaagaaagacgcagaagagaaggctaaaaaggatgccgaggctaaagccaagaaagacgcagaagagaaggctaaaaaggatgccgaggctaaagccaagaaagacgcagaagcaaagagtaaggaggacgcagaggagaagcaaaaggctaatgccgaagaaaaggctgaggcagctgccgaaggagcgtgcgaagtgccggccgcaaagaaggcggaagagacagaggaa

SEQ ID NO: 20260 - DNA, 2033 bp, Heterodera glycines
  misc_feature (1973)..(1973): n is a, c, g, or t
aaaaccattttatgctcattttgaagggaaaattctggagaatattgtaaattttatttggtttggccttaaattgtggacttggctaaaaaagaattaaaattattgaaatttttgcccttggaaaaaatttttccctattggtaactttttttgaaactttgcataggccaatattttgaccccctccatcgaatccctgtttattttttcgaagttatgtttttaactcgagatcggctcttctaattttacaagggaaaatcccaaaaaaattttaagttttgcaaagttttggcgttctgattactaaataaataataaacctatttgcacggcgcgccaacgattcgtcaactcgacgattcgtcaacccagccaaaatgtgacgattcgtcaacccagccaaatgtcaacgattcgtcaactcaatgattcgtcaactcgacgattcgtcaacccagccaaaatgtgacgattcgtcaactcagccaaatgtcaacgattcgtcaactcaatgattcgtcaactcgacgattcgtcaacccagccaaaatgtgacgattcgtcaactcagccaaaatgcgacgattcgtcaactcaatgattcgtcaactcgacgattcgtcaacccagccaaaatgtgacgattcgtcaactcaatgattcgtcaactcgacgattcgtcaacccagccaaaatgtgacgattcgtcaactcagccaaatgtcaacgattcgtcaactcaatgattcgtcaactcaatcaatattacttaaaaaatggaacttaaagcaattattgaatatttcatcgaaaaggtcgtgattttatgtgttcttgtttctaaattagcctaaaagaatgctataattgtgctaagcgccattaaaagctcttgaaactgctttttaaaactatttttggctgggttgacgaatcgtcacattttggctgggttgacgaatcgttatattttggctgagttgacgaatcgtcacattttggctgggttgacgaatcgtcacattttggctgagttgacgaatcgtcacattttggctgggttgacgaatcgtcgagttgacgaatcgttggcgcgccattttttctagatatttaggatgatcaaagtcattggcacattgccatttcccaaaaaccacaagaagaggtttatgtgttggcttctccactgaattgttttccaggcgtgcgaccattgattaaaatgaggttggaatgtcattcatttatcaaaattataattgcaatttattcataaaatcgaaaaaatatttcgaattttaaagcatacctttaaagcctgggatctcacctgaaggtaaataaaatatgctaattaatccaaaaaacaatgaatgggtttattttaaacatccttcttttttaatgatttacgagtttattttaatgaataaatactaagtaataaacctcattataacgaatcgcctcattttttaatatgttctcacacaaaataaaaattaatagaatgtacaaattatatttgaacatttttatgctcttgaatttagaatttgtgaataaattaacatgctgcttaaattttacacgttcgattattaatttgtaaattatgctttggtatttattgagcattatccagcttaatcatcgacggaaaaggcaatttattcattctttggacttttttgacattaattcttgatgaataattttaacaaaattttataagaaatatttttgattatcaaacaaattgtaaccgatttagaaaataaaaaagtggttttaaaaaattgacaaatacaatcatttgatacatgatttttaattctttttgaacacaaactccgggtttttagacttgtttgcatatatttaattttattgacttaaaattttcagaaaatcccaaaaaattattttgtttttttcgtgagaaaatttaaaaaatgccttanagaaactttttaagcttgacaaaaaaatccattttttcggctaacatatgaagatttatc

SEQ ID NO: 20261 - DNA, 2225 bp, Heterodera glycines
ttttgtcgtccatttttggcattttaatcacttcactgaacaccaaagtgccgccaaaaacgagcgaagcgccgacccaatgggtaaaagagaaggggttttgaaaccaaaagatggaaatgagaagggagaggaatttgcgaagagtgaccactgaaaaagggacgaatagaacaaaatgaaaaacggacaaagaaaaacagacaaatgaccaacccaaagtgacggaaagagagtcaattgtggcattgagacgatagacgaacataatgcaaagccatctgaagaaattccaatgaaaacccagcagggaaagtgtgcaaaaattactgcaaaacacagctggccaaaagacggagccaaagtgccgaaattgggagggaaaagccgaggaaaagggcggagggagcggaggaaaagcgacggacactgcggagaatgtcgccgcccatcagagcgaagaaaggcaaagagacggcgtgctgaaattgaacagttcgctgatcaaaacgaaagcatggcacaaaaaaaccaatttgacttcgttaattggcacctcattttgtttggcattttcttcgccgccgcccccccccctccacaatgccgtcttattcctcttctcgagtatgggcatattatcattcctccttctccctttctcgagtcttgggtcaaatcatagtgtcgaaaattcagttccgatcatccattaccccccccccccctctcccatcctccctttttttgtctcaccgtgtaaaacatcgcttcccgcggatgcctcccatatttactaaaataaaaaacaattaaaatattaattgctgcaattaattattattgaactgttttggtttgcctctttctcccattttacctgtacattctttcctgacaaattgccaaataagaagagatcaaaagggctgccgaaagcatcagcacaccgacggcccattctctgtaatgcttttccgcttcttcaagtgaaaggacagactcaattttctgaaattcaataattatttttatttaaattttcattttatttttcccactttttccaaattcgaagtggccaatgtgcagagaataatgcccaaagtgatggccaaaacggacaaatatttctttaacggatattctcggcccaacaaaagtcgattcattagcagagaagtgagcagagagcccttttcagggatcagattaatgaattgaattggataattcaaagccattttgggattgtaccgaacggaaaataatgtgaagcggcacggggacatggaagttcaatgcttggttgttgatcacattgacaatgaaaaaagtgacaaccaccggaagataacccctgggaaatcgaatcaaaaaacaaaaaaagagagagacaaaacgccaccgaatgggaattttgtttttcactgagaagcattgggtggtgaagagcagtccctcgacactaatgaacagaaaagtggcaaaagtcattaaattcatcgcggaagggtcttctctgaaggaaaattaattggaaatggcgaatcatttgtccgatcactttgccaacgattccacacagatcatacaaccaatgcaaccgccaagggcaccgaacacagaaaaggcggcatcggacatcgctttccaaataattagttaacaattatcaggctaattagtcttaattaaatgtcaattaagcaattatacggttaataatctagccaattagccgttaattatttattaaattaaatgcaattattttagcagttaagatttaacacaaatatattttaaatgtaattattagaattattttgaggaatatttatgtataatatattcatggcttcttttatgattttgtgagtgatttaattttccgctttttatcaaattgtcgtcaaatcactcaaattatttgaacacaaaaagtaacaaactacaaacaaaacattaaaataaactcaaaacagagacaaaaaaataaataaataaaataggggaaaattgtaaaattaaaaaagaaaagggacaaaaaatggcaaatggagagaaattctagaaaaaatgaatattaattaaaatggcattttaggcgatgttcgaaataccaaattcgaatggaatgccgtcgagaaggaatcgaatggtgcctttgtattgggagaagagcaccgaacacaaacacagcccaactcaatccaaaaact

SEQ ID NO: 20262 - DNA, 2038 bp, Heterodera glycines
  misc_feature (69)..(69): n is a, c, g, or t
  misc_feature (2025)..(2025): n is a, c, g, or t
ttcaggggggggggaattttccgtgtgaatttccagtggaaaattcatcttccatcccggtcaactttnggggaaaaacaggaacgtggaattccctgttttcggtcaagttggaaaaaacctgataaaaagcttgggaacatggaatttttccgtttccggaaatctcttttttcccaataataaaacaaacatttttctaaaattattttaaacaaaatgacaaacaaaaatttttttacatcaatgacaaccggtgcagcaggaaccgaataagtggtagtctttgtggtggtcgttgagctcaacggcggttcagttggagaaataatgtcggacacagtcggcacaaattccatatgtttgaccattttggccggtggtggaagaatgtcaaaagtgttcgaagttgcctataaagatcattttctttcattgttgaaaaaaattttttgattttgtcaacttggtgtcacccattccgtatctacaagaaaatttttgaaatttttttcttgaaaaatttccaggtttgaaaaaaaaattttttttttagtttaccatggcttgtcgctgttgtcgtggcggacagtttggcaattgtcgtcgtaccatcacaggtggttgtccaccagcaacggctgctacatgctgctggtggggcggcccagatgcgtgaacgtagaaccgtttcggaccggcaacaagcggtgctattgttgttgttgccgggtcagcgacgcctccgccgccaccgccctcggcatcggaggagggcatcaacgacgaagacgacttgtgcacaacaattgtacgaggcgttgtcatgttcaactgatgttgctggtgctggtggtgggggtggtgcagtgatgagacaggcgatgatgaagcagtagcaacagtagcgtccgtcgtaccaccaacaacattcccggtcgatgcaatgctaaaaaaaaagaaagaatatgtgtaataagtttggtttagtgacacgattttgggtctcgtttaatgtgttcagtccgagtaaagcataaacaacagtttaataaattatagtaattaattttaatattgagttatttttgctatctaacaataaatcaaaatccaaaatgggaatattttggtgaaaaaagatgaaaattatatatttttcatgccaaatttattatttttcaaatgattactcatttctgttcatgtgctgctgaactatccgaagctgctgttgtggttgttgttgcacaacaattgatgacggacgggggcatgaggaggcggcgccggcggacggtttgatgcgcaacggtcgagcagccaacagcaccggtgatgaaccagcagaagctgaagcagtactcaaatggaactgctgttgatgatgtggctgttggtagtagcgacggtgatgaaacggtgaggatgagctggtgacggtgttggacattgttgttggacgaaatgcgcgaactggagaggaagaagcgctgttgctgccgctgccaccaccaccaccaccggtgagtactgctcgctgttgttgattgtgggacgacgatgacaacggtgtgccgccgccaccaccaccaccaccaccagcgccaacattcgtaaaatgttgttgccgttgcgcaacacgtccaccgcctacagaccgtcttccaacctcttaaagggtgggggttgggatacaaggacaatttgagtaatatgatactaccgatgttgcctcccttttcgtaagaaaaaaaaattaccaaatttaatgtcatagaaaaggttctaggagattttcggggcgcccctgaccacgaatctgacaccaattatggccaattccgggtccttggttggaactcaaacaattgttcaaattgcaaatttatgttctaatcttccatgttttaatctatatcatatctattttaagaagcgtgaaaaactcgaaattttaatttttgtacaacaaatccgggtttggaatttttaatgtaaaataaatttattttatacgaaganttatatgatttgg

SEQ ID NO: 20263 - DNA, 2203 bp, Heterodera glycines
cgcatctgtgggtcattgcaatacgcaccaattgagacttttgcgggtgttggatttgtctgcactgatgttgaggcatctctggaggcgcgtctttcatctgccaaggacaatctgatcagatttggcgacgaaatctacataaagctgagcggcgaccatggccagagttgtacgaagattaccgtctcattcagccaggctgctcggtcaaattctccatcaaacaatttcgtctgtgccgttttcccaaccaaggatagccgcgaaaacttggagcgctatggaagcacactttgggaacaaattgacggaataggcacattggcgggcaaacgagtcaagtggtaaattttaaaatttgtttttttccatttttctgaattcaaaaggtttatgggcggagacgtcagttttatttggtcaatgatcgggcattgtggttctgcagtgacaacatttccgtctccaatttgcagttgcagaagtgatcatttggtgcaggagggcgaaatttgtgaactccggacaattgatcaaactgtgcagttcgcggagcagttcaccagagccatggtgaatggcgaaaaggcaaacgcagcggtcagatcggcgatgatgggcatcacgaaaccaccgcttctcctgtccattggatttgaccggatcatccccgcgccatttcacgttttccaggggcttggaaatgccctaattcgggaactcgaacagcaggacggatgtgccacaattgctcaaaacttttttcggagattcggcgcgcggagggagcaatttcgtaaacgagacatgaccgggaattcaattagaaaaattcttgtccatgcttctgaaatggaacatctcttttcgacggattggccaattacaatttgcagaacccttgtgcacctcgggaaaattcaaaaattttcaaaagtcattttttcttttttctcaaacttaaattcgaaatttaggcagaaccactgtcaccgaatgacatagatgagttggagaggcgcgtcgacgaatttaaatcttttttgtctgcccaggagcggatgcgcgggtttctctcaaagaagcccaaagcacatcttttgttgagccattttgttcccttcgctcgcgagcacaaatttcttggccttttagatgaacagggttgtggtgaaaaatgttttctatcccattaatctgaattttaaggtgatgaggcgctccattccgtttggcgccgacttgagcaactgtggaagtgtatgccggacgcagaccaaattttgcagcaactggagcaccattttgtcaacaattggctcctcgactctggcaaaattgatgaactgaagaggtatgtatgtttggagggggtaattgcgttaaacttgttttatttaaaaatttatatataataattcagagaaaaagtgatcagagggaagagtatgatgagttcgatcaaacggaagaagaaactgacgaaatttcgcttatcaatgtcattgattgatggtgatttagcaagaagaaattggtggacgacgggagacggacgaagaaagcgatgcagaagaagaacgattcgattttgaatagacactgttcgataaaagtttttcttcgtttttacaggaaataaattttttatttaatttttgagcttcattaaaaactgtgttatcatttcacttatatttatttgctttaaaaacctcaaaatacagttacagcatggatgggactcgaacctgagacccccccttttggtgactaactcacagaccactaagacgaaaaatccagcataattgtacttgcagcccaaaattgggccgctgtgtaaatagcatcatttacagtgtgacaaatactgcgccacctttaaatttataatatctctctcaaaccagaaaaccgatttcaaaatggcttttaaccccatttgccaatcccatcaataattcacagcaacagtataacaatgcccacagcaaaacatgtgtgcttattgaacaaacatttggaagatggaaacgaagatttttttcgctacaaacccaataagaattaaattgtaaaacatttggcacgttcataattgccacggccattttatataatattaccctcatgaaagggattcccgaatttgatcaggaagaatttgttgatgatcagccagaaaatgatgatcgtg

SEQ ID NO: 20264 - DNA, 2399 bp, Heterodera glycines
attttttgcctttcccccacaaaaatgccattcttggggggtgtatatttaaccccgaccccgagtcggggttaagggtcggggtcggggtttgtctgggttgaaagcgtcggggtcggggttaaccccgaaaaatggtcaaaaatgtcggggttcggggtcggggcggggtcggggttgcaaccctagttaaaagaaatcataaattaaaaaatttaatccaaaattttttaaatttattaaataaaatttacttaagatttaatataaattcaaataaatgccttaaaccgctttattctatagactaattttaaggttaaacttatcttaataaacttccagtatttttttcataattttatttttaagttttgttatggactcaagtatttactaattaataaaattggttattttttgttttctcgttcatttattagtaaaaaagaagggcatgcatttttttattttaaatcaattttaaattatttcttttagtttttactaatataattataaaatatttatgctggctttgatctatgtaatttttagtgttacaaatttaaatttcgcatgccgaagatcctttttatggcttcttagtaatttttggtaaatctgttgaaaaatggcaaattttcccattttttgatcaattggttcggcgtctatcaattcatgcaaagtatctttcccagaatttacaattttattttcgaaatcttttgaatcatctgatatcagtaaaaattttaaaaaataaaaataaaataattttaattctttattgcattttttcatatttaatcatttaaaaaattttaattagttaagattcactcgttttctattttaaagctgttatttattttgatgttttaataaactttttaaacttttatatcaaaagatttttgacttttgttttaaatatttgtcacacacatttattctttggcattaaaactatcattttttgttatttatacaaaatttaaattgtttgctttatcgttaattttaatttttttcacaccttggtaagatatggctaacggtttgcccaactggttttaattgctttttaattatactaatatgttatacagtctatggtataagggttagcccatgctgagagatgtaatcgccttttagaattttgttctggtatttattttcatattgtttattgtatttaatatcgttatttattaaggttttcaattttattttaaagttttgcattaaaatgattgaagtatgaattgaaattaattaatgattgatcaattaattttctatttattattaagctttttcggtgaattaaattttattcttaaataaatattaattcaattttgaaatgtaaatttagtttattttggtattttttattgaatttctttgcaaatgcataaattaaaaatttttcctaaaaggacaatttttattgaaaaactttcacaaatttgaattaaagtaacctcaattataacatcaacccagattaaaaatatagatcatttaattctaaatttattactgggggataatttttcaaaatttaaggactcattcatgcgcatcaaagcaaatggcaaagcgggttgctcgtggaccgtaaaattaatcgtcaatggctaaattgctacattttatggtagccaagaatatctgaaaagaataacaaaaatatagtaacacacatgccagtggaacgtgctgaattaggccttgggactcccaacccttagaaatccaatcatttttatgagggggttctggggtgatcaatcccacttccctccccaactcattccaattccaattccattctggaatggctttgtttcaggaaaagcatggaaaacaaatacaaataaaaataaaacaattaaatacaaaatggaattaaatatttaaataatattacaaatcaaatacaattaaataaaagcattaaattacataaaatacaaaatccggattaagtgatgagcagtgggaaaatcgcatattaaatatacataaatggaaggggaggagtcagatcgatcgctcattggttaacggagaagcaattaaatgaaaatgaaaaggcattaaaatgaatgtgaaaataaaatgagaaaatgcttcggcaatttaatgttaatttatttatctcttacacctcataccctgttttagaccgtccctggtctcagatttttgaaaccagataaaacaaaaagttttatacaattattattatttttttaaaaaatttatttcaaaaattttcttagatttttgcataaaaatatttcaaaatgcaaaaccaataaaaataaattatgaacttttggcctatcactcccttccctaaaaggatcgtccctgatcca

SEQ ID NO: 20265 - DNA, 1348 bp, Heterodera glycines
tgccatacgcgccataaaacgaaggcacaaggccaaatcgggatggaggggtccgtaaatgctattcatcatgctgtgggcctgggaacagaggtaaatcattgaatcataaagacaaaagcgacacctgctgcatcaaatcgtagccagtacggatgaacccttgctgcattttgatgagagcactcagataaaggttgtaggcactttgggaacgcggattaagacgttttattacggggaacacattgaaaatgtcgtcctcagaaaaaggcgcttgtgacttggactttaatgggttgagctgataattctaaaagcgaagacaaacaatgccgacaataaatgaagcaaaaaggcgaccttgagcattatttggacaccgttcattaaacaaaaacgacgaatgatcgccgagcgttgggcaccgccactccattcgacgaaactgtcacaactgaacggggaaagaaaatgccaatggcaacggacagattaagcgattcaaaacggaaataccaatcggaaggaatgcaaaggccgaagtgcgcgtacgaatcgtcgccgatgcttttccataggctctcttggctcagcttagcccatgccatcgttttcggtgtcgggcccgagccggcgccaatgacagttcctttatcgaaatagccgtatctccgcttttttctagctccagttgacttcttcagggccacaccatttgtttggtcgttgtcaaattgcgaaatctgactgacgtttttgccggagccaatcaaacaattgaggaaatgggcaattgccgtgcccataaaatgcacttccactccctggacgaagtcgcggaaaatgtgacgcaaacaccgacaaagaagctccattttagcgatagtctaacaaaaaacaaagattgcaatccgaaaatcgtttttttacgaacagcgaacgaaccgtgaggtaatcgagtcgagaattgtgctgtgtagcttcaattaacttgcccaaatagcgaatgttaatgccacgggcgtgcattgcttctaccagggcaactccatcgatgggtgaaactgccaattggacggagtcgcgcacaaattgagggatttggtgagtcaatagaaattcagccgcctcagcgatcaactttcgctgggcctgtttttaaaatgcttgaatcaatcggaacaaatgaatattttacaaaaaaagaaggtaaagagtcgcccttcaccagccaaaaaacaatcgtccctttgttttcacctgaacgtcctcctgtggcgcgtgtctcaccgccgtgctccacgcgtccgggttcagtcggatgtccgtctccgactcttcctct

SEQ ID NO: 20266 - DNA, 1783 bp, Heterodera glycines
  misc_feature (1717)..(1717): n is a, c, g, or t
tcaattttcaacagtttggccgagttttcaacaattcttcgtatagttcgttggttgtcactgtttttcccgagtcataagacccataaacaatcgaatcctgctgttcccgttccaaaatgccgggaatgatcgactgggccataacacgtaaacctttgaagtcgatgatggccatgccagaagtgtgaagcctgcaaagtttggactcggccattttccaggcgatttttaattgactcactttggatcgtcaatttgggcatatgcctgaaccgcggccaagtcagctgaatacgatgcgtgcgcagccgcgtccccgccgagttcctgcaattggacaaaggcattggttttctcgcgccccacccgaacgcattgtcaaccttataatggtccttaacatcaaagcccagtgagaagaagatgttgttccaaatgaacatgtgcatgcgcggctcgtccattgggttgatggtgtgcaccgacccatcaataacctaatcaaattcggtaattaaaaacaataaacgactaattaaatttgacattaccgctgaagcgccccgagtgcaagcggaaaggaagtcggcatggactttgaacctggccctatcccgacagagtttctctgcaaaactgctctgcggcatgtcgtgcgtcgtttgcagctcctcgttccagtctcggatttgtccaggcatatggtcttccaagccgagtctgtgcggctgaacttgctcatcggctcgcaactggtcctgggtattttccacagaggggacaatctgaaagcgaattttctgcttcggttgacattggcaaaaccaacccattgataaagctgaaaaggcgtgggcaatcgctcgaaaatgtgtttctcattgcgcagcttcaacaattggacgagtgtctttttaaagtgagcgctaatgtcggaaagcaaatcgaagagactgtggaacacgcgaccgccgtaagtggacgacctttcgggcttgaacttttcgccaatagtcgagttgacgaagaatccacgggtgcagcaagtgacgtgaaaacgacgatcttcgaccgtgtccacaaccaaatagagaatgtcccccttaagacggaaaaagcaatgaaagagagaaagaagggagtgccttcattttccttggtccgggcgggggattgaaagcagagaatgagatctgtttgagagcgataagctgagtgggctgcagagtgccgttgctgtgctcggccattggaatcagcggcttcaaaatgatgtcggaagagttgggcaaaagccattcgggaggaagacagtccgactcggcacggagcaattcaattgtgggagagcctttcgactttttgcccaattcgtcagaggtcgattgagtaatggtcgacagacacgaaagtgaggcaaagtcgacgccgctgaccgcatcagaaatgtccaccgaacgaattatttcgcgcaaatggcgcacatgcactcgagcctcccgcaaattatacggttctgaatgacggacaaccgaatgaggagcgaatgggccggcattggtcagcaccaaccctcgaccactctcatgacggcgttgtctttgatgtccggcacattgcgaagctccgtgtaattgtctagtgctgttccctcgtagtacaacttgaaacaggtgcggtgacaactggaatccctttcgagcaacatgtgatnaagctcttgaatgatgtcggactcgccaatctgaaggcaggcgaaagtgagcaaaacattgtgtcc

SEQ ID NO: 20267 - DNA, 3236 bp, Heterodera glycines
  misc_feature (8)..(8): n is a, c, g, or t
aggtcatntatgcatcggatgcaaagtaaaaatggggatttaacaaaaagatggctgtcttaattttgcaatagttaattaattgttgtgtcctctcaattagttaattagtgcccattttatgtcgccccaattaattaattacccattaattcattaccacgtgccaccccccccccccctcccatcaattagtgtcctaattcagtgtttctttgtgcggtgtctgcgcgacaaaaacttcgtcgccgggggcgccccgtgcacttgcagcggacgccgcgccgacgaaacggggccaaaaatgtgcaagtcgtgccgactgaacaaatgcgaacagattgggctgtccaaggcaatggcactatgtggtaacagcggaagcaatgggaacagaaaaagacggacagcggagcaaacggcataaaacggacaaacagagagagaaacagagagagagagaggcagacagagagagacagtaaggaacactaccgtaatgatgtgttgggcattaaacagagtcaaacttatgccggatttgcttttttgtttgaattttctcccaattttgtattttaaaaaattttatattttttattgatcaattacggataaatcaataattaaggaaaagaaaatgaacataaatgtgagtgattcatcgagatcatccgaatttcctaataaaattctaatggaaaatggcaaaatgattggggcattatggggcgattttacggctgtttttcatgacaaaaactaaacaaaaaaaggaccacaaaattggataaatatcaatgggaaagggcaaaaagtacagagagatggttcaccgattttgaccgtttctggccaacccaagccgagtgatcagaacgtggccaaggatttgccgctctcttttggccactaatttggcttctccgtcgtcggcactttctgtctctcgcaattcgacggtgcaaacgatttcattcttaaggcaaaatcggacaaatggaaattcgttttcagactttttgttttaaaaaacaaagcaaataaatacactgtaccgtggccctctgaagatgggaaaggagcacacagagagaaacgccttcgacttcgtcctcacaaagtttgggcctcgatgattcaaattccttaaaaagacataaaacaaaaaaatttcgatggattcggacattattggataaaaatgcaaaacaaatgattaattagcgaatttccgaaaaaacattttcgagaagggcagaaaagtgccaacccaagacgacagatacaaaaatgttgcaattgttgtgcgaaagtaatcacctcggggaacttcaaatgtgccagcgcccattgcgagtgcgttttggcaccgtcacttgacaatcgtcgcgcaattgtgccattccctcgctgctggtcacaaccgatttcttcactttgtgttgacatgtcgtccacactgctgaacacgtacacctgccaacagaaaggcatctcaagtggcaaatgaattggctaaagttggcaaaccaacgaaaactccaaggctatcggcacaaaatttgggatacaattaaatcaaactctctccaaaaagatccaattaaccccgtcaatccgtttggagtaaatacggaagaaattgtccaaaaacgtgccttgttggtgaaatggccacagaagtcgaaccaaattgtcacttggagtccgagttcagcgaagtcgacggtgaccggcatcggaagttctgcaaatttaggacactaattacagggccaaaagggcaaattggacacagaagaaatattatttgtacatatattagtaataaatgcttcaattccgcttgccgtgcattgtccgccagtgataagtgtggtggtcgtacgacgtcgtgtgcccatcgtacaccaacgggtcgtgcagcgagcgcgactttgtcaaattggagcgcaattcgggaatttggacgtcgcggacctttgggtcacgttcaacatcggaaatggatcagaaaaatatttttctctgttcaaaaatggtcattagagtgcaccaacaatggctttttctgcttctaacttaaaaaatgggattttttttgccatttttgacaaatcgcatcaattaaaaaagtctcctgaaaatgcttattgttaatccggatttgtcataataatccccaacctccgctcaccccggaacactttgttgagcatgtccagcaatggaatgggctgctgaatgcgtcgcttcaaatacttcatgaacacgccgttctgctcgcccttcacctcatacgcgccgacaccgccgctggtcgcgtagcctaagggaattcgaaaaagcgatttgaacgacggaaaaacgaattaagggaaccgaaaaaataaaatggggaaatatttgtcacttttaacggattttcaatgcctttcttgccgccaatttcccaccataaacggtgttccgattgacgcgcacttcgccgcgtcgtaattcctccgcgtaagcggtaaaagcgaccaaattggagggcaaaaatttgcggcagatgtccaacagaatgaggttgagcgcgggttggaagtcgcggaattggcccatcacctgagggggaattgcagcactttggccaaatgcaatggaatgcacagcaaacgaaagaccaaccaacccaatccatgctgaggcaatgctcgggcccatagtcttcgccgggcgctccgattggcagcaaatagcactgaccattcgcctcaaagccgtggccgacaaagtaaaacacggcttaactgatttgatatagcaagaaatgattgtttgcgtggtacgaccagggacggttccaggatttctgcctaaattagagggggttccgcctcaaggacgacgactttttaattttgatttttgaaaaaatttagcgaatttttttttgaaagtttgggtgagggagtcttggagggggtacaaataaggaaaaccgaaaaatttcaacacaacatactatttttgccttaaaaatttggatggatcattgggacccccccccccccaggggtccgtcccttggataccatatacataccgtaaacgccttcgcccaacagcttgcggtattcgcaaaccatggcacgcatttcctccaagtttaggtcgccaagtgtgaccgttttgaagccgagctgctggaaacctctgcctgtaaatgagtttgttttcactggttt

SEQ ID NO: 20268 - DNA, 2186 bp, Heterodera glycines
gaattttggagggggcggggaaaagaaattagtaatataataataaaattattcgctgtcatttttgttgtttactgatgctaataaataaacgataaaaaaacttaaaaagcacacaaaaatgacaatggaatgggctgggcgaggaacgacaacgaaaataaataacaaaaattataaaaaaatggaattaatttttattattttcattcgaaaaagactaataaaatggacaaaaatatatatttatgtattaataatgcacaccaaaacaatcagagagcaaaaggaccctaaaatatgcaaatatgcaccaaataatagcagaaaagagaaaggaaaaggaaaatgagtgaaaaattaaaatggaaaagaaaagagtttttgaacaattttgtattatgtaattaataaaattctcggacaaaataggtaaaaaaaattgcgaagtatagcaaaatgaatggcacggcacacacagacacttaccttaattgaagtgcccaactccacgtagcagaaggcaccgaccaccgaaattagtccggaaagcagccaaacgaccagcgaagcgcccaccgcttggacattgttcagaatgccggtgggagtgatgaaaattccggagccgatgatggcatttgtcacaaaagccgtggcactccaacggcccattttgttcacttcgcgcgacatttcccgacaaatttagagcaattaacaaataacaagcttattgattttctaacacagcaaaaaaggcataaaataaaaagttataataaatatttttctccatttgttttctatattaattaactaattaattaggacatataaacttgtttaattacgtaattactcataaagtgaattgcattccgtgatcagcataccaatttgcgggttacttgagcctgggacatgtgaaaacgttgcaaaacatgatatcgatttccgttttctccaaaaaaagaatgtgagaaaatgaatggttaaagaataaaaaaatatttattaattaaaattctaataaaattattttaattgtgaaaaattttcattttaacaatttttatcattttgttttcaaattcactttttaaaaacacttttaaattctttgattgccatggaaacgaaaataaaaaccaaatttttacttttgcccagggtaaaacaacaaaatcatttaaaaatattttatcaaattgtttgctattaataaatgcttcgaatatttttccgcattatttttgccacgttaattttcgcgaaaattcgtgccgaatgggaaattcccgacgaattgcgcccaccccaatttcttacagtaattaaaaatggcttccaatcggcggtttatttcacggagaatggccaaaactctgtcgatgaagcgacaacaaatcagcaatggcttttccaaaggcttttggaatttgcagatgaaaacaaaatgccaacaatggcaaaaagaaaaggaggcgcaaatttggaaggaaatggcatttaccgagagcatacagtctcgagcaattggcatacgctaattgacaaaatcaacggaaaaagcggcgacgttttggatggatgcgaaggcattagcgaattaattattcacatttaaatttaatcattattagggatcggatttaattgctttaaatcgcaaaacaggtacttaaaaaaagtaccaaaaaagttcaaaataagcgcttttttaatttttttgcatttttcatgagaaaaaatagagtaaaaagtaaaaatccgattcataatgattagaattttaaatatattttaagacattaatacttttacatttaataaatattttttagttcttttacaatcatccgaaagaattgagtttgaaattggggtaggaaatgtgacgatcggatgcatcaacaaaaatttcgatttatcaatttctccattaaatgtttatttctgcaaaaatggcacagaatgccaacgatcaaagtgaaaattaaattaacaatttaattaatgaaatgatatttaaatttcaggaaaaaattgacaaattgcgcaattattgtgcaaccagcagaaggaaattggacgaattatgaccagcagcaggagaaaaggcattttgaattttttggaatatcaccaaccgaaaataatgaaatttaaatttaatttttgca

SEQ ID NO: 20269 - DNA, 2342 bp, Heterodera glycines
  misc_feature (36)..(36): n is a, c, g, or t
  misc_feature (49)..(49): n is a, c, g, or t
  misc_feature (51)..(51): n is a, c, g, or t
ccaattagcattaccacgaaaacattaactagtaanttaataatccttnantgtcaattaagcattaattaaactagacaatgaacgaattgactatttcaaattgtgtggcatactagcaaatacagtattcgccttacttggcatacagtacatccgtcgcagtgcctcgatgtcgctgtccgacaacttttcacgttgtcccattttgctgtcattatgttccgggtcgaatttggcatggattgtcttcacaccccacgttttggcacccatgtgggcatcgtagtgcatcacgctaccgtaatcgtacttcacaccgtagctaaaatttaaaattacaaaattcaatgaataacaattcaatcagagagcactaattactaatttcctggatccaggtacaggctcaggcaatttttcagcaacctggatgtttcctgggcttatcacaattctcattaatcggaaatgatttatacaatcaagtgtctaccataattaattagatgtatgaaatttattggtaaaaataaaataaaaataaaattagagattttaccttgaatattttgtctgatcagatattgcaaaaacatcatattgttgcggattaatattgtccttatttattgtaatatatttgtcacggtctaaagcggggaaataattaattaaaaataatttttatatatcattaatttattttagtaaattttttaattggcccacccgctcggctctgttcatggccaagcccaagcgagtgcagtgtttcatgcataattatcccaatttggctgggacatcgaaagctcaacattatgcgattgaatggcttaaccatgccaatttcgctgaagccacaactaaaaaattgcaaaaatttattttaaatttaatttttttttgttgatttttttcatttaattctgacaaaaaagatatcaatttaatttttaagtttttagttaaaataaaggtgccgggtcgttactcaaaaacaacaccataaaatggaaaatctttaacaaacaatcaaaattttcataattttgccaagaacaaaatttttagttcttgataatattcgctagcccaaaatgttctctattagccttcaaaatttcaacaatttttgttacattcaaaaaagttatggccagaggaactcaaaaaaaccgagtttttaagcacatttttggtcataaatttttgaaaacttaaacaaaattttttcaaatttttataggctaatagagaacatttagaacatttagtgcaaagcaaggactaaaaatttgtaaaatgaatcataataattatttaatgaactataatgggaaaaccacccaaatttcatcatactcgattatagaataccaaaattataaactattcttactgctaccgtattgcatccaatttaaaatacaatacagtacccgttgccctatttttctgtgtatttcacttacgctcccaaacttgtctccttcagataatgaagatgtgttgtgtgggtgggttttgctgcatattctttgaatttaatgcacgaattgctttgaatttgtttcaacgcgaagcgcacttgctttctttcatcgttacctaatttaaaacaaaattttgaataatttttatctaaatttataaaaaggatatcaaaaaatttttttgaattttaattgccttcattaaaatttccaaaaaaatttttccggcactgccagacggcacctcaggacctttattccccctttcactaaattttttaaaaattttactcaaaaatgccaaaaaatactcatctttttggcgaaaacggcaactaacaaattcctgtttgttttttttgctctccggtgctgaaatttctaaaaataacactggtaaaaaattttttgaaattttttgcccaaatagcataaaggtcttcgggttagaacccaatttaaagctgctgaaaatgttttaatatataaatgatatcgttttttaacaaaatatcagggaattcaaattgaaaaaagctaaacaaacaagcgaataaaataaaataaaatataaataattttaattattttttttaaaataatttttacgcaatgctttgtccaagaaaaaggcaattggcttgtcatatggccatttttcgatgggtataagttcaaagaacagtgcgttgcccgcccgttttgcccgtaggtgcggtgccaaagcggcaacagctgaagcggtcccctcaatttcggcatccggcaaaattgaatgggtcgcattgtaagtggctaatgatggcgaattggagcccaactgtgaaaaaacaattaaataat

SEQ ID NO: 20270 - DNA, 2886 bp, Heterodera glycines
  misc_feature (1356)..(1356): n is a, c, g, or t
gggggggggggggggggggggggggggggggggggggggagggagggggagggttttttttttttttttttttttttttttttttctctcccccccccccccccccccccccccccccgcgcgggggggtggttttttttttttttttttttttttttttttccccacccataggggggggggggggggggagggggggggggaaaaaaaaaaaaaaaaaaaaaaaaaaaaaggggggggggtgtttataaaaaaaaaaaccccccccccccattaaccccctaaattttttacacggctaaaaagttattcaaatcaaaaaaaattttttggacgcaaaaagaattttttagcttcttttttccaatagggtatgagcaaagaaaatatgtaaatccatgcaacgcacaactctcgcgattgttaatccatcaaaaagcgtatgagcaaagaaaatatgtaaatccatacaacgcacaactctcgcgattgttaatccatcaaaaagaagaacgaatttaatccaaatatctatcaattttaaatggtgcagaactaaaaataatcaagaagatattcaaatatttcaagaacaatacaattttagtatatttgaaaataacttaaatttcgagttagaaataattccccagggtttgatcggatttgaaaaacctaaaagtggtttataaagtttttgaagctctatcgactcaataataaaaatttcgaaaatttttaaaaattttcgagttttccttaaaaccctttaggattttcggagacccctttggtcgaaaaaccaggctaaaaaaatgtttttcgggggtaatttaggtacctgattatgtttctgacctttatttttcatttgggaagcttttaaactgttttttcaaaaaattcgaaaaatctcaatttttggtccctgaaaatttgggcaaatgtttaaaaaaccgtaacataggtttgacaaggtcatttcttgcatttaaatattcaaaaaatgtagaaaaatacagagatttttatgcacattatttgatgtttttatcttaaacaagaaaacaaatattcaaaactttctgaaaatttttcgatttttcagaaaaaaaatcagaaatcctttcagaataggaatacatttgaggtgatcaatattttattggtgagattcctttccaaaaatttttttttgatttttaggcctcgaaaagaggacaaatctttggagaaaatgagaacaaagttggaatcctgaaacagatggtgaaaataaaacagttttccgaaaattcatacatattttccaaatatttatttttctcacattctcattaaaaacatttaaacatntatttcgaattattgttattttcttttttcaataaacttttattaattcaatttattttttcgttacttttggttttgtacttatgtaaatttcagtttattttttgtcttttaatttctcatcttttatcttacgaatcattttccatgggggtcgattaaagggaccatctccgaaaagaggatggcagcgcgcaccgccataccctatcagatttttattttaactatttttaatcatatattattagttaatggttttaattattttttaacaacaacaaatagatataactgatagctttagatgagggcgaaattctctgatatttttttaaaaccctttgacaacagagcaattttcccgaaatgaaaatatttattataattttcatgatataaatcgggaaaaatacttattaataaaaattaaacgagaataaaattgcccttcatttcccgcaaaaaatttattttttcgattcttaattacatgtgcattaaaaaatatttttcatttattcatattataatttttcggtattgggtgtgaggtttattgattaatggaaggagtcccaaaatacaagccttttaattgtgaattcatcagatgtatgaattccaatatgggatagatttgaaaagaatttatttattaatttaatcgtgcattttcatagtcctttatttccgcaataaaataccataggacaaaatactgcttagtgggaggaatagtcccagcaaactatcctttttaattgttaattcatcacatgaaaaaacggatatagaatgatttgaaaaaaatttattaccgaattaaaaaacatttatcccaatataattatttttaatatttcgtgattaaaaattattgcaaaaaaattactaatttaaaaccattatttcacgctttttcatagtcctttatttcccgtactaattaattttcgaagatcaaaagagaaccgagggggtctattccgatcgtttttcttaagtttttttcaaatcataattctatgtgctttaaaaattgttgcgttcacaaatcgataatttccgttgatatcgattaattgggggggggggcaaaaaaaatcgactgaaactcgcgctttggtgtgaagcgtactcgagaataccattaggctggggttttagagttaccgctgtccctttacaatttaatcgttttttcgagttttaacagttactctttatctctaattctctcctctctcctatggtgaatgcgcatctctcttcacagggggggggggggcccagatttttatactaatactactaacgatcctaaattgggcatacgtttggataaatgaaggggatggagtcgattattcggaaaatatatgcttaattaataaactaaacgctaattgatgaatatgccataaatttaaacaattggtatgagcatagaatccattgtttgacatgccaaaattgaaattggaattgaatgccaattcaaaatttgacaattcatttccccgtctt

SEQ ID NO: 20271 - DNA, 1532 bp, Heterodera glycines
cgttgaactcatacgtgcgcttcgcggcagtgattagaagaggtacaacagcgattagaagaggtgcagcagtaaatagaagaggttcaacagagattagaagaggtgcagcagtaaatagaagaggttcaacagagattagaagagttacaaaaatgattagaagaggtgcaaaagtgactaaaagaggtacaacagtgattagaaagtgggcattcaaatagagcatttacggaaattaaggaattgtttttattcaaaatagataaaaaatcgatgtgttatatttttcattttttaaaatataatacactttttattaatgaaaaacaaattatgaaatgtataataattgaatagttatttaaattgaaatgaaaaaaattttacaattaaattttaaaataatagctgaaattctttaattaaatataataaataatttaaatgaaaatcattattcatcaaaaaataatttaattaaactaaaaaaatttattattaataaaaccaaacatttaaatttattaaaagtaatgaaaattaacccaaaaaatacaaagaaaaataatgttcaccgtccggattcgaacctgctgcccccccccccctcagaacatgtcccagaatccccaatcacacagggattctgagatcttgacgatgtcaaaagtaaaatctgatcacgtattcgtgatcagcggcccaaataacgcctaaagacatgtttttggaagatttttggtgaaaaatttttttcacttaaaaaccatgtgctcccccctttggtcccgaatcccaaaagcacttttatttttgtatctttttttaaaaatgtgatagaaatgccaaataaaatttatataatagagcaaaaaattgcggatttttgtagtattttagttttacagtatgacttttcagaaccgagttatgaatttttttctgaaaaatcgaaaatttccagaaattctggaataactttttttcttttgaacattataaaaccaaataaatctcataaaattctcccgattttttgctatttttaaagctttaattcacttaaattgaccagtcctccattgagttatgaattttcaaattttaacccaaatttccaaggaccaaaaaaattaaaaatattttcgaatttttaaaaaattctaaaaaatctgaaacttaaaataaacatcatatttgtgctcaggaccctaatttaccccagaaaaatttttttcaccctctttttcaacccaaaaaaaatttttgaaaatttctagggggcctagctcgaaaatttttgaaaattttcgaaaatgaagtacaccgttcgatagagcttaaaaagctctacaattttgctctaaggccatttttggctaaaaccaacccctgacgagttatgggcccgggactcaaatgtcccgctcaggccaaaaattttttctatttctggaaaaaaatcgaaaattttccaaaaaaattaccaatggatagagctcgaaaaactagtttggaagtggtcttcg

SEQ ID NO: 20272 - DNA, 1767 bp, Heterodera glycines
  misc_feature (1668)..(1668): n is a, c, g, or t
gcaactttccgctttggagactcttctcgacatttcttatcaggtacttattttgtttgttgggtctttaagctaaagataaatttttgtttgtttagggctcaaatgttgagaagtcctttttatttgatgtttccagcaaaatttacatcgccactgactcttctccggtggatatggtgggcatatcattcatccgttgtatttcacaattttgattttcctcctcttcaggcaacatatgagttgtgctgcgatatgattgatgtttgttattttattttatttttgtaattaagttgaatgatttaggtaacaattgactgaattatttaggtaacaattgacatttcatccatttatgggcaccggaatgagcagaaaaacttccgaccgattggctttgatcaggattcgtccgccgttatcactctccggaccagacaagtcttatttattaaatcgaagaaacattattttgtaccaattatttaatttaggttatttttttgcgccaaataaatgtttatttggcattggtttgtgtgatcaaagaagacaatttcgaaaagcaaggacttatcgatttcaatttcaatgtgtttaaacaggcaaatatcattttaatttaattttatattaattgacaattctttaaagggagtggaagatgtgttcgaattaggcaaaagacggttgccttccctggctgttggatgacaccaaaactcagcttctaatttttccgtttattcactggcattgtcttttatttttgttgccgcatagaccaaatttctatcaaattattattcaaatgaaatttataaagacacattcaaaaatacattcctaattattattgttgctgggaacttttgctgttgggaggggcttttcaaaaaaattaaatcttttgatttaaaattttttttcagagataacaaattgctaattacatattcatatcagttaccatgatctggtaaattcatggtatcagttatgctttaagaattctctatcacctaaattaaaattctttttcgcatttttggcctaatggatttgtttcaatcttcacaggctaatagtgaactcagagttcgacagataccaaaatgtttattttagagaaaaaaatgaatttataagccaaaagggtccacgctttgttctcaaatccaaaaaaagaaaagtatcaattttgtcaaattaatattttaggtctttggcgttatgttctttccgtttccaatctttgtgaagtaacaaattgttgttttaagggtaaatctttgttttgttaaaaatgctttctctcgcaattcgacgtttcatcgtccaacattcaaatggcacatttatgagcactaattttgtcgcgacatcgtcaaactttttgctgatggaccaagaaaatgacaaagagacgaagaaggactttaggaaaattgtgaaactgctcgaacgaagtccgactcagaaaacaaagaaagggcaggaaaaagcggaagaaaatgcgaaaagagaagagaacggaagggaggaggaaaggaccaattggaaggagcacatcagcaaaagtctgcacaaaagttacgacgaatacgcgacgaggaaaagcatggaaagttggaagaggagggcccgaagggacacattttnggtgtgaaattgcaattttaacattgacacatttgaattttcatcggttaagctatatgagagaccggaacttgcccgacttggtcacttacacccatc

SEQ ID NO: 20273 - DNA, 262 bp, Heterodera glycines
aggaggtgtgtggtgaacagtgatagaaagatgaacagagagagagagagaggagagagagagaggagagagagagaggagagagagagagagaggagagagagaggagagagagagaggagagagagagaggagagagagagaggagagagagagagagagaggggggagagagagagaggagagagagagagagaggagagagagagaggagagagagagagagaggagagagagaggagagagagagaggagagagaga

SEQ ID NO: 20274 - DNA, 1432 bp, Heterodera glycines
ggtctcttttaattaatttttgcttttcacaggtattacgtcaacagagactcgctcttctcatttcacaaggcggcagaggtattattcattttttggaatttaagaacattttgggcattttcaacaacaaaaagccgaaaccgattcttattattagaaaagttgtaaggaaatatcatgaaaaaattttttaattcatcacaaaatttcaacgaaaaagaaatcggttttataaatttgaccgaaaatttaaaacaaaaaattcaggaaggaaacaaccgaaacgggggggggtgaagagctctgttcccataaaagtgccaaaatctgttaaaattagccatttccaacaagggaatgaaaatgtcaacctcccaccacctcttgatgaaaagtgccattaaaatgaaactctttttttccatttccaggtgttcttggccaatctgatgtccatttacgcggtacgttttggcatttactccaaaaattttatgttatttttgccattaattttcctctttcatatttttggccgcccattacaaaaacagtccggacgacctgcaaatgttggccgacgcgccggcacatcacctttttgtgctgatggcacccgtgccggctgaccaaagctccgtgccacaggcaaatatttgtggataaattggcatttaattcgtccacactccatcaccgaaaatgaaatccaagaattatcgaacatattcaaaatttaaaaaaaaaatttaaatttttgaataaaattaaatgagtgatgatgaagcgttaaattttatgaaaaattctctaccttttcagaattttctacatttttttattaattgtaatttagaaaatttatttttcccggttcgggaaatgacaaaaaatgattaaaaaatcaaatttatctacttccattcatccattttcagattttggcggttgtccaacagtgcctggagggctccatctctaaacaaagtgtgacaaatgtacgggacaaaggcaaaaagcgggcggccggtgacctcatcccgtggacactttgccaacactttttggtgggcgcaaattggcggtcattttagggacgggagcgggaaaaaacgtcgccgggacataacgtcgccgcaaaatttttttttttctaattttagaaaaaaatctagaaaaattgtcaaaagtttagttagctagcttaatacgaaaaaaattcgagaaaaattcaaaaaaaaatttttatcaagaaaatccaaggaaatttaaaattttcaagttttgtggttttttccggaaattcagcaaatttagtttttattagattttcaaaaagctaaaatactttcaagttttcttgaaattttgaaatttttttttttttttttgcggcgacgttacggcggtgacgttttggggtgtaccc

SEQ ID NO: 20275 - DNA, 2176 bp, Heterodera glycines
  misc_feature (4)..(4): n is a, c, g, or t
  misc_feature (28)..(28): n is a, c, g, or t
tacncaaataattcatttttgtatgcgntcacattcaaacaaagttgatgcccaaactgaaatatttgacgtatttccatccttcggttttcaaagaatttatatgattggagacaacctttgcccttaaattttaaatttaatttgattttgtttattaataatcacatccaattccaaatatttctgcttgattctcgaaatagaaaaacttaaacaaaattaattgaaattaatcaaaaaacacaatgccaacttttgtaggttcacatatgataaacattcaatgaatacattctccacataaaaagtttcattttgcttccttccctttcggattctgaatgaattttaaattattaaaaaaaaataaataaatgattaaaattaattaattaaattacaaaatatttttcttggctggcgaagatcgggaaaagctgctccttctgctcgccttcttctattccatgatcgtgtgttgtgcatttgtgactgtccttgtaaatcggcttccgtccataaggttttccaattccgtacaatgcggcaaaacggaactaaaaatgcaaccaaattcattaaagctcaaaatcaaatttctttgccctgggggctggattttaaatttttggaccagtcataaaatcattcattccttaattgtttttttgaaatctgttatcggaaatcccgacttgttcataaaaagtaccatttgattgcccaatcctgcacatgaacgcctgtcgtgaacacatatttgtcaacttttttcgggaaaagcctggatccaatttgaaaagatgaaatatttttttaaaattttcatgtacttaaattgcggtcgtcacaaaaatgtcaaatcacattttgaagttttactaccgttcatattcttcttccgtcggattcggtttgcacaccgaaccgtcgaatggcattttcggatcgggtggcacaagggaatgcgaaggttggataaacttaaaggaattgaatttgatcaaataactaaaatgggaaaatagttacgaaatattagatttccataaagcccagaaaaaaataaaattaattgttagacaaatccctaaaatacgggtcccttctggtcggattgtttttcgacccatgcttccatggagcatttggagctgcggctgatgaacagattcatcttcagctgttctctttgctcttctgtttggtgtgccattggcagcatgtcaagtccaagaagccaaaggtcggcataatcagacaaaaaagacggaccatttgaacggaggaaatcaatttgcatggcacggccatcgaagtctgagaatggcatgttgggaaagccgagaatgccaatttaaaatatataaattaatattttcaccattttccaccgatgaaaagcgagtgaatggctcagcagtttgattcaaagcaaaaagcacaaaaaatttgtgttgttctgcacccaacggataacttaaataatttccaattttgtattataatttttttttgctataaataattttaaaattaaaaaattcaaagatttaatttactttgcttaacgttaataaaaaaaattcaaacaatttcttagaggcaattgatgactccaaaatgatgacttttcctttgtcatttttcgtttgctttggcactgtgcgaatttaatggcgcgccaaatgattgtgccatttttgttgccatcctttggcatattttgcacacattctttttcaatcgaatttccctggggagttaatatataatttaattaggtacccaaaatttattcactacggtttcatttggtccatggttggtgtgataaatgcggcactcttcccccttgtgcctatgtggcagtgtgggataaagggataaagagagtgatttcgccccatggttaatttttatttatttattttacatttgaaagtgtttttccgtgtgatatcaaaattgttttggaatatttttatgcatttgtcgaacatagtgaaaaggattggggaatggaaaacggatgaggatgaatcagcagtttgataattaaccaaaatataataaaaatccatttccgaatccaacagcaggcatcgcctgtaaaatgcggaatttggccctttttcatgattaatcctgttaaatcttatttttcataaat

SEQ ID NO: 20276 - DNA, 1383 bp, Heterodera glycines
  misc_feature (26)..(26): n is a, c, g, or t
tgtctttggcaagatgaaccaatttntggagaaaatgaacataaaatgtatccctagtcaatgggtcagctaattgcttaatggaatattgatccttttatggcattattttaatggaacccatcggcagcaggggttacggtggaaaacaattcgaaaggttaatgccccgcgggggacggatgatccgagggatatataattacgctaattgcctctttaatattaatattccgtcccggcccccctgcaattacgctgagtggccgtttggtgccggttgttgctgttactgctccgttttgtggcgcctccgctgccgcatgacgccacgcgccggccgcgccacttggcgccataaaagcggaagcggtggaagaactgcgcgggaaggcgacagcgcccgaggcgcggtgatggccattacccagttcgctggcggatttgacggcagccgcggccgctgtcgcgcggtgctggtggcggtggtggtgatccatcaaattgcccagcgaggcggcgtttgccaacggtgccgacgcggcggtggtcatccgacgtccggcacgagttgagcaacgaccacggcacacagtgcagcaagtgtttgtctgcaaatttggagggaggaatttgttttaaagtgccggaaaattttcggggcccggcttatatgggcatacggaaagcgcaaaaatattgtaatttaaattaaaatatttgaatttaaaatttaaatcactttttgacttgtaagtattgtgtgaaaggcaaaaaattatgaagatcatcaaaacaatgctcgagattcgggaatgaattaattatgaccaattaataaatttaatcaatggaaaaatggcaatcagactcgccaccacatcacaccttgacgatgatcgctgatcaatgtccaacggaatgagaattgatcaattttggtcgtcgtcgttttttggattatttggcgctttgttacggtcgttttggcgttttatgttttttttgtgtattgtcacgacagtgatcacgtcgtttggccaaaaaagtgtgtgggtgaagaaatttaggcaaaaaataaaggtgtagagcaggtgctgctgctgcttcctccaaaaagcataaaacaatgccacggacacgggacaccgaaggcgaggaacaaaaatgtgtttagaccgacctaaaagtggaaagcgcatttttaactaattagtaatcattatttttttggagaaatgccaaaaggagaatgtttcttgaacaaattttagaattgataaaaaaattcaataattgcataggtaattgtattttggtgcccgatttaatggcaaaaattcggttcggcctttattgaagtggcgctggcaaaggcgtatc

SEQ ID NO: 20277 - DNA, 1339 bp, Heterodera glycines
acaggcgggcggggaaggcgctccaactctccttcccctgcttccttcccattttatgacagcattttttgtcatgatcaccacgcgccaaagtgccaaatacatggaacaaaagctaattgtcggccaataaatggcaaattagctaaacaatgcttggcatttgctaggaggatatcccacgccgaaggcaggcggcttaattggtgccaaaaagaataaaagcaaaaaaaaagcgagacaaaaataaaaaaatcaggcataaaattatctcaaacgagattttccaccttcgttatttggctagtgtgctcccgttgctgccaaatgtgcgcagcagcattagtactattatttttaatgagactaattagcgtagcgtcgcgccctgccgtgggtgttttttcatcgggttctttccgctggccggccacctgccccttgccccaataaagaggttaattagggaggaggaggggttggcacaacggcagcaggtggcttttgaatgactggcacagacaaagtgccaagacggacagtcacgtggggcgagggaccggcatggcaataatttttgtgcacccttcactgaatttggcaaaacaagcggccaaagggtcgtcgtggcatcttttaatgaatgataatgagtcagaaaggattggtgggtaaatggttttcaatgttttcaatgttcaaaaatgggatttttaaaattgaaattgaattaaagggcaatttaaaataaaaatttaaaaattgaatatgtataatttatctgtaaaaatttaaaataattatagtggactaaatgttccaaagcaattcttaattttcaaaaaataaaacaaaaatctcccctcatttttgtgttgtgccattgatcagcaaacattgctgtactgatcattgatcctttggcttttgggaggaataaaattaaaatgacggcgctcaactttccatgaatccatcagcttaaaccgacggggcgtggaccgggggaaggaaacattgcgccaattgggctccaaaattagcagctgcgcatttggagggatcatccaatggcattggcatggagaagaatggggaatcaatgcgaatgtttcataaagctagacgaatccttggaaatggttttggcactgcaaattggccatttttggcacttccaaagaatggggggctaatgcgtttttgtagcgagccaaattaattttaaaattaatttatggaatttaccgcaatgggaaacaaaaaaaaaatttaaatgcacgaaaatgaattttgggagaaatgcgcaaaatgtgagccttcgtctattcccatttgc

SEQ ID NO: 20278 - DNA, 1782 bp, Heterodera glycines
caaacccaattgcacagccgcagctgaacgacggcgaaataagaacgatggtcaacgactgcgaattcattttggtgagggagaaaatggaaaaaaggagagattaattggaattatgatggtgccatctgtttcaggtagaacactcggaattccactcgattatgtcaacttttaaccgacaaattgagcaggaacaggacaaaagtggcaaactgataatggaagtcgaacggaggtaatgccgacaatggacagactcattttctgaacgcatttcgacactaaatccggattcttttttaaattttgttttagagtaatcactaaagcctctcccgaccgactgctccaacaacttttggtgggcgatgaaaatgccgtgggttcggaagaagtgccgtccgactcgcattttgtggaggactttttgctgatgcacagagtgtttttccgcgactctgcccaaattgtgcgccaattgctccgttggttccgcgcggagcccaaccgccgagaccgagtggcgcggataatgctcatttggttgaacaaccatttcgaggactttgaagggggacagagcggcagacaaatggccgaactgttggacgaatttgacgaagtaacagtggtggtgctaataaactgatcaattaagagagaattttttaattaaaggcaattaggcgtatatttttaatctctttcagctgttggccagcgcaaagatgttcaatcaccaaagccttctcagcataaccgtcagtgtgaaatcgcaggcccgaatggtctgacgaattaacgaaaatatttgtggcaacaagtttgcttgtttagataattttgacgaggtcggacagagctgaaaaactcgacttccaactgattggcaggaataatggcattttcgtgatgaatgtcgacgcaaattcggctgcggaaaaggccggcatcaaacgatgggacgaggtgataggtgtaaaaccatggatatgctgctgaattcagcgaattttttggaatgaattattattcaaaaaataataatagggacaacgactctctgtccggtctaatgaacgctaatattcaacgatttgttcagcttttggagatcaatggccaactttgccgctgcatgagcctttcgaaagcattggatttgctgagagaaagcacccatttgagcatcagcgtcaaaaccaattggattgggttcaaggtgggcaaaggcgcaagggcaattaatcgttaatcatttcgatcattaccttcaaaataactcgagaaaatcacaaaggacaataaataaatggaagagttaacagaatcacaatttattctttcattcaggaagcactgctctctcaccaaaacggaggaggcgatgatcagtcggactctttgcccgttccctcctctctcaaccctccggcgttttcgtcggcggtgccgtcgcggtaccaaaagaaaagttcggcaccggcgatgggaggaggcgcaacgatggcgcaacagaagagagaacgacgttcaacactctgttccgcactccaacagcaggcggcggaggtctcggcattttttcatcctaatattaagatttttatttaaaattttcgttcaaatttttatgcatttcaataaatccttcattgactttgcagaaatcgtcggtccaaatgggctgtggcccttcgtccacccccacgggctcaattggcagttgcaacggcggaggggggacattgtccagcaaaaaagtgctcaacaaactgc

SEQ ID NO: 20279 - DNA, 2706 bp, Heterodera glycines
  misc_feature (2648)..(2648): n is a, c, g, or t
atttagaaatcattctcattaattttctttgtgttccttcaattatttaattttcaattttcatttttccgtaatttttcttaatttttgtcaaaaattggcattccacgtgccatcattgttttccaattattacattttttgtactagttacactctctctcaataaatttgattaaaatttaaaactttattttcgtttaatccaccacaaaatggcgccgtcgcccgtcggcgcaggcgatgaaaattattgcggcaaagggaacgaaaacggcaaatgccatccgcagccgttgccgttggccaaaaatggcaaaaatggtggagattttttggtcaaaggagcggcagaaaatggcaaaataacgacgaacaaaggcatcatgaacagttgtggcgaatccgtcgatgaacagcacacggcggcattcgattttcgccatttttccgccatggaaaaagggcacagagtgggcaattaacggactaattgattgtcagcgcaaattaattaattaatcgctgtctaatggacatcgattatccattaattaattgatgtttcgctgtactcttaagcgccaaaaatattgaatgtttcattttcgtaattagaaaatggaaattattctaaattattcccaaaggtctgtaaattgttcgtgctgaaaaagttcgacgtttcctttcgccacctttggctcaatttgcacactcatcagcttgtactcaccaaattggcaagcagttcagcctcaaatgatgagcccggtccgacaatttaatggattttattttattttaattaaaacaataaatttaattaatccaattaaaattactatttaactattatctgaaataattaatagtttatttttaaatattaaccaaattattcttaattttaaaatatatttttaattttgtttttgcatttttattaattttgctaattttgtttattttttaattcatttttcatttccccttcgcttcttctgtagttgcttccacttctgcttctgtttcggcgtcgtctgatcattttttgcccaacggacttttggcaaattcgggccgaaagggcagtgttttgtcagccgaattggcattctgttcaccgagtgccaagtcgcaaatgttggacctgcgaattgttaaagaggcgcaagtgagcaaaagggggaggaaaagccaaaaacaatgggaggaagcggtgatcagaaaacactgatcacgcactgcccattgatcataaaagcaaccgataaatgaatgagggcattaagcattttaagcaaagtcattggggatataagatgaagagaatttggcagagattggcttgaacattctaatcatttgatcatggcattcctaatcagttgatgccattcaaattcaattggctggctctcttatgcttttggctatcctttcgaaagctggtttttgaggtgctgagcaaagccattggcacgatgcaaatcgcggagaaatggcgccgggacacttcgctgcagactttcgacccggaactgattctgatcatccaatggggcaccgcttttgtgctcaactcgtggcttattctgtgtaagccgacctgagaaaagtgcgccatttgatcatcgggcgtctgtctgatcagaataccgaccttttgaccagtgtgcccaatgatttcttacatctttttccatatcatttggctaaaatgccaattgcttccgttttgcgttcagtcaacacaaaagaggcctgccagctgtggtgccgtgggctgcagcagctgtgtgccgtcggcgatccttcttctgatcagtcgcatgcactcgtcgtggagcggtggctgcgcaaaagggtatcatttcttgatcaatctcgatcagtttcaaatttaaaaatgaatttcaatttggaattttgcttttcagttccttgccctgcttccccatccgacaagtgccgcgtcggtgaacatcaaacacatgaagccgtttgtgcagcaacggctgcagtgcaaagtgagcagcaaacaattgcaggagatcgccgaggtgggcaattaaaaatggataaatgattaattaaaagtgaatcagtgggtaatttaatagggaaaatgaccaaaagcaaaatgaaataatttaattcaaactaagaattaaaaattaggaaaataaattagctcacagttttaagagggtgaaatattaattaaatgatagcacgtcaattaaattgctccaattaacggattataaatgtttaaaattaaacaactttaaataatcaaatattatctgatcatctgatcactgatcacaatttttcttttccttcaatgctttttctcctttgtgcccagggcgaaatgggcttcgaggcctttgtgctggcacataatcggctgctgaacttccacgcgttgttcgactgtatgttcagcgagtacgcggacactgaacacgcgcaattggtgccctttcaacgctttgtcgactttttacgagacattcagcacgacgggctgggacaggtggttgctgatgaggggcgggcacggaaaatgaatgggccattgattggaatccgaatttaaatccgaatttggcacaataccgtacagccaaggggcnctgtagctcattaatttaaagtgaattcggaattaccatctcaaaaatgatgcaaaat

SEQ ID NO: 20280 - DNA, 1202 bp, Heterodera glycines
  misc_feature (55)..(55): n is a, c, g, or t
  misc_feature (87)..(87): n is a, c, g, or t
agagacttagttgagcgcactgcaaggagaaccctaacacagttcagcacaaaanaattaactattcacgcttgagaacgcgaagtntgctgcggagaatggcaattatatgcagaaagtcaagtgcatatatctcagcgcctagtgcatgaataggagcgtttttactgttttctgagagcgcctgaaagcagctttcgaatggtatagctgatttttttggatctggaattttcgcagagatatatgcaaattagtaaccagtgtttcgtttcaaattatttctcgtattctaacgaaataattttttactatgagtgtttggtttggaaactgtctaaaatgttccgggtcgcccacattgcacaattttcttgaaaataccatgaaaaatgctctaactccaagagacttagttgagcgcactgcaaggagaaccctaacacagttcagcacaaaaaaattaactattcacgcttgagaacgcgaagtttgctgcggagaatggcaattatatgcagaaagtcaagtgcatatatctcagcgcctagtgcatgaataggagcgtttttactgttttctgagagcgcctgaaagcagctttcgaatggtatagctgatttttttggatctggaattttcgcagagatatatgcaaattagtaaccagtgtttcgtttcaaattatttctcgtattctaacgaaataattttttactatgagtgtttggtttggaaactgtctaaaatgttccgggtcgcccacattgcacaattttcttgaaaataccatgaaaaatgctctaactccaagagacttagttgagcgcactgcaaggagaaccctaacacagttcagcacaaaaaaattaactattcacgcttgagaacgcgaagtttgctgcggagaatggcaattatatgcagaaagtcaagtgcatatatctcagcgcctagtgcatgaataggagcgtttttactgttttctgagagcgcctgaaagcagctttcgaatggtatagctgatttttttggatctggaattttcgcagagatatatgcaaattagtaaccagtgtttcgtttcaaattatttctcgtattctaacgaaataattttttactatgagtgtttggtttggaaactgtctaaaatgttccaggtggcccacattgcacaattttcttgaaaataccatgaa

SEQ ID NO: 20281 - DNA, 2392 bp, Heterodera glycines
aaattttaaattcgcccctaaattgttgtttaccagggtctctagtatgcttaaatgtacatatattgtgtttgcctgtattcaatgtttgccacatttattaaccaggtttattacacacattgaacaatgaaacaaaagtagtgtaaggcccattaatccggtgtaaaatccttaatccggtgtaaacccttgccccccccccctgggcagagagatgcgcattcagttgttatttgaaatgaatggaattttcattcttttttcaaatattcctaatatatatcattgtagattggaatcccacaaaagcctgctcagaattacattcggtgcctgatattatttttaaatttaatctttgttaaagatttcgctggcggctgttggcaaaataggcgcttcgaatctgcacaggtgttcatttaattttctgtcatagctctgccaaactatgaatggtgtgagtaaggtttaatgaggaaaacgagatactcaagccttttaatccatgaaaatgtataatcttattaggtgtaatctaataaaatcattacattaaaatgaatttttggacaaaatttgcgattttaaagctttttgtttttactaaaatattaattggggtttttacatgagtaatcaatatcttaatatcgtcccgatctttttcaatgccttaagcttggagattttaaaaggtctaagttgggaagtgttttcaattatctagacatattcaaaagctgtataccatcttatgtcacaaaaaaaaagcattttcaagggaagaaaattaatattataatttaaacattcaaaaatgtagaacggttaaaatatatattcaaaagaaaaggttcgggaactcaaaaggattgccttttcatattaaattatttattgaaatatttcaaatttttaaatgcaaaaacaataataaattacgttaaagagttaaaagggaatcttttaccagagcattatttgtatataaattagctcagcgggaaactttagatgaaaatcccctaccattgagtttgggattcaattaaatttgaaatagaaagaagaacaacgagaattacatggcaaagacataagagtaattatttttaacttccctaaatccaaaatctaaaaataatgatgaataacagaaaaaaacaatttatggggaagaggtgaagggagcaaaaaaaaaattatcaagaaaaattattttttaaattgctacgaatgactttaaacaacatacattcagaattttcaattttattattttttttaatgggatttgaattatctttgggtcattgagttgactgatgataattaattaattttgcttaaattttcaaaattttgggcagcctatattttgaactcgttttttaatgtaaatcgcgtgcatattgcgtaataaatgagaaattcgaaataataaatccatcaatcaattttgcttggcagtttttcagaaattgttggtcaaatttgcgaaatagttttcgattttggaaagaaatatggtacacagcaccaacaattgaaaatttcaattttttaatttatctttacgtttaatttattcgtcttattttattatttttattttaaaatttttcgtcggaccataatttctttatctttatgttcagttaaagaacactttcgctctttttctaggatttggaattttaaacacgtattattaaattttaatgaacagcattcaaaaaacagcgacaaagtatttgggatatgatgtataggaacttgaattatggttgaaagtattttcacatgtcacatttgtggcaggggaatgattgattaactttccgcggcggtgctcggcagggcgacttcatggcgcaccggtggagagggagatggagacaaaaaaaaatacccacgcggttttggaaatcggatttgcgtggcggcgactttaaagggttaaactaataaatatctttaatttgtgaacctgttcataaatcaccaacggatttcaccccttcaatgggttaggggaaaatcccgcggcggtaacttcaaagggaaacaccccttcaataggctcgggattttgcggggaagtatcacgtagcggcaatttcaaaagaaaataccgcccaagcaagcgggcggtaacttcaaaggaaaataccccttcaataggtttcagattttggaggggcccttccggtacccgctcggttttgggtctatcacttgcacattgtgctggaaaaggataaaaactcattaatcatttcaaaatgggtccatattgtgaaatcgtttcaaaaacggaaagcctatcaatcaaagatttaaaaaaaatttttggccccatattgctaaaaatcattaatcatat

SEQ ID NO: 20282 - DNA, 1337 bp, Heterodera glycines
  misc_feature (1272)..(1272): n is a, c, g, or t
aaaatcttcaatttttggtttggggtctatttgccccttacaaaaaatttgtcgtttcccgtgatagcttaaacaaattgtatgtttaacatttagctgtgcatacacatcggtggcggtgtaaagtttgactatttcatgctcaatttgcacccgcgcggtccaaccgttgcggacgaaacgtacgacgagcgcgtgatcgaagtgcgccgtgaccccaaccgaacgccgtacattgcgctagttgcgggtgtcaaggttcctattttggcaattttggatacatttagtaatttgtaaccattgagaaagatgtccaatcctccaaagttcttacgccacaaaaaaccaaaaaaatatgaaaaaatatagtttgtatatgcgagaaaaaattatggggcctcaaaaagcgaaattttgactgtattaccttgaggttgggtttggatagggcaattcgattgaaaactgatgatcttttttgccgtcttatcgggttctctagacgcccaaaacgcaaaactttttttttcaaattgcttaattttgctccgttcagggaaagcgttggatatacgccacgcagaacatgcaggccggccaaatcatacaaacgacgtgtcacattccggaacggccggtcattggctgtgagggcaactcatacccattgggtgtgcaattcgtttttgtaaaaaattaatttatttcatttttgaatgacacgttgttttttaagtgctacgtcctcctcaattggaaaaattttttttatccgaaatcctttttcgtttcaaaatccgtcaattttcttttgcaggcgctttggtcgaagggacaatggtgaattcgattgagcttcatcggaacaaccctaactgtatttcatttttttgttgaattttcgtacatttgggcggtgaaaattgatcatttgcgtcctctttagcgcacgtggtcatcaccgaggcgggcggttgtgccgaaattattcgacacatggacgaattcactgttgtccgggttggtcattcgttggtggtcccaaattttaatagatttcctctagaattgaacaattaactccccaaacttttagccattaattccaattccatttttttcagatgccgaacaaatatgaatacgcggtgcgcaaggttagtggattttgcatttgtttttcaattttttttcaaaaatttttttccatcattaaaggaaggcatgggcggttgttggaaaactggtcacacgtggactggggagtgngttcgaacatgtttttttcaatttttattttattattttgacagtaaaaagcattggggctctgc

SEQ ID NO: 20283 - DNA, 985 bp, Heterodera glycines
  misc_feature (52)..(52): n is a, c, g, or t
gctgtcctttcatgtttaacgcagttaatttatgccttttgtcagactttcnccagtggaatcggtgttgctctgttatcggcatggaggacaacgccattttggcgagaattacctgcaagaattggagacaaaagctcagcaaatggctgagcatggggccgaccaaattcgatggcattacattggccgaatacaatcgaacatggtaactctgcatctttgacaggattttattcaggcatttcaaaaaaaaaccacaaaaagataaatcgcatttgtgccgtgcccaatttgtggtgtgtggaaacggtggacagtgttaaacatgcgaatggtcttcagagggcaatgaatgcgatggggaaaccattgaaaattttcattcaaggcaaaaattgcagaaaaattctaaaaacaaatttgccaccaattttcagtaaacacaagcggcgagctcaacaagggcggtgtacatcctgaaggactgcttccattggccacacatgtcacggaacagtgccattctttgacactgatcggtgggtagaggtccaaaattgaaaaaaaaatttgttagaaccccgctacgacctgccctaagattacggaatcaggaatcccgcaattgtgtccataagcatttttgaagaattttaaaggtttgatgacgattggatcgattagccaaagtttgggaagcggagacgaaaatgcggactttgcactgctccgaaagttgcgtgacgcattgcaaacggaactgcggttgtccaccgagttggagttgtccatgggaatgagtgccgactatcaattgggtgcatgccgattccgatcactttctcatcactgataaactgttgttcaatctattttcagcgatcaaatatggcagtacaaatgtgcgcgttggttcgaccatttttggtgtacgaaattatgccaaaaaattggacaccgaagagagcaaataaatttccaa

SEQ ID NO: 20284 - DNA, 1563 bp, Heterodera glycines
  misc_feature (1539)..(1539): n is a, c, g, or t
cattttatactttatattaatgtatataaagtttaattcatttaagtatcaatatattaattaaattctacacataaaacttgataattattttttctaaattccaaattttatatttttgatgtttatatatttttcaattttgtggacagtttttaataaattaattttcaatagcagtattattgtttttataaatgacaatgattaagcttcacttaagaaatatttagggttttaggacaaaacaactattgtgagagaccggtaccgatatattatttcaggaaaaacaacaatcaatttcaattatttttgagataaattgaaaacaagatcgttagggatttgtttatgtatttagattatatacataatatagttttttcctttaagaaaattttcgaaattattattatttttttaaaattttatgttattatttactgatctaaatatttgtggctttttttttaaatgtgtctatgaagtcatggtgctacggagttgaaaacaaaagctttgtgtccaatttttaccaattcaaatgtcaaaacggtgattgtcaacagttctctgcgatctgtctttacaaaacaaaacaaaacacaaataaatttataccaaacagattaaatacgacgacaaacaaaaataatcaattcaacacaaccttattcctcaactaaaaaaaaccaccaaatatattaagtctcttaaaaagaatatacgaaacgccatagaaattaataatttaaaattgaaatgaagtcaattagcacatcaccgcccactagaaaagacggtcccctcggcttacagtaacaaataaaataacaaaaacaattcggctaccgatcggtggggttcaaggttgtgctcttaatgacgacgacggctgatcatctcgtttccgcctctgtgagcctgcgagctataatggtgacgaacagcataggggtgagatcgagaagtgcgagaatgactgagagacaattcagagatgtgatcagatacagatggaactgagcgagatgaacgacgaaaaccaagagcattatcatcggggaaatttgggatttgggtgacaatccaagcgcgaaaacatttcaatccctcagacaaaattttcccatccgaacgaatccgtgtcatatcgaaagtctcgccgaatcgccacatctccaccagacttcttccgctcgttgttagcgcgatgaaccattcgccagcgactgtttccaggatcggcagcagttcattgtacagggtgtgctgctctcggacgtacggtggtggcaaccaaacaaaatgaacatgtttgaatttggcacaaatcccacgaatccgtccacattcttctgcaatttgcgccacggttttgcctcgtagcatggcatcccgtcccaaaatgatcagtgccgccacaactttggaagtcagcaccgccttgtccagtgcccgaataatatcgccaattgatccgttgacggtcccgatgaaatgtgccgagatttggtttcccgctccaccacagangtgtgcaccagtggagtcgccgat

SEQ ID NO: 20285 - DNA, 2687 bp, Heterodera glycines
tatatatatcaatttacaaactttacatcaataaaatttagataaaatatttctatatagttgttttaatttgtagtttaattctcacccaaggtggcagtttttaagaaacgcctacttggcagttttttaagaaacgcccacttggcagtttttaagaaacgcccacttggcagtttttaagaaacgccctggcagttttaagaaacgcccatggtggcagtttttaagaaaccaccccaaacgccgaattttttgtaatgcaacccggcggtgccgataggcccagcaaaattagaaattttgaccattttaatagatttaactgaaaattggccattttgggggatttttttcaaaaaacagcaaaatcaataaatttcttaaaataagtaaatcagcatctcaaaaaagcattattgacccacatcaaatcatcaaaattattataggttagctatattaggattctacgcccctaaattaggctattaaaatatttaggaataaaatttttcttattgtttgtcaatgcttccaaattgccttttgactttggagtcgcttcgttgccctccattatcatttgttgacgcgcaaattccactgctatttttgcattaattgcttttcgctgggcctccaatctttccaattcatttccatcatcggacagtgcaaaagaagggcaaagattgtctaaaaagtgagagagaagatttttgtgttttattttattattttgtaaattattttttttaattattaaatcgcgttttttgtctttctaagtgaatggcacggagttaagcgttttaacgattttaaactgagctcgacattttgaaaaaacctgaacctaggttctgttggaactggacctaggcctggatttccagattgacctagacctgacgaaaaacccataaaaaccaaaaactcagattcccacaaaatggccttgaccctgggcctggtccaggaaaaatccaggcccaagtcgagaaactaattcccaagttttatattctttaattgtgatgtcattttgccgttactttggtctgaattgatgtcccaagttatgagtgatgtgttcggtgtgcttgagctcattgtgtgtatgtttttgaggcaatagaaaaaaaaatcaatagggtcaatcctaaaagaggaaatcaatattttttgacaataatgttgacatttattaatttaatttaacactagaaaagggttttttgtgctaaaaatcctgaaatatgtaataaaatataaaaattccatgaacaaaagttaagacttttatttacatatttttacatatttgataaacatattttagactttttagcatttttcataaatttaggaatttcttgttaaaattaaaaaaggtatcctaaaaaacgggttttttaaaaaaagacacaccaaaatttagttttttaaatgtacaaaaatgtgattctataccttgacatctacatatatgaaaaaattataaataaatcaaaaaataaaatattcactgaaattcgcatgaaattatctacgtatctgccaatatttagtatcaaactaaaataagaagaataatatttcacaaaatattgagaattgtaaaattcaaaatttttcgattttcaaatttatattttttaattcccaaaaaggtcaagccttaggggtgtattttttttgaattgtattttttatgtaaatttgccaaaaatgaccaaaatgccctaaaagcccaaaaatggcaaaatatgcatttattctcgaaaactcccaaaatataaaatcatacaatttataaccctattaattagttactaaatacatcgcaatcataaaatgtttataacattatgtaaattagtaaatgcagactttccgatagaacataatttggtttttaattattaattaatttaatttttttgtgtacagtgctcattgcaaaattttttaaaccattgtaatggataaatttgaatttttttatctataaaataataacaactatgaataaataaatctcagataaaaaaaattgacaacaataggccatataaatgtaactcttttatttgttattaagctcttattagtttttctgttatatttcacactatttctaatagaaaatagatgcatattacttttaaatcaaatatcatggggttgaatcgttatattagttaataatcctctttttgtgaacctttttaacaaaacggtaatagagcattttaattttataaatggtttttaatttataattcttgtcaaattataaatttcctttaattattccaatttaaaatgaaccattttacttcaactttatttcaactcagaattcattttaatcaaaaaatttgaaaaatttttttaaatagttatttttcacttcgtatgatttgtttgaatttatttaacagaaagatttgtttaaaaaatataaaaataaatatttcttataagcattttaagaactgtttatttaatcggaagattaaatttttaaaatattaaatggctttaagctccgttctttttgcaaatgatcgaggttttatttaataatcattcgttacgaagccattttctaatatccttttcttctctcttctaggggggtttactaaatgttgttgaaatattttttataattatca

SEQ ID NO: 20286 - DNA, 1380 bp, Heterodera glycines
ttcaggatggtgttggccagtgttttcgttgattttccggatgggaattgggaagtcaccaccagagaacagtggctggtgatgagacaccggagggaagtgggcttgatccttcgcttgcgactgtctgcaatcgattcttcgatacagtattggaagattgctgatagtaagcttccggggtttgcaggttcatcctcgatgctgaatcggctcttcattttggtgtagtgaaacttttcgttgtgttccaagcttccttcaagcttcttcacgtactcgttgacaggtttattcgacgaaccctgaccgtgttgaacggatccaagcacgtgggctatgcccaaaatttgattgatgaggaagccctgtcgaggctttttgccgagaattgagtcaatagaaaaatcagtgaagcgcttggacatttttaatctattttaattaaatattattttttgtgttttttgaataaataaaatgaaacatggagaaaaagcaacatatttatatatggtattcaaattggcatggatgtgcaaaatttgtgtatcaattcagttaaatgtgttaatttcaaaaccaaccattgacctgaagagcagcgcactgccacccatgaagcacaagacgacagggcacctaaacagctttggaaattagaattgtctaatgcactacctcaagtcctaaaagtcaaattagaaattgctgccaggataaacggggttctgtaagtcgagctcccgccctggttaacagcacagcaaataataataattatttaaaaatagagcaaatgaaattatgatgcccgggtgtgtgttttaaagtcgtccaaatgtcgataagctcctcccactaatcaataattttcgacgctatccctcaaggaatgtatttttgaatttcttagtatttggcacaattcccaagggaattgtgccaaatgctaagaaattcaacacgttccgcccagtaatcgataattttcgacaccaataccctgtagtggaggcattttcaaattttcctttgattttattcccttggggcttatcgtaagacaacgggtcttccgatattgagcccttcgttgccaatgcaaccagtcaaaccattcatttcatcttccccaaaatgaacaagcaacgtttaccatctgagctgatttgcgaaatcatcgccacaatcccgcttatgtacctatttggaggaatttctaagaaaccaggtatttttttattttaaataattatttaatgaaaaaacaagggagtacgcgtccgccatctggaatagcggtcatcaacaataggttcgaaatttttcgggccactggacatagtcgcttcattaaagtggtcggtgtgattctga

SEQ ID NO: 20287 - DNA, 3073 bp, Heterodera glycines
  misc_feature (1574)..(1574): n is a, c, g, or t
cttcgaattgtccttgaattttgaattaatttcttttacattattatttttaagaaccataatttgttgcgggcttttgtagtaaaagtcgtaaaagtttgagtagaaaaagtctgtgccgtaagtgacccgcacatcccccaccaattcattctcatcaagctgatgccttaattaacgaaatgcaaaataattagacttgaccaatttaatcaagcaattaattaattcccttttaattgacctttttggctgcaccataaaattctgaggctgtggaatatctacagaaattgatcccattttttgctcttttttgccgctgtttttttccaataaagcattgatcatacgaacaacaattttggccatcactttggccggcacttccaacacaaattttcttgtgccttcgcttttccctttatggaagaatttttggacggattgccaataatcggccaagaaaatgccacttttctgttcattttcaacgtgtgaatttgtcggctgatcaacagaatttgtgccttttttatttgctgtgggcaaaagcggcggagaaattaatttccgggaaaaagtgaacaaacggtacactgaacaaaatgcggaaatgaaagcaataattcgatgaggataaacatttggattaaatagttttaattttcaattcgactgttaatacgcccttttaattaattatcatttttatttttaaacaattaaattaataattattattttgttttttcccactgattgtttctccgctttttgcctcctccactgcttcttcctccttgtccaattgcttcttcgcttgtgccgttccgctagttccatccgattggccaatgctcagagtgacaacagtggccaaagcgtcgcccgccattccgtcgacggcacaattaaatggcaaaatgctgacaaaaaggagaagcagaataattgggcagcgaatcatttggcaattcagcaattaaaagaattaagcaattggaaataaatgttcgctttgaaaggaaaattggcaataaaattaatttatgcttttaaacgcgtttaattatttaattattaatttttattgcttccgtttgtctattaaattttgttaatattttcttaaggcaactaataccatattagggaagcaaacggaaatatggctttatatttattggcaatttatgcttacacatagtgacacgttaataaatgttggctggtagtgcgtggattttcaatgtaaaaataaaaaaaaatcgtcagtgccatttgggggatggtggggcctcggcagtgccattttcgtcggtcctttcgctttgtccaaaaagaaaagtaaaaatttcataagaaaacttctaaaattcaaattcgaacaatttatttgaatttttatatatttttgcattattttattatatgagaggaacaaaaaacacttctctgaacatttatttataaatgactttagcactaaaaaacacttaattttccgctgcgctttttcacaaatattattttgaaatattcaaaaaattaaataatttattttattattntagatcatgaaattggcgtttgttcgtttgaatgttcttacggtactttgtctgttctgttcaatgagtcattcctacggtaatccatccgacgaatccgatgacgaaatttgcgaggaagaagaaaatgaagcacaatcagaagcagaagaagcggacgaattttttcataattttaacggcacaattcaaagtgaaagagaggagaaaagaacggtgaaattttaattgaaaaggattttattaattttaaatgattgcctaattaatgaccatttatttgcaagcgcaggttgtcgaaatattttgccgaaatacaaatgacaaatttcaattttccaccgacgacgaggggaatttcaaaattcaaatggaagcgaaaatcaaatggaaatttcacaaatgcaccaccggactgagaatggcattttacaagaaaaaagtgatggaaaacaaagtaagacaaactgaaaacagacaaattgacaagcgaaaagaccaaatgaccacaaatagagcaaaatatgcctataacattcataatttgcttcaaaaatttgttgtttttcaggtgccaaaatgtttgcccattattttgcggagtccaaaacggaaattaaaaaatgcaaaaagattggatatttgtgttgtcccaattcgcatcaaatggcttaaatttggcccaaaaataaatgcagaagaagccgaaaccgaagaaaatgacgaaattttgagaaatgaatttgcattggattttgatgtggaaaagaacgcgcaaatgaacggacaaattagaaattgcagtgatttacattctgctgaacacaattttgaaatgattttcaacaaatatttcgatgatggaaaaagtaattacctaattataattagcaatttattataattattaaacataaaattaattaataattgtttatgtaattaaaaggtgttgacgaagagggacaatcatcgaaaagtaaggaaaatgggcacaaagtgacagaaaagtaattaaaagggcaattaaaaagagggaaaagcaacggaattgacaaagcgaaagcatttaataaaatttgaataataatttatatttttatttttcagcttaaaatgaggccgaaccgtcgcaataaatgaaaaaggacgagggaaaagccaacttttaagagattctgttaaacactttgataacatttattctgatccgacttatgggtttaactttttggttaatttttgctattgctttttgtaattctttggttctctataaactctttacaatttctaagattcaaataaaattaaaatgactacggtaatcgtacattaaataccacatttgtttagccgaatgcccttcaaagaaacagcaaaattcattattttacttttgtgtttttaatcacataaaggaattgaatttcgttttgctttttgtgcctatttcattccgttttcgcgatattttcgtgcctaattactactgatga

SEQ ID NO: 20288 - DNA, 1386 bp, Heterodera glycines
ttttcgaattattagatatctccgacagcacacactgattttcatcccccgaattaccgaaattttttcccataaggagggctacgaatatatattttttaatatataggtaatatgtataataattacaataatattttaaatattttattatattttagaatcaatatttgtattgcaaaaaagtgaatctttttgagagtgcaaccgcatgattatgacaatttttcgattttataaggaataatgcgtcattacactgaaaattgagcatggcacgtgcctttggcattaatttattacaaaaaaaaatttcttatgcattaatttacatgcgatgggtaaggggccaaatttgcctttttgggatcttaaagatgtgccaataattgatttggcaacaaaagctattcctagtaatgctaataaaaatgcgaaattaattaaaatatttcatttaaaaattaattttatttttttatgcttaaaaaaattttattttaaaaatgtaaattaattttataattaaaacagtaacatatataaaatattttaaatataaaaataattaaaattgacaaaaaatattgaattatgataatataaaaaatttttgaataaattagcctaattttactaataacaaaactaaaccactcatgtgccatttgattagaatttttagatgttttttggtcattccgtcatccttttttgcttcatagcaaatttgtattccttttattcatcggcggatgaagttgttaagtgtccaatttgtcaggaagaatttggaggaaacgcgcaagagaagcttctttatgattgcaatgtgagctaataggtttaataattaattaattaattaggtcaattaaatcataattaatttttaaattccttaaaattaaaatattaaaataaaacattattttttagcattgcattcatatagcatggtaagcattcatttttcaaagtcttatttttcattgacccctttttaagcgaaaatccgtcgaaggaaaatttttgttttatttgtaataaagcagtgaagcctaaatcagcagggcatcaggtatttatttggttgcacatttatcattaaaaaatttaatttaaaattttaagttaaccatccaatgatttaaaactaagtgtattgatttttcagttagtcctgtgtccaaggctgtaaacagaaaaacaaaatttttttagccaaaaactaagcaaatttgtgttccacattttaggccaatttagttaaacaaaaaattaatagaattttcaaaaaagcattaaaaccatcttttaaccaaacatttttattggtatttaaataaatcaaagtttcagatgtttaaaataatcataattttt

SEQ ID NO: 20289 - DNA, 2167 bp, Heterodera glycines
tgaaaatcataaaaagccgtttagaaatgaaaagcggacaaagtcatcaatattccagtgacaatttgaagacggggtgagaatttcggacatttcctaataatgccccccccccaaacgttcagcgtccaggacactttctcggaagaagcttcgggtcggacggggctgttcagcggaggcgctacagcaaacaacgaggtaatgcgtccgccgacggctcatgagcagccgatttacatgagtcgggaggcagtggtctgaggagatggacggagccgggcgggccacggaggtggggaccaccgccttaaaacgctcacaacatcccggagatatgctcttggggttttgattgaatgaacaatagcagaaggggggggagggcagtcccaatgtaatttatcctaatttctctccctctctcttaaatatttcgtaattgaaaatgcaaaaaatacaaaatacgcttttatccgctgatggtttcggcttttggtagtccgtttttttcgttaggggatttcggcgtgccttacccccttaaaagccgacaaagtccgctcgtgtcccatttgacgccttccattcgttttccttcagcagccgaatccctacgacaccgccgttcacattgccttctccgactcgcgaatctcttccgtttgatgattgtccgtccagcactttttctgctcatcagtcacttcttttttcgtccagtcgtcctccatgtttctctttttcttctttctttgttcgttacctctattaccgtatttctccgtcctaccatttccacttattactgtattatctacacgaaatcataaataatcgctgccgtaccattggtctcatctctttttatcctcctattacatattttcattttattttttactatttccatcactgcatattatttaattaatttgttggtatttgtctcctttcctatgaataattttattcaatattttgcagaaatagatttttcaaaacaataaaaccatcttttttgttttttgattgcattgttttgattcgctttttgcctatgtattatgtttcaaagttgtaatgattctgataaaatgaaagcattacctcaaaaaattttcaatctttttgaattcggacctggttcgaaatggatgtcatattcgtgatcagcgcaccaaatagcccttaaaacgtgtttttttctggtttttttattctttatttttgtggagtcacccccaactcatccataacactgcgagtcatcgtcgtggtatttttgattatgcggtcttggtcgtggcatttttatgcatggataagttgggtctatggatgagttgggtatggatgagttgggtatggatgagttgggtatggatgagttgtatacgcgcgcttgtaactgctgtatcgaagtctaccatgagtcgtgcatttgagtgcgttcttatacatacatcctttttctgtatgtcttgaaatacgtatgttagcttccctaaggcgtgtatatatattcctcggacgaggtgcgtccttggagattcagtccgatgcagggcacctccaacccatttgacccactgctcatcatagtcctcaatggaaaccgcaaaaattcttgaaaaaacaatcctatgatgcttacgattgatatttcattgattgcctaaaaaattatatgtgtttatacattcttatgaatcaattaaatccagcacattatgccttaatcaattctactatgaaggagaattttattaagtccctttaggaatatcatattgattatacagcttactctattgccgtatctcattgcaattcatacagatctttacgacattgatacaataatatataatatttctatttaattattatgttattattatctgaacgcatgatacaataaagaaaaattactattcaacaaaacacagctaaataacgcacaagcgatcactagggaccggatttgtatggatttccatatgttttttgccaactcatttccccctaaaaacgacgaagatagcatttttagcttgggttgatgctgctaggatgaatttttatttccacatttccatttttacctcccatatttcggcattttaccaaaaaacccgaaaaacgcccccctaaactttttttt

SEQ ID NO: 20290 - DNA, 2190 bp, Heterodera glycines
aaaatactttcacttacttccacgcgttcctcccgcaattttaatttgtccgccaagtgctcccgcatttgtacgtccggatattgacaggcggtgaacgcctcctccatcgtgttcagttggtactccgtgaacattgtacgatggcgacgcttccgcttttcactgcttagagcactgagctgaaaaaatggaaaattaatttaaaaaatggaaaattaattaatttcatttgaaaattaaaattatcatgaaaattggaaaagttaatacagtcgaattttgtaaatgaaaccacttaggcattaattatattataaagcagattaagctaatttcataagattttggcaataattttgtcatttcttgcttttttgagtcaaaaattaatgaaacaccaatgaagttatttgttaaatcaaaatattataatttcattggaattaaaagagttttcaatccaagcaatttctttctggatgcccgagaaatttgctaaagaaaaatttgaaaaatgagaattttagttattattaatgattatctgcttaaaaatcttaatcttaaaattttttagcccatgaaaagaaaaatcacaattaaaaaaattgtgccttttgaatggcataatttgtggatgatttcgttgttgttgatgtgccaatttgttgtgatgaattattgttgttgttcttgcaatgaagggaagcagaatgtttgtctataaaaatgataatttatattaaaaaatcttattaatttacaaaaaattccataaattaatttattttgttaattttattatttaattgtgcgtatttaattcacttaaaatttcaccagatttaaaaattaatgatggcggtgtgaaaatcgttgttgttgacgctgtggcttgtgttagcattgttgcaaagaatggggggtacattggtattggcacaatgggtggagcagtgccaaaagcatttggtgttggggttggcaatgtgcacggcttaaacagcagattttcaattgaaaaattcgatgtcgatgacaaaattttcatttatataaaattgtatttttgattaactaaaaagacgcaaattaacaaaaattaatttcgtccaaaaaatgtttggaatatgaaatttatgtaaaaaaaatatcatgggaaatttaatgccaaataaggaataattattataaaataatgtaaatttaaatttagcagaaatagtacaagaaaatactttattttcccaaataaaattaaaatggtagtaaagaaagaaaattcatttatccatttgtaaaattaattaaaatttaattgaatgccaaaagagcaaatattaaagttttgttttagtaaaataattatttaatttaaaatgccaaaaaagttggaaaaattaatatgagttttatcaaaaaaactaaattttaaatgcaaaattagaaaacaatttgatctttttaaaatacatttaataaaacgctaatgaaaaacaataataaacgtttttcttgcattttcaaagaaaaatatataaaaatttgaagaggtgttttttgtccaatagcccgagattttgcattccaaaccccatcagtattccattctaattttaatggcatttacggtgccagaaattttggcaaccaaaaaatttgggccacaaccataattcatcagtgataatttgaaggcggcaacacagttattattatttataacaatattatttaggaggaggcgattgttggcaccgcaggtcgagtccatcataagcccctcaaccaattaattgtctattactgtcggtgtccccacaaaaaatattttattttcccctttgtttttgccgatagaaaatggcaccagcggcgccgcatttttaatatttatttaaacgacacccctttcggtcgaccgggagatcaatcccccccccccccttcagaggatatataatgatggagtgaaagaagatttgctcggaaatcggttccccccccccccgcccgccgaggcccgaagagtgactaccggcagggtcgagaatagacgagagtgggccggccggtagcggcggcgccaacaaccgcccatattaaaagcttcctcgccgtatgatcgtacccccccccccccaataacgccaaaaccttttccccgtgaggggggcaggtgtgatg

SEQ ID NO: 20291 - DNA, 2196 bp, Heterodera glycines
tgatttttaataccatatttagccatttttgaatggctttactttatattaacaaatttaaagaaatttttgggaaattataccctcaatttgaaaaatttatgtccatatttttgccattttatgtccatatttcgcgattttatatccatattttgacagccctagttatttatggccattatttttggccagcagaccattttaatcttccttttcgcatccctttcaaatatataatgaggtcaaaaagactttttcattcataatacatatcgcaaaaatgaacagacggtaatgaattcttttgaaaaattaaattttcgtttacccaattttttcccatgtttcagttggatttgtgcggatgtttggttggacattctgccatcttttgaccatgcccaactcggactcaaaatggcattgctttccgaccgttttgatgttttggtggacacgcattttgatggaaaaagcgaattgacaatttggagagaaataataattgacaaggacgaaggaccaaaaccgaaagtgtctgtacggatcgatggcagttaccattttgtggattttccgttgtctgttcgtcaactgccaaacaaaatcagctttaagaacattcagattgagtcattcttaaacttttgtgcacgttaaagcatttttctcttgctttaggtacatcgaccattccgtgatcaaatttctccgctccaagaagcgattctttgacaaaagtggcaccaaattggaagtgtttgtgcattcaattgatacggatgtccaaccgatttgggatatttttaccagtgaaatttgggcactttttacgacaaacattcgccatttgggcttcgaagatggcaatcatttggacaatttgcgtcgtcgcacatcgccaacaattctcactgatcttgatcaattgaattccatcgattccggtcgtctgttccccgatagaattgctgatgatgggccaaatgcaactgctggccaagcgttgtccaaatggttgcatacgtccacaactgatggtcaaccaaagcgattgtattgcaataattattttggtccactgaatctcgaatgggtcaacaacttcaaagaggtgtgtctagccatattttcgtcaatttgtttttgttttaccaatttttgtgtttagacatttcgccgtgccaccacttctgtcagttacacaattcaactttatttttgggtggaacaaatgccaattgaatcatttgaattggtgaacgaacggacgaaggaaaagctgacactgaaacagaatatcgatgaattcgacgtaaatgtgtgtaattggttgttgcaacggtgcccaattggggagatggcgacggcgccagcaattaaatggggagacagcttaaatccgagtgccaatttgaaccatatcagatttgttctgtggagtttcgataaatgcattgggtgagcagcagcaatagcatttgaattttatcgaaaaataaaatatttaattaattttaggccattgtcgccaccagcggaagaagaaaaagcggatcaaagcaatgaaaatgtcgtctgattaagtgtacgggaattaattaattacctaattgtatttgagaaatgatctatctcaatttggtgtgctcatttactctcagaaatgcttttgttaattctttcgttctacatataatattacacatttatatatattttaaataattatgaaataaaaatttaaatgcagactttattttcaacataattctttaataatcatttccgaaataaaaaatattatttaatgcaaataatttacataatgacattttgccaacattttttaaaaattatatttcatagtccaaatttttctccatccagctcgactttttttcgcaccgcttttctttcttttttttgtggcgcctttttcaaaaaagttttggggaacggttggggcgaaggcgctgaccaacgaaatgtccaagccacgaaatgtccataagagtaaaaaacacgaaatgtccaaaagtctaaaaagcacataaaaacccagaaaacggatctaatttagggtttttggagtcgctgagtacgaatatgacatttacctaacccatttcctaacccaggacccaaatataaatataaaaaatgaatgaatttattaaacattcaataaaa

SEQ ID NO: 20292 - DNA, 1676 bp, Heterodera glycines
  misc_feature (1547)..(1547): n is a, c, g, or t
  misc_feature (1598)..(1598): n is a, c, g, or t
  misc_feature (1615)..(1615): n is a, c, g, or t
  misc_feature (1624)..(1624): n is a, c, g, or t
  misc_feature (1639)..(1639): n is a, c, g, or t
  misc_feature (1649)..(1649): n is a, c, g, or t
  misc_feature (1658)..(1659): n is a, c, g, or t
agatcttcgacccctcggcctgatcacggcctctcaaggagggacgaatgtggtgttgagagaccaatcaataagtgagtgaactttgctcactcctttcccttaggcactgttcctccccacatataagcgctggctttccgtccctccatcgttcattctgtcatttattcctcccattgcacttcccttcgcttgaccatttatttattatatttgtgctccaaataaatatttgtcttttcttcatatctgttgttctcggacacaacagattttggcgcagtcagcagagcagaagcgaactgaagctgagcggcgaaagagctgagaagcagcaaaatttggattgctaattccgagttggaatagctgtttccaaaatcgtcaaaaaggagaggaagctaattccgatttggaatagctgttcacccaggtggtggcactctcaatttatggtgttaatccgggacggataacagccagcgacgaatcgccgaatttggaggaattgaattgtaatccgggaaggataacaatttcaattactgatcgaggccgaacagagcaagagaaaaatttgattggaaggtaagactggaaactgagtggcattgttaatccgagttggataacattggccttcatcgattttgattgttaatccggacggataacaattaattctcactgttaattcgagttgaataacagttgaccagccagcaccaattttcattgttaatccggtttggataacaattgacatcactgtaaatccaagtcggattacagttaatcagcagcatcttgaatttgatccgagtgggacaaattaagaaaagtgaaagaatggccgcggtaacaaaggtcggaaaaggacccggtccatttttgccagatatgtgctgggcgacgtggtgggaacggttcgagtttttcatccagctgaaaggcgtgactgatgtcgcaacaaagcgtctgctcctgttcaccgaaatgggtcaggtgtacgaagagcttcggcgaatggcacagcctgaggatgtccgaaccatggaccttgccgaaattgaacaactgatggtggaacgatttggcgaagcaaaatcaattgctgcgtgcaggcatgaattgttttcagccaagcagcagacagggcaatcgataagagactattcagtccaattgcgaagtttgatcgcgaaggctgaatggagccgcgacagcattgacatgtgtcagcgcattgtttatcaatggcatctccaatgattcaattcgggttgaattgatcaaaaaaggcgacaaggacctaaaattcaaggatgccgtcgaatcagccgttttgttggaacagtctaatttggatgcccaagcaattggttcaaatgcaataccggaggtcgcaaaagttggcacttagcaaagaggaccaagaacgccgaataaagcacgagaggttgttttcggtgcggaaaaccggggcattttgcaaatgtgtgcccgaatcagaattcgacatgcagaaaatgcgggaaaattgngcattgggctgttggttgcaaaatcaaaaacagagacggaaatgcgaattntggtcaacaatttgatncaaagccanagaccaacggacgancaatcagaancatttgatnngtcaatgtcagcgtcat

SEQ ID NO: 20293 - DNA, 2412 bp, Heterodera glycines
gttttccgaaggcattgattgtccgaaccgccgccccagaaaaaacgaaaacccgcagttaaaccttaaaatagtgcgggtcctgctcccattgcttcacattgcgtatcatccgctgctcctcctggtcatactgaacatggagtcggccatttttaaatgtgaaaaataagtttaaaaaaatctaaaaatcataaatgaaatttgcgaagtacacattctgaaattcagctatttttgagtatagtcaagattaatcctttataaattgcttttagccgagaatatagtttagataaaaattctatagacttcaatattgcctgatatgatgaatatgtgtactgtaggacctaagtaactgagaatggtcactaattagacacattaacattgaataggcgctttaagtggaattgagccagaaaacccaaatttcagcattttttgaatatatttagtataatttgactgtgtagtatgtttgcatttttgttacacatcaactcaaaaaagcaaatgtttccggtttatgtcaagaaatgtttttgaatgtatgacaaaaagggtaataattcagccctcgcccatttttttaaaataaataaagatcagaacatgtagggtgtttttgaggtcgctgatcacaaatatgacacccattttgagttatttttaacccggacccgaatttgaatgattcacttgctcaaaaaatttttgtcatatggtattaatcgggtgctgagcctgaacgttgtgaattttgcaattttgagcactcctttgtgcgcatttttttttgaaaaattaagcgaaattaaaaaaagtcggatgataaacggaattatagtcaaaaacattagtggcaatgaaaaaataatgaaaacgggccaattatgcaaaaattagaatataaattaaattgaaaaattttgaaaaattgctttaattttgtttgccgaaatttaaaatgaaagtgaatgaaatactgataaaaaaaaaattttggggggggggcggtctcttaagtatgcaacacagcccgcaaacgcattccgcttctgtctgcgacaccgtacaaatgtgcacgcgcgcggagataccacttcactgctacgagtgggcgtgtcatccaaataaggcaataaaaaggcggcaaatatgcgcatttggcacatttcggattttcgtcggattttgcattttttgaatgaattcatccctctcgtgtctacgcgtttagtcttgaatttagcaatttttgacccaatgcctctaattgtcaaatcaacaaaaatgtcccgaaaagatggccgtttgccttcgccaaaattgctgaccgaagccgaactttgggcgcagatcatggatgctcgtcgacatttcatcctgccggcacaagaaattgctaatgccaaccctcaaaatgccgatggtgtcacctcccccaattccgttgccaatattcaggaccatggcaacacctctcaaagtccagttagccttgcgccgaagaccaaatacccgcctcttcaccctcgctacttttcgccaaatttccgtcgtgatcgtcgttcgtttcaccgccactcgttgccacgccgtgctcctccataccgtcggcgtgtttcgccgattcgtccgtctccccgtcgcctgccaaaccgtgattcaccttcgagccattccgaattgcgccgctttccttccggtcgctttttcccgcctcctccgatgccattgcccatgaaccgttctttgtcaatgatgcctaattattctaccccgttccaaccaccacatcagtatcagcgttttgaaatgagtttcaacaattgtaccttgactcaaaatttttcaaaaatgtgattcacctatttttcgaattgtttgtttcatttgctgttgctttaaaaagtttttggtctggtggttgctatggtggataataatatggtatcataggcatttttgacatttcacggagttttttgacaatgacccgtcatcgtaatcctagccatcgtcgtcacttgtccctaggtcactcaactccatattttctattgctctttaagtagtgtgctcttaaccatttttagtctcatcactttccgtttattcatgaatgattcacacagcatttattgaagagaatggccttatatttagatcgatttttaggtataattttcggaaatttttggtcgattcatagtggtgatttttttgcgcattaattttgatttgccaaattatattttttggcttctacaaatccattggaagatgcgcctcaaataagtgtcttaaaatccacgactattcgcccacaatttgatggagtcacatacaatttatgggctaaattgctgacgctttggtcggggcaggccatgacgtggtaaa

SEQ ID NO: 20294 - DNA, 2085 bp, Heterodera glycines
aaatatgtataaaaaaccccaaatatgtaaataaaactttttttaatggtatttttctgggaaagaaaatccccgtaaagtatgaaatagccacaaaatgacataaaaattactttttttttggtatttttaggcaacattttcaaacttattttttctttataaattttcaaaatatgtaaaaaaatgaaaatatgtacaaaaatatttgctgaaattttggattttttttttgaggatttctaaaaatttccgtaaaaaatactcaaaatatgtaaaaaatgaaaatttatatgaaaaaaaaaatccaaaatatgtacaaatatgtaagaaaatcccggaaagtgtttttcctgctatttagagcaaaaatatgtatttacataaaattggcagccctaataatttgtcaaagatggttaaaaaatttaaaatttgtatattgtttgccttttccatcacaaaatgccattcttaggggtgtatatttaaccccgaccccgagtcggggttaagggtcggggttaaccccgaaaatggccaaaaatgtcggggttcggggtcggacggggtcgggggtgcaaccttagatcaaagcatcgaaaaacagtcggagaaaatgacctacaggacaggagatagataattaatgccttggcattaaaagcatagccaaacagagggaaggcacaaaacacactttggcacattattttttcatcagaaatatgctcgcgggcaccaaccattttacggaagaagtaaaacaaaaaaggatgttgtccaggcggttctgcttctccttcgcctcctcttcgacattgtgccaaaagctgtgaatcatccattcattcattttttccatttttccaatttttttgctgaggatgatgatgtgatgatggtgagattcatcatcgttttgccctcattttttattgttttggccccattttcgaaccacataaaattatctgctttccaagcgatgaacggaaatggcagcaaaatgagaaaaagagaaaaagaagaagcgataataaaacgaatttataaaaataatttattgaaaattttgcaaaattaaaaaatttatttttaggaacttatgaccataattttctgaaaattttctatgtgtctgtctttattaaagtttttattccggcgaatctttttcctcttggaaccattcattttttatttttaagaatttctgcaaaaataattttataataagcaaaaattagcttatcatttgatcatttgacagccctaaatattcagttttgcctgtaaaattctttaaaaatgttttaaatttttagcaaaatttttctaactttttgagttttttacttattttaggcaaatcttcacccaatatttgatggacctgaccagccttcgaccatttttatatttggaccctttggcatttttattcaaattagcaaatggaaaaacggaaaatgattaatttaaaagaaaacaaacaaaattagcaattaaaaaggctgaagaatttgtgggatcacgtgaagccgaattaaagcgaattgcttcggaagcagaatttgtgaatgtgattaatctgtcggctgagcaaaattgttcgaaattgggtcggacggaatgaaaaatgaccgaattgtcgaggaaattaacaaactaattacagacactcttcaaacggtcaaaattcggacgaaataatagcaaaagccgaacaaacaaatgaaatattatttataaaatgcataattcgaacttttatgtaggttttgcagcaagcatagaaaattgcaattgataagtgaaaattgaaaaaaaaacaatggaaggtattacgaatttgttgctaattaggataaatataaattaatgtcttattgttgtttatttgatttattatcaggatttctcaactaaaattttcgaaactctcttttggctgtcaaaaaataaaaattttttataaatttatttcatttaaaaacttgtaaaaaaatggcggagggggctaaaatgaaaatttttgagcgttttaaaatcttctaaaaatcctctttattaattttaaaa

SEQ ID NO: 20295 - DNA, 1059 bp, Heterodera glycines
gaaaatcatttttagagcataacaactgatgacagccactgtcattgttccaaagagatttctataccagatgccaaaaaaagagatagccattttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattccaaaaaaagagatagccatttttttgga

SEQ ID NO: 20296 - DNA, 2387 bp, Heterodera glycines
cacttagaaaatggtgggttttgtgtacaaaaaatatggggaaagactaaaaatcacgggtttacacaaattggaagaaagaagaaaaatcaatgatttaacaacagcttttaaaataatcaaagggttcaccagcctcgatgctggaaaaagtttcgttttctcagaaaggtccaggaggcctttacttttacgggtaaagcgccacacggccaaaactcaaaataattttttctatagaatagtaaaaaactggaataatcttccactggtagcggtacaaattaataaggcaaaggaattcagggatttactaaaagcaatgagttctgagtaggattttccatgttgccatatttacactatatttttatcacctgtgaatttttaacatttgattgatttatttttattcattttttattacgatattcactttgtattttttatttgaccaactttatttgttgttttctttttggcaccatataagagcactcatgtgcctttggtttgctcgataaattaaattaaattaaatatctcattaaaaacgttgatggcaaaaaaaaaagaaaaaattcgtttttattttttattaaaatcacataaattgttaaaaaatagtttatagaattttctacaaagtatttgggataaaaaaaattatcaaaataaatacaatatcttctgaatactgacaaacgaatacggtatcagctttaactaaaagttgatagaggagatgggtttttccagttcgaaaatttgtatattcacgatagtgtatatatcgtatctattcgatgtgtgatcacagactgactacagttgcgttacaccaaaatttacagtaattactctgtgtgtctgtctgtctgaccactgctacgaaaaaatagtacataaatcggacgagatcagcagaggggcaaaagggtgctcgaatggcttgatgatgagtaaatattgggtggataaataggagtgcgagagcagaattttttgccaaaactcgagaattgttgagaaattaatgaacaaattgaatttgccaaatttttcctagcacattcttcaggctggaattctaattgcgaaaaaatgctaacttttttggcccgaaattcaatcggggaaaaaaatcaaaaaaaaaatcaaaaacaacacttccaagcagacgaaataccgaccgaaatttgaaaattttgtaactcacaaaggtcacgaaaagacctgaaaaattctaaaattctcgagtcgagtgccaagtgccgagagtctcgcacaaatagcataatttggacaggaaaaaacaaaaaaaaatttttttgctcgtctcgtgtcatgtccgcctccgcttcaggatccgcttaatttcggcttacggacatcggctttatccggtggacagcttccacttgtttagccgctcgcgcatcttgcggaaagtgttcgattcctttgcgcgcggttgccgcgtgcccttggcgacgcctccgtatacctcgcctgttggacttccgctaatctttaaattcataaatgtaagttgaaatttaattttataaattaattaattttaaattaaaaatctttaaaaatgtacaaattaaaaaaaaatcaaatataataataataataaatattcaataaaattatatcgacaatcattccctattttctgaatttcccttttttgatctttattatattaaattggcataattttttcgtaacattttaatgcaaattatttttataattttattcgtattaaatccccttattttgtgctaaattttccttcaaaattaaccttaaaaatattggtgataaattataaggccttaattttaataaattttccatttttaaataagctttcgtcgttttttttgtgaccaaatccttattttagaccgaatttgcttctttttaagaaaatttttatttatcaacggtctcgatttaaatgcggttaaaatttaaatatttttgtgccgcccaccgagtaggatgacgaaattgtgccgtgccgtgggcggaacacgcgctcgtccatgctaacggaacggcgtcgaaaagcggcagtaaattgggcaaaaagtccaccagcgactttctcatttttggcatcatcatccgaatcatcatttccatcgtcataactgcgagttgaagaattgttcaaattctgtaaaattgaccaaaattaacaataaattaattatagtaaagtgccttggtgccaaaaactggcaattaattctcatgataaatgctttatttttaaatgaaattgttatattaagtaaacaaaatatgaaagtacttatttaagaagtaagttttaatataattcatttaataaaatcgttttccga

SEQ ID NO: 20297 - DNA, 2666 bp, Heterodera glycines
gtataagcccacaatggtgagcgattttggtttttcaaaaagttacaataattgattttcataggcttgaaaatttcaatttttaagattttttcaacaaagaaaattgtttccgttttcaatttatgaattgctgaatgcaatcaaaaattttgagctcagaaaacatttgaccggctaacttgtgaaagataaaaacttgcgacgcaatccgcttttcccttcgaagtgtttgtccaccagcgcatttaaatgaagcgaaaaacaaattcacagattcattcccttccctccccgaacagcgccatgccttggcattccacacatcccgtgcagtgaatctgtgcttggttcgccgccatgcaagtggcttgcctgctgatcacctaaattttgattgaaaatgtacttgctcacagaatcaatgcaaagataaaaataaaaactgattgctttcgccaggagcacaaaaaattgcggtgcataaaattatgcaaaaaaacgaaaaaatttcaaaagaccccttcttttattctgcacggattttgccgtctgaaattttatatttctcccgattttttttttgaaatttaaattaccatccgaatttcctcattttgttttccaaccattgcgctcatctccaaaatccattgcacatatttggaacgtccttcgccaacatcgacggcatttccatcggatgattcgtccattttttggcattcacgaaactgaaacaattcaattttgcaattaattaagcacaacaattttattacttatattaattataaaattaaaaaaacaaaaattgctgttaaataaacatttaaataaaataagttaataattaattcaaaaattgcaatttagagaagaatttttgggcaaattttgtaaatcaagggggagtaaaattttaaatttcggtctaaaatttgcgattgacaaatggtgggtgcacttcatttccccctcgaaaaagtttttttttaattttcaaatttagaaatttcacaaaagaaaatatttttaaaaaatgttagtaagaaaagttcaaaaaatttttgaaaaaatttggtagtgttcatcaaaaaaatcgcagaaaagtttcaaaaaatttttttcttgaaattttcttactaacaataagtttcttaagaattttttcccggcaaaacccaccaatttttgtcggatgcgctgtcgctgctccaacaattgctccaacgcgcaaattgtgccgttcaattcggccaacactccctcgagcgtcggcggaggcaataaaatgctaaaaataaatttacatttaggcattatgaaaaattggttagaaaatatgcaaaaaatattgtggaaaaacaatgaaaaccaatacatttcacgcgaattccgaaatttttgaaaaatttaaaataaaaaatgaattatttttaatatttttcgggaaggaaataaactgttcctataaataggtgtctaaaaatcggtgcactacgtttcccgcgtcgaaaaattcaaaaaaatttttactatcttagaaattttcaagaaaaaatcttattgttagagcttttttataagaaaactctaagaaaatgaatttcgaaattttttttcttagttttcttaagatttttcgtttcttcgaggggatgccaaatgtgaaaaaacaacacgaagacttacccccgaatagcaaaacgttcaagggaagagggactgtaagaagaaaatggaaaagaatttcaaaatatatcgggcagaaatgagaacaccgactttaattgtttgagttttttatattcatgaaaaacttactaaaaataaggaatttttttttcaaaaaagccttaaatttttgagtttttctgtgttcaaagcgtggcttatgcacctccaatttttgccgattttcggtcggctcagccaacaattgggtcaatcgttcgtccgttgcgccaattcgctgctgacgcgccgcaatttggtcggccaacagaacattcgcatgacgaagctgaacatgaagcagaaataattgacagcctcttcagtttttttcgtgtttgcctggacctggacctggcttttttcacattagactggacctggatttcctggacaaaaatccaggaaattccaggtccaggaaaaatccaggttgccaaaaaatggcatggacctggacccaggaaaaatccaggcctggatccaggtccaggtcgatctctagtgcaaacagacgccacgcagtaaaaaaaattgaaattttaaccattttttaaaacagattttcaccaaaaaatgcgaattttgtggattttcagaaaaaaattcacgaatttttttttgagagaccatggggggtataccaacaaataaaatcaaaacttttcagcataaaacactatttttagtttaaataatatttcgactgtgtggagtggtacagggatgggtccttggcaaaatgcaacccaaaatgaatgttttaaaaactcacaatcagcacagggttcagtgacaacagttcattgtacagtttgctgttctcggcactgcgcaaccaattgaggaagcatttggtcaactgaaattggacaaaaaaacgtcaattattaaatgagataaattatggttcattgagcccgaaaaaa

SEQ ID NO: 20298 - DNA, 1098 bp, Heterodera glycines
ttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagaatgccaaaaaagagatagccatttttttggacgtccatacctcacatatactcaaacggccgaaaatcattttta

SEQ ID NO: 20299 - DNA, 1390 bp, Heterodera glycines
aatgaatttaaggatttcacgaggaagaatggaatttcccatctgttttgggcaccgtactgcccgatgtcgaatggacaggcagagcggtttgtcgacactttcaaacggacgtttcgaaagttgaaaaaggagggggtagcgaataggttggatacgtttttgacaacctatcgtaccactcctaatgagtcgctcgaaatatggatttattcccgaaaacccccaaaatatggatttatatggactaaaaaccttcaccaaatcaaaaaattttaacgcagaaatgctatttttaagcccctttcttcatagcatatgcgcagaaaaaatatgttaatccatataatttacaaccattgaaaatcgcacaaaaagctttgggatacgattaatagtcgaacaaaatttaatataactttttaaataaataagtttttttttaatttttataatttcttttcccaattttcctttgatatttaatgtgtttaattacaagcaaaagagctagaaaaagtcattttttgggggatcaattcgcttcccgtgccccccccctcccgagattaacacttcgtagtttacatcagccattaattacatcactcttaatcctatgtttatattcttttacttcttttttcacactaaactcgaaacattgccaacaaaaatgactaaatctctgaatttgcatatgaaatccaaaaatatttaaattatgaataattttttaaactaaattttaacaccagatatttccttttcttctgtgtttaattagacagtgaatgcaatttttacatataaataaatacgaccaaaccgttgaaatatggactttaaatccaaaatatagaaattgagaaatttaaattcatttttttgttcctttccttataattttaaaattgaaaaaattccataagtaaaaagtacctcttgtcgtttatcgtccattaatttttcgcttcaaaaaattctttatttctcctcctcttcggtgccaaataattctggaaaaatggtcaattttcttcattttattttgtaaaagtgacctttggcaaattttaggcaaacattacttcaaaaaaaaggacttgtcctttctccgacgctgaaccagtgaaaaagccaaaaaatatgtaaatttattttaataatttaagcaataattaatgatttatatttaaagcgaacccgagcaatttgataatgggtgggtatataaaaaaattaaaatgtatataaattatattcaaactttatagcggatttggcacaaactctttgttgtcagtaaatatatatattatatataattataaataaagaataaatagataaatattttataaaaataaataaagaatatatttattat

SEQ ID NO: 20300 - DNA, 1936 bp, Heterodera glycines
ttaatgtagttgatgttgtccgggtccttaatctttaccaaataaaactaatacttcaccggatggtataaatttcagggtaattataataattgtttcctttcttttgcaccttatgttaccgaacttttcagaatctcattagatatcggaaaaatgcggaccttttggaaaaaatcaataatgattcttctcttaagaaaaggggataaaagttgtcttatcaagtatagatcaattgccctctcatgttcactgtgtaaactatttgaaaaatttgttgtcagggcaatttctagtttcattttaaaacatgacataatctcagtacaccaatttgggtttgttaaaggtcgttctactgttatcttacttattgtaactcattgaaaattggttagccggtatctgcaatggaaaaaatctagggtatgtttattatgataataatcaatctaaaatatttatgtctctaaaatgtaatttaatctaagattaatatatatgtcgatagacgtaagatttctatatggatatttaaatttttggaaaatttcattgagtttcaaaaaagttaatgaacaaaaaatgctgaattaagattttttgcaattttgtgaccataacttcttttatacttaagttaaaaatataagaaaattatattatgaaagagagcaattaaagctattgaatggataccacgaaatattaatttggttgaatttgagccaagctattaatttaattattttacccattttttgttttcaaacccattggcagttttaacaaacgcgctagcacctggtcaaaataaaaataaaatatcggagagggactcaacgaaatttctacatccgtttttcaattctcaaacatttcttctccaaattgttttttcatctttcccattttttcttcatccgttattttaccgcgaatgccaaattgtttcttccatttgtaaattgttctacggctaactccaatttccttacaaatttccgcataattttgcttccattctttatgtgaatattttcttttttgcttatattcatttgtcattttaataaatttttgcacaattacaattttttcttcatcagttgttgatttatagtttttatgaatttgtttttgaagaccaaattctttgatccattcataaatatatttgcgatttgtccccaattttttcgctattttttcttcaattttattccattcttttgttgaatattttcttcctttttccttaattttctcttttattttataaaattttccaattatttctctttttttgagttcatttagttttttttcttctttttcttcccatttttctccaaatatttcatcaaatgatttttgttgcaactttttcttttctgctccaatttgatcaaatttaatattaaaaattacaattagaaataatatagggaataatttcattcttaaaatattttccgattttttttaaataaaattaaaattaatattattttttattattgatgatcatttatttatttatacatgaattaaaactgacacaaaaaaataatttcttattaaacaaactacaaaacaaaaaaatactcttctgacttccgtaaacatttaaaaaaaattcgattataattttctattaaaataatcataataattaaatttatttattttttacataataaaaaattgaaaattatttaaaaattgaattttcccgttgcttaaagattgcctacttcattgggcacgcggattggcaggtcaccgtttgtgtgccacgcgaggccgaatgtttggtgatgtttgaagcggcggaacgcgttgacccggagatcagacgggcggtggaacgccgcaacgaatgctatcgggtggcattcagctatttgaaggtggctaaattgaataaaaa

SEQ ID NO: 20301 - DNA, 2729 bp, Heterodera glycines
  misc_feature (935)..(935): n is a, c, g, or t
agccattgttgttggacagaattgactgtttgtccttcaattaatcaatgattggttaattgattgataattatagccctttgatctccccgccgtttactggttggtccttggccacataaatgaccgtcactttatgcacttcacggctctgggccaagtcgaggtgccgaatttcacggtgaaaattggtgggcgcgtgccgaagtcgggccaacaggccgaaactggccgcaaaacggcaccaaccgcgccgctcaacagcgtcagccgacatgccggcatcagcgtcgccaaagtgttcatcattaccaatgttggtgccgttgcggatgtttttgttacgacatttctccgccagatgccgttcatctgaaactgtttgataagatgagatcagtaaaagtaagcggcatcgctctcaattccccgaaaatttttaaaatttgatctaaaaattgccaattttcggctagtctgtcaaaaattccaatttatcccccgacgggtttcagagaatctcaaaacgtttactcagataataaaaattgatttgtttgttttttcaaaattggcccctaatataaatctcaaaatggtcatttaccttggccattcagccgttcgtcaggacatcggttgctgctgtggacgaactgcaacatttcggggccggtgatgtcgaaatggggcaacatttgttgttgttgctgctggtgattgttggcacaaaaggaaactgaacgcatggacggacgtggcaaatccttaaaacatttttagatagactgaaaaaataaaaatcaaaaactgttttatagcatttaaaagaattttttatgtgtaaaatcttaggctaattacgcgcctaattactaaaacatttacaacaattattaatttaatttgctataatgtccaattttcgagagagntttcccgtattcccccccccccccccctcctctccttcgtccgaatacgtctcggtcagctgctacctgaaacgggtcaatcggggcaccgaaggaggacgacttttgccgaacgctggccgccttcgcttggtgaagcgacggagcggcgccgccattctgccggggacaggccaacgaattgagccattcttcgctgcaaaaaaaaatagatttaattttagcaaaaagaattaatgttttacacgggcgactccgtctcctcctccatgcaaattggctgcatacggtaacagtgtcggccgacatgggtacgcgaccaaagactgttgctgtccttgtccaaactgaaaaattgtgtaacaacaattaattaacgaatgcaattgggtgggcattttcccaattaaagcctttgccgaaaaaattgttttaaatttcgaaagaaaacctcatctacaaaattttaattttcttttgtctcttacactttcctttaaaaaattgaattttaaacttttacgtaaaaaacaaagtatttttataaaattttatgaaacaacagggtggggaaacacgaattactccagtttcaaaactcctcaaatttgattggtgttcaattcaataaatacaatacgcctgtgccatttgctgcccgatttgccagcgtttctgcccccccccccccactcacttcagcacggcaccctccgtctccatgaaggtgaccatttgttgctgttgcagttggtcgccgccaacaccgtccccaacatttgcctgctgctgttgttgttgctggtggtcatgtggtgccgttgtcgctgttgcggttgttgagggtggcaacgaattccattgggtgaccgggaagccgggcaatggccattggccggacagtcgaatgacaaagccctcgaaaaagtcgtcgccggtggccacaaatttgtccgccaagttggaccagtgcagcgagatggagtgccgtgcgaacaccgcacacaaatgccatttcagctcgttggcaatgcgcaaatgctttacctttgaaacaaggaaaaattggcactttttggaaaaataattgatgttttttggaattaaaattaaaatgaaaaaaaaaatcaaactcgaattaaggaccgaccaaaattgaaagattttcgaaacttattaatcccataaattaagaaatccctgaaaaaaggaaacagtaaatacccgcgccagtgattggatgagtgaatggacaagttgagagtggaagcccaaggtgatggaggaggacagatagcacagaaaacgggcaaaagcgtggcggtggtggtgctctgttggcccaacatcagcgcaaacagtcgctcgaagagcggcgcgtcggcacgctccaacacctttgggagggggggggggggaatggtcagagtaaggaaaattggtgatccaacaacaaaaaaatgatgtgaaattcgaaataaaaataaacagccgcatggacggacgtggcaaatccccccccccaaaaaaaaaattttttttcggcactcattccgtatccccccctccctccctctccgattccgtctcggtcagcatgtggtggtcgctgttacctgaaactggtcaatcggggcaccgaatgaggacgacttttgccgaacgctggccgccttcgcttgctgaagcgacggaatggcaccgtcattctgttgggggttggccaacgaattgaaccattcatcgctgcaaaatatttaagttttataaaaaaaataataaaagtttattgac

SEQ ID NO: 20302 - DNA, 2383 bp, Heterodera glycines
ccccccctttcgcgtgttaacctaatacattaagtgttgtttgtcgtctcttaatgaattaattgcttcttttgattgtttgttctctcttgacaatgcattttgttccaaatttgcctgtctctctcaagtgatattccttttaaacgattctttgtccaaaattcacttaatttcacatttttgattctcccaataagcgaaatgctttctttccacgacattttcttcttattccaaagccattcaattattgtttgtttgttttcccatgacagctgctaattcacgatgtttgttgttattacattcattcttttgtcgaatacctcttccgaataaattttgcaatttttttggaatctcaagaattggtgtcccgaccaaaaaaactattaaaattttggcaggtattttttctaggctaaaaaaatgtgctgatcacgaatctgagctcagattttgaaaatcattgattttatctaagattttttgtcaattacttgattttttccaaaattaagaaaattagtcggacataaaaatgatactaaaaagagctttcgaatgagctattgaatgtataaagaagtagttttaaattttttacgattttttgaaattaattattaatccctaggggtcagatgagacggagacctggggttcgagtccgtttggctgcggtttatttttttatgacacttgatgaaaaatcatagacaaaatgaaggttcatgcatagtcagagcttagattcgtgatcagagtattttttaacccaaaattcattgctaaaaattttttaaaaataatttaaaaaattgaaaaaaatcaagtagttgacgaaaaatcttagataaaaatcaatgattttcaaaatctgagctcagattcgtgatcagcgcattttttaagcctagaaaaaatacctgccaaaattttaacatttttttcgtcgggacaccaattcttaatgattgccatttttttgagtcaccaattagcgatagacaaaaatttttctaaaatattttaatttttaaaacgaccatttatcgaaaaaccctacattatcatttaaaatattttatccatttaaaaaatgaaaggatcggaaagaaacaaaagggatgagaaaacaattttaaagtgaatcacattttgggattgttttttgccgagaactgtcactcgtaatgaaccactaaacaaaggcgagtacgtccccgtcgtcgatgtcgaattgtcgcaacaaattgtccctggtgcgacaaagcaattcggacggatacgcggggtccgctcgtcgaagttcgaccccttggaaaaacgcaccaattaaattgaaaactattagggaagcacgtcgttaattatggttacgccctgcccccaaacctgttaatgtgtcgggagcaaaaccgaacagtcgggcgcccaaaccgacgactttgtggatgggcagcgcaagggacagactgcgctccatgctgcgacccgcgtgctcaagtcggacctttttggagtgaatggtggagaagggctgggcagggcgagggacggaaacggcgctggaggggtcgccatctcaaaaaggggaggataaaaggaggatatgggggcaattggtcaaaaacggatgtgtaaatgcaggcccaccccttgtttaagtggaaccgaaccttaccatttgaaatggagtaaatggtcgccagccgtgcgatcgtcgcgcggtgttcggccgggatggggtcggcaccgaatcggctcaaaaaaagcaattcggcggaacgtcgtgccaccggcgacacatcgcaacggtccaaatcagtctgaagacgggcggggggtttcaaggttacatagaacggaacaattaattttgttgattataagctggcttacacacaatttggggcagtttggcgatgatcatctcgcgactgtccacgccgcgggcgccgggcagcggagcgcctcggagaatgagtttggccaaatcggggagacgggccaatccgtccagcgattcccactgaaattagtcagttccatctatatttttcaaaatttcttaagagaaagctcataatccaaaatccgacgatgggaaggagtccaccaaattcgtcttcccctccctccgtttttttacccgactgatcggattgtcctgcagaatcagcgttttcaaagcgcaaaagccactgccatcgccaaaattcagtgtttgtagtgcgcaagaggacaaatttaaataattcaaactgaaaacaaaaagcgaccatttgcattttccaagaaatgcttttaaattcactttggcaaatgcgaaagggtcaccggaaagtgggcatttggcgtcgctttgcgtgccgat

SEQ ID NO: 20303 - DNA, 3192 bp, Heterodera glycines
atccactatttgttgtacaacatcaacccaattcagcgtttccctttcggcaaagtatctgtacagtcgctgcttcacatttcggattgcccgctcagcaactgaagctttcactgacgaatgcacgggctcatgtttctcaatctcccgttcctcaaagaattccttgagcaatttgtttttgaattcggtgcctttgtcggagaaaatgcggtgtgggaccattggcatttgcttgacaagctctttgaatgcatccagcatctcctcggccttcttatttttgagtggaacgacaaacaggcgttttgagagaacatcaaccgcaaccagcaggtatcggtgaccgcgattgtgacgagaaagcgcttgaaagtcagccaaatccacttggacgtcggtcatgaagccagcagctacagtttttgctctcggaaatcgtacccgcctggggcgcatcagggtgtacgtgcggtgtccctccaaatagtgttgtacatcctttttccgtagttgttttaactttttccgcgcctccttccacagtgcactaacaccggcaaacgcagcaggagaggatggatcgttgtacagcttgtcaagagtggtgttgatcatttccattttttcggctgaaattccttctttattgacgtcctgctgcttgtgctctgcgatggtctctttggtggagccgttaatgaatacaaaattgggtcctgcctaagccgctcctccaattggtccgctcccggtggtctaatggtaggtcgacccgctcttctgtcaattatatacctgatggccgttcgcaaattgcttcgcaccaatggctgagcattttgagtgttgataattgcgtttccccggacacccatacgatcggcataacggttgcatttgatgtatattagctcaattctctgtgccatggtcagctgatttgacggaatggcaaacagttcacgttgttgttgttgttcatcgctttgtgctgatgttgatggacccggctctggtgagtaatacactcgtactcttcgcgcttgcctcactcgtttacgtatgcgcagctcaccactctcatcaccattttccggggggtggcgacgtttggtccctctcctaggtggcggaacagacgacacttgtggggcagcaggaggaggttgctggtgccgtggcactgtttcttcaatttttggctctcttttcggaatatgatagggtgtggcgcgaggaggtggcttttttgacggtttctgttcatgttttggttccgcaggggggttgtacccggcttgccgtgatgtggatggtcgcggatccagatcgaactttggctcccttttaggtttgcgatcaacttgttgtgatgtggatggccgaggatcgagcagtggttgtggttctttcttgaggctaggacgcggtggaggtcgaggtgtttcaatttttggctgtggacgagacgggggtgggcgagaagggggaggaggataataggcccggtattttttgcgatgcaaatcgtcatcgccatcatgtaattttcttctggttgcaatcctgtgctgtgcagtgtccatctcctcaattgcgtccgcgttgtcaggcagaacgggcaaatcgccataatattgtgatggtgctggcagagcgaatccgctctccaacatgtagtcatcctcttcgtcactttcgggtagcggagcagcagctgcttcagcaagaaggtcccgcacaaccggctgccgttgttgtatgtcgtttctcttttttcgccattcctccacacgcccatctctccgagagggcggcgcagcagctctaggtggtctcggaggacgctgtggacgcggcggaggactccccggcggggacggacctgggcctggagggcttggtggacgacgaggaggatgctgaccaggaggcggtggtggaggaggaggacgaggagggcggggtggtgtatctacaacttctgcttcatcatcagcaccgcctcgcctcatcagaacactcaatcccttgactagctcaacccgtgctggtttgtccgcgacctcccgtctcatttgcaagtatcgcctaagctgttgattgtagctgacatttttagctgaagggtttgttcgttcagccctggcacgcgtcaaatcgtgtcgtacagcatccaaattgatgtcacccgtgtccgtcgcagaggtgagaccccggtaaatttcttgtggtacaagcacaaatttatttgccattttatgaaacaacgagtgtgaaataacaacaatttttttacggtatttatacatttttgctcacaaatgaattggcaacttcaattaacacgggtgttaggagtgcagcgaacagtccgccaacccctgctcccttctgaacaatcatacgtctcgcgcctcgttcacttctcactctgctcaggcagcgaacaaaatctgcgtagggcatcagcctgttcttctgacgtttgttcaagcgaaatcgagatgcgacaatgttcaaacaaatttccaccagcgctagcagttgatcagcgttcgctttccgtatcagcttgcaacactttttcgcggacctcgttctggccagcgcacaaagccatttggaattctcatggatgagttgactaattttagcttgttcctcctgactattgggctccattctttggtacaaacacaactaagccttgatcctcctcttgctcgtccttaaatatatttgtgcgtaggcgcagcacggggtcagatgaggcgtgcatgtcaattagtaaatagccgtatgggcgagcggtcgctttacgataggcgtcaagaaagaagtcgagttgacgcgggaaaagctgtacgccaatgttacggatggacaacagcgagttgggtgcccgcatcagtaccaggtactgggcggacagacgggccactttgatctttcgctcaaacaaattctgcgtaacgaacacgacagcaaattggtggtggtgggactttttggtgaacaagtcggacaaatagtgctcatcaatggacagcatcaagtcgtcgaggatcagcaaaaggggctttggcatgcgtttgatcagctcttccggaggaacacccgaataaacgtcaacccccgactttgcagaagggtcagctgaattcatttcaccaaaacagtaaaggg

SEQ ID NO: 20304 - DNA, 1266 bp, Heterodera glycines
  misc_feature (10)..(10): n is a, c, g, or t
aattcgattnttggcacaaacaaaaactgtataaggtaacctactgaatggccagcatttgttgcacgattggaagtaagaacagaataaatggtggcaaagtgccaagaagacaaataagatacaaacgtgtccgttcgcgcaacaaatggtcaatggcattatttgatgctggaggcggataattagccgtggaggagaaaaacgctgaaaaaccaaattataaaacttgttggaccgttaagcgaaggattttcattaaaacaaaagttcaatgatttaaaaataattgcggaaatagaaaaatttttaatctcttttgcaatttttatattcttttttcatttttttctttattttaattttaattaaatcccgtgaaattaatatttacctttcttaactataccaaagaccatataaatgacacaaatacagtagaggatgggaggagttaacgtagtaattgttaagaatacagtaccaattgtcagaattagtgaagtaattaaatcaggttcctaaatgataaaaatttaaattataaataaaaaaacaataaaatacggtaatcattgctggtggaaaaaaggtttgcaaattttgcaagcacatggaatagcgtaatgcaggtcgataattggcaaagattgaataagcagtactgtagatcaaacacacagtgatgcaaaatttcgttttgctaaataaatttgtcgaattataatttttattttttctttcattttaaaaattgacccaaatttaccgaactgaaaaaagtacacgccccaaagaagcagcagaaagtgcatgacattctgaaaattatagtcttttttaaatatattttcattacaaatcgccaaaaaaattcaaattataattttcaaatcagtttgaagctcattactggtttgattttctgtatatttcagtgaataaaacctgtaaccgcgttaattacttctcccgttaccggtcaatttgtgaaaaacttgctaatcaaccgacaaagataagaacaggtaaattatatcttacagatcatatgagttaccatcagcagagctatgaactaccgtttttgtactttttcccccatttttctcgcccaatgttatttcatcgtttctttgttttttcttttattttatcactttgccactgaataactttttatattcttttcttttttaattttccgcggcgaagtcgttagttattataaaactatcaaaaaattaagtttctttttaaatttaa

SEQ ID NO: 20305 - DNA, 1288 bp, Heterodera glycines
gcaaacacaaaaaagaaagttttttcctactaattaggctatggagaatccaggaaaaaatatgtatttacataaaaaaaagaatccctgcttattgacataatttactagttcaaattgcaatgattttttttaattgaatgagtccatatttactagagtatttttgtcccgaatcccaacttaaaataactatggattatagactcataaagtgcacttttattccttacaaaccaatttaatgttcttggtaacattcggtttttgagagatttgatttaaaaaactttaaaacgctgaaaattgtcattttggcgatttatcaaacgttgcaatttattttatgttcttttctgccgcgcggaacaaaacgaaattacctataattaatttttacatgacttaacaccttaaaactatcatatttgaaaaagctaaatggattataattttgggcatcatgtgaaattaattacagcctccaattataactacttgataatgatgaaagggataatttaacgaaaaaatttggatgttattcaattattaagacaaaatttgttaaaacaccaaaaattagagtctctatttttatgttaaattttacattttcaaatctcgacttattaaaaggatcacgatataataggaagggtaataaaattgatgctggtgtttcttaaattccttcaatgggtttgaaaacaaaaaatgggtaatatatataaattcatagcttggctcaagttcaaccaaattaattcaatagctttaattattctctttcagaatataatttttccaaaaattttccttataaagcattgaacatgctgtgttttttgccatggtcatgcaaatatatttataaacctttaaaattttaaagtctttaaaatggattgagccaaaattaatttttatattcgtagccctaagaattctctatttacctttaaaatttcagaaaatttcattgagtttcaaaaaagttctggacaagaatttctgacttaaggtgatgacaataatttttttttatacttaattggttgaatttgagcaaagttatgaatttatattttttgttttcaaacccattgacggaatttaagaaacgcgccggcacgataaaatttatcggcgtgaaatttaaaatcgatcgattttcggtgctatagagaaaaaagcggtcggaaaagaatagttcgataaatttagaaagtcgaaaagatgatgaaaaaatcacaaattgttttgcctttgtcgatgaattttctta

SEQ ID NO: 20306 - DNA, 1634 bp, Heterodera glycines
ctaaacatatagggctgtagaatgatgtcaaatttataaaatttgtccagctgagaaaaaagttatgatactttaaacttggctcagactataacggccagactatagtgtcccccccccccccgctatgcgtaatactgaatcctggtccgattcagtattttgcgattttcgtccatattataatccatatttttgtcttttgtccatataaattcggtccctatcaatttgaaaacgcaatagaataattcaattaatacacacatcaataaataacaattacaataaagagaataaaaatggaagataattaattagtatgtatacaataaattacaagggaggggaggaattaagttaaagggaatgtattaggtatatacaatataatataaggggtagggtattatatacaacataatataatggaaaggaaggtattatttacaaatataattatatcaagtaattaggaatatacaatggcagtacattaattagcgattaaaaaggatttttggaattgatacatacaaaatactgaaatgcacaaactgaacacataaattttaaatttaaaatattattttggcgttttatttacatttcagcatttagtatgctatgggcaaataagttataggaacgggtgaggttgccgtggccgggcccgcccgttttgtttgccttgttaattgctgcataataagctggtcgcgtgcgctccctcagaatgatggggttaaagccttttctggccaggacgaaattccccaataggcgggcacatcgaccattgccattgcggaatggatgtatgtacacctaatgaaatgcgttttcacttagttattgaatattttaattttaaaaggtactaagcgatagtgcatttcggcgacaagttgaatgacgccgaggtgttgttcgtgtttcttgaaccatccaatcagctcgttcatcttcaacggcacaagccggtagtcaaccggaatatggtctccgacgctgacattgcaagttcggagccgggccgcatctcggggctcatggtagtctctttgatgcattttctggatcatattaaataacttcggtcgctgttgtcttcatccggatgttgtcaaatgttgaactgccgtctatataaataaaaaattgcttaaaggggaaaatacaaaaaatgaagattctgtgaaacgataatgcagccggcgctagtttaaaagcgggttcttttgaatttttttcatttttttggtctaaattttttttctttattttacacataatgatggatatgtgaaagcaaaaaagggtcgccgtcggagaaaatgtggactttcgtatgtaaatctggtcctgctggcgcaccccatcctccctacgcgccaaacatccaggtacttccgtgttttgctacccccacctcaaaaatttttttaaaatattatttttaaaaaaatttcgaggagggggtagcaaaacaaggaataccattatccatcctattggtctcaccctgtcgctcacattgtgcatgtatgcacgaaaattgtaaaattttgttttttaaccacgaaactcaccattttggcgcactaaaagcgcaccttcgccctggcaatgta

SEQ ID NO: 20307 - DNA, 2129 bp, Heterodera glycines
  misc_feature (2091)..(2091): n is a, c, g, or t
cagtcggtcggtcgcttctctcacattgttatgtcgaccagggcacggaatccgctgtgttgttcgagtttgcagcagcatttcgtactgtcgcatcagcacacatctcgggctctccctctccctgctggtgccggtccgtgccatttgtgcggacgtcgtcaggacggagtcgtctcggctcggcagcgaacgaacacaacacaaaaaagtggcacacacaaaaacagcagtcggcggcgggtgttctcggcactggtgagttgcagcaaaaaggctgaaatgaatggaggtgaagaacgacagaatggaggaaaatgacgaacgggcgcggtgatattgcttgatggcatccccccttttttggcagaaaatttttttttaaataagccatgaagagcagggcttgaaaaaattttagtttgaatccgattttggacataggcgcaaatgctggggccgcaaaagtcgggccgcaaatcggactccgttgtaaggatttttgggatcgctgatccttcttaaaaacaaaaagttttctgccaaaaaaagtggcgggggggggggggtaccatcagcagtatgtgttatcaagtggcaaggggcgaaggcacttacagtgaaaaggaagcgacgaaacagcgaatggaaatgcaatggtcagccaaaatatgctccttttataggggcaatttgaggcaaaatcgaaagttgtaagcgcaaaagattcatccctgtatataaatagcacaatccacagacatttcttcattctttgtaattccgctactataaaattttgtggtattaagtacatatgtatatgtttattaaacaatatttatgtacaatagaagcatccaaattaaatcttctttgatcattggatatctatgaggttttaagtctaatttggttttagaaaaaaaatgacggaaaagaaatacttccataagaaattttggtaatactatagatggtgggtgagccccctttttggataaaattttttggttttaataagtcgtgaaaacatgtttatggtggttttcagggtcgaggaacccgaatccaacatttattttgaccaatttcgaatcctggacccgaacaaaaaagtcgaaattaaaattttcaaaattcactcttatgtccgtatctgtatagaatgaccattttttgatgctgcaataatttttgactaaattcagcttattttgatcaatttagaacaaaagttttttaattttttaatattagttttactttttactcgttaaaaacaaaagcctgcttttaacagcaaatgtgcaaaataaatccggtgctatggaccaagtacgacaaaatgcaaatgattaaaatgaaatggaattaaaacaataagaaaataaaacataattaattcacaattattaataaacaaatattttaatgggttcattaatctcagcgttcatcagatttatcacttatttcaaatgccccgtctccgacgattaattttcccgcgcttttaaaatgccacaatttgaattacgttccatattacagcctccttcgtagcgcgaatttgcagaaatgaagttgcaataattcaaaatatttgtgtaaacttctgaatataaaaaatgaaaaatagaaaattttaaataaaaagaacgaaaaactattttttaggtgtttaaatcgtaaaaaaaaagtgccaagtagggattttaggttggcattaaattgtccattggattttgtgccgccgtttggcagtccaagcaaataaaagcgtccgtttttttgcaattgaattggatttccatgagtctaaatatctatgttgtatgtaaactttgtaaacaatttcgcgaatttaaaaattaaattaatttgctaacattcagaaaggcattttttgtcgaatttgcacacaaaaaagggatctactgattttgctcatccttttttgcggtccgaagcttttccttgttcatttgactgaattgtaatctgttcaataattcaaattaatgaatttaattttaaccaaatttgtgttttaattaattaattttatttgttaaattattacctaanttatttgaaatcaattttatttaagaataaatttagtt

SEQ ID NO: 20308 - DNA, 3287 bp, Heterodera glycines
  misc_feature (652)..(652): n is a, c, g, or t
  misc_feature (3266)..(3267): n is a, c, g, or t
  misc_feature (3276)..(3277): n is a, c, g, or t
ttgtttgaacaattcaaagtgttgtcattgttgttgttgttgaaagatgaatgggctaattcttttataaaaagtgaatttttaatttaaatttaaataatttaaatttatttccatttttaccattaaaattctcttcattttcatcagcagaaaatgagttgccaaaattgctctcaattgacgtgtccaaactgccacagctgcaccggtcgtcgccctgaactctcaaaaagcagtggtcgcatttattcgacaaaggcaattggacctaaaaagcgatttaattttattttttaattattcaaattttaatttgccattttgggctgtttttggaaagtggccgatgttttgtggttaaaatgaggaggcgaaagaacattgggcctcggctcagctgctgtttcatcgtcaatgacttcataactaaaaaattgaaaaattaataaatatttaaaaatgccaattttattaatttttttacaattcttccgaaattgttggcaataattgctgagttcgtgtcgtttgaagccgattttttgtgttaatgaacggaggatgattctgcggggttcgatgaaacacaatttggcccgcccacttttggttgtctttgttttggtctaaaataaatattcttttttanaagtaattaataatattcaaaattaattggcaaaatatcataatttagttcattaaccgatcattaggatcaattagtgtcttaattggttggaattgtgttttgcttttcgttttgccttgcttttcccgcttataattgtttctgctattgcgtcgttgacgttcgcaaatgagcagcaaaccgatgaaggcgagcacattaatgcccgtggcaatcgctaataaaatgatgagcaaattggtgcgaaattgaagcggaaattggcaaagaaagggcggcggagtgtccttaataaaaacaatttgttaattaattattcattaactaattagagagggctcaaaaagagtggaaaaaattacccaaatatagtggaaaaaatataaacttatcttttaaaatggcataaaatcagaatgttgccaacgaaaactagtatgtaaagcaaaatgggtttagttcagttgggccctcacggttgggccccaacatgcttttggctatgactttttttcgttgtcatccaaatccaacaatcttggtatcattcgaaagcttcacaagtttagaagctatttctaagatattattgcctcgcgattagacaattgctaaaaaattatagcatgaaaatttgcaaaaaactctaaatttctgaaattttttcttattaactttttcaaaagccaaaaaacctttttgctttttgtaagactaatagagcatgttaagagctttcgaatgataccaagaattaaatctcaattatggcgacttaaagcggataaattatccaatcaaatttgattggttaccgtaccattgaatgcgccatttccttctgctgagagtcttcacttaaacaccagggacatcgatgccgaaaaagttcaactaaatttatttaaaaaaaaaattaattttcaataaattgaaaaatcattttccacctgttaacgtggtgttgaagcactgtgcgtgaagttcaagctgtatcttttcattgccctcctcctttttgtggtcatttgactttgagacaaattggaaaacggacacaaacgacgactcgtcacagattcgggagaatttgaactttgggtcaatgccatggacaagggcctaattggaaaaaaacaaattaactaaaaatatttaatttattattattttgcctgaattgtcacatcgcttggccccccgcgagcccaaaatgtgaaaaattccaacgaaattccctgtaattgagcttaaaaataaaaatcgaaaacaaatctattgtgctaccggcacttccgcttttgttatcgaccaatcccgcgaaagccgctcattaaactttggcatttggttaatgagggaaaacctaaaaaggcaaaccgacaattaagcgacagtaaattccttcctaatcaaattaattatcaattatatgtttttatgagagtgagagttttaatagaaattttttttattccattaaaaaatatctgttcaaatttttactttttttagttttctctctcataaaaaattattcaaaaatccctttttatgtaaggaattaatttaaaaaagccacctcggctcagcacaaagttgcgtggaaatgcagtctctgcgaaaacgtatttgttcaaccgaagtgctgatccaaaattgttgttgttgctgatccgaagatgacgacggagtgctcgtggcatttgctgaaaattcagcggacaaaacgaaatgaaagccgatcagacgaaaagttatcagcagaaaaaggaggagaggagaacacttgtaattatgatttttataattcgtcatcattagcagcggaaaatggcaaaaattattaaaaaggaaacaaagcacaaatgaaaaaaagcatttaaacaaaaaattaaatttaattggtgaattaattaaaattaaaaaagatttaaacaaaaaaataaattgatttggttaattaaattgaattgtttaaactgatgagatcattaggaagcaaaatgatatgctgaagaatatttgtgtcgaatgggtcataaaattgctttgtcgtcatctttgatgattggcatgcaaaatgaaaaatgagcgatttgtttcttttcgtccggattaaggaggggcgacgaatgaatgaaaatgaatgacttatgaatgagtggtagtgggaaggcgttttgatttgatcaacacaatgggcacagattggaggagggcacttcaaagggaaaatggggaggaggaattgcttaatgagttgcctaatgaatgcccgcccacccacgcaataataacgtaagaaatagacaattccattttaaaatggtttttcaaattttcgagttggacatgttttataaaattaaattttacactggatttcaattcaaaacagagaatctgtctcaaaatttagtttattctcatcagaaccttcaaaacaatataacaaacagtcttattcccgtccttttatcattggtaatccttttggaaatctgccaatgagcaagtgagcgaaattgcgtaagtggcagtgatcagaaaaattttgaaacggattcctgaaaacttcttttttttaacctccatttgtcaataaggnnacctgcagnngccatgcaag

SEQ ID NO: 20309 - DNA, 1638 bp, Heterodera glycines
tcggctcgctcctgaatagttagaagaagtttaaaccttctggtggttggttacgcttcagttaaaacacagacgcactcgtgcgctcccacaaacttaccaatcgatggtccccgtttccgttctcggataacatgtggagtagagttctacgccttcgatcaggtcaagtgtgccgttcacaagcaccggttggtcagcgtgatcctcgttggcaatgtgcacacaaacgaactctgcgagcgggtttgggtaatattcgcccggggagctcaaaatttcctctttaaaatatgcgtacagctcttcaacagtttggagcgcaaatgtttgtagaaaatgctttattgctctttgcattaaatagcagccggggcagcaatagaaagaaaggcaacaaaaataataacaacagaacaaatactaacaatcatcaaacaagccggcaagtcaatggtacaaaatgctcggcttaaatagtggttgactggttagacatagcttcgctgtcgacaaacgcgtcacagcgtacactggattatttgtagacagaggcgaaagctccgccccccgagttaggtaacgaaagtgactggatcagaccatattcaccacttgtcagtgccatcatttccgtagtgtgtactacatcgttgctgcgagcttggctggtgttgtccgggcccgaatttgatgttgtacggcgcagtagtcggatcacacaaacggcaatgcagatgactgccacatcaaagaggtacatcaaagcgagcaggagccgctcaatgctgttcatcatctgtgatgatggtgttagtcctgcggatgcttctgctgctgctctgctgtttctacgatcagtgctgtcttccaatttggcgtcatcatctctctcgaatatgaggaagttgaagcgaatgtcactggagttggtcaaaaactgtagctgcgaggaaggatcattgaagtagtgcccaacacggaacttgtatacacgtctacgccaaatcaggtacacatggtcggccgcaatgaaaaaatccgttttttgttctggtaaaaacccgacaaagttgctcctcaacgagtgtgttgccgtgctgttctcaccgccgccgttatgaccaccaccaccaccaccacctccgtcagtgttattcagagtccaccatcgcacaaaatcggtgatgagcagctcatggatccggcgctcgtgcttgtccaccatgtacaaccggccggaaatatggtcgaacaaaatgcgtccatacgcactcaaatttcgtgctatcttgtgctgatgaccgcgcacaactgccactgcatttgcatcatttcgaaggtcaaaaatcacaaaactgtggcggtcatgtccaaaacacgcccacggcaaggcgctggacaacaactcgatagtttgccgccccatgctcatgaagttgtccacatcagtgagggcaatgttccacatatcagcactgttgtacagtcgatttatgtttgtttcccgctcaacgtgacacgcggtgttctggttgtagccgaaccaatgttggatgggtgatgtcttggaaagggagcgaaaggtgcggtcaaagaaattgggtgggtcaacgctcagctctacgttgatccatt

SEQ ID NO: 20310 - DNA, 2289 bp, Heterodera glycines
tataaattagtccttgtaattctcattaataaaccttttttttaattccgttattaataattataagaataaattatttttttataagttaccccaaaattaatgtacctataatttaattcgcatatgtcaattcattcttatcattaatggccaaattaaaaaaaagctatttcctactgaatttcctcaaacaaccccagcgatattaaataaaaatattatgaaattgattatataataagaaatttaattcataaatttattcaaaatttgaaaaaaacaataaaagaagaattaaatgataaatatggaaataatatacaaaaaaaaaacttttaaacaaatatatttacctactttttaaaagtcaatattttataatgggatagttttcaaaatagtaatctgagaataaatttaaaaaatattggaaaatttccaatatgtgacacaattgcttttatttattttattttaaaattttaactttaatagttgttgactttgcaaatgtgcaataacatcaattttgaaaaatttttataaaatacttagtttatgttaattttttatttaaatttacttttgtattttaacttaccgaagagataaacgagagaataattaaaaataactgagtttttgaatcaagaaaataaaagataaaaccaagtgattttccaaatataagaaaaaaattaaacataattaaaaatagcgaacaattcttattaaagctttaaaaaactatagttttgcatatatatatatattttttttttgctttaatttctgaaatattgtttgtttttaataattttttgatagatttttaaaattccggtcttaaacaaaaatatttaatgttaaataaataattaatgaggaagattaaaaataattccaattacttttatgaaaataaaatctttttttctaaatatttttttttagtaaattatttttgaatttctctaaaaaaaatttaaagttttttatctcttataaaccgataaatatttgcggaattttatgtgctgaatcttcaaaatattatataaatattcaaaaaaccgtttatagttttatttcttctcaatttctttctaaaacaattcaagttaaaaatgttaaaagttttcagattatatattaatttataatagagcctttgaaaagatttcgaatgatatcaagattgttggatttggtgtagaaccttcaaagttatattgactcaattttattcagacaattggtccgttctggtctattggtagcgcggaatcaaaaaataaggttttgttaattaatacatatttttagattatttaaatttttttcaacaattattatataaaacagggttgtgcattcaaatttgaattaaattatttaattttttttttatttcacttgaaataagttagtttttcatttttgcattactaagtataccaaaaagctcttagaaatattttaataaatcaaaataaattaaattgccgagcctagaaatgtccgaaaaaataagaaaatgattaaataaaaatttctcaacagaggaattgacttcccattgcgctttcaagagtgataaatcaaaaaaatttatttttcattacttattatccatttaaataataaacatccaaaaagatactgtcaattatccacttcaaaaataagctacgatattttttattgaaaaagttgataaagtaaaaaatatcaaataatataaattaattttttatcaaaaataaattctaaaaccatgaaaatgagatcattaattaagtattaaaagtgaaggacacaaaacaattgcctcattaaataacgctgtttttgaagagtaaataatttttttaattaaaaccaaaaatttctaataatatttttttgaaaatttattaacagttttaaaagttcttaaatttttattcctttgatttaattaaaaattcaaaaataaataataaatagatgaaattgagctttgactaaataataattaaataataataataaatcacttttccatatttgatttaattcagccactttacaagagattcaaaatgatttacattatttaaatgtcaaatttttaagtttaattactctaaattaagctgtatgaacataattgtaaatttacaaataaccaatttataaattataattataaatttttttttaataaaaatgtaaagaaatgaaaaattaaactatattttatgggtgctaaaaggaatgatttaatctttgttcttttccaaa

SEQ ID NO: 20311 - DNA, 2569 bp, Heterodera glycines
ggtaatttcacgtgagaatggaaaatattaaaatcaaaattattaaaaactatttttttagttataattttaaaaggttcgttaaataaaagaaataaataaaagaaaagaaatgttataaaaaaatgaatagtatatcaacaggatttttttctgaaaacgaatattttctattgtattattcaaattgaatcaaactcatattttcgttaattattatcattttgaacaaattgggaaaaataaaaacaaatttctaacgtgagaaaccataatcaacttggataagggcgatttacaaaatataacaaaatttaaaaatgcaaaaagattaacactcgcctaaatatttataacacccctaaaatataatcataaataaaaattataattgtttttattaattaacagaagcagacaaatattgctcataaaaagttcattaaaattaaaaaataaattaatattttataggtcaactgaaatttctatcaatttattttttgatacctaaatcgttgagattgacagtcatttgacaaagttacgaccttttgcactatttcggacaaaacaaaaatgagttacaaggtaataaatgaacaataattttatacaataaaaccaaaaaagttaaaacattaaaaattaatttaatattaaaataactgttttagactttgaaatttaaattgagtttgttttaaatacaattgacaataaaaaataaataaatgtgtagttacaaagtaataaatgagcaataattttattataatataaccaaaaaagttaaaaattcatttaaaatattgaaataccaaccattaatttcgaaactcaaattcttcaccatatcgagaaagttttataaagaattgtgtaataaacctaatttgaatataacaaatttaagtgaatttgttattattagttcctaattaaatacaatttttataaaaattttattattaatttcaaatgtgaggccattaataaaaagagatcaagcttaagaaagtgtattaaagaaaaaagaaagcagtaataaatttaataaatatgaactcgactgattgaattatttaaaatcaatttaaacaaataaaattgcaaattctgttttataaataatgtcggtatgcctaaaataattgaatttaagtaatttttatttatttaaaaaaaatacaaggaaaggaaaaacaataatgcataaaaattctttgttttattttataaaattataaaaaatatttcatccaataattcataaaaatgaaatattttctcaaatttactaaacgaatattttttactgattaaaaaggtaaaaaaagaattaataatttctcattattatattatttttaacgacttttaatttttatatgaataaaagaacaaagataaaaattataaaaaaaaaacatttgaattggaaatgtatgggagaggaaggatggcaagagactcaaaataatctaaattctactcaaaataatgcccatcgaaattaaatataatttatcttactttaaaactatttttcataacaaatgaaaaaataaattgctttattatgattttaaaatttgaaaagattagatgccgaaaaattttttgagaatttaaaagttggaatatttttttattaataaaatttcattttgatttattagagtctcaattatttgtcaactttaatttggatccaaatgtttaaaataccggctaaactagtaaaattaaatggtttttttttatttcataaaagttccgttgttttaaataactaattaattatggatattgaattatgaccgttacctttaattccccactgaatgagcacgtgaatcatgaccgtgaaatcaaatagattttataattgaaatattttaatactcttgcttagtataccttttttgttaaatttttgtagtccatagtatttgttatagtgttattttgttaaatatcttacaattagtgttaaataattgaactaggaaaataaaaagtagattatttctcgttggtagttctctgaaatactgttttagatttaaaaaaagtttatttattttaaatgactataaaaattatttgtcaatttaatttttataaaatatataataaaaaattattataaaaatttcaatatttataaatttcattttaatgatataaaaaagatttttgatgtacttttaattaattatctttaatttcaattttaaaaaattttccataatatttatttttggccgaatatttttattttactcatttatttttttagtaaaaacaaaattatataaatatcatgtttattagtttaaataacaatatttattttgtatgagtttcatgcattcaataaaaattgcaaaaataaagaaataaatattcagaaagttattgaaaaattacttgaaagttttaattatttgaattatttgagcagcataaatttgaaaaataaaataaaataatattatttaaacaaaacaaaacgataaacggacgatatattgaatttatgtatagtaattatgtttcaaat

SEQ ID NO: 20312 - DNA, 2957 bp, Heterodera glycines
tttcaattaacctttttttttgtcccaaatcccattcaatataatttatattttacttccaattctcacctttctgctcacaacaaatgcccttttgcgtttgtttgtcccgattggacgcgaatatcccaacagagccatcaaacgctttttcggatggattgagagttcactaaaaataaaattaccaattaacctgcctgtcatttacaccggtgactcacatcatcagaatcacttgcgcccactgaaagaatgccaaattaaacccaacccaatttattgtgctcaattgcgattagccgactaatatttccctaattggccccctaattagccgcttaatcccttggccacctgtctcttccattccttttcagtggcgtaaatcatttcgtaagttcgcgtcatcatcgcgatcagaaggttgaactgcatcagactgaccagcagctcgaagatgaagaacagaatctgtgggggacatcgaatgggaagctgaaataaatgagaataagcggtggaatgaatactttgccgatgtttccgagaagaggggctaaaacaaaatggcaaaaagtggataattattattataattggtttaatgagcatggcaaaagtgtgaccttggcacgtgtgcaaatcctggtagaaagtggagaattcgcccactgtcattatgaacagacggatcagtgcctccaccggattgccaataatgttctctttgttgtcgtttgggtcgccttgcgaaccggcggcaatccgcgctctttcacaggcgcgaaaaatcacgaaaaagccttagaagggacaaattggcaaacggatgaaagacgattgacccccgcggggcaaaaatttggcacaaaggaagggacaaaccctgggaaaagccgatgagaaagatgaagtagatgaggaagaagcggaactgaaaagcaaaacgccgattgttttgcggttgaagtgatcgccgttggacctaccaaatcctgggtgataattttgtagatctgaataaggagtatagcggattaatcggattggaatattaccatcaacacaaatggcccaacaaatttaacggcgcgacaataatactgaaaagggaggtgaaaagccatcagacaaacgctgaaatgaaagtgccaaaaaatggagagaagtgaggatgactgtggcgacggagaacatattgtccagcagaagcattgagtcggcaacgccacacagaaaacggacgggcaaaatgagaaggaccagcaacagggccaatttgtagaaaattttggaggggaacgaagtctaagggggggggggacaaagcatcaaaatggacaaatgactaaaagaggaaggaaaaaataagcggagggacaaagcataaaaatggacaaatgactaaaagaggaaggaaaaaataagaggagggacaaagcatcaaaatggacaaatgactaaaagaggaaggaaaaaataagcggagggacaaagcataaaaatggacaaatgactaaaagaggaaggaaaaaataagaggaggaacaaagcataaaaatgaataaattatcaaaagaatggggggggggtaaagcaacaaaagaagaagcgatcagataaataaagaaaaacagcaatgagaagagaccagagcggaaaagcgaatcgaataaaagaaaaatcagccaccaaaatgtgaagccatcggcgacgaccgatgttacgaatgtcgagcaactcgctgatcacctgatccaacaaatgatcaaacactctcaattatgccaaaaattggagtttgaattttcgttaaaaagagacctgaaaaagtgccattccgtagaccaacggctcggaaatcattcgaagctaaaaacaaatgagcaattcgcatttttgttttttttattcttgggttaactgtgccctcaacgccgaacatgccgtacttccacagatgacacctcggctggtcaaagtacaaattgtctaagcaataagaaccaattagctgacaaattgcaagattaagtccattttacgcttaaacaatcaaattaaatatttcataccggtcatagtttgtatttaattcaagaaaggatgaagccactagcaaagccttaaatttaacaaaacctactgaaaattccgaatgatccatcattttgggtgatcattctgtcgctgatcagagtcaacgcatttgtgttggcatcaaccgccttgtgattatcaaatgctaattgttgctaattgggtgctcattactcacttggcccgtccacgaaacatttccttcagtgattacccaagtggtggcggaaaagggacgactcataaaagcgacgaaagagacgatgtagaaaatgcaaaagccgaacagagaaatgaaccaactgatcagagacaaagggagaggggaagggtacggtaatggaccaacagaggaagagtacggtaatattggcgcaccgttttttagcgaaagctgaaagaagtgaaatgaggtttatttatacatttgactatccgatcagaatgaccgatcggtgggcaatgagtagggggggggtgggagaatctcgactcgactttcgacatttttcggctttttgggtctctgtaaaactcttttctcgcacacccctagcagtgagtgagtaattaataaacaaatgatttagtgaccttcccattttgcctcaagcaaatcctccaacagtccgtccaacagttccaaatgtttcgtgctctcctgtaaattgcgcattgtcaggccatcatcattttccgtgttgtgttgcgtaccccgtaaacgaccagtgaaagtgccgagtcttcgttcagatcgcccgtttcctgattgatcgtgtcgattttggccaacggataggccacggaggacgcctagccgtagtcccacacatattcactctccaactgcagaa

SEQ ID NO: 20313 - DNA, 3716 bp, Heterodera glycines
  misc_feature (2627)..(2627): n is a, c, g, or t
  misc_feature (2633)..(2633): n is a, c, g, or t
  misc_feature (2650)..(2650): n is a, c, g, or t
tcccaccggtttctgtggtcgcgaattcggttggccatgccaatttcgtgaaacggcacaatttcagtggcaccactgaaagccgaagacagaaaatgagcgaccattaggctgataaataatgcatttgctcaccgttggcgagggtcacagtatcggttgaccagcccaacattgtgagcccagtcgatggcatctgtcaccaaatcttcgaaactttccaactgagtgttctcatcatactcttcaaagactttgaccgcataattttttattttttcttaaattttaaataatttttcgcatttttaaccgttttaatcccatgatggatttgttcaccttcttctgtgatggaggcttcattttcttcattactttttgatggcgaagtcaaaacgccaatttttggctcgaaaaggccgaaaagcaaaaataaaacgaagacaattttggttttcaaatgaatattagccattaagaaataattattatttatcttaaagtgaaaattaatagattaattttatggattatataaatttaagtaaataataaatgtttttatatggctttactttcgctctttgccggaaacacttccttcctcgcattttcatttaaattacatgtgaaattcattcggaatactttttgaaaatgaatgaataatatgtcaataatgaaattaatttgtaagcattaaaactatagacccggataactaactgtttcgatctatcgaattaagtttttaggcttttaagtggattttaatccttgaaacaaatttaaaaaaaataaacaaacttcttattacttttttctttaatatatattttttatggtatttaaccgtaataaaataggataatttaaaaacaattactgaccaaaagcttcgttagcttaaatttgaatggaggaagcttctgccgattttcgaatttctttgtctcccataccggcaaaagtttaggttatttcatttaatcctacaaatttggatataaacggagttctaaatttaactattttggccactttttgtttcagttgtcaaatgaaccagagatgtttaaattgaatttgttcaaaattaagaagcttcaaattggcggcggcgaaatggcctcgaccctccaaaattttcgatttttgtattgtgaattataagtgccaaaagtttaatttatttcaatattaattctgtaaattataatgttaaattttttctgcttctttcaatctatgtttagttacctaattacatttaaggcacttaaacaaatttgccattcaaaattggctttattaaatttgccgacacgtaaagcacttttctttttgtacttaaaaaagatgcttaagttactgtaataatgctattatttggtttaacgcatataattatattacgcaagcattcattttttgtgccttcggccatgtcatttacaagaattttacgctcacatttaacatggacaaattaagaaactctaacccattcattagtcgcctaatgaggaaagcggcgcttaaaaattaatgaaaaaatggatgaattcattttgggataaattcagaaaaatttccaatggctgtcgtcgacacaaacattaataattcagtaagagaaagtcattttataataattgggttaaaaaccaaacgagtaaattcagctgtatgccgagttcaaagatgctcgtccgagttggcttctcatcggttgtgccctccctttgggaattgtcgccgccttcggaatgcttttcaatttttgcgttatttttgtgacaattcgctcaaagtccgcatttatattttaaattccgtttcaattattctaatcctttttttggggctttgaatggcactgccaattttctgctggcactttgctctttcttcgaactgctccatcagcatggccattttctgtttgtgttcgtcgctttttcgggcttaaatttcatcgaatatcaaacggccgcacttttcgcggcactttccgtctttggaatgggtgggacaaatttaaaagtgaaaatcaaaaatcgtgccaattttaggtggcattgccatttcaatgtttttcactgggcttgaccgactcatttgtgttcttttcccggaaaagtaaggcataaaaaaacatcccaaattaattgacttaattatccaattaaaaaaggcactccaaaattaatttgcgcttttatttgggcgcaattacttttgtctgttttctgttctccgctgcgttactttacacactctttttgactgctaaacagctcaaaggactgatgatcagcggatgtatcgtcgacattgtccaagtccaaaaaaaaaaaattatttatttaaattgaattttaaaatggaattcattaaattttagggtccatccgttgcatttttcgctccttccaatttgctcacaaatctcgtgaccactgccatttatttggccatcggaatcgccgtcaaagccaaaactggtgatgatatttaataaaaacgctttttcatcccaattaaccttcattttttgcttcattttcagcttctttcgccgcccaagcgaatctttcccgccgcggcgaataatcgccgcncttttngcgttcgcttttcgccnatcgtcggcgtcaacatggggcggctatgggtgcttctgcgcccctccattccatcgccgatcaccgcgtggctttggcaagtgatcaccggcattccactgaatgtcattgccgcatcgaacggaccaattctgtactttacgaggggagacaatagcaaaaaatgaaatgaaaactcaagcgtaatggcattttggcgctaaattcgggactgctgcttaatgacaccgagtcgagaaaaacttcccgttttttttgagcttggtatcgacttctcgaggccaattacaagtctctgatgatagtcttgcaaaataaatgcgttattaacaattactactaaaacccaataattaaatgctaaatcattaaaaagaaaataagttgattatatttctaaatatttttgattaaaataaatgcttttccttcatttatgtatttagcatcgaatatcggcaggcgttccgctcggtgtttccgtttttcttcaaacattttcaaaagattgataaaccgaagcaaccacaaattatacggctgaaaactttcactgtaaacaaaggcaaagtttttccgcatttatcaaatgttcgaaatatttaaacgattgagtgtatttttagttttgattgttgtttttttcgacaatgatttcttttggcaaaaacagagcctatttcaatttatgtcatatcactgatctgacatcagcagatcagagccgcgactaaaatcttggaccatcttgatgttgaggctgaaccaaccgccgtcgttcgactcggccggttcaacccgcagcgaacaacacctcgcccgctcaaggttgtcatgccaacacccacacatcaacacatggcacttggaggatggaagcgcgagcgtgctcaactccgttctcaacaaaacctggcccgcttgttcgtccgcccagcactgaccaaagaacaactcaaggaggaatacgaagcgcgcgtccgaaaacgtcaacaaatcccagctcccatggcgccggcagcgagggagccacagacaaatgttccgactcccgtcaatgaaaat

SEQ ID NO: 20314 - DNA, 2149 bp, Heterodera glycines
ttacttaattccattgactttgctaaacttcttgacacctatgatgttgattctttacttttgaaaccacctcatctcattcagtgaccaaatttatttatattgttatttatgtcggtgtcacgcttttgcgtataaattgattgattgattgaagaaattaatatgtttattgaattatttatttaacaatctaaaattgatggaattgaaaaattgtttaaaatgattcaaaaatataaatgtatgtttttttttgttcaaaaaccatcgtcattatttattgcaacatgttcaattagttgatgaaccaatgtttgcagaaccgatcagcgaatttgtctggatagaaataatatttaaaattataataaaaataatattcaaataataatgccaataatatttatgtcttatttctgaattatttattaaaaaatttccaacggcaattttattactattccgttgaagaaatttgcttggccaataccaaatggggtcagaaatggcccagccgtgccattgaatgagggcgctgacgaataattccaagctataaatggcaaatttaatttctaaaaattcgatgaattgaaaatgccaacaaatgacggtggtgctctccgcttcttgttgtccattgttgttgttgatattgttgttgttggccgttgctgatgcttcttcctccccatcatctgctggttggttgcgcaaaaattttctgaaaatttatttaaattttaagtttagtttccgctatttaggaggcgtattttttgcagcaaatttttaatctgcgaattttttctctttagggttccgatgttctatttttcagaatcggatttcagaaaattctgacaaatttgttcaattaatcccaattcattaaaacatcaaaattctttttccagcggcgccacggcacgaacagagagagtccctccccctacatgcccatcttggtgcaaaatcttctaattgaaagcataagaaagtgcataaaaattaaaattttttaaatttattacttaaaaaaattaccaaactaaaaaattatttcgaatattttggatttaatcccaaaagtaatgattgtacataacagagctaatataaacagcgggacggaggggtagttttgggtattaaatggtcgatcggataccgaaaacccgccgaaattttatttttccggttttctcgtaatgactttgaataacattgaactaaatatttttcattttgaggtaatttggcaataaaattcggccttttttccctcgccttatgataatcgcaattttcacctgtgctttgcccgccggtttttgaaccaaacctgcgatttaatttaatttaatttaaatttgtttgtttaacattaattcgtttgatcacttggattttcgcctcgggcaaattaattcgtcgtgccaattggtccctggtgttcacatccggataatgagagctttggaaacatttttcgagttcctggaaattgcgaattagttcataatttttaaattggcattttccaattattcattttaaaattaaagaaatttagtcaaatttaatcatggctaattcaaacaattttcatttgtctgagtttgcccatttgtcacgcgccagtcctaccgtacctccaactgtagctcactaaacgcggtacggtttcggcgcgatgttttacgccgatcatccgctgacgctgaagtgccaccaaccgaagaatttgaggatgctaaaattggaatttttacatttagtatttgtgattttatatggcatttgtttccatggaaaccgatggcattaacccatcaaattccttttttttgaatattttaaaaattttaatggcaaattttgacaatttttggtccgaaaatgcaacaaaaaacgaattaaaacaatttaactgttcttcaaaaggtaaagcagcaattgaagaagaaatttaactttttaattattttattcagatgcgtttgaacttcgaacaaagcacaaaaatcctttttacacatccaccgaagatgaaactgaggacgaagagggaatgaaaacaccaaaaattggtatttggatttaatttaattacctaattgtattttgtaattacagccattgg

SEQ ID NO: 20315 - DNA, 3330 bp, Heterodera glycines
  misc_feature (1392)..(1392): n is a, c, g, or t
  misc_feature (3161)..(3162): n is a, c, g, or t
  misc_feature (3215)..(3215): n is a, c, g, or t
  misc_feature (3260)..(3260): n is a, c, g, or t
aattccatatacaatttttatttcattaaattaaatgactataaatttttcatttttcaacttcatctttttatcagaaaattgaaaaaagattaatgcttaaaatcatatataaaagcttataaactgcattaaaagagtaggggttgtttcggcgccagccctagttttttgacaatgattttttagattgatgtcaaccaaatctaaagcatgtgaagggctttcgaatgatactaagaattttagatttggttgacaaagaaaaaattatagtccaaaagctagtgttggcgccgaaccgtgggcgccgaaacgaccatttccctagtaattagatggatttatatttaaatcgcaaaccaatttaggtccaaattattttttaatactattcaagatggtgcgcggactaatcaacaaatcgcgtgacgaacaaattgaacaacaaaatgctcgcattgccgaacagcaacaagtttctgtcgcaaaatcgctaagtctaaattgcattctcaaaatttaggtcattcgagagtgtaaaacattgtttcgtcatgtcagtgcgcacagcaataccatcagttcggccttgctaatgttcacagaagatcacccggagttcgccgctttgcttcagcatccgattcctttggtttgaaactttgtttttcctattttgggttattttcatttgtttccggggcaggaatccgagtacttcccaaatttgtcctctgtcggtagaaattttctcatcaacacccaagttttcctaaaaatgcaatcctctacctttctgcggttttgtttgtgtttttgggtctcaagtttcgagtgttttcattctgttttgggacattttgcattttccacccattttcttaaccccccactcaatcgcttctctgccaggtgcagccgcaacaacaaaatgtccccacgccgagtcagctgcagttgttgccaactcgccatgacaacgcgttgtttagcgactcatggccaatagtcggcggagcgagccaaagcctggcaatgcgtgcaagcgagacgtttcgaaaaacaacccacccgccaccgagcctagggcttcgtctgtttggcattcaagaagtatttcttaggatcacaaacaaacaaaaaatacgcagttgcgggtttcactttacccaatcaattaactgttttagaaacattcaaatttaacattcttggactcattcaatcgctcgaagaattctctagtggctacataattcaaaaaatttcttagctttcaaaaagattgaaccaaaaaattcaaaaaccgacttccgaagtcaaaaaatcaaaaactgattttctaaactttagaaaaagatcccgctgtgggattgaaactcaaaattnttgcggacggcattccgcagggataaatcccgcgcgggatcccgtcccgcacctggctctataatcccccttccctcttcgtcaacaggaggcgattatgcccggtggaactgctgcagtgacgaaagacgccgaagtgacaccggcgagaaaaggtgtttttttgacgggcacacaaagttataaaactcaacgcattccacattgtgtgaatgctgattcactgttctgttccgagaccttggcttcggaacggagtccaaaatttgccaggagtcgaaaccaaaacccgggaatttgccggttatgagagacccccgaacatataaacagcactaacgcttttcattaataggaaagccgagcccgaagaaacaccgtccgtttcgcaatgttttcaaagctttgggcgacggcgtgtcgaaactgaagttctctacgcgaaagcgcccagaggtttttgagtcctccataaacacacatccaaaatatacgattgatattaatttttggggagcagctcgttttcccctcccagaaatttataaaaaaactgaattttttaaaagaaaatatctcgaaaaaagatatttgaaaacttcaatagcgatttttaaaggtttatgatgaattgctgttttttctaaaaaatttcaaaaaaaaattgctgtaaattttttctagaaatttactttaatttttcggggaggcgaaggtattgcaccctaattttggacactggcttaaaggccgctatttgccaatctctcctcccttccctcttctctcatgtgcagaagcagcagcacgggacgacactgtccgggacggatcagcgccgaccgcaatttgcaccgactttcgatgcctcgattgccgaacagtctacgttccaatgggcaacggaaggtcaatcatcgtctacgagtcaatgggcaacggaaaaacaggacgttggacagtacaaagaattgcccaagtttgggcacggcggtgggggcggccaccgccctttctgaatttcgccacgtgataagacaatgccatgaatttgcgctttaccttttaaacttcaattaacttatctcattttctgcgtattttaatttcattttattctttattctcatttttttgcttgttcgcttatgttttccttgtgtcttatggataaacttaattcttttcttttttactcaattacgtaatttattgcctaggctaaaacaaaaattttgaacggggaaaaaattgtttttttgttttgtttttcatcacttaaatccttggtccgcggatgtcctcattttatagatttgtttgaagggaaatccaagttttaagtatgcccttatttcgaaaaaacaagaattctgcttaatgtggactttgacctgcattttctggacaaaaatccaggacaagcaaacattattgtttatcccatggctcattctgacaatatgtagctgactaagtttttttggttaagagatagacaaaaataaataaaaatttgtccaagtcatcttcggaattggtgctttttggcaaagcctgttcaacaattttttttctaaaatctaactccaaagagtgtcatttagaaaattccgaccatccaagtcccaactacagtgtaatagaatatttaaaacacatttttattcataagacggaaataccaagcagagaaaagcaaaaagctgatgaatagaaataaaaatacgcaaaaagcacataaacaaaggaaatggaaaacagacaannagaaattatccaatgagagagactgtcccaaaaagcacccaattaaacccganagcactaatttataccataaaaacaattatggtgtttgtctttangggagacagcctctgaaaatgcataagagggaaaaaaaataattcgccaagaaatttaaaatgaaatgaa

SEQ ID NO: 20316 - DNA, 1592 bp, Heterodera glycines
acgaaatgggcgagttcggcaccattggagcaaggtgtccgttggatgtcccaccatcagcagcatgtgactgaaatatttcaaacagagccgcgcgtaggggtggtactacgtttccccccgtcaccgttcccccccccccccctccaaatcagttcccccgagaaatttatttttaaaacttagaaacttttcgagaacaaaatcctcgaagttttttataagaaaattacaagataaaaaaatttcgagaaattatccagcaatcttttggctggtggggcaatcaataaaaaactgacttgtgccaatgcacagcaaccaatggccaggctgaggaacaggagaagcgaccgatgctcagtgccgtgatttgcatgttgtcgccgaataaatcttgttgcattattttgttgctgttgtgtcacccctgtcattgtcgcttcactgctgacgacaatgaatttgggtatttgagtaaactggaaacggcactggttggcctagtaaaatgacagacccataattcccccctccccccgaaatacaaaaaaaaattctccaaaaagttatagtaataatttttttattataaattttacttaaatttaacccaaaatttcctccccccccccccgccgccggatcacaatttcccatattttttccaaaatttggtctcaaaatggcaaaagtctcactttttttctatggcgccgaaaatttaggttaactacactggacccgaagagcaaaaaaaaaaagaagttattcgcgttgtccttccgaaaatttttctgttcagcttacgagcctgtaaaatggtgtgccgggccgtcattgctcagatggcacatccacagttatattagtaccatgtccccggcgagcgggcagactgagagtgccaacaataacacccgctcactccggcccctaattatctctttgaaaattgtttgcaaattcaattaattaatacacataagatggtgcctgcccaccgccacagatggttatgttatgacgctgatggcattggcacagcattgttttgtctttataccgtgaaaatttcgttatccgcgactataatatgggaagaagaatatgtacaaattgccacaagcgatgccataaatttggaccatcaacaaacaaaacaatggccatttttatgcccttgggtgtaatgatgacacattttgacgtacaaaaaatattaacatctgctgcacattttgcactctagtagccagatcagccctaattcagataatcaaatattttagggactttccgttatatatttatttttttaaccttttatatgtgataaataaaaggaattactatatatattaaatatgaattaaaaaataaaaacaacgaaatgcacatttttagtttgtgttttacaattgtaatacaaataccgaaaaatacacatttttagtttcttacaattgtaatacaaatactgaaaaatacccacttttagtttgtgttttacaattttaatgcaaataccggaaaatgcacatttttagtttgtgtttttacattgtaatacaaataccgaaaaatgcaca

SEQ ID NO: 20317 - DNA, 1243 bp, Heterodera glycines
ccgccgggcccgggcttttttcaaattttttgaattctttttaataaaattaaaaaaaatttacttttttattttagcttagaattatatcaagccatgtaaatcgaccttttttgctttttaaaaaacttttaatggcgcatttttttaaaaaaaaatttgaggtacaatgggggggggtccggcggtgccgataggcgccgccgcggagaatttttgaaaattgtgtgtgatttgttaacagatttcaccaaaaaatgaccaaattttgaaattttgagctgaatttttgagaaaaaattaatctttttgtacaaggcgacgctgaggaaaattttttgacttttaatgaatttattatgaaaatttgttgatttttcataaaatttggaaatctcttgctggttaaattcgtgccgattaaatttttcgatcgtcggctgtttctcatcagctttttctttggactcctttttcgtcttctccaattcttcgaaattttttacatattccgaatttgcatggattgttgaaaaaagatggtttttgagcgatttagtgctgaagtcagagaggctaaattcatatttggactttccattttctttacattctcggcactccgcgattttgccatcctttgatttttcaaataaacctattttccagattgatgcattcatttctgaaaaacatttcaaaggatttaaaaacaaaaagattggcatgtatgtaagaaaatcaattggaatttgtttctctgattatcgttaatttgaactagacatttcgccatattaattatttaaattttcaaattgtgggcagtttcgctggcgaaatttaagcccgttttagcccggtttttttccaaaaaaaaacgggcccgggacgggcttaaatttcgccagcgaaactgcccacaatttgaaaatttaaataattaatatggcgaaatgtctagttcaaattaacgataatcagagaaacaaattccaattgattttcttacatacatgccaatctttttgtttttaaatcctttgaaatgtttttcagaaatgaatgcatcaatctggaaaatagcgttaattgaaaaatcaaaggatggcaaaatcgcggagtgccgagaatgtaaagaaaatggaaagtccaaatatgaatttagcctctctgacttcagcactaaatcgctcaaaaaccatcttttttcaacaatcatgcaaattcgaatatgtaaaaa

SEQ ID NO: 20318 - DNA, 1590 bp, Heterodera glycines
gtccgcaaaagtcggtccgcaaaatgtcggtccgcaaaagtcggtccgcaaaaagtcggtccgcaaaagtcggtccgcaaatgtcggataatcttattaatatataaattcatccttttggctttggatttagcttcggcataatgcttaataacggtacccgcggcgagaacgcaccaaagcattgggtgccaaaggagctgggaagttaaatgatagttaaagggacaatttaggtcccgccctatcatacgctgcacccttcccgttaatacagcgattaactcaccttatttttgctcctttaaatccaaaaatttatgaaaatatttaaaaattaaatcaacttaaagtttccaaccaaacaatgtttttgactgttttttctttattttcgctcgaatacttaattttaattcgttcccaacttcttgttctcgataaagctacatacaactggccatgagcaaaaacatctcgtgttaaatcaataccaattttctcaaaagtttgtccttgtgcactattaattgtcatacaaaaagctaattttaatggatattgatgtcgtttaagaacataaggaagttttttatcttctattaaagttattcttggaataaaatcaatttctccaattcggtctcctgttaaaatcattactcttaaaacattcttttcaatatcaagtatttgtacacgtgttccattacataagcccatatttacattaatgtttcttattaattttgtaacagaattaattttaagtttaagttcatggtcaggaagactatttgtttgaagtttattgagaacctctggaagaataggcgcacccttgctttcagcatcatcaatgcttctaaaaacatattcctcacccggaaattttttttaaatttgatcattataaatattgatttctctgttatatggtgctaaaatacaatggctgcataatttcgaataatcatttgttttaattatttcaccaaaaatttcatcaaccaaatcattgtcttcaacatcacaaatttttggaagacatataccgttttcatcattacctttaccgttccctatttccaaaatttggtttgcaaaattttgtgattcattttccgttcgcatattttttctcaaatggaatattttaaaattaacccacaactcacttttttgtagtgttaaatctaaaatttcggtttttgttgctttattttttattggcaaacattgacggaagtcaccacttaaaatcataattttcccaccaaaaataatattgttcttatgtatctctcttaatttcttatcgattatttcaattacaaatttaggtgccattggtgcctcgtcaaaaatgaaaatatccgtttctctaacttcttttgcttctttagaattgttttcaatcgacgatgatgaatttatatttaaatctaatggtaatttaaacgcggttgtgaacagttcgaccgttctttaacaatgttgctgctaaagcactaaaagccatatttgtcactttttttaaacccaggtaagaaaatgaaaaatagcagattgaacaaatgattttcctgt

SEQ ID NO: 20319 - DNA, 3246 bp, Heterodera glycines
tccggtggctggtaatttcgacactgggtaaattcgacactgagtattttcgacactaagtaatttcgacactacgttttcgacatagagaaatttcgacactgaactatttcaaaaactctcactgttttccagcattttcgacactggaccatttcgacagtgagtaaattcgacactattgagaatttttaaaaattaataagaaattttggtgttagtattaggtattatgataaattttcctatttcattttctaattcgtactttttaaaaggttaggttggtataactagagttggtcgggaccgggaaatttgacaaaaaccgggaccgggacttaccgggaccagaaaagtcgggaccgggaccaacttttttgaccgggaccgggatcgggaccttgagaaaagccgggaccaaccgggaattttttcaagagaaaattttttttgaaaaattttgaaaatttgagtgcactttgttacgaaaattgccaatattcaaaaatgttcccataaatattgtagtttcgttttgggggacgaattcgaagaaaatttttaaaaattttcatttcgggggggggggaatcttggattttctgagtcccaaaattctggatttttataaattaattaaaaaattttgcgaaaatggccctcacgcgaaaatggccacgcgaaaacggccctcacgcgaaaacggccacgcgaaaacgaccccgaccgtggaatgggtcgaagcgggtcagttccgtctggccagttccgtcttcaaaagtcatgaaaacatgttttagggtgattttcggttttcgggccctagaagccctacaaagcgctttgaaatcaattaaaaattgcaatgatcagtgatcactgactgatcaggtttttttgaattatcgccccaaaatatcgctatttggcattatgagtcattgtctaacactgacactgggtttgacgttttactcagttataccaacctaaccttttaaaaagtacgaattagaaaatgaaataggaaaatttatcatacctaatactaacaccaaaatttcttattaatttttaaaaattctcaatagtgtcgaatttactcactgtcgaaatggtccagtgtcgaaaatgctggaaaacagtgaaagtttttgaaatagttcagtgtcgagatttctctatgtcgaaaacgtagtgtcgaaattacttagtgtcgaaaatactcagtgtcgaatttacccagtgtcgaaattacatagcgccgcataaaatatgcactaaaaatccgccaaatatgcaataaaaacccgaaaaatgcccaaatatgcactaaaatatgccttaaaaacggtgctgggtcgttacttaaaaaaccatcattatgaaaatttttgtcgaaaaattatttataactttgctcgaaagcaaccaaatttttaattattgatatcatttgatagccctaagtgttctctatcagtctgcaaaatttcaaaaaatttcgttaagtttcaaaaaagttatagctcgaggaactcaaaaaaccttgattttcgacatttttggccataactttttttaaacttaataaaattttttgaaatttaacaggctcataaagaacatttagatctatcgaatgatagcaaggattaaaaatttggtctttttagagcaaagttataagcaaaaattttcattatgatggttttttaagtaacgcccattatgatggtttttaagtaatgacatagcaccctcgaaacgactgagcttttgccgctttctttttgagggttatcccatgtgctttatcccactttttcccatactccaattccttctgcgcgcatcatacaagagagaaagagaggggggggggataagagaagaaacagacgagaggagatagccgagtgactgttacgaaaacacggatttcggaattgggaccgggggaaagagccaaatttgcgagaccagcgggaatcaagtaaaagtcaacccgttaattgggggatattaccaaaatatatttatcccataattagttaaaaccgttaattgctttccacagtccattcaacgccaaataaacccattggacgactaatgagttaatttggtttttgttttcttccgctgaatttgcttcaaattcttttatcaccgaaattatttcggcttcatttaattttttgatatttttatttttcatcgctttttgaatattttgttttattttttcgtcattttccaactcttttattaattttcttgcattctttccaaatttttctgttgctttttccacgctttgtccatttttcattgtccaacagaaatctttccgcaatttttgagctttttcataaaaattgtaaaaataatttttcggtgtaatttttcgttcggattcttcggcacataaaatgccaaaaatataattttggaaccattttcaaaacaaaaattcatcagattggaagaatacgctcggagctgtgctcaacagtttcttttccgtcataatcaaatctaaattagaagaagcggagtttaaatttattaagacgaaaaagcagtttaaaaattgaaaattaagtggcttaaattttgtatattttaataagcattcaatataatttagctaaatcaaatattttaataataagtctgggtgtctttattatctttgaaattttgaaaacttaaattttggatacacttaaaaatgataagtattagggactgcatggaattcccgaaaaaaattggaggtcagatttcggtttgcggaatttttaataaaaaatcggaaatttattttttattagtttttttaccaattcggaatgattttttttaattacgaaataattagtttttcagcgcctgtcggcccgccggaccccaaaaactccttgttttttcctaaaaaattagcccaaaatctcaaaattagcagtttttgtataattctgtttaaatcgcataaactttttaaaaaatttccccagcacccaccggactacgcttatgttcgttcccaaaattaaaaaaaaacgcgggcctttaaaaatggcgtcaatgtaaatagtcactttcccaataatattttaaacaatgtaaattgattgacataaaaaatattctgaagagaaaattactttttaatttttggtttagtttaaaacttagtaattaaaatatttagaaaatttctattatttttttaat

SEQ ID NO: 20320 - DNA, 3080 bp, Heterodera glycines
aaaatggaaaaatttttgaataggaaaatatttttttttttttgaaatttctgtttgtgaggcatttttctagagaatgcgtcattttttcgactttcgaaacacattttattagtggttttttaaaatttaaatcaaagtcactcaaaactcccttaccatggaaattttagcaaaattttttcccgattttgaaaaaaaaaaaaaaaatttttttttccacaggtgatcagcactccgtccgacattttcatgatcatggaatacgtgtcgggtggtgagctgttcgactacattgtcaagcatggacggctgaagacgggcgaagcgcgtcgcttcttccaacaaattgtgggcaaaggggcgaggaaaaaaaaagatttttaaagaattttttttaattttctgattccaaccaacaatttatgtaggagagatttggaaggcccaatttttgttagaatttttaaaaaaaattttctggttccaatcaaaaatatggttagagggcagaaaaaaaaagatttatgggatttttttctaaaaaaaaaattcgttctttttacaacaaatcacggcgagggttgggaaagagttcaagggcgtagccagacccttagcttctggtggggggggggctgaagtcaaaaattcgatttttagatatgtatttttggtttttttgaaatcccgaattattgggtgtattttacaaaacttttcgccaaaaaattactattatttgccattttggcctccaattttcaaaatatggtaaaatgtgggtccggcggtgccgataggcgccgctgtgaaatttttttttgagtattgtaatgcattttttgttaagaaatgtgtcatgacaactcgtacaaatgcttttagactaggcctaagcttttggcttagacttaagcctaggcttaggccgaagcttaggaataagctttattattttttaaattttatattctacaagttgcttttgtacgagttgctattaagccggaaaaaggaattgggataacgctaaagggagcgcctggggggacgggagcagaggtaatgttgaaagacgccgcccggctattgtaatttcgttacggttcaaaaagttatggccaaaagtgttcgaacaagcattttttgcattcttctggccatgttgaatttggttgacaaagaaaaaaagttatagtccaaaaaccacgctgaggccgggcccaactgaactaaaccgttttatggcttgttcaaataataataatggacctttttttaagaatattattttgaataatttgatcaatttccgctaaaatcatttttgttttatttcgtagtgaccgtttggggctgtgccgtgccgtcttgtccgagaggcgtgtactcaaagccgaatggcctggaatgccacagcacttcgtgttgcgagggcaactattgcaatggcgcggctgggccgtacaattttggcatttttgccacggtttttatcaccaccatgacaagtggtatacaaatagtatatagtatagaataggcccggaaatttcaaattagcgtatctcgctgcggaatttgaattcaaaatcctttgcgggatgggattctgcggttaatcccgcaaaatcacgatttctaaaaaaatggcgggattggtgggctgggatttcgcaaaatcccgcgcgagatctccgtccctgtatagattattaatgattgtaaaatctaagaatactgtagtacaaaagttaaactttttaagaatttcgttataaaaattctatgaaaggcgaaaatttgaaaaattaccaaaatctataaaaaaaacaaataaaaatatactgtaattggattattgtaaatttgtttccaacattcaattcatgtttaaattttaaatcaccaatttgttaccgtattttcttgttttcagacaattctgattcacttacactttccattggtcaaaaggggaggttttctctgtaaaaatctcgccaaaaattccataattttttttggcatcgccttgacatttttccacacaaatttacgattaaaaattcttgaaaatcggggaattttcgggtaaaatctttgttaataatttttgattttagtgattttcattcgtcacaatgtgtaagaatggaggaatgagaggccaagtgatgctttctctgatcagcaacttgaagaaaaatatgaggacggacttgagaaaaagagagtgataaaagccatgatttaatttgattataattactttttctgtgcaaatgcgtcatgtgagcataaataatttggatttacaaattttacactcattgtttcatcaaatcctcttaatcccgccctagtgaagatttttttagaatttctaaaatttgatgcttgaaataaaaatgtaaaaaattgcagcaaaatatccttggcttaagcataatgtcgctgtaaatgtttattgattttttttaagaatttgctcagtttaatggcttaaaatctaaggctttttccgcgaaatttcaattacactgaagtgatggaaatagaaaaattttccttttaagaacaaaaatttattttattttttctcgagcgttttttttttgaaattttaatattaaaattttcattttattaccgtttttcccgtgttcgtataaatttttgactgattgaatatatttttttaatttttaaaattaaatattttcaattaacgtctccgaaacatttaaaatatgaggactaatttgcatgaataaattaataatggccattgctgggaacgtaaaaatccaggaaaatgatgaatggcatttttatcaactactgactgcatcggaaaaaggagtacttatttgcccataatcattcattttttttttttttgtttgtttctgtgcagttttttaattattaattttttttttcgaaaaaataaaaccaccaaaaaatggacattatatatttaaaaaatcattaaatgagcatttttaacaaaaaaaaattatcttccataactttaatttaaattattattttttgtttttgttagacctgca

SEQ ID NO: 20321 - DNA, 2720 bp, Heterodera glycines
  misc_feature (2708)..(2708): n is a, c, g, or t
attaaacccattaattttctttctgaccatattctgtttagttttggccatttcgtcaggtctctgtagcaataatagccgcaggcgataacctcgttcattttcgggcttgactgaatgcatttcagcattgtcttgtggaacaaatctcttcggcttgtcgctatgtcattacgccaacataaaaaaatcctaaaaatatttcagcatataaatgatgctatctcttattagcatggttgggtgcccgacatgtttggcagtaaaaaaatgtttgtggacgtctggggcttggcttggtatatccttgatattaattctttctatgtttctctcattaaaaataaaataaatttgttacataaaagctttgagaaaatctcacgcaaaaatttcgcccgcgctgctttcggtaccgccggttttttaaatattttaataaatatgacagaaaaacattaatggggtaacaaatttaagaacaactttaataatgcttaataaatgtgtaatttaatttgcagattcatttttttgtaaaatgttcaaaatgacttacaattctcggtcttttgagctcaaaaaattatagctcctcttttgttcaggcagagcaattgacatttgtgtcttttgtttagggaaagcttcggtcggcgattgttttttattttctaatttacgttttacgaataattggctatcacctgaaaattaattgattaattttgtaatattggtaaataagtaattaaacttaattacttgattgacggaagaatgtaacgaaaccatttgaggaagaatttattggtcttactgactcagaaattaagcaggaatttcccatttaataacaatggcaaaaattagctaaatttataataaaatagaaaatttacgcaaaatttcaccataaacttccttaaattgacacaaaaaccatttatgttcccacgttttcatgaataaaataatgtaaaaataattttgttggaaaagtaaaaaaaagagaggaaaaatattttctgtgaaatttttccaaatgccaattcgtttgtcttgacgcaattcactttttatgtgggaaaggaaaacgatgtgaagaaatttgataaatgaaaaagtgaaataaaattaatttaatttatttaatggtataactaaattaaataaatttaaaaaagacaattatttcgaaagacaatactttattgtgtttattaaattaggtaaatcgtttgtttggctctaaaataataaaaaaaggcatttaaaatcaaattatcaacaaaataatagtgaaaagagtaatacaaataatttaaggaaaacctgaaaagaacttcaaatggaataaagtaaaccctaaaataatttgtcaatgttagcaattttaattgtcaaagttaattaattgtaaaacattcatttgttcgatttttattaaaaatcgaaaacataagttgttgaagttatttcaaattttttcaaaaaagcgtgcaaaaaggcacgcctcaaattaattgtgtaaaacggaaagagaagggcattcattcattattgctgcacaaattatgcttttgggaatgggacggacaacaattttcgatttttgccaacgtttctcggtgtacttttatacgttgttaccgaaatgagcacgataaaaatataaattacgaagataacgaagatatatctgtgatgggaaaaattacaaaatgaacgacaaatcaattaaggcaaattgcaaaatgatttaaactaaatatatgattttcatagcatatttatctattttagagatttttagtttaatgctttgaaaatgtcagcacggccccgggccgacgatttttgaccggttaaaacgatctagctaagaattcttggtttttgtaattttttgaaaatatttatttggcatatgtgtttgacttgtcaattttatctaatccctagaatttatatttcgctaattctcacctgaaaagtgggatgcgcaggcgaaggcggcggtgcctataacagtgtccgtctgaaagttggtcaatcattcggtcgtcctggtccatctctttggccatttgtccaatttgaccgtccccaatgccattttcctgcacaaaattggtccaaaatcataatctaaacactcaaatagtttttattttgaacaaactaacgaattttggtcatttaattcgggttgatttggcttcactttggcaattgcaggaagaaaatatcgaatttcatagctcctaaatttattactttacaataaatatggaaattgcaattatattgctaaaaaaagccaacgagtttgctgaagaaaggaaaggcaaaataatcaaaatgaagaaaatgtaaaaaaggagaatagtgacaatggattaatttaatcataatatttttatttaatatttattttcattattgttgccagccgatgaatgcgaattaatttgtccccgggatgagaaagactgtgtttgggacggcatcggcccgaggaacagcagaacgactcgcctaagctaagttatgctttattgtttattatttagcaaataaaattaaaataataattaaatttaattattacgaacattgatacttttgtcacattgactcaccacggtttgagtgagaagccgatcggagggtgggtggggagaggagggttcgatttcctccanaggtctaccatt

SEQ ID NO: 20322 - DNA, 1234 bp, Heterodera glycines
tttcaacgttttttctgtttttttaattagtcctaaatttgtttaggctttataataataatttggtaaatccaaacttctcgggttccctcgttcagttttgcttttcaaagttcctttggtgtaatttgtgctcatctctttggtctctctctttccgtttacaaattttggatttgtttaggggagagcccccgcccatttggtgtcatttgtctccgttgggcgggggtttgagaattgggattggcacgcattataatgggagtggcgagagggatggcacatcttcatccattcgtcccgaacaaaaagaaagtgcacgcaaacagcaatttaattcttccaactttggcacttcaaaagttggacttgggaatgtgcttggataaaaaaacagctgcggcttaatttgccttggcattggcaatttgccaaccttcgacgatgtccatttcgtccgactaatttggctgaattcttcgaatccgtcaattgcccccccccaaatggacactcttcggcatgtgctcgcctcttcctccctggcaatggtcgtttttggctgttttggcaattgtctatcggcctccgtttttctccgggtttaattgcccccccccctccctttggtccgttcatttccctccgtctcagcgcaaaacttccattaacattttgctgagtgccctcgctttcgttgacattggccttctcctcttcgccatccccgtgttcgttctaccaactttggatcggtcggtggttctgtcgacgaatagtagtaattaattagtgctaattgagcatttagggatggatttgtcacttttgagtctgtccaggcggtcatcgtcaaattcctttacccggtcaatctgatgtttcaggtgccgcttaagatgccattgccattcatttgccaaatctttgccattcagacgtggagcatttacacaattgtgttgatcaccgctgagcgatggttggccatttgccgtcctctccatgtgctaattgctgcccaattacgaatcaattagtcccttgccctttttaattgaggtccgctctttgtgcacttcgcgcactgccaaatggtcattgcttttcactgccttgttttctgtcctttacaatgtcgtccgcttttgggagtacagcttaaagtcggtggttgggattaattcacttgggggtactgtatgtggttacggtgggctgtggttaccgt

SEQ ID NO: 20323 - DNA, 634 bp, Heterodera glycines
ggagggactaacacgggcaaaactcacccggcaaaaaaagtgccaaaggaaaggggcgaactcggcacagaaagacattttgtaattgaaggacggactgaaatggaacggcgggatttgggaagctgagcttaatcagtgtgaaggattattcattcggttattctttgcctttgctttggttcactctttcctcttccaaaaggtgtctttttatatggaattccctccattttccctcccttctgacgtcgtcaaaatttcgttaaaattggattatttttgatctttaaccaattaatttaaaaaatttcaatttttcgtctattgaagaatgaaagaaattcgaatggcatttcgaaattgtgcccttttatccccgtggatattccgtttttcatatttcagtcgccatcacttgaggagaaaagaatgttttttatttgcaaattcctcaatattcaaatgcatttttcggtccttttccttttttcaacaaaattcgcagaaaatgacgacaattaacggactaattcacgtaaattctggaaaagtatcgcccattacggagaatttagcaaaccttccttttttattttatctcggaaaatgataattgcaaaaaacaaaaagg

SEQ ID NO: 20324 - DNA, 1365 bp, Heterodera glycines
  misc_feature (8)..(8): n is a, c, g, or t
atcgtacncaatttggaatgtaaatgttgttcccaatcctcctaggtggactacaaggcattcgcgcatttgatcacgacttgcgcagcggaggagttggccaaagtgggctaagcggggccatggacggacgggggaggaaggagtggcggggccgaggccaacgagtgacctgccgattcgggggaaaaccgatcatccatcccgtcgttctttccatccttacgatcgatcacccttttccccctcgcccattgtatctccttttgttctctttctaatcgctccctctccaaaatgtgtgtcccggctggcgagaatggcagcaccttctaattctataaaatgcatcgtttgttttcgcttcactcagtgcacttccaaataaaatcgaatggatgggttgcaaaatccaatgggaaacaaacaaacgaagtgaatgaaaatgctctgccaatggcacggcatttggccattaatcagccgaaaaccaaatcgaactgcctttgttgtcaaattaaataataaataaaaatagttttaaatatatttagaatactgaggcaatttcaagctaataacgtcaacagaagtgattgctaattagttttttgctttaccttcggtctttttttaattttcgctttttctccgactttaactaagatgctcttcatcactttaactgctcctatcatttaagccaactccaattcgtttccgctacgaaagcgttttttttcttgcaccgaaaattgggagggcgggaaagactcaaagaaaatgcgagggttggagaggaaaggttggaaagagagtgaggctgagaaacaaatgaaaaaaaacaggtgaggagggggagggttcttgacgagcgggtgatgttagccgaaacggacaattctcccggaggaaccatctcagaaaaaatcccatcttccgctggggtgggctccaccccgcctcccagcagcaggagcccacctccgctccccctttcccttctcgcctaaaccctcctctctcccccttttctcacttcccccttctatcctactggtaatttttaattttattctctatgccagaaaaatggctatcacttttttgcgataaattttataccatacaaatgttccccgcttccactcagagacgctgatagtaatgaccattctattctgctgaaacagtattcattaattctctatgccacaaaaatggatctctcgattatgccacaaattcagaaccatacaaatgttcccggtatgagacataaaattccgcagaggaatgatctttctattctacagggaataattttatttattctctatgccagaaaaatgattatcccttttt

SEQ ID NO: 20325 - DNA, 978 bp, Heterodera glycines
gccgtggaatcagggcgaacagtggaaatgtgccgaacatcgaagtgcgattgttgggccgaattgtgacgaggcacaaagtcagaagagaaaggacaaaatggaaaataaaaataaatgccccaggcaatcgcaaaaggaatggacagaaaggatcagaacttttacaaggacagacaatcgagacggaatatcatggacatttgggcacacacaaaaaacatcgagaaagacagcttcgcaatgggaaaatttgagggtaagcgaatgggggggggatttggacaatttgacaaagaacggcggacactcacagagatatttggccgactcatccgattttacgaaccaaaagcattgctgccgaaggacgtggtgtttgagctgcactgccgcgatttcatcaatcggcatgccatcagcgacaagcattacttaagggtgagtaggtaggcaatggcacggaaagaacggcaaaaaaaagttaaaaatttaaaatttaaggaaattggcaaaggattgtatttggacctgtgcgcatacggtgggtcattagcgagtacggtagtcactcgccgattgtacagaccacagttgtcgtcctaatacggtgtacagttgtcgctcatttgtggccactctccgccccctccacgccaatgtgaaaatgctcgaccgatcgacaacatcttattcgtacattgatctgttatggttgattcctcaaacactcaatgatttttgaacattttgtaatttgacagtgccaaacaggacagacgcaaattgctgaagggtcagtcgccggggcataggcacggccattgccctaaaatttgacattggcacggccattgccctaaaatttgacattggcactgccattgctcaaaaaattgacattggcacggccattgctcaaaacattgacattggcacggccattgccctaaaatttgacattggcacggccattgc

SEQ ID NO: 20326 - DNA, 1937 bp, Heterodera glycines
gcctcagacgggagcttcgcgccggtttttcaatttttgttgaccttggacgggcgcttcgcgcccgttttttaaattcgttgaactcatacgggcgcttcgcgcccgttttttagcttgttaggccgcttcgcggccttggacgggcgcttagcgcccgttatttaaattttgaggtacaaaagtgattagaagaggtgcaacagtgattagaagagtgatcagaagaggtacaactgtgattaaaagaggtacaacagtgattagaagaggtgcaacttgattaagaaaggtaaaacagtgattagaagaggtacaactgtgattggatgaggtacaacagtgattagaagaggtacaacaatgattagaagaggtacaatagtgataaaaaagaggtacaacagtgattaataaattcattaaattaaaatgaaaatattttttaacaaatttaatttaaaaaatacatgaaattctatcaattaaaaaaataattcatttaaacttataaaatttattcattaaaaaaaattaatttaaatataattttttatttattaactcaaaaaatattttaaatgaataaaaattgaaaaacacgaaaaaaatggtagaaaaataatgtacaccgcccggcttcgaacttcgccccccccccctcaaaatgatgcctcagaatccccaatcacacagggattctgaggccttaacgatgtcaaaagtaaaatctgatcacgtattcgtgatcagcgtcataaaatagccctaatctttttttaaagaagtgataaaaataccaaataaattttataaaatagagcaaaaaattgcggatttttatattattttacttttccaaaatatcttttcagaaccgagttatgaattttttactgaaaattcgaatttttccagaacttctggaataactttttttagtttcatgatagaaaatctaaataaaacccataaaattctcctgattttttgctatttttaaagctttgttgtatgaaaattgacttaccctgaggttagttatgaattttcaaaatttaccccaaaatcccgagggtcaaaaaaaatgaaaaaaatttcgaatttttaaaaaattctaaaaattatgaaacgaaaaacaaaggtcatattcgtaatcagcatctcaaaataccacagaaaaaaatttttcaccccccttttcaacccaaaaaaattttcaaaaatttctagggggcctagctcgaaaatttttgaaaatttccgaacatttagtacaccattcgatagaactttaaaagctctacaattttgccctagggcaatttttggctagaaccaacccccgacgagttatgggcccgggactcaaatgtcccgcttaggccaaaaaatttttctatttcctggaaaaaatcgaaaaatttctaaaaacatcactaatcgatagagctcaaaaaacgatgttttggaagtggtcttcgttttccctggaaaaatcgttaaaaaatcataaaattcaaaaaccgaaaaaccgaattttaggcctaactcgaaaaattttgaaaattttcgaaattttaaaatttggaaaaatcgagctcattgagctctacaataagtccgctggcgaccccctgctccgagcaaacccttacgagctattcgcctggtactgaagtgtccaaaaaaagtgattcttacgttgcctaacctacaggtcaggcctttgatctgatcaaaaaatttttgctggcaaagttgtaggcaacagttggggcatttcgcttttggggtctactaagccctgaaggcaaaagcaaaaaatttcgtaacagtgagactgtcagcaatgtcagttttcacgccgctgggactcagttggccctcggagaaaaaacctatagttttcccgaattctcctcaaaaagttgtaa

SEQ ID NO: 20327 - DNA, 3185 bp, Heterodera glycines
atttgagaacgacggaagagagaaagatgatgatgggctttcgaagatttgagcttatgaaggagcgatataacgaaaaataccgtatcgcaaatctgatcactgaagcattgggacagtattcagaatgagaattcacttttttgaaagtttatcatttttttatccatgaaaaaagtaaagtaacggaataaacattctttttacagtttttcgtcttcatactttaatagcaattaataaattcattcggctctctatttttccagatgttttttggcgaagagattactaaaattccgcgggaagtcggcaaagaggacgtgtgtaaagcaatttctcatcaaattgaggccattgacatagatcagtgcaatttgaatatgtatttgaagcctgacacgggagtgatttcacttgaccaattccaagcgatgggttccaaaagattgacaatgctaaggaaactcgaaatgcttaaagaaaaatttggaaatgccaattcgcaggatgagtacaaaaaggcatttcgagaggttgttgcatattgcgttgcgttatcatcgttaattattttatcaaggacatcggtgctctgatgccattggtaaccaatttatgcgtaaatgccggactcaatgaagcaagaagagaggaccgcatttcgcattttatacttcgtcttgctttttgccatattccagaacaatccgattggtttgttcggttggaaaccgaactttttcgcatgcgctttcaaaacgagacgaaaaaaaatatggcactttttgtggcatcgatcggcatacaattgaaccaagtaatggtggtttttttgcgatttgttgttatctcccacccctcacagtgacggtcccaaggttaagggtttttggggcctacgggtacccttaggaaaaaaatttttttttgccattgttttgaataacggcgcctttttaaatcagataaacgaagtttaaaaatttattattctcgcgtcgtttttaggttgacacttctgagagagagcagttagttgacgaactttgccaagcgctgtcactgagtgctgaagagatggaaggggtagatttgtacaaagtgaacgaacagcaatttgttggtcattattttctcaatgtttactttaggttgatttcgttgatgttttggaattgctttcctcacaccgaattctgttaaaaaatggcaccgcttacatttcctcaaatgaactttttgcatttgtggtgcctcgttttcgtgacaacctttccgcgtcgatgactcgagccaggaaagaaatcggatttttgcaggagaatgacaggctagtgcccctgatgaggagcatggtccagggaggagcaatgtgccaaaatgagttcgttttattttttattcatttggcataactgtgtcaaatttagaaacacaaatgtcgagcaaatcacttcggacatgattgattcactagcccaaagctcattcccactttgcatgcggcaaattcatttggttttgcggcgggagcaccaccttcgacattttgcaagacgacagttcggccttttcttaaaagtttgttcgttttttgacggatatttacatgtattttcagggcgctggtctttcgctcgagggatctttggaattttttaggatggaattcaccaagaaaatgaataacgagaaattttcaaaagaatactcgtataacattcggcacatgtacggaagagaaggaagtcgcatcgaccaaaggcctttgtcctgtgcctccattatccttggcagtttaccaacggcgctcgattgtcacgggtgtccgtataagtgagcaggcaccacgggtcaatttaaaaatgtgtaatttcttgaatttatgaaagatacccaaaggcttaggatatgaaaaaataaatcgttttattttagacacactgatgcgattcttttgggaaaacagctcgaaagtttgttccgactcctttgaagattattctgaactaattttcagctgttggtctcagcgatgatcaaataaatcacattttggacctctcaaaaacacaccgcttcgataaggcactcaatgatcattattctttttttaaatttgtttcgtttaaggcctgtaccaaatacttcgaatacactcataatatgactgatttggaggaactgatcacacatccgaaccaattcttcagtttatcacaaaaagtgcggcgtggcgattttaatcaacggaagaacgattctgacaatgagaacaaagaggaagagttcgactgaagagaaaagtgtcattcccattgctaacttattaattcgttttcgatctctaaaatcctactttttcacttttaatctacaattgaggtcttttatctcccaaatatctgcgtgataaatggatttaaatgattgcttttcaattctaaaggccaaacatgccaaacagcggcgtacaaaatcactacagaaaacgcgtcgcatattactacgattgtgagtttgtttcaattgctggtacaaatgaagttggtcccccatattggaataagtttttctgaaaatacagcatttgctggggtgcaagattccaaaacccatcatgcgaacttatttttatgacttgtaataaaacattttttgcgaactgtggggcgggagcagctttcctattaccaaattcccttttgcaattaattattttaagccaatgttggcaactattattacggccaaggccatgtgatgaaaccgcaccgaattcggatgacccatcacttgttacttaattatggtgtttatcgtcacttggatgtttatgtgcgtactttcgtcgttctttttgattgccattcatttctctgtttcagcgtcccttccccgcctcccttgaggacatgacccgctttcacagcgaagagtacatggacttcctccgttctgcaactcctgagactttgaagcagttcaacaagcaaatgttaaaatgtgcatttattttccgttttggactttgtacgttttccctttagttaatgttggtgaagattgccctgtctttgacggactcttcgagttttgacaactttccagtggcggctctttgggtttgtctgcattttaccgtttgcatttcttttccttttgttagcggctgcggtaaa

SEQ ID NO: 20328 - DNA, 2067 bp, Heterodera glycines
  misc_feature (2022)..(2022): n is a, c, g, or t
  misc_feature (2058)..(2058): n is a, c, g, or t
gttttttgggggagggaaatggctttttttttaattttttgctttagtttcgttttaattaaaaaaaatttccccaagaagaaatttcgggaaatgttattttaaccaatttttgtatttttggcttttacgtcaaaaaaagccccaaagcccatttttcaaaaaaataaaacgaaacgggaaactctaaccaaattaatttgcaaagcgaacgatagaaatgggcggggaatcatttggggggcaaattaagggccccataaatcgtgcgtaaaattggccgaatatgaacccaaaaattgaaagtgatctttggttaatgttcagcaatgaaaggggcggcgtcgaaactgaacagaaaatgcaatttttggttaaaaaacgctttacaaaaaagcgatctttcgattggaaaaggagaaaaaagaaaatatcgaaagatttattggcacgggttaaatcactttccgtatgacatatcacaagaggaagtgacttaaaagaaaatgatggattgttttgctaattcactcattaagcgatccattcccttctccgtttgtttggcccttgggctaaaaatgcttttcgttgtgccaacccatgagaatatttactgacgagagtgagtcttctcacaacgagtcttatgttgtgtttgtgtgcaaatattttcaaattggcaaaggcaaatgatgcattggttttttatcatttgccaccaatccctttaaaatgccatccgtttttatgaatttaatattgccccccctcccccctaatcggatgattgaattttgggagtgttatggaaggataaacgccattcacccttctcaaagtcaacaactgctgatgtccgcatggaaatttatggggaaaaactcccgccggggaatgaatgactgatttgtgcattttattggcggcaaatcattcaaacgaacgaatgaatgggcaaagtgggccaatggtcgtcgggaaggttttattaacaaaacacgggaaaagcgaggagtcgagagaggatctttgaacaaaatgataataatctgattaaagggggatggatgggggcagcgtgggggcagcgataagccaattcaatcatattatcgagaatttgtttctacaaacaccgaaaatcaacaaaaaaactataaaacccccaaaaaatcatttgagaaatccgagaaatgggattcaagtccaacagctgtaaagagaagctaagaacttcattcatgcgcccattcatttgcttggcatttggcatttcgccatgcatccgtcaccaacgcccttttcgtgttggcatgaattaatgcgtaagtgcttcatgaggtgtgttgcacttgtggattatgcattaattggcttcatttcacacgaatcattcactgcccccattcaaagaaatgccatttcgtggggagtgaaaatgccaatgagaaaagaaaaaatattctttaaaacttttatttaatttataacgtattttctgcccgttttgacattggcattcggacagaacacagagaattctcttcttccttccttctctgctgctgatgtgctgttggccgagccctccaactaatagcattttctgtgctcaacagtctttgtggccattgcctgaggcgatggctttgtcagtttatgtgtggcaaagaaagagagaggcaaaaagagaaagaggggtagaaagaaaaagagtgtacttgtcttggaggacagagagaaaagacatttggcaaaggacagagaaaattggaaatgattgcctcgggggacaccgacggacagcggcaaaataagggaaaaagcgggcggcattccctttttacgactcatattccacgccgggactcaagtgtccaaagcacaataaattatttgcattaaaaagccttaaaatgctaaaaattgaagtgaaaattacttattgttaacgttaaggacatatggcagctctttttaatgtgatttttttattcaaaagagaattattacctatanaaaatttaattttctgagttttcatgggattaattntttaatttt

SEQ ID NO: 20329 - DNA, 2388 bp, Heterodera glycines
  misc_feature (2233)..(2234): n is a, c, g, or t
  misc_feature (2249)..(2250): n is a, c, g, or t
  misc_feature (2252)..(2252): n is a, c, g, or t
  misc_feature (2263)..(2266): n is a, c, g, or t
  misc_feature (2286)..(2287): n is a, c, g, or t
  misc_feature (2290)..(2290): n is a, c, g, or t
  misc_feature (2323)..(2323): n is a, c, g, or t
ttcaaatgtttattaaatttcaaaaaagttagggccattttcttgagtctctaaattttcaaaactcttaggttacaatttttgtaaatttttgctaaattttttatatataagatagtaaagaacaggtagagctaccgcttaatagcaagattattaattagtttaagtttgactaagttatgatttattatttagcaaataaaattaaataataattaaatttaaaattgctgtcatcggtattttgtcacagcatcgaatcggaatatggccttaaatctatctcaacctgctgagcttgtactgctccaactcaatgcatgaaattgaagttgtacaggctcagtgagaaccaaaagtacaaatctaaggccatattcggactcggcgtagctgatttacccagtgttatgtaaattcagtgttttcaggtagcattagaaaaattttttgttacgagctggttccgaaaaatgccgtttttggagacaactttcaaaaccggctctccaatagttccaatattataaattaaaattttttatagtgtatttgcatggtattaattcaattctaactccttaaattcaatgcccgtgggactgatctcttgcccacaaaatggcaactcatcatctataataatggcaggtattttgaaaaaaaccaccaatatgaaaattttgacgaaataattatttctttgctcaaaagcaataaaattttaaattcttgctaccattagatagctctaaatgttctctattagattgcaaattttcaaaaaatttcgttaagtttcaaaaagttatggcttgagcaactcaaagctcgttttcgaacatttttggccataacatttctgaaaattaatgaaattttgcaggctaatagagaaagaacatttagctctatcgaatgaaagcaaggattaaaattttggttgctttaaaacaattttataagcaaatattttattctgatgattttttaaataacgcccattgtgaaggtttctaaataaagacatagcttcttttggattcatgtttaagttttgtttaatttgaaaaaataaaatatcgaaaaaaactcatgttgcaccctaagcattttctcaattatggcatttttatgaaactgtgccgcagcattcattgtttgtttgcttttatttgttgctctacatgaaaaggaaaagcaattttgacagtgaaaagcgagaaatgcgttgtgctgaattgaaaatggtggggaagggatcaccaaattgataattctgatcattgatcaccggtcgaaatattttgggggtcaagcgatcactaaaattgcttctctcttttttctacaccgatcagtcagtcatcagcgggcttcagtcatttgtttgttcgacgttggacgacgtgtttaagtttagtggacttggatctttgcgcagatggctggcgtcaaatttctggagagatttaaaggaattaattagcccggcaaattttttgccattgaaaccccataaaaagttataaaatccccggttaaaatggcatgattggagacagtgccggatcattgattttttaaatcaggcttattgaatgtgttcaaattcgatcattagtacggagcgaccacaacagtaattgattagcccaattcccttttttgggattttattggaatttttctgccacttttaaaaacctttactcgagagtctcgagctattaaaaaataaatatattttaaattactcacttaacgcccgcggcggacgcgcatttgcacagcgcttgcgcgttggcggtgttcagtccgctgttgagggcgcacttcttcacttcctgcaccgccacgttgtccggcgggtagtccaagccgcacctggtgcagaattaatgtgccgaaatatgttggaagggcggcattttgaggctcagcatttcaaaactgggacggcactttttttgtggggggggggggggcggcactaattgggaatgactatttttgccattttgaactccttttttcaaaaatattgtggaatggggatccggcggtgccgttacgcctttagctccctcagctcctccctggctgtgccgttgagtcagaatgctgtttataaaaagcgggcattttctctgcctttttagggtccttgtcttaccagtctgttcgagagtcaaaagcctaacggttttttgggaggtttttgtctcgnncctccgcttgttgtnngnccccccagccnnnnttgttgttgttcccccttgnncgncttctagcagttgcccgccttgctgttcatgcntttgctcgtgcaacgatacatttttttgccggccatcccatcaaaccatttcccattgacctgca

SEQ ID NO: 20330 - DNA, 2382 bp, Heterodera glycines
aaaacctgtaatttttattaaataaccagaaagaaaacattaaaagacggcaaaaacaccaaaaaacaaattttcaatttttcccaagggaaaagggaaaaaaaataatattgggcattttctgaattttatcaaaaatattttcgacaattttaatttttatgttttttaataacgatgctttcttgggctccgtaaattctccgtttttttcattccaaactttgttttttaaatgtcattttgttgtatcattgctcattcaaattatgactaattgtcgctttttcgttggattgtttggttattcattaggaaacataaaattttgggttttattttgcgacaaaaaggcaaattcttttgaattttttttaatgaaaaatgaaagaaaataaacccaaaaatcgcaaaaaattgacaaaaaatcaaaaaattaaataaaattaaaattaaataatttaaacaattgcaatttgaagaaaaaagaaatggcgaaatagggaacaatgagaaagtggggtgcttcaaattattaagggtgcatcgaaggacgaacccattctggtgcaaaatctgttaagaaattggaaatcggtcaacatttacaataaatctaagaatttgatacttacaaactacaaaacttaagtttttaaacaaaaatttataaaattgtttcaaaaagctcatcccgcaaaaagggttatgaaaagcaaaaaagaatgtctgctcgcccgctgccccccccccccctctcgcaatcggttggacccgaattcaagagcttttgtactgaattccggaatttatgtattacgcattgtcgagctctaaattactccgttttttgatagttgaacaaaatctctcaacaaatgtggctcaaattttcaaatttttttttggaaccaaccgttaaaactggcaataaattgcatcaagacgaaaaatttggacgatttttttcctcttaaaatgtttaattaatttttccagaaaaataatttatttttcattttacaaataaatcaaaatattacgtaggatttaatgaccgctataaaccgaaaatttattatttctttaattctaaaaatattttttacaaaatattttcaaaattaatttttgtaggatcgattaaaggacatttcagtaaaaaataactaattttttaaatattggctcagaatctttaaaaataaatcactttggtgcaaaacctaacaaatggagacaaaatgaaaaaatcttatttaaatgttaatttcccaaattggcaatcatttaacgattttccatttatgcccaaatttatacgaaatgaataaaaaacaaaagataatgatgatgttcatcagcaacattgaactctttgaagccattcactttgagaaccgccaaaatgcttaccacggagcaaatcaaaaaatccgctgattcccgacgattgcaacggtctgtttgaactgcgcgggtgggcagggttcagttgggtcaaaaatgatgggtctgatttaaaaatacataaattattgggaaaaaatgagtaatttgggaccggaatttttgaaaaacaaaaccgggcataagaaatgccgaaaaagttgggatcggcactttgattttcaaacaaactctcaatttcttgtcgatattccatgttgtagcggagaatttccatcagactctgatcctgtcgatggcaagtcaaatttggagcagttgccgtgtaaatgcacgccttcgtctgtccaattggcaccatacagtcgggctcggcggcacaaagcaaagccatgcaaatttaaattattatattttaactttcatagggagaaaaattctatattttaaagggttaaaagggatcggaatcgacctttattttttgaaaaaacttgacccaaacatgaaaatatccgaatatcgggcccagtcctatggaaaatacaagccgggaccaaacttaatttcgacactctgtcaagtcgacactttataccgcctgtcgacaacagttggccgatcgattggaatgaaaccgcaaaatctaatcaaagtatccattatcataataataccggatattagcccaaaattgatgtaaaatggacgattttttaatgaattacaaaaaagttcgaagttttaattctcaatttattatccttttaccatttcattatttgccgcgtttgctcggatttgtgcataatcacaaagtttgtttcgaactgtggcggggtcaatttttgtgcttttgtcatatatttcagtcaatgtgtatgttctgttaagctccaaaatgggtgtacattggcaaaaattcggaaatttcctggaaaaaagcgaaattaaaagggccggggaaatttt

SEQ ID NO: 20331 - DNA, 1131 bp, Heterodera glycines
gtaacgtttcggcaatttcaacagtgaatcagacatttacattggattcgaatgagtggaagaacccggtgatatgctcaatttgaggcgggagggggggcactcgccgatccgtcacaaaatggtgcagcaccccctcccattggcatttccgccgcttccgttctttttttcctctcctcgcctctttgcccccttttcgtccacagcctccgcgaccgaagaagtggccaagtcgaaggaggaatggcccaactcggcacttttcagcagtcgctgctgttcctggaaaaggacaatggacggacgaacgaagccggagggacaaggacttgtaaaaggcattccgcaattgaggacataaccgtttcaatgcctttgccactgagcgctgaaaatttggcacatccaatcgaagtttaaaggatttcccttttggttttgtctgtcgctccttttactttacccacccgatgtttcacaataatgtgcgttttgcttttccgcaaattgccgtccttcttcttcgctgaccattcgcatttctttcaggtcgcatttatttgccacaataaacagcaaaacattgcccgtttcgtcgatgcgttcaacttctacaaaataacaacaaatttgtgtttttttgggcttccgtcgactgaaaggctcaccttttatccacgatgccaaatccctaaatgattggcgatttgtgatgtcaaagacgagcattgcggccgaggaatttcgcatataaagagggacctgggacaaaagggacggacaaatcatcacaaattctgtgccaccccccccgtcccctccattgaccatttaccatcgatctgaaccgttcttggccggcagtgtcccaaatttgaagttcgaattcgcgcccattattcgccctcctgtaaaagtgccaaaaagggaattatttgtctcgagtgactgacgatcgtgaacagatataactggcgccgagtgtcgagctcatctgactggtgaagccctgtccgtcgtgacgcagcaaaatgctcgtctttccgacccctaaatgacctcagaatggcaaattgcaatgccaagtcccacccatgtcgcccagtacgacgactttcgatttgattg

SEQ ID NO: 20332 - DNA, 1051 bp, Heterodera glycines
tacgacgactttcgatttgattgccctgggaggggccaccatcgcattgtgttgcggattctgccgctttcgcactgttccgctgctctgctcattaatctgttgggttgacgaagaagagaaagaggaaaatggcatttaagaaaagacagccagtcaattgaatggttttgttttaattaacttaagaaaatttgacggaataaaaaacaaaaaatgcttttgaaaaagttctacaagaacccttttaaatttcactttctgcgattgattggaaaaaagcaatgataaataatatgcttaaaacaaagcgagtgaaagcaatcaattaatttaaaaaaatatttatgcggaaatgcataggtaacttgtttaaattataacttttgttgcatttaaatgaacgattagaatttgtggtaagacacaaccaaatggaaagagaaaagggaggagaaaataaaaggcatttaagtaacagtgaaatggccaaaaatggacaaggggagaagcagacgaatcaacaaatgctaacgaattgtcaaaataaaatataaacagaattagtcacacataaaaaagaaaaaggtaaaaatggggggggggggagaaaataggacaaataaataaagaaaatatttgaaaagttaaaacaaagagatggaaaatgcgttttgatcagttgcggaacacagaaaatgaatgacccttatcgacgaacgatcaataagacggagggagagggctaaacggagagagggaagggatgcgagagaatggcaactgatcactcaccgatcgaaatggaggaggaacaaatgccaatcaatggtaaatatttccaccacctaaaaagtcaaataaagcggttgaaacgacgccaaaataaacaaacccttcgggggcttttcggtgggcttttcttttgcattatttaacgtcaaaataggctcttcataattatgttctgaaataataaatcgaatttaagagagaatggcaaatcgaaaagaatggaaaatacgcaaaattatttatttgtcaaaaatga

SEQ ID NO: 20333 - DNA, 1765 bp, Heterodera glycines
  misc_feature (120)..(120): n is a, c, g, or t
ttttacagaaaaaggaacgtcggaaaatcgaaagttccccggtcttcgcctaccgatgtggaaaaattggtaaattctgctttcaatttcatcgaatgcgccctaattggctttcacatntcatagttagcaaattaaacgtctcgactattttttttttgttccggacacttgactttttgcggcgcgtcaaaataaatattcaaaaaatactaatccctatattttaaatttttgaatcgggctgaatacgttatctgaacccttgagtgaatactagtaattggtttatttgtgttgcaggagtgcgagttgccgagtacagaaatgcgcaagcctttgctttccggtgagccgaatgcaatgacattgttggaggaaatcacggagacagaagaaacggagaggggggacaccgatgaacaacaacaaaacaacagctcacaattcattcgcactgacaatgagcaggtgtggtttagtggtcaatgaaatgggctcccggtaaattggacaccagaaaattggacaccagaaaattggacactagaaaattggacaccaatggaaaaatggacaccagaaaattggacactgttgtaaataaaaatgaaaataaacaaaataaattactaaacaaaaattttggcttggcctaaaagatctttatcttaatctgccatatgttgtttataagcgtaaataatatggaaatgaatttgttattatttttgtaacttcaggagaagaaaaacatcatatcattcataaagaaataagttttattactcatttctggtgcattttttggcccattgatcaatcgtcacccatttctggtgcattttttggcccattgatcaatcgtcacccatttttggttaattttttggcccattgatcaatcgtcacccatttttggttcattttttggcccattgatcaatcgtcacccatttttggttcattttttggcccattgatcaatcgtcacccatttttggtgcattttgtggcacattgatcaatcatccctcatttaacccatttattctactcaaatttattttcacctaattcttgattttttttaaaaaggaaatcttagtgtccaattttccggtgtccaattttcctttagtgtccaaaattccggcggtgtccatttttccgcttggtgtccaattttctggtgtccaattttcttgtgtccccttttccggtagaataatcccccttcgccattttgaaataaattgttgaaattgtttacaaattttcatggtcgtataaagaaaaaaaattaatcaccattctaagaatctttttggtagaaattctgattccaagaaaatctcctcaaaaaattaacccttgattttaccgtctaaatcagggctggacgaattacgggttacgtattccgtaattaccgcgtttttggaattcccgtaattatgaattacagttgagattttttgttttttttttcaatttttcttctacagagacccaaattcgtatttttttaaataatcaacccgaaactgcgcaaattaaccatttttagtgcaaaatctggaataagtaaaattaaatttacagaaaacacgggctggagtacatacaaatcttgaaaaaaataatataagcacaccataggttttagctcagggggaagtttgggcatcatattaaagcagggttaccctttgtccttatttgtaagatttgtccttattttgagggtccaaatcttacaaat

SEQ ID NO: 20334 - DNA, 2184 bp, Heterodera glycines
  misc_feature (49)..(49): n is a, c, g, or t
ccctttctccgattttgccccctttgttttctttttcctctggattcgntggcatctgctcggaccttttttttcttctcataatcacatcctatctgatgctattcgccccccccccccgtttgttggtctacttaagtggagttgctgcttgggtaggggacgggaagcacgggaaatgtggacacagacggcgaaacccccgggactaaaacccggccactctcaactcaattcttcgccgtccgccgtcaactttaggccgaagaagcggctatagacttcaattgctcgttgtcccttgatgcttgccaggaatgcttcccggaccatacggcaggaaaggttgaatgtcattgtcgggacctcgacctcgacgcattgttagaaaatccggagtcccggctacctatcaccaccgccaagtccgacttcgcaatcatggccctgctatatttccgtctcgcccactcactttgtagagttgaagagcccagactagtcggttgctacagttgttctacaggggctcaattcgactatgtgtgccattccgacctcgaaacagccttagccacagtcgtttgtgatgacggtcaactctttgttatcaactgcgcaccaaacgggacggcagggaggcacatcctaccatatgaccgctctgaagtcgcaacggaatgccaagtgcgttgtccgtgggggtaaaagcaaattttggctgaatggcacattacggtatatccctcgccaacaacggttcggacaccagcaaagaatatccgaaactctcccctttaaccccgaaaatttcaacttttggtcaggacttgagattgacttattctctccccttaaactcctcggcaaaggccccgccatcttattgctttttgccgtcggcctcgtcgtcctttacttattcgtcaaatattctccatttttcaacacataccgacttatcgcccgtctattcatcggggccattttaattaattcagtcggctcattctctccaaaagtcagcaccgctttgccctacacaaatcggcctattcagcacatcaacacttcgccgatttggacaaatttgtttctttgtccttttccccccgccttagtctcgaatctcccccctccgttcccttccccagtttatcccccttttccgacacgccacaacagaagagttttgaaaaatttaccgatttattaacagattaacatagaaaaggcactttgctttgaagtttaatttaattgtttttaatataaaggatatattttaaaattttaaaaattattttaaagaaaatttgtgtaaaaccaagcgttaattaaagacgaataatatcgaaaattacttttaaaatttatactagcaaaaatttcaaagcacaaatcccaattttaattaggtcaagagttaaattaatgttttttcacatttcaattcggcttaactcagaaataacattagtttttttttaatttcattatacttcaattagtttaaaatatttaaaatgagcatttttagaactcctttaaaaattcactgaattcttttgtttttattcacatgacaattaaagtggctatttaaaacgggttttttggttgttgcattccaatttaaaagagaacgaacgaatgatgccattagcgagtgaaccaaaaaagtaaaagtcacaaattccttttaaaaaatattgatgaatttcgaagaaataaactggaattgaagagacaaattattattagcgaatagggcaaaaacctaagcaaagaaagttcattcattgtcactcattcgttggaacagaacagcgtaattgacggtaattaattaattagtttttaatggcctttgtttcttttgtcaatgtttgtgtttgggcaatcacttcattcatttcatttgttctttcgttcgtttatttcttctcaaattgcgcatttcaattgcataattcgatggtcccttttcgttttcgtttgcatttgcccttggccattcgatcggctgactgttcatcatccgatcactccacgcccatcgccacttttgcgaacggtttgcccacccttttctgatcatcgacagattgtcagcctcgcccgcccacccgctgtttatccaggaagattcccattaccgctcgccctccctgcggttcttcg

SEQ ID NO: 20335 - DNA, 2971 bp, Heterodera glycines
tctctttattcttctctctctctctctctcttttccactttttctcactcttcctctcactatagcgcgcgcttctctctttcgctttctttctccctccctcactctctttctttttttctctctcacttcctctctctctccttctctctctttttcttccaaacacatataaattttttttgggcacattattttttagtgatcaactaaccgtaaaaaatggttaggtgccgaaaaaattcctatagagctggaaaaagctcttgcaaaaaatttatgacgagcaaaaagaaaataaaatttccacaaatttcttttaatttttagtgtgacttgtaagcctaaaaaactaacaaattaattaactcaaattaaaaataaaatgtaaaatgccatttttaaaaagttcaccaaaccgaccgactcggaagagccttcgatggacgattttcacatttccgctggaacaaaaaattgcaattattcaattgaacaacaatcattcagcttcgaagcagtggagaaataccacagcaaagattttgcgattccaatcatagcattaattgatgaaaacttcagcgaaatcgacgtaaaattgacaggtcattaattcattcattgtactgtagagatacggtacagccaacgaagatttacattttgagggacacaaatagcgaatgcaccaattcattaaaaaccacttatgactaagctttggctttagaatgaaccgaattttaattttaaaagttcattcgttttgtcggcgcatatttccatcataagaagtagacataaatattgtttgaattttaacaattaatatctgttataaaattttaaaagcatttttcagatgcaaataacagaagtttaatggaatttcacattggcacaaatcggtctctgaatgtcacatttcccgacgtaaaaaatggaaaaatattaatataaaatacataatatttatttttttattttaaacattattttaaaatataattatttttaataatattttaattaaaaaaggtgtcgccttatgaccaaaatttcgcaacattgccaaatggaagtttcacaatgattctgtgggtggcactgcgcaagaacagttacgaaattatgttgaatgacacggcgttggacaacagacaattttggccaaatgattggtgggaggggtcgggacgagagaatgtcacacatatcgtggtaaaaactgatttctacaaaataaaaatatttcataaaattacagattttttcgaagattccatttttgagttttttgggtattaaattctttttctactccaattcttaatcaataaatggcgcatttttctgttacaatttaatctaatgccccgtgggcgggggtggcttttcgcgggggcgggggtttgctttgaatttgctccaaaaaatctcacaaaaaatgaatttttatgaatgatgtgttgtttctcttaactttgacctcgtcatcattattttcgtcatccttttcctcttcagccaggggccttatgctcgtctcgcggtttagagctaaaccacggttaacggcgttaaccgtggttaaaaatccttaaccggtatgctcgtccttccctttttaaccgtggttaaggataaaccacggttgagttaaccgtggtttactcccttcttaaccacggttaacgcaagttaaccgtggtttatttccaaccggtatgctcatctaaccgtagtttaatctttcttaaggaatcttaaccacaactcgagttgtggttaacgtaaatttatttaataatttaaatagtaaaataaataaataaattttttctagggtaattttacatgcagaaaaagaatctgacttttatttttgtctatgatataaattattgacggattagtgttatttcatcaaaaaatttgcacacgcccaaaccgctaaaatagctttttaaaaaaggtgacaaaatttaggtacaggccattttttgaaacaggtacaactacggttttgaatctggtaaatcattttctcagatttggccccaccatattaaaacatttgataaaacaaaacagatagaaggcctgatctaatatgttcaaaaattgtatttcatttaaatcgagtccgggcttcgcaattgtcaagatgaatacaatattcgtgattagcgactcagaaaactgacgaatacatattttcatttattcaaacatagacaaaatttaaaaacctgaccctggcgccaaaacgtgggcgccaaaacgttggcgccaaaacgaccttggcgccaaaacgtgggcgccaaaacgtcggcgccaaaacgaccccgaatcttcgctatttacaccttttttggggcgcgcaaatcgaaattccgaccccaaaaatgtcggaaatcggaattccgtgccatccttggtgtgcacccatttggacaacacttggcgagcagttgcatttggcctatcatcagcaatttgatcggggaacaggtcatcagattggatttaattcattggtcaagatcagtgaaaattgtcagcgaagtgtggcgacgtaaattgtccaactgattgccattgtgtcgggacacgttgaattttattttacgacaatttttttgtttgattcacttcgttgaattgatgatttcttcgccgaatttccatgcgatgacagtgtgccaatgctttgaatggacaagcggtggccaaatggcttttcacgccactgcaaaacaatgtgccaaaggtgttcaaatgctggttgaaggaggattattggcattttgcgtcatagattgaagccttcaaagcggtgcttacgaattgattatttggcatttttacagtcttttgggttcgatgacaaaaatattttggaaggcactttcaatttgtttttgacgacagtttttttacgaattcaaattgtggaattttaatg

SEQ ID NO: 20336 - DNA, 2419 bp, Heterodera glycines
ccgcttaaaaaagttagaaaaattagggaacttttgttcatttttttaggttttggttatcaagcaacaaatttgtgcgcatttgcactatcagaaaattgaaacagcagctggtgttggatttgtgtgtctcgatgttaaggccgctttggaatttcggctcaattcggccaaggacaatttgatcagcttcgacgacgaattgttgatcaaactgagcggggaccacggccaagggtttaccaaattgaccatcagtttcggccaagcacttcgaaacaactctgcatccaaccatttcattgctgcagttttcccggccaaagacaccagggaaaatttggaacaatatggtgctcttctctggccccaaattgatcaaatgaatgcattgatcaacagaccgattaagtggtaaaaagggtgaatatttttttaaaattgtctgaaggtttctcggaggtgatgtgagctttgtgtgggcactgatcggtcattgcgggtcagcagtgacttcatttccatcgcctatctgcaattgtcatcgtgatcgattgctcaccgaaggacagcagtgtcaaacccggacaatcatgcagacaacacaacagtcagaacaattctccaaggccgtggaaaacggagagaaagcaacagccgcagttcggtccagcacgatgggaattgtcaaggcaccgctcatgaagacaattgaatttgatcggattattccagcaccgtttcacgtgttgcaggggttggggaacgcacttgtccgagaacttgagcagcaaactgatgccacaattgccgttcaacaatttctgcgacagataggggctcggagggaacaatttcgtaaaaaggacatgacgggaaataccataagaaaagtcctcaaacgtgcatcggaaatggaacatctctttgaatcgacgtggccaaagacaatttgccaagctctaatgcacttaggccaaatccaaaatttcacaaaagtacaaattttgagcaattcactcccaaatttataaatttaggctcaaccactttcgccaaatgacttggacgcatttgaacaccaaattgagcagttccgtggttttctgacccaagaacaacggatgcgcgacttcctatctcagaaaccgaaggcccacttattgctcaatcatttcgtcccatttgctcggcaacattctttcctcggcttgctggacgagcagggtggcagcaaacattaattaactcaaattttcaaaaacattaggggatgaggcacttcattcggtttggagaaggctggagcaatggtggaaatgcatgccggacgcggaccaaattctacaacaattggagcaccattttgtcagcaattggctccttgacaccggcagaattgctgagatgaagcaggcgagttttgagtggcgtgggaaggggttaattttcccagaaatcatttgaattttaaacattttagaggctggaagaacaaaaagaagacgacaatttttcggagcattcggatggtgaaaatgatgaagactcggtcatcgatgttattgggtgatcaaattttgttttgttttttaaatttacttaaaaaaattttagaataatatgacttaattattttttctttattcgttgagaaaaacgtgaaatattgcttaattaaatatataactcaggtgggattgaacctgggactccctttttggtggcaaactcacagaccactaagacaaaaaatcaattagtttttgaactgggggcttaaaattgactcggtgtgtcccatattgagaaaatttaaaattaattaatgctaattgagcttgccaggtgataatggcttctttttgcgctttttcatttttggcatccattaaattagtttgattgtgtttttctttaattgaacccttcggcggagaatcgccattgcatttaattttcatatttttttaatcacaattacggctgaggaatgaatgctttggtaattgtgagaattgttatttccgttaaaagctttggtcgatttgtactgagatgatgcccattttcgtcttattggaaatgtttttttgtcaagcatttgatgaaatcgatatcgccgttcccccgggaattgccccccccccccgtcgaagtgcccttgggctatgcccctttcgttccatttccaaacttcgcacgagctggcttctcctctcgccacattctcatgtttcattgctttttcgacaaacagacagactaactttggtctgaccctatttgaacatcgttaagaaatcggtttctaaatcgccattttccatttatttaatcaaaggcacatttcgttggtggttaaacaaaatgtaggagaattattggcaatgaatgattggcaatttctgctgctgat

SEQ ID NO: 20337 - DNA, 2568 bp, Heterodera glycines
aatgcaataaaaatgaaaaatacacccttaaaaatcgacctaaaaattttcaaaaaatgcacccacccttaaatcctgaaaatttcgaaatgtacttcatttctaactacaatccgtgaataaaattatttgccttaattttagctaatttacatagagaaaatatcaattttaataaatttcacccgtacatttgaaactttttcgcccctattttgcgaattttttgcccttatttaggtccctaaattagaattttttaccccctaaaaatcccatccctatttatgattgaaatgtgcttcttttttttttttgcttctcaaaccgcttttttgcggcgcacttttccagaagaaatctcgtctctttaggtaaaagtctatagagacgagaggttcgaataaagaacgaattgtatctagcattggttgagcaataagctgttcttatagtgaattcgtttttacagggtttttggaaaaagaaaaggattcgttattttgtaaatttattttacctaaaattatttcatgaaaaagttttaagtctatttttaacctacgactctcaagcgacttttgatcataaatgtttaacaattcagcataattaggtaaatcagcagtataattgttacgtctaaatattactctcaaaaaagttttttgaacattctccaatttttctatatccttttttaaataaggattgaaaattggagatccgaattctaaaattggtctgcaataaatattaaacaaatttacaagtattttcgtatcaccagttttgattgactttaatatagcaaaagcagatcgtaatgcttttttcgagataatttcaatatgttgtgcccatttcaaatcattagtaaaataaatgccaaggtctctgactggttcgtttccgggatttttaggaattggaaagtcatcaataaaataatttattttttggtttttgtgtcccaaatgtaaagttaaacatttatttgaagcgattttaaggccgtttaatttacagcattgattaaatttgttaataaaattttggagtggagaaaaggaaatatttgaaagaacatgataggccttaagatcatcggcaaatagtttaattttaacattttcagtttcgcagaattttggtaaatcgtaaatgtaaatgagaaatagcagtggtcccaatattgagccttgcggcacaccactgagacagggatattcatcagagaaatcagacccgattttgacgaaaaacatttggttttctaagtaattctgaatccattttaataaggaattatttataccaatgctttggagcttagatattagccggttatgtggaaccgtgtcgaatgctttagctaaatcaaaataaattacatcaattgattttctattttctaaagcaaaactgaaatcatccaccacttcaagaagttgagtagtaacagaatgtgctttacgaaaaccatgttggcaatttggtaacaaattatttttttcaacaaaattttttatttttcctgctatattttcttccaaaattttggaaacagaacatagcagggaaatcggacgaaagtcgactgggtttaccggattttgaatttttgggacagggcaaataattgactttttccatatttctggaatttgggcagtcatcaatgagaaactaaaaatatggaaaagtggtcggactaaattttctttacaatttttcaaaaaaatgttgggaattccatcaatactagtgttgttagaatttgaaagtttggaaagagaaaaataaatttcatatggagttatgttaaaatattcgatatttttttcaggattttctatgcattgaaattgttctaaattttgatctgtaaaaacggaaaaattgttgcgctaaggcattcgacttttccttatctgaaaagagaatcagaccatttttatcagtaaatgcaggtatcatggtatttttaattttaaggaaagaatttataaattgaaaacgttttttagagtctaaggtccgcaaaaacttattttcgggatttttataaaatttatttatttctaaatcgatttttttcgaaacttctaagaattttatttttatatggtctttgtgaatgtccttccaaagctgtttacgatagatgattagtttcaaaatatgttctggcagtttttcaactttttttttgtttgtatgggaacataattccttatcaaattatttaggaaaaacataaatttttggtaaataagctctatgtcaggacaatcagaaaaaaataaattccaatcaaccattgagagtatagcatttatttccaaataatttgcttttttgaagttataaaattttttagaggcattactattaacctgtaaatttatgctgaattgaattgcattatggtcactattgccgaatgggggttcaactataacattattcaacagattttaattgtttgtaaataataaatctaataaattgttgcaccgtgtaggagagtttaccattagtcttagtttaaatccctctaaaaag

SEQ ID NO: 20338 - DNA, 184 bp, Heterodera glycines
ccccccccccctacccctccgtcctcctcttctcttcaccctcctcccttactgctttctctccccctccctttgcccctttcctctttccttcccctctcacatctttgcccccttcccactctcccctttcccccccccctacccctccgtcctcctcttctcttcaccctcctcccttact

SEQ ID NO: 20339 - DNA, 1953 bp, Heterodera glycines
  misc_feature (25)..(25): n is a, c, g, or t
tatccaatgagtttttaaaaatttncgagtcacaactctcacatgagaaaaataattaggaagaaaaatgtattacgcccttcatactgtttgtgaaccatgcaatattttcagttgagtgttttataagattacaatataaaaatagtaaaaaagagaaaaaaaaccaaaattcaaagtaaaaaacatggattattgaaaggtcatttttgaatggaattatgcatattttaacacttatgtattgagaaagcaattttcaataaaaaaatacccaaacaaacagtcaaacagtaattgattaatgagcattttgaagtaacagcatggaagtcaatcgaattcttctccgacttcccattccacgcacaaagaattgcgaaccagaagaagactattgcggggagggcaaatgcatgtttagtcgtaagttcagcagaggccaatcataattacgaatgacaaatggcaaaactgtatatgtatttggacgataaacgataatttgtttttgtcgtaacgacatgttctgagaaaatgtgctaaatttgtcgtccgttttgtcgttcgtaattatgactggctcccctaattgaggatcgataaatttcgcctccttctaaaaatccgctcaaatttcagctgctgacggagaaggtgcaaatatcttcatgcatgttcagtattgtacgaatgaaacattgtgtgagaaaggggttgaacaggatattatcagtaaggaagacaacacggtaactggacgcttaacatgcgacaaaaggacttgttgcgagtggaatttgtgcaacggttcgcctttttttattagtgccgtggggggagcacgaaaatgcgatgccacaaaaatgagcaagaaaattttaagggttttaattaagtggggatcatccctgaaatttgaattttttattgcttttcgcacaatattgacagtgggcttagttcaaaaggaatttttgaaaattttgcttgaaaatctaaattaattacggaaaaaccctgaattgaccacgtgaatcgtgaccgtgaccgaaaaaccccctgaaattcacggtaaccatgaccgtgagtcacggcacatctctattatcttttaatggacattttttaaatatcgatgcggtatcgctttttcttgaaatcaaaaattttctcacggtgtcggattttcagggacccgtgctgcggtcggctgtcatttgcgctctttgtgctgggctttcgtggcaatgattatcgcattttgggctggtaagattaactttttggacatttgtttttaaatttttgaaatatttgatttttcaatatgtatttcgcataattatcaaataaataatcccatcattaagcatcatttgatcttcgctactaatgaggcaaacgtcggaaatgaaaccttttcaaagaaagaacgcatcttatataaaaacatattagtaaagaataaatttgtaaaaatttatcgcatcaaaaatcaaaatgatttacattttattttctgaaataaaatatattaataaattatatacccgccggaaggaacaaaacccgcgcagaatttttaattgaattgttctttcatgcatttttgtgggaaaagcaggaaaaggagtcattcagcaagagcagtggatttatttaaaattggagatttttgcaagaaatttttaaaaattaattatgattttagagcttgagccgaaaactgtgggtgattcaacaaactcacaattataccacttcgtttgaaaagaaaaaatattattttaagggtaatctaaaaaaatctcacgtgtttttagggaaagaaaaattttaattttaaacgataccaccaaaatttaaataataaacattttttataataaaaagaaattgcaaacaagttggcaaataattcacacattttctgtatttaagaatcagcag

SEQ ID NO: 20340 - DNA, 661 bp, Heterodera glycines
attcaaaaatttgaagcaattaaataaaagttcaagcaaaaaggaaaataccaatggaaaaatggcaccaaaattgagaggaaaattggaaaattattaggcacatatcgcgaaaaaaaatatataaatggaaaaaagaaatgaatataaataaaattgaatttaaaagaatgaaagatagtttttataatgagaaaaagaaagaattctttgaaagatttgatgactttaaaaggttatgtaaaggcaaacaaaaagaatttacgaaggaattgggaatttcagaaaaagcatttcgaagatggaaaaaagaattggtgccaaaatattataaaagtaagggaaataattatatttttattaattattatttttaagcatgcaaaagacattctgatgaggagaaattaaaaagttgaagcaatattttaatcaaagaaagaaatccaaagtcagcgatggaataattgcaaagggtgcttgcgcgttttataaaaaccgccacctagtcgcgttttataaatccgccagtcgcgttttataaatccgccacctaacaattcgcgttttataaaaccgccagaggcgttttataaatccgccaaaatggaaaggcgcgttagaagatccgccagtcgcgttttataaatccgccaaaatg

SEQ ID NO: 20341 - DNA, 1417 bp, Heterodera glycines
ctcccaataggaacttcaaacgacttagtctcgtgcatttgtacggcgagaagacagaatatggtgaggcagttcgcaacacattcaggtaaaaaattaaatttagatttaaatcataattttttccagaagggttctctctttgccgcttttgcctcccgacattatcagaagagctttctcaattatcgtggcggcgtcttctcctcctggaatgccagtgttcttcctttacttctctcgaacatacatcggcttgacacagcgccagttgttggatggtgttaacgcatttggagataatccactcaatttttcacccattggcaatcattgtttgtttaaatttatgcattttatttccaaaaatttaatttttagctgcactcgggacaacaatttcgaccatcaattcggaacacagctatgcggctaccccagtacagtccggcatcggctcaccggaaccaactcttacatggacaaccactgtgagtccacgggagcagcttgttcaatactcgttgagcacgctatcgacttcggcagcgccttcaggcagaattatttaatcaatcatccgtttaaatttaataaaaaaattcagttccagcgtgggaggacgaaatcgttcgtgcgccacattttccaattccgctttggaacatgcactcacagacaacatctgccctcgctcgtacaaacaacggactggaggcaactcatcttcattttatggtctttaatttattaaaaacaaattgaaaagaaacatttagaaaggcctctgtcaccaccccgccctttcggacttcatttgtggggttaatgaaagcatcgacagacaggtggacgctgcccgatctgctcgccatttcattcacaagcgacacaaacgatacatcctccaggatgctgtcattatgtgaattttggcggacgcgtcgtacaacagcaatggtgaaattagtgatctgatgtcggcgcttggtctccaagttgaaggatatgcgggaaaattgagagattttgaaaattacgatgattcaattgtccatgttccgtgatgattttattgaatgtttaataaaattatttttttcaatatgtgaagctgagggtgtgtctatagagagaattcggatcacataggagcattaaaaatttgttcgaattttggtcgccattagattagaaattaaaaatttttcctatttcattgttatatttgtgtttagggttaggcaaggggctatataaatgtcgtattcgtattcagcgaccccgaaaagcctaaaacagacccgttttccggctttttatgagctttttagacttttggacaattcgtgggtttttactcttttggacaattcgtggcttggacaattcgtggtttggacaattcgtggcttgg

SEQ ID NO: 20342 - DNA, 2634 bp, Heterodera glycines
ccttctgttgatggaagtgcgtgccaagctgggccccttcaagaacacaggtcgtttcgacttgcacgaggtgccacttggcacttaaatgatattttgcagaatgccgctgatttcaccattgacttccggctccctgcttcgtcctgctctctccaaccatatgatctgcttcactccggaaagcgttctgcaccctttttaccctacgcctatccgtcacccaaacttcgtttttaatgttgacggcgacccattcccttcggctacgcatttggtcgcccaaatggccataaagtttgcagattttgtaagttttttcaaccgattaatttttcagattccttggcgtcaaccaaagttgcatggaatggataatggagccaacggatgggcccgaatgttggtggcggttacattctgtaatttgcgaacagattcagttgccgttggagaaggttcagcaatggttggtcacaatagtcaccagacggggggggggggcacagctgccgtctcgaaacacccgcgttttttaatttaaacacaaattaggtaaatttaaataagaattcattgccatgaaaacaggaaaaatatttaatatttcttaacgaatttgtttaatttccccggcggcacctctctacaccgttggacgacaaaaagcgcgattttaaggtacatggaagaacgccaaaaagcgctgaaagaagcgatgaaaatccaatttgatcagcaccccacactgttgagagttttactcgatactcaggtgaaggctttcaccccccgccaaacaaaaaaaaatggaatgaacttcgataggatgcctttttggtgtgctgttgtcgtttttcggccgtcgaggctgaattaaacattggaatgcgcgaacgcgacttgcgcctttggctcacgcaaattcgccaaaacactaaacaagtttctgttgtggtggggttgtgattgttattcgcttcccattttctaagctgatggacctttgtcttcgtccgatggcttttcgtccgccattttttggtggtaatcgaattggacttttgctgatggaattgcgcagggaattcattctcaacggcgcatttgccaaccatttgcccgaactgcctctgaatgtcgacacaattctcggctctgattcaccgatggaaaattttgtggttggaaaaatttttatttcacatttttgagcgatttttttagacaacggctccgtttgatgtgctcaaccccttaaatttcactgccatttgggctagtacggcttaacaaatgcacattgtacaaattggtcctctccttgctcagatccctaccttttgatgatgaaacaccagggcgatggttcatctgctggtgcaattgccgtcaacgcggaactgacggaacgaaattgggccaacgctctgtccaagaaacacccgcctttgctaatttcacgtgatgacacttttgtcgaaagtgccttttctcagatgttcggagagattggactgaccaaaggttggacttttattataaggaatggtaatagagagttttagtgccttcttcaaatggcactttacactctgagaatggcctttctggtggatacaatacgctcgaggaaatgtcccacgaaatgctacgcactctttacattaaggttgtgtccgtccgcttcttttttgtttcattcaataaaatgtttgttagatgagttcgcatttccgcacacaaatatccgagttggatgaaatgcaacaacagattaacgtccgttctcgcgaaagttcgcgactgcaggaactccgtcggacgcttgaacggacccgcgaccaagtgggtggggagaattgcagggcccttgggtggggaaggcatacacattttcagggggaaaaatttctatcgaaaaacaaaaaagcactggcaaagatgggaaatgcaaaattgaaaacgaaaatcgtatttttccattcgcaaaaagagatcaaaaaatgctttccctccactcccctcctcacctcacctccccttcactcgctcgcaaagagtccaaatggaaaatcctaattcctgggaccaaattgcatttccccccccccccccccaccactcattgatggccgtgcaatttagttggagaagggcaccagtggccaacttccctctgctccatcaaatgcacttggtcagcaaagcaccacttctgcgacacatcaaagcgattccacaggcaacggacctccgcccccggcgaatcagtcgctggcaatgagtgcccagtggacacaggcggccgcaatttcgtcgggccaaacgcaacggcctccagcgtttccacaaaggatggaccatcagacggttcatgggttgtgcaggtgttttgaccgttgttctatgtttgccaatccaatgattgccatttagagatgaaattccaacccaagaagggcctcctttgcggtctctcccctttcctccacctttccatcaacgccaaatgtccttgggccgttccgatggtcatccaatggacggtgctgtcaaaatcccttcacttttctcgcaagagttgagtccgttgccccattctgcgagtctttctgcctcaacccaaaggcg

SEQ ID NO: 20343 - DNA, 2383 bp, Heterodera glycines
agtgtttgtatttcctcctcaaaatcactcccaaaatcttcatatcgcgaaagcgaagaaaagcgcgaaatttctgacggtttcaaatttcaattcattgccgggggggcattaaaaaagcgcgtcgccctcccaccggcggacggccgcttaattggccaatggaataattaacacggcgatgatggatttggagaggactgaaaatgaacgggtggtgacgaataaatgagtgactttccgctggtgccatccgttgcccacttttaattgcccttttcccttttaggcccatcccaaatattccccccccaccacaatttgacatttgggtagtaaagttgtttcaattattgtataatgccaatgtgtatcagtgaaggttcaaaccaaaaataaaaagcgaaattgaaaaatgaaagaaaaaaaagtgaaaagcgaaactttagaaaagcaaaaatgcgaaagtcgaaaaaaaaataaagtatcgaaattataaaacccccgtcttccccttttccccccattcatcctcttccatctatcgtcccccttactcttccttctatccctcacctccccctctcttccgcccattcatcctcttcccccctccctctcatccgtttcctcccttcctctccctttcccttttttcactctgtcccttttgcttctgcgcttttcaataagtttaatggcctttcgcgacacactttggcatcgcttcacttttccatcccaaaaagttcgtcgttcgctgcgaattacgtgctcaaaatggtataaagtgagggaaacacgcccaattacgcgtttcatgcgccagcccaatgggcaggcaaaacaaaatggtgccgcggcattttatgaaggggcggggaaattcccccaagttccctttccaaatgatggcacagaaaaaatgtgaaaaaacaaaaattggactaattttaaagcttttttctaatattttttaatcaattaaagatttgctgaattcttattgtgcaaaaaaacaaaagcaattagcaattcctttgcaaaaagcgttaagcgatgggaaacgacgttttttgagccatccctcaggggatttccattctcacgtttttcctttttattttcttccatcttctggactccgttccaaacaaaaaatctatgtttttagttcttaagtctcctattaccgtatttttccgcttccttacagtttccttctcttccgcgtcctttcctaccgtattcttccgcttcctacagtttccgtcccttccttgacctctttttgcgcttccatcggcggatggatggcgccgttcggtcgtccgccgcttcgtctccgtccctaagcgatgttctgctcaattttccctcctcaccttctcagccaagcgaattgcagttgttcatctacggatttatcctggtaacttctctttctcttttatttttttaaaattttatttgtaattttatttaaatgcttttccttccccaaaggttctcattccgaccgccactattctgggaaatggcctcgtcatcgtttctgtcctccgattcaaagctctccactcggccatcaattttctgattctcggcttggccatcgccgatttaggggtcgctctgtttgtcatgccatacgccgtctacgtttacgtatgcttcttcttttcttctatagaatgccttttctaattgtctgtttaggtccaaggcggtcgttggctgctcggttagtctgttttttgtcttttcccagtttgccaattctccctctccccaggcccgctgatgtgcaatctctacctgagttcggtccgtttctctctctctctccctccctctctctctctctccctccctctctctctctcgaccctctttctctctctcacgttccctcccctctctctctctcacgttccctcccctctctctctctctctctcacgttccctcccccctctctctctctctcttgctctctctcctccgcttgatcagttcacttttcctctcttaaggacgtcgcgtgcagtaccgcttccatcattctgctcgccctgatcagtttcgaccgataccaggcgatcagtcacccgattcagtactcgcgccaggcccagaacatcgcccgcgtggtgcggctattcgtcggcgtttgggtgtactctctgctcgtcgccagtccaatcgttttgggtccctccgcttttggcattccgccgagattggcttttcattgctccattaggtttcaacgaccctccgcccgaggaaagcgctttccggcgcctttgagcccttccagggccgcttctacaacccggggtctccctgttgccctccttccgcccccttccttctcccc

SEQ ID NO: 20344 - DNA, 2417 bp, Heterodera glycines
tttacccggccattttgctgctcgcccgcagcactctcaccatgcgtcgacaggactcctacaaaatttttgtgtttcttaaatcatctttaattaattcaaattttacctgtgtcgcttccacacagtcccgtctcagtctctgctgaaattttgttctggtgaaggagcacaatgagtaaacttaatgaatgtaagtttaggcaagccatcccacagccatgaattacttacataatttgaaagttcattttttagccaataatgggcctatggaaatgaagttttcggaatgattttcgagtccgagcagatgagggcaattttggaccattctcatggttcctgtttatagaaaacaactgctggtggagctgagtgaaggggggggggggaagaattggcccataaaaaagcattgggccgtctcttttgctccttccagcaggcattgaaaatgaggcagaaaagagcatatggccaaagggaggaaaaacaattttgctttttatctaagttttactttacaaacattttttacaaatcgaaccaaaattagttgaaattttcaataaaataacaatataagcaattaagcaataaaatttcaaggaataaaaagtcacagactcaaaaatcaacatatcgccataaatttaaaaaaaagagattaaattcaaaaatattggcaaaatgtttaacaaagattttttaaatttttggccattttttaaagttaggggaatttttttttgaaatgtaggctaattgagaacctttagggctgttgaatagccaatacgagcaattacaattaattattccccaaagagccgggctatcgcccagttaaaatccacaagttaattagtgggagaagaagcaaaccaatgcagcagaaaaggccgtgggatttttaagtgaaagctttcttaaaagctattcaatttcgttatttatttttgtcagttagagaaatggcttatattgtatcaaacgagtttaaaaaggaaaaaatagcaaataaaattaaatttattaatttttataaaaagaaaacccttaggctaaataaaataagtgtgaattttaaattttaatttcacttctgagcaatgactaaaattcgccctcattctttgaaattttttttgccttttttaattttgttataaaaaatatatttatatataaattttccctcaacagattctcaattccgcaataatactttataattacagccatttggccatacaaatctcacacttttcttttttggccaaattttggctttgtccacctgccgtaaatttgcgaaacaacagcacgaaagacaacaaattaaaaatttgatcaaacttggagaaatcaccggccgatcactttttggctctgccgccattagctgacttcgaccgaccaatttatcgatcatgtcttcattaccgatcactttttggctctttttcgattgccgatcacttttggccatatcttctattgctgatcactttttggcccagcgactgatcaatccttagtttttccaaccgtgcaatttttcagatgtaacaatgtaacacaggcttgaaaataatttgcttaaatggcaaatttatggattttgagggcaaaatttgaaaaaaatctaagaaatttaatgcttgttggggaaattgtttggaaatattagtgaaatttaaagaaaatgccttaaatttttagtttccttttcttttaaatttaagtctgagggctctttctattcccaaatatttggctcaaatttcatttctttaggcccaaagacggccaaatttctcagctttttggagcagttcacactgtgcacaatgttccgcatttttggccgtttcgtcggcacttatcccatcgcatttctgtccctgtttcgcaaatttatctcaagtcccgaaaaaagcatttctcgagcaaccctaggccatatgaatttctaacatccaatttctggcatctccaacaaatagggtacattacgtagtgattgaatttggcacaaaatcccacagaaattggatggtatttttaaattttttattagttggtaattcaatttgtttcttacaatcagagagagggtgcttgtttcgataaatctcgaaaagcggaaatttgcttcagaattacatcccgctcgtgttcgtcaaaaccatctcactggttgccatctggggactcttccacggcttggtaagggcctttatgccctcattttcagaattttcgggttttctttaaggaaaattttcgaatttttcatattttaaattttgcgccctgatcaggtgctgatgccggcctttctcgcctcgctgccttcacggtggttggagaagaactgttaccggatggccgttcataggattcaggta

SEQ ID NO: 20345 - DNA, 2255 bp, Heterodera glycines
  misc_feature (128)..(129): n is a, c, g, or t
  misc_feature (132)..(132): n is a, c, g, or t
  misc_feature (142)..(142): n is a, c, g, or t
  misc_feature (176)..(176): n is a, c, g, or t
atttaaatttctaatacttttttttcgaattctcctcccaaaaaattaaattttttcactaattaagaaattaaactttattgattttttttatatttaaattaattaacaaattattaaaattttanntgngtaaaatganatttgttcttgaaattgcccattgtttttgtggnaaaaccgaacccgtcaagcagtggaaggcttcccaaaaatgatccaaaaacccataaaccgatgatcaacaaatgcaaacgcttcatttttgtcgatcggattgtgcttcgctggagagcaattctaaagaaatttaatttaaaatcattttgtaatcttatacaagagtttacagtttgtatttatataatttaattaaaaaaatatattgtcgaattgatatttttaattctttttataaaattgttatttttttagtttttggatcaatacaaattattggatttattatttaaattaattaatttaataaataattaaaaaaaaattcactattacaatttatttgaatattcatttaaatgctttaatttttcataaaattacaagtcttattatttgaaaattttcaaatttaaaaatatataatcattacaattttgaatataaaaattaatttaaaagaatttaaatttttaaataaaaataattttattattttaaacattattaaaccaactttttctgacaaatgctcaaatatttgtgaatagccatggctaacaaatggaatgttgaaatggtgcacaacacgcacaaaatgagatgaattgccaaacatggaaagaatgtgaagggccatcgggtgagcaccgaaatgacctaaaaacactattttaatcgtaaaataattattcaattaaatatttatttcgaaattaaaaatttatatttttttcattttaaaaatagtttctaaatttattgaattaaaaattgagctgggatttataaaaaatttaaaagaatttagaaaaaataatttatttttatgtaattttctttttgtttttttccattcaaaaaaagaattaaatttatttaagtataaaaacagtatatgtaccgttaatggtatgccgacggcaccggctaaaaagtcggttatcgccaggctgaagatgtacgcgttgatcggtgttcgacgaatgtgccgtgcccgtaaatagacaacaatcaccaccaaattgctcaccgaaatgatcagtgccaagcacaaatcggcaacggaatacaccaaaaatacagtatcaatcatcaatatttacagtagggggagaaataagctaaaatgaaaaatatattttaataaaattgaatttgaaaaagattgtaaataaaaaataataattcacatataaaaaataataaaatattaaaacaatatttttttttactatcatttttaaatttaaataaaaaattattcaattaattttttaattattttttaaaaaaaggaatttttcttaattgattatattttgctttataagcatgaaagaggaagcaaatgtgcacaaaaacctgttgtgctaaatcagtggtttaatttattggaaaaatattttatttttgttcaattggaaaatgatcgcttttttatttcgttttttggcctttttattcaaaaatatttaaaatatttctaagaaaaattttgttttgttcacaaataaaaatttaggtactttgagttccaaaatatttatcatattttacgtatttcgttaaattaaataaattttacgtatttcgttaaattaaataacgagaaaaacctatgatggaaattaaaaagaatcatttaataatgcgtagttctattggcctaaatttaattaatttattgcatgtaatgaaattgttaaaaaatgtaaattaatataatattataatataattggaacatttaaacaaaaaacgtataacatataaattcataacttggttcaatttcaatcaaattaataatatttcatggtaacattcaacaaacagctcaaggtgttctctataaaaatattaatttagaaattttttttttacaaaattgtaaaaaagttatgctcataaattttcaataaattttgagtcaaaattatttgccagaactctttttataactcgcgtatttatttttaaaatttcaaaaaatttcattgagtttcaaaaaagttttgaacagaaaattccgatttaagattttgtggaatttaataaccataactttttta

SEQ ID NO: 20346 - DNA, 1713 bp, Heterodera glycines
gggccagaacgaaaggaagccagtcatgacggtgggcaggacccgaaggaggccagtgaagacacttcaaaaccatcgcaggttgacaaagcaatccaaaacgaaattgacagagctctcctccaaattcaatcacttcaaaatgaactcacccatcttgtcaaaagaaaatagttctgcagacctccagctattcctttaaaattcctcaaaaaccaaattttctctagtttccctttgctggaggtctgaattttctatttttcagcctttccaatccaaatcaattgtcgtctatatcaatcaattgtcgtctatcacttttacccatttgacctcatttaaacttttcctaatgtattcgtctttaatcatttatcaactatttaaatctaacgtgtaagtggtcaccccttcgttagatattttatttattaataaagataaagataaagtaatttgaaaaaatgtattattattagaaaattttataacaattccaaaaatataattaaaaataattaatgataaaaaatattattcaatttattttaattaattataattaaaattaaatataaatgaaaattaaacttatagatatattactaaataaaaaataataattactttttcaatatttatcaaaataattttaaaaacttttaattattatataatggcatcccaacggtccagacaaagtacggtagaatgatctactattgctgtacggtagaaggatctaccattgctaggtttgcaaggacccgctgaacaccgtccgatgtacaatggattaaaaataaatgtataaaagcaaaaataatgatgcaattcataacccatgaattagccctctaaaaaattaatttcaatgctaaataaataacttataaaaagaaatatttctgtttcttaagcccaaaaggattcaaaaattgtattgtaagtgacaaattgtttttcctaatgcaattcaaaatttatctaataattatttttgtcattttaataaattttttatgtaatcttaaaaaaaaattaaaaaaagacagattatatacataattaaacaaaatgaaattgccatgacaagagatttatttgaattttgaatatgtatgtatgaaatgtgatcagacaaataaaaaataaaaaaactaacaattaacaatttatttaagaatgctcagataaaaaaatgatgtttcttaaattaattataaaatttgaaaaggttgacaattaaaaaaaaattcaaataaatatttacgtagaatataattaaaatataaatataataaaactaaatacatagcacatataaagctggaataaatgaagtttgtacaaaaaaaaattgtaataaaactcttatttcataattttgtaattacaaaaattagaatataaactgacaataataaataacaaaaatcatttaaaaatgaaataattgtgaatatttaagcacaagtatatgaaaaattgaacagatgacattgaaaatagttattgacccaaaaaaccatttactataacaaaagtataaattcacaagatctaacaaaaatttgaaaatttataaccaaaaattcaaaaaatttaaacttactaattttgtccctatcttttttgaaactcaataaaattttttgaaacttaaataaataatagagaaatctttggaatatctaatcatatgaagaa

SEQ ID NO: 20347 - DNA, 786 bp, Heterodera glycines
cctcccgcccactccataagggaggcgttcaatgtaccccttaatgagccacttaataattttttaaacaaaacttaaaaaggattaaactttttaaaaaatgataggcaccatgccaaaattgtccaaggacgcgtgcaggttggccatctgattgtgagcagcaccaatcattccaccaactccgccaccgccgctgttcgaaattggcgacgaaagggtcatgtcagaggtggagaagttgccgctgtcgccgctcaaatagctctgtcctccgcccccaatgctcgtcccgttcgaattgcgcatcatccgccgctccatgccaattgtgcccgggttttgctgctgctgttggtaggcggccgccaaaattgcctagaggggaaacattaccaattataaaggcagagtggaggacaaaatcatacattaaaaagggtggtgggtcggtaaaaatttttgcgaaggggggtcggccgccgatgactcttttttttgcttttcaaaaaccgtttcttttcggcgcgctttttccaaaaaacttttcgggaacaggggggggggggggcgccgccgggaaaaattttttttttgatctttgggtgtgatttgttagcagattttcaccaaaaaatggcaatttttgcgattttgagccaattttttaagaaaaatagtaattttgtgaggttcgggcggtgccgccaggcgccgccggggaaaaatttttggactttttaatgaatttgttaagaaaattttcaaaatttgcgaccccccccc

SEQ ID NO: 20348 - DNA, 1402 bp, Heterodera glycines
tccaaaaagatgaatattgaatttaaaatttatctttccccacccgtttaacctataattgcgcgaaaacgtttgaattcttttaaaacttttctttaagtttttttgaatttttttcgccaaattttctttttattttcaaaaagaatgaattttttaaattaaactaagtgtttggcatgtttccagcagtagttaaagtttaaaccaatattttaagtccgtatttggctatcccatacgaacataagcccgatttagtgataagctgatagtggtctttgatcagtaccttcggatcatcgctcctgacccggcaccagactttgcagtggacgcagattgacggcttaacacagaataagcattgatcagcggcagagaaaaaagggggaggagagagagagaaagtgtgcgtattggatgaagagggcagcagggaacataaagacagagaggagagagagagagagagtggcaagaaatagtgtgtggaaaagtgtggcggagccgaaacgagacggttagagaggcgttagagcattttttttttgttagttgttaattttatgtagcagttttttaaaaattaaccaattaaaataaaacaaataaatgatttagagcaattttgaggatttttttaaattatatttatttttaaatataaaaatatttgaaaaaatattttatttaaaatgtttttgaaattctggaagagaaacaaatatataaaaacataaccggtcccaattagaattaattatccctcattaaaaataaaattaattaaaacacttcacattttcagtgccattttccgcttgtgccgcctgtacaattgaatgaaagtgatcggattagagatggaaaggacggccaatgtgcacagttccaacggcgtataggtcagcttgaacagattggcgccccacagcggacttttaacacgatcacctgacaaaaaaaacacataaaaaaactaaattccgaatttggcataatgcacattagcaaaattcaaatcgtgttttataacacctcaaaataattagaataattcatctactgggcctaatcaattccgataatgtgaattttcggaaaatgatcgagatgagaattttgaaagtgggcctaatgagcgattgaatggaatttgaatatcgaaccaaatcaattttcaatttaattacaatttttccgatcaaatcttcgtcttcccatatgggagacaaattttgctctggggctgatcagagtgattgcttttatcaatttgcaatcgaattttagaacatctttagtcccacaaaaagtccgattctgtctgtcaccaccgtactttgtgtctaccgtactttgggactcaaattcgccgtagccaaaggtgtaaaaatgg

SEQ ID NO: 20349 - DNA, 1621 bp, Heterodera glycines
  misc_feature (294)..(294): n is a, c, g, or t
tggacgattggatggatgcctatgtttaccaccaatatcaacaaacaccagttttttgttgttgtgttgttctaggctactacttttggctgtttgatgttggggtggtgcattttgtcggttggttcctccccaaattcgttttgtcctccctcccctgtttctgcttgccccccaccccacccgtctctgctgcccatttttcacccctaaaagctgcgcaacacaccttatcggagattgcttcttcttgataagcggaaaatgaaagaaaaagcatttaagtataatggnccaatgaggtggaaaagagatatttgtcatccttatgcagtggatgctgcttatcaagctagccaataatgaagtaaaattggatggaaaagccaaaaaaatgaagaaaaagggataaatgaaacatggtgaggataatgatattcaaattcaaaaagttattacacaaagatgatagtttgcggaataaaataataaatattgatgaaaaaaagggtgctggagaacggattagttaaatataatattaattattttttaaataaacaataaaagccccaaaaattacagcaaataatattaaaatattaaaagatgcattaattaaatggttgatgaacaagagatgcaaaatccagcgaaaatttgattaaattattattcaattagttaaaaaattattatgatgtcataaatttctgtttacggataatgatactccgatgcttacggtactcaaataatgccgcagttagctaagcatgaagtgcggcgtgagatccgcagttaaacaaatattattataaaaaaaaaattttgtaaaaatcatttcattgccccgcagggcgcggaggagtgtcccctcctctccccgtccgggcctccccgctaaatcgccgcgccaaatggagaaataatgattgaggcgtagctgtggcggcgattggtggtggagtcatcggcgcgaattgttttgggaattgggcgtgcagattaactgctgggggcggaggaggggacaagcaacagaagaagcatgaggaattgggaaagtcgtcggataagtgagtgtgagtggataaaaagggaggaggggagggggtggagctcacacggggagggggatgaagagggatagaccccagcagaagggggatgaagcggcttcatgtgactctcatcaaccaaaaaagcatagcgtacgtatcccgtcccattattcacaactccgatgcttttcaaccgtgaaaaatataaaaggaacataaatttgaaaaaaaccattttaaattaaaaaattcgttttttaattttcttcataagaaaattattttgagagaattctttcatataaaaaaattatatgaaacgccattgtatgaactttcataacacttattttgcacatgaagactctctcaaatgccctttttatggtcattaaaattaatataaatttcaattgcttacatacaattgttttcatttgatggcatttaattgtgccattctttcgttgtttgtgttgttgacattttcccatttaaatggtcaataatatgtgccatctgcgctcttaacaaaaagatggttcaagtctgatcag

SEQ ID NO: 20350 - DNA, 2352 bp, Heterodera glycines
acgccgtgtttgagctgatcaactggttccagccaatgcatgtcgttgggttggagaatgccagcgaattgatttacatcccggcacacgtggcggcggaaatgattcgggagggaaatgtgagggcggggggaaagcatcataaattgaattaatttgggaatgctttagctgacatcaaaggaactggtcaccgcttacatcgaccgattgaaggaggtcaacccgctgatcaacgcaattgcgcacgaaaactacaaagcggcactaaaactggcgaaggaagtggacacggaattggcaaaaatggattcaaaaaagcgaaaatcggtaatgggtttaattgatcaaaattgattggactaatctaatggcattgtttagttggctttctcgaaaccgttttatggggtgccgttcacttcaaaggacaacctgaaaacaaagggatttgtgaccattgcgggcaatcgctatctgaaggaaggcggaaaagtggccacggaagacgcgctaatcgtaaaacggtggcaattggatgaaattaagccaattaatcaaataaatagccaactttaaatgcattaaacaacatttgatgctaaaaggttcccaaattgggttttttatggaaaattttccggtcaaaggatgaaggatgcgggtgccattcttgtagccatctcaacgctgcccaatttggcgatgagttacgcatgcgatgacaccgcttacgaaggagtcaccaacaacccacacgacacacgtcgcattccaggcaaaacaaacagcaaatgcaattaaatgctaattaacgagttcttaattaccaatcattcgccgctttttcaggcggaagcagctcaggcgaaggagcactgatcggcgccggcgcgtcactgtgcggaattggcaatgacatggggggatcagttcgaatcccggccaacatgaacggagtgttcggcctgagaccgaccagttttcccgaccgtaagtgatcattggcataaatgtgctgctgatcagtttaggttttgtcagcaatgctgcacataactgagtttcaattaacgacaatcagtaattacggaaggttttaacaaatccgtgacccttaatccgtcatgactgtgtccaaaaacgccgtaattccaatgaccagaaattgcttgtagcctttggtttatatagtgtacccattggttgaactgaatgaatgatattctagcaaacattaaaaaaatttctacacgtgtttatctgtttctgatcatcactcctttcccaatcagacgttgtgccagccgaaggaattgtgccggacagccttctctacaaaccagcgcttaacatgctcaccaatggccctctctgtcgctatgcctccgatttgccattggcacttgcggtaaaagaattataaatcaaactaaaaccattaactaaattaacaaaaacattttatacaaaagttgatcaataaagcaattccaaactgtctaattataaaagcgcgatcaaatgaatttaaatccgctttctttaatttcatttaaaaaaattcttatttttaatgtcaatgaattttgaaggtaatggccggtaaaaaggtgaacagcttccaattggacgtggaatttgcgaaggatttcaagctgtactacttggaagacctcaatgttttgatcactcatgagttgaaagccgagcaaagatttgccgttcgaagagtaaaagcattcactaaattatgctaaattaaaatttgcaaaaccatttcaggtcaaatcgtattttgagtcgaaatacaattcaacggtccaaaaggtggagttcactttactgtcgcgttttctcgaactgttctatgccgacccgtggaaagccggagttccggtgtgcaaatcactcaaatttggcactaataaattgatcgtaattaatttacataatttatttctggcagaccttcgatgagctgaaaacgacgtaccaagacattcaggcaggcgtggcaaacgacacttttttcgcgttgcaatttgaggcgttgaagcgatttgctgtgccaaaatcggaaaatgaacagaaatgggtgggaattttaacacaaaatttcgatctgttactgattagacaagttttgtgttccttcaggtgctgctcaaaaaggagaagctgcgcaaacaagttgcccaattgctcggcaaaaacggactgctgctgaccccggtttggccaaccgatgtgccattccatcacatggaaccgttcgtcgctttcgacctcaaatacacaatggtaggccagtgaagggtgcttgctataggtgccttcttcaatccgccc

SEQ ID NO: 20351 - DNA, 1566 bp, Heterodera glycines
  misc_feature (7)..(7): n is a, c, g, or t
  misc_feature (34)..(34): n is a, c, g, or t
taacttntcgggactcaatttatgacgaaaatantgggccctccttattttttattttctactaacacttttctagtggatcactttatagattcaggaaattcattgcatgaattgaaaagtatttatttttattaaaatttgctgcttattttccgtaagaaagtttttgggaggaatttcacaaccttgccataggaaaaactcatatctgactcgtataaaacataactcgaacagtaggtatatttgttgtgcaattttatagtccagccttcgctagggctctcaccgcggtgtattttaggtgtgtctttgatgtatcaaaatttctctcggccgtgttgttgactgaaaaataaaacgaacttaaattattgcaatattgtttatacgaagtcttttgatattattctgacgacttccatgataataaatacttatacaaagtttatctttttatatatttcctcatcccaaacatggatggaaaataggcaataaatcgacaaatattttcaagttttgccatgctatttatctttcgggactcaatttatgacgaaaatatgggctccaattattttttattttctactaacacttttctagtggatcaatttatagattcaggaaattcattgcatgaattgaaaagtatttatttttattaaaatttgctgcttattttccgtaagaaagtttttgggaggaatttcacaaccttgccataggaaaaactcatatctgactcgtaaaaacatagctcgaacagtaggtatatttgttgtgcaattttatagtccagccttcgctagggctctcaccgcggtgtattttaggttgtctttgatgtatcaaaatttctctcggccgtgttgttgactgaaaaataaaacgaacttaaattattgcaatattgtttatacgaagtcttttgatattattctgacgacttccatgataataaatacttatacaaagtttatctttttatatatttccgcatcccaaacatggatggaaaataggcaataaatcgacaaatatttaaaagttttgccatgctatttatctttcgggaatcaatttatgacgaaaatatgggctccaattattttttattttctactaacacttttctagtggatcaatttatagattcaggaaattccttgcatgaattgaaaagtatttatttttattaaaatttgctgcttattttccgtaagaaactttttgggaagaatttcacaaccttgccataggaaaaactcatatctgactcgtataaaacataactcgaacagtaggtatatttgttgtgcaattttatagtccagccttcgctagggctctcaccgcggtgtattttaggttgtctttgatgtatcaaaatttctctcggccgtgttgttgactgaaaaataaaacgaacttaaattattgcaatattgtttatacgaagtcttttgatattattctaaggacttccatgataataaatacttatacaaagttcctgtggagatatatttcctcatcccaaacatggaggaaaatagg

SEQ ID NO: 20352 - DNA, 2517 bp, Heterodera glycines
  misc_feature (1683)..(1684): n is a, c, g, or t
tgttttttccataataatgacaattttctttcccctaaataaaataaattaaaatttgtttatttatttttgaaattttgaggtaatatctgtcagattgggtctttcaatttttggattatgacaaaaaactaagaaaataagtacgaaaataacagaaattgctttaaaactgcatcgaaaaacaaaatgtttcgctatataaaatttaagataatttaattttaaaattattttatataaaaaacatttcaccttttgaaatattttgattgaaatttaatttctttgcccatttttcagtcgtcaaataattcacaccaaatatttgtttaatttttgctctaaattcttcccattcctttcgtgaatgtttcccattttgcataaattcattttttgttttaaaatatttttcaacaatttcccttttttcatcatcaatttgttgatttttcaaaggttttccattttttaattgtttcttccatttataaatgctttttaaacttatgcccaaatgtgttgctattattttttggcattttgtcctttttccttccaattttccatttaatttcatttttaatttgccatatatttgatcaaattgctttaacattattcttttttcttcaactgaataatttttgttcttcatcattccaaattctcttttccatttgtaaattttcttttgattttcacccaatttttttgcaatttttctttcaattttattccattctttctttgaatatttctttcccatttgcttaactttttctttaattttatcaaatttttccacaatttctattttctttttattttcaaaaattataaaatgatcacaaatttgtccaaattttactggcgcttgttccaattcatcacaatttgtggacaatagtacactctgctcgtcatgcacttccgaattatcatcaaaattttgatcaaattgttctgcaaataatctttgtgcgatattttcatcattttttgtctcattttgatcattcttttgtccaattattccatgttgatcagtttctttctctccattttcctccgatttttcgtcccatctttggccaaatatttcgtcaaagcttttttcttcctttattccgccagcataaattttgagaattaaaataaataataatatttgaattttcatttttcataaaatgaatgattagaaatccatttgaattatttgcttttatttcgtttataacaattcttttccaactcaaatattatgatgatttatgtattttgtgcatattttttaaattttgtagttgtaatatgaataaaaatattttaatattcattttttataaaaacatttataaattacttattgatttaatgaaaattcatttcataaatgtatttttgcgcaattctttcctgcacaattctttcctcattattaataatatttactttaatgaaattctattcaaaaaaggagctttttgggtcttgcagtgctgataggatccaccgcaagaaaaaatggaatttttggattgatttttaacagattgcactatgaaaaccagcggactaatttttgaatttttgaaaaatttttaagaattttattaaagtgcaatcatatttctataatattcctcttctacccttatcgggagatgcgtttgnnaattatgtgtcattatgtttatgtcacttcaataactcagctgcggttgctggtgctgcaccggccgtcgtccaacctcaacacgttcaagacataattccttggtagagcgatttaaattcgctctcgactgctctacaaaagtcaaatgtctgatgaacaaattgagtgagaacgccgccttctcgaagcatcttggagtacagccgatctgtttgccatctgtagtcactgattttggatttggcgacacgattgaaaagttctcgaaaagcttttcagtcgtcaacaatcagtctttatcggcagatccggatctcttcaagccgaaagagggaatggtgaaaagttacgacaatttttgaaagacatcggaaactgctccaagatttcaaattagaagaattcgacaaggccaattcaactgcctcatgctgcttactacattgaaagtctcaaaatgattctgtcttatgcagtgaattttggccatatttacagcagatggggacaaaactcaagtataacaacattatggaagaattacagatttatctttccaccattgcgaggctattgaacagccttctggcgttggagaaaagagagggaatattctggggagggatttggggattgagttcggggatggatttgaggggaataatttccgaattcaatatcactttacgattaaagtcaaatgctaactgctcgtttttgtaacgacagctttaaagccaagggtaatcagaagttggggaatttatcaggagattaaaagagaaaatcatagaacatacggaataattaaatataaaacgaaaacataa

SEQ ID NO: 20353 - DNA, 2014 bp, Heterodera glycines
aggtccatgcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaactttaaaatttttaaaatgaaataattttcctgcaccgattgtgtgttttggcgtagtgatggcactgaaaagaatgtttttggcacaaaaggcacttcgccaagaagcggcgaccgaagcagcggaagggacggaaaacggaaataacacaacgaaaagccgagtgaaaggacgccgaaaactgagacagcagcagcaacaacaacagtaccatcatcagaatgtgaatgcattccaatggatcggaagcgacggatgggccgaccgattggacgtggtacggtaggacacggttgggtaacagtcggacagttttgggttactgttggactggctttaagcagacattaagtatttgcccaattgaatgttcggataaatttttccctttaatgtggcaacgaatctagtcacttctcggatcaaacattcaatgccgccgacttaaatggtcactaattgcctttgctaattaggtggagggcgtggaggaggaggcggccggcagcttttccattcgaatccattcgccaaatgtgcgcacctttgagccctattactttgcgcttaacccacacaatcacacgcgcaacccgtggttccgcgagttttggcaacaaaagttcaaatgtttgctgacggtgccaaaggacgacacggtcagccgacagtgcaccggacaagagagtctggccaccgggtacgagcaggacccgaagctgagccaggcaagaaacagtagaattggggggatgacacaattggggaaggggcacggcacaatcaacgggggaccggtagagactcatccgcccatattattgagattaagatatggcaccaaaaataggcattaaaaagggcaaaaattaaattaagcaaattagccaattccatttttctatgatttcggaggggatttggcaatttttatgcaaaatcatttgtttccattttctttcgcttgtgctaatctctcattgctcaggtgataaacgcgatcagagttgtcgggtaagttctatttgtattaaggaaaacctattaatgaaatttcctcggaaaagctatgccctccgggagatgtacaatgacaagtgccattcctcgcggcaaaatgcgaccgccaacgcacttctaaatgcccaatttgggttgccatgccccgaaatggaaaccatcaacggcacacttttgtttaggcaaaatgagaataaaaaataattaaatgttatttaacaaataatcattgaacaaggcaaaataaagcaattaaattaaggtatatgatgaatgtcagctttgttgacgaattccaacaggaaatttcgttcgatacttccggcgaccccccggcgtggtgcgttttcctaaaaaatggggggggtgagacagatgccaataatggcaccgggataaataatatgcttttccgggatgacgcacaaaaaaacttgtaaaataaaatatcaaaaaatcatgtgcctaaatatggggttggggtgatgaacccatttttgacagattaattcacttttcgaaacaggtacgacattttgaattacgtcggtggcgaccatttccgtttggccggcgatttccgacaaacttcggccggctctcatttgctacgaatgcaccagaagaaactgatgttctatgataaaagtgacgaaatgccagagtaagtgggggggggggaaggattttagggg

SEQ ID NO: 20354 - DNA, 2614 bp, Heterodera glycines
  misc_feature (2444)..(2444): n is a, c, g, or t
acatggccaagcttgccaagctgtactcgctgctgacggacaaggagttgagctcgctgtcccatacgctgcagttggcgcgaccgtccaccatcactgccgccagcgcaacggacgcgacgagcaccagcgactactgcacggagtcgtcgccaccgccgccgccgcaacagtcgccgactgtcgcctccggcgctggcgttgctgccgctgcatttgttcaaccgccgcaacacaggccaacaaagagggcatttctggaggacaaccacaacgactacaacacgggtgggcaaaaagggacataatttatttaactaaatggggcagggcttgcatttaagttgatcccacatgaaataatttgaaaaaaattaaaaatattatactggagagattttgatccgacatttttttttattcttatttaaaaaattatagaaattataaattaaggtttacagtctcctctatatcttaaggtgcaacgacggatgttcttgtttgcagaaccaacacatcattttagtctctcgaaaatttcgtgaaattttatatccatttattgatacaacacacttttgtttttactaaacaacatatgtatgagggaggacgagggtgatatgatgatgatatgattaaatgattaattatcccccaatttattctattgcactttgaattttatgtgtgtttatcgttgtggatggaaattcattcttttcttgacaaagaacatacaaattcaatcaatcacaaaatgtaattataaaggactgattccatttttttttttgagctttgtggtggcattggtttgtttacaaatctgtctgaattattggataaaaatgtggcaagaattaaattctccggccctttggggcctcaaaaatcatacccatatttgaaatgggctcctgttgtccctgagttttgccaagccaaaaacccaccactccatcaaaggggaacatcaaattcagttgatcgaataaaccatatttgacacgacaatgtgctaattattaaaaaaaattcgatttaaatttttgtttaattatctctcaccactcatttttattatgtgccgcctggacgccatctaaaattacgtattctgttacataatttcaatcttaacaaatccccacttatctatatgttcaatgaatgtattgtattatcatttacttatccatcactcggtctacgtcagttgggccatggcacgtttgggccccagcatgtttttggactataacttttttatttgtcatccaaatcaaacattattggtatcattagaaagcccttcaaaggttgtattagcctgcaaaattccaaaaaattttgtcaattttgaacaaatttacggccataaaagttggaaaatctggctttttaagttgttctgaccataatttttctgaaccttaacaaaatttttcaaaattttgcaggctaatagaagacacttagggctttcgaatgctaccaacaatgtctgatttggttgacaaagaaaaaagttatagccaaaaaaccgctgggccccaaacgtgccggagcccaactgacgggttccgccatcactccctcccccctccccctctacaaaaaaaagagcgcgagaagggatggggtctgtctttaattaggcctaatccaaccaaccaattgttaagtgtacgaatcatctttttatccttttttagacgcctcccctcgtgacaaggagatcaaaaaaaaccaaaataaaatagtttttcctacaaaattgcaatattttgttgtgccgtgccccatctttcttctctttatgtctctgtgccgttttgatcagttgcggcggtgtccctcttttgctgctgtcctttcttttccgtcttttgccggtgttgttttttccaatcatcattttcattttcttttttttaactcattttttctgatctgctaaatacataccatttttccccttttatacaataaattgggtatgaaaataaaaatatttgcatactaaattcgaaatgaccgaggcgaaaaaaataaatttcttaattcacaatctaattttaatttttcaacagtaattccggaaattttttttttcaaatccccatgctaattttatccctatgcttagagtataggaggtatacttttttctccatcaccatcattagcaacagcgctcttcagctgaatcaccgtccgtcctcacagggtaattaactaattatgtgcctgtctttttaattgatgagtgagtgaataatttgtcgttgttcagcagagcttcaactataattgtcctgttggaagctagaagaggacatgtaagttgaatttctgtccactttagttggtgccttttctttcccctcttttttcctgttattatttgactcggttgtagacttattctaactganacgaatttaaattatgaaattataattaaatttaaattactttaaatttaaacctttatattagtaccaaataaaaaatttccatttttatcccttatgggtttacaaaaaaaaattaatttaaaagaattttaagtttaatgataaaaatgaataaataaacatttcta

SEQ ID NO: 20355 - DNA, 1034 bp, Heterodera glycines
taaaaaagggaaatttctaaaaaatttggctaatttctaacaaaattcatatagtcttaaaaattttccgcttgcggcgccaatcggtaccaccggacctctcccctcgcacattcaccaagttttttggaaatgtgccgcaaaaaatgttaaaaatctgatttagtgatcccgaatgcatttttggcctttattcttattttgaaaattttgaaatagaaaccctggatttagacaaaaacacccataaaaattgactattcttgcataatttataatccttaaatttggtcatttttagacaatatctgtgcaattataccaaaaaagaattgaatcgaggcgatacatcgaataaaggaatgtggagccaaacacattattaaaaaaataataatgttttatgagattttttggagctaattaaaaacaaacccccgtccccggggacgagaaatttctcacccccgcccccgccctgagaagaggtacaacaattaattaaatatttattaattgaaatgaaaaatttttttaacaaattcaaaaaaaacgaaattctttaattaaaaaaaataaatgaatttaaataatttacaacaaattttcagattaattaaaagcactgaaaattaacccaaaaatgcatacaaaaataattcatttacaccgcccggattcgaacttcgtcctcgcccctcaaaatgatgcctcagaatccccaatcacacagggattctgaggtcttaacgatatcaaaagtaaaatctgattacgtattcgtgatctgcaccctaaaatagccctaaagacatgttttcggaaaatttttggtgaaaaaaattttcaactcaaaaaccatgtgtgctccctcccctttggtcccgaatcccaaaatcacttttatttttataaaaaaaattttagaaaagagataaaaatgtaaaataaaatttatattatagagcaaaaaattatggatttttatagtattttacttttccagaataactattcagagctgagttataaaa

SEQ ID NO: 20356 - DNA, 858 bp, Heterodera glycines
aatgttgtgccataagaaaatgccaagagaattgtgcgaggccgcgaagtggccgagctatagtctattttatcattcataattctacattacaaccgtactgcctagcggttgcgatgtgccgaaggcgcattcaaccgctagtttttttaaataaaaaaataaaatcttatatatttttttgtgtttaaaagcgcattcgatacgaaaacgaaacacgaaacaaaaaaattttttgaaaaacgaaaaagaaacacgaaacgaaaaaattttgacggacgaaaacgaaacacgaaaacaaaaaaataaccgttttcgtacgaaacgaaacgaaaaaaccgaaaattttttgaacttatttcaatcataattaagaaacatataactttaaaattgtatcatctaactcagggaaaggagatcctagtaggtggaaaagcggatgtggctctagaacagagggtgtgaccaaaaaattttcaaaataaagaacattaatgacaaaaaataagatttagggtcaaaaaggaaattttgtaaaattggttcgaatcagttaatatacaattttctggataaaaaatgtattaaatattatgtttttcacatcccattatggattttaacaatttttggggaagaaattagcaaatcatacatttcggtgaaaccgtgctgaaaaaaacagattttcaaacaattttttgcgttgtatttttttttaaattggtgaatgggaggtgggtccggcggcgcctatcggcggcaccgggaaaattttttgaaaatttgagtgctatttcatagcagattttcttattaaaatctgtaaaaacatgattaaaaaatcgataaaat

SEQ ID NO: 20357 - DNA, 2104 bp, Heterodera glycines
  misc_feature (2006)..(2006): n is a, c, g, or t
cacatccatcgtctgccattggaagctgttttttctccatttcggaacgtcatcaaaagagtcggtgattctaagtataatcttcaagtcaagtggaagtttatcgcgttcacaaagattcgcaagcgtttgttccaaatcgtagccaaagtgtcgcagacaaagctaaaaggacgaaatgcaacggaacaacgaaagacaattcgcaatacgtgcaactgctgcttggataggtcgggcataatatcggctaattcttgcaattggtctgctattacgcgctccttcgggtgaccaataaactgaaaaatatccgaaaattttagttaattgcaaatgaattataaagaaaaaaagaataagtgggcaaaactttgcctcaaacattcgctgtttggccaatgtgtcccttatgcaatgccttttcacttcgtacgccgtctccaatgctcttttcattgacatacgttgaaagtctgtacaaatacgaccagcaacaaatttgtcgaattcgtcttctaatttaattcggtcatccaaacggacaataaatcttacagaaatttatatggttttcttctttttttaacagtttgcttactcgcttctgtcaacgttgtcttgaacaaatttgaatttaaactccaaagaagcgaaagattggtaaaagcagacaacaaattccaccgccgtttgaataattttggaacgcctggcggacaatttactaaaataggaaattaaagagaataaaggctacaacgttactttgtgcacaattgtgcacttttttgaatggacgcacagattttgcaaaggttggaactgctcagtaatttccaaatgactgtgattaaataagggacacatctgacgatggaacaaagagttgcttggtcgtccgaattcaatgtacggcttttgttcaagtcaaaacacatggaggtgaaaaggttcgtcagctcaaccaaaaacaagtccaaaatttcagcaaaaaggccgctgattttgggtgtttcaattagtgatttttccaattttgatgattgcgagctggccttttctaacaactgaaaaagcaagtattatcggagaattttatttgacatccctcatgataaattcgaaccctgattagaacaaaaattaatagatccctccctaatgttaaatccattggcttactgaaaaacaggtgctttttactttttggtacatacatccaattatacctgaagaacatcctcgaggttcatttcggaatgtgtcatttttcatctagaacgcacacttatttcggcgtaaaaatcaagtaaataatattttaacttggtttggaccttctaggatgtatttcggaaaaaaaattttcagcttacaaattcttttttaataaattatttttataggcgagaaaaatacttaacttacaattaggtaaataaacatttttcgagaatttgaaatatatttgaagaacttttctttccatagtttggcatggcgttttatttttatttttatataaaaaatgagacacacttccctttttttttttatatctctaaaatatttatcccttcgttttctatttatagaaaactttttcgatgcataatttccttttttaaatctggtgtcattgtatcgaattttaaaaaatgctctattaaaaatcattattgaacgtgtccaaaaggggaagggacgaaaatttttgtccagtaccgtcctcgccttttcttcgtttataggttctagcttactcctattcttggtcacttcagtcccgggtctatagctcgccggcccctttaaattgtatatatcactccgcatcgagacgtcatatatcaatataagaataagaattggccacatctttatttatcctctaaactattaaacaataagcaaattgagtgtgaatattggatactttcaattcattttcaagtatttaaaaacaagtctgcaagtcctttgaatataaaaatgagttttanaggaattctatttgttttttattcaatttcgacctgaatgtcagctgcggtttcttcttcgcgtccgatggaagattggaaatctgagttagctatgc

SEQ ID NO: 20358 - DNA, 1052 bp, Heterodera glycines
  misc_feature (64)..(64): n is a, c, g, or t
aaagattcgtgagtaatgggactctgaaggtgtaatttactcatttacaatcaatcggaattgntaattatatgtaattagttaattagtaaggggtaaaaatcaactcgtacttcctttgattctatatttcagtttaaaacaatgaaacctttttaaaaggtagtacgagtaacgtaggaccagaacttccatcgaaatggtctaaaataagagggggccataaacagagcgaggatttttagggccctagtcataaataacatttgaaaaaggtttttaaagctcgttctgtttttaacaggggttccagaggaattccccggtcaaaccgggagagcggagatgactaaaggtggaggtcatttctcaagtgcaaaagattttagagaaaagctatgttatatgtacgagtttttctccgaaatctttaaaaatcggcgccttagtgaaaaacgacctaacactgacaatgaatcattgaatattccaatcattatggttaattttttctttggaatgtttttaataaagagaaaagaaagtcaccagaaaatgtgtcagtgaaatcaaatttatattaactgttgtaattggaaaaggtaaaaaaacattcggcatgaatattttgaaagttaaaattattttgaaatatttgatttatgaaagccaaaaaatatttttcaattatattaaacgaaacattcacagccaaaatgatgtttttcgtgtatttctcaccaaaataaagctgcaggaaaatatttaataaataaaaatccgcgccttttcgacaaaggttcagaaaatccacgaacacctgacaaccttcttagtgagtaagaaaaagctcattgtcagattcttcgaaaattcattgatttttttagcaatgaataataacaaataaaaaatcgaagccaaatttaaaaatttccgttttccattcattatctttgcgttttctctccgtttctcaattttttctccgacttcgtgacgagtgaattgtccgtacaaatgagacaacaattcagctggactttgcaata

SEQ ID NO: 20359 - DNA, 1484 bp, Heterodera glycines
aagaaaaaatattttttccattaaatttgacgaatctttttttttaattctcaaaaaaccccaaaataaaataccaaacaagcagcggagcataaatcccgacgataatgccgaaattccctgcttgcccaattttaatttggcaccgacaaaataaaaatgccatttctcaaatttaaactaagtgattgacggctgggcaggcgggcactaaaagcgatagaaggctttttctttgcttttcccatcttcgtcaatttgccgacagcagcaaattgtgccattcctttacaatttgtgccgaaattcaacccatccgccaccagcggaggagaagcacccctccgcccctcttctccagcatccccactttcccattggtaaattttattttttttttcgggtgccgtaaaattggaggacggtaataagccaatgactccccgagggcaaaaaaaaaaataaataaaaataaaataccataaaattttattgtgtgccgaggagcacaacttgatagtcaattcaagtaatatgtgcctttcccgttaataaaattgaccaaattacgagtccttttccattcgaagaaaacatttaaaatgtttttttaatttccaaaattttctttcgtctttcgccgtccgccgtttttctcccggaatttatcgattaatcaatcagacacaatacaaactcctttgtgtgtgtgtattggtgggcagcaaaaggaaagtacggcaccgcaaggactccctcgggatttgccgcggggggggggggcaaagcccggggcggccaagtgaaaagcgatgggggggggggggggggatgtaggacaaatcgttttttgcgggacattctctcgctgatctgacaaattgggaaaggaatagaggaccgaataatgggtgaaaagataaggctaaactgtctaaattatatccacaaataatatttttgaaaaattttcgacaaaaaaggataattagggcgggcgttgaacggtataagaatttttataattattttttttcgtggagaagttgaaacgtatcaaagtggcggatttaaaaaaccaattaacggctcggggaaattccaaaccctaagcatttttaaattacaatatttaattatttggatgagccacaataagcatatccccaccctttactcacttccgcagcgctccaaatctcttccggtgacgtcagtggcgtaattggggtcaattggccatacggcactggaatggtactgtcgcgattgtacgttatggaccagggctgaacgtaactgattttcagttacggtcatccgtaatccgtcattacggcgatttttttcagttacgggcattccgtaatcccgtcattaccggagggccaaaaaagcccgaaattttggcgaaatccgtaaaaacgtaattccgtaatttttccaaaatttttttttaattataaaaaatcccattctaaaaa

SEQ ID NO: 20360 - DNA, 1261 bp, Heterodera glycines
  misc_feature (1234)..(1234): n is a, c, g, or t
  misc_feature (1255)..(1256): n is a, c, g, or t
aaattttaattaatctctagctctcggctctgcctctctatctcctttttatacctctgcaattttcaagtctctatttctctctctccgacttactcttcaatttctttttcatgatttcttttctctctctctctcgctctctctctctctctcttttcctctctctctctctctcgctctctctcttctctctctctctctctctctctgtgtgtctttctctgctctccaacacgcactttggcactgtttctctgatggcacacgatatacataagcagcattttttgtggctcggggcttctttcttcgctaccgtatgccaacgtcgctggtaatgctctccaacaacgcgtaccattacggtaatgatttgcattcttttttagggggtcatgtccacggcggacacaaatggtcatgacgttcgttgttcctctgctgctgtcggctggctgatcatgaaatttgtgatgcctgtgctgacggacggacgaatgattgtgagctgatcactctccccaaaacagaagtctcatattttgtaatcgctccttttaatctaaaaatgtaccaatgtgtagaaattttgagctgatgagcaccgcctccgttacgccgagggggggggggggcgaattgggcgcatcgataaaagtgacggattggggaagagaggggagaagtttttgaattttgcatcattaatttttggatttggcgggacaacgagcaaaatgtacatatatgttgagaatcaaatcgaccgacagcagtgggagcgaaatgccaatgaatgctcatcagacaaatttggcacttcaataaattcaacttttcccctaaaattcccacactctaaaaatagacaactaaaatcattgatgagactttttcgagttatcttattttgatttaaatcatcacattcccttgactggctatgatcttaatttatcggcattgtgccagaatttgcgagccccttctgctcagaagagccttggctttttgttgggtgtcggaagcgtccattatcatttaatcccgttgagttatggctaatgggtcggtccttcaacaattaacggaatgccttttccaaaaaaacgctaaatttgtcgaacctcccaaagcattttccttcccaaatttcttcccaacttttccagcagcaattttcaggtgttggttgtgtttatgaaaatgtgtccttccccatttccctaanttttgccaccattcatgaccnntgcag

SEQ ID NO: 20361 - DNA, 1211 bp, Heterodera glycines
ctgctggtggcggagacaatggccttaattaagcaaaattttaattatttaaacaaaattaaatgccttttttaattgctcacccgatgcaattagtggtactgaaaagccaaacgcagacactgttacaattgttgtcccaatttccgtcttcccaattgaccgccgctgtctccccaataattttgcatcgtttcattatccatcggttgtcccatccctttgctttggccaatgtcagcttttcctttgtccattcgttcaccaattcaaatggcaccattggcattgacgacacttgcacataaaaatgaatttcgtaactgacggaagaaatggcattggcacggagaaattgctaaacaatttgattggaaaaacaaaaatcacaaaaatgttgggccacacctccttgaaattgttgatccaatcgaagttcgtttgtttgttgtaatctgcgcaacgcaatcgcttgggttggccatcttttctcggagaatgcaaccatttggacaatgcttggccagcagaaattgttgaatttggcacatcaaaatcatcaccaaacgcagcgggcaacaaagcaccggaatagattgaattcaattggttgagatcggtgaaaattgttggcgaagtgcgacgaagcaaattgtccaaatgataaccatcgtaaaagcccaagtggcgaatgttttcagaaaaaattggccaaatttcacgaacaaaaatgtcccaaatttgttggccattcgtggtatgtgaagaaggaagccacaaatgtaaattggtgcctcttttgtcgaaaatttggtgatttgaacgaagaaaagcgatgacggagtgatcgatgtacctaaaaatgggatgaatgcttttattgcgatagctctgatttttaagtactcaatccgaagatgcttaaaacggattttgctgggcaacggacggtcgggcaatggaaatggcacaaatttgtcatcgattcgtacagacagcttcggttcaggtcctttgtccttgcgacgaatttcgattgatctccaaattgtcaattcgcttttgccatcgaaatgtttgtccaccaacgcattgaaacgtggcgaaagaagtgccattttgaggccaagttgaggacggtcaaaggatgggaaaatgtccatccaaacgtcgttgcaaatccaactgaaatgggaaaacagtttagtcaa

SEQ ID NO: 20362 - DNA, 2019 bp, Heterodera glycines
  misc_feature (1879)..(1879): n is a, c, g, or t
  misc_feature (1923)..(1923): n is a, c, g, or t
  misc_feature (1978)..(1978): n is a, c, g, or t
  misc_feature (1984)..(1985): n is a, c, g, or t
  misc_feature (2001)..(2001): n is a, c, g, or t
actatattttaaatatttccagtataaaaaattctttaaaattccaaaaaaattttcacccccagaattattaaattttttattagtgcaagagtagtgcaagagtagtgcaggagttgttcatcagtggttcattagttgttcgtgagttgttcaaaagttgattattttacataccaagatgcacatgcagtatcttggcgagagttgaagttatatccaaaatttaaacgtcaaacatctttttacattgttttaagagtttctgatgtattatttttattacttaacctaatttttaaaattgaattttttcggattctggacacaatttcccatgaagtatcttggtcagtattggacatgtaatgcccaaatgcacgtagggcgtctttacacattattttaagtatttccagtgtaaaaaattcatcataattacccatcaacccctcagaatccctgcgtatcccccctaacaaaaaaagtaggcaaaaaaaattgtcaatcagatccctttttagggtatttcccgaacccggaccaaaacctgccttataccatctgaaagagcaaagtctgtagaagtgtcatcaactcttcttttttcgattgcaccgattttaaggcaggatatgagccatcaaacacaaactgtcaaaaatttttgaaaaaattttcaaaaattttctgaagaaacttttttttacgctaaaattgcaaaaaacgctttccaccaatcgatagagaatccttaaaaaatagttgtactcttttgttcggagccaatccgaccaacttgaagagagttattcaaaaaatttgccttcaggtgctagattcctcttatatagagaatatgtaaaaacaattttagctgtcttctccagtcaattatcactggtaaaaattaccatcgaaaagaagttgaggaattcatgaacatcattagatatgacgttctgcaactggtaattaatgaactttatataattaatcatttttcaacaaaaaatattcaaaaagcaaattttgtgtatcggaattctgttttttaaattttaaattaaatagaataacaataaattcgaaagttagatcggtaatattttatgaacaaatttttcagttgactttcggttccatttgcgccaacatcacatttgaaggtgaaaaagcaagaatggagtggtatttggggcgtctttccaaaaatgctcaaatgatactcgacaacgtggagccttatgtgtcaggcgaacttgtaagatgattcttttacattaatttaaaagtagtgacaaatttgtagtgacctttatttctacttaaacaatttatcactttttaaaaaattttatatttcctacaaacctagatcagccctattatggcacctttaaccaattaataaaagcatttacaggtataaagctttcagatttttgaaattactatttttaaattctaaagaaaaaattaattgcttcttggtatcggagaatgccggattaatagggcttaaaaataaatgcatataaaaacctctaaaaattattttaggaaaaactttgtaaaacatgaaacttttcatttttcccttttacatacattcatttatagtatgaagtaaatgtttaccattttttaaattccatagaaacttttttgtgaatttttactgaatttgttgtttaattttaagctaaaatcattccccaaaattgaaaccgcgatggctaagcaagttattgatgatatgtcgtttactcaacccgttactgacaacgcgacaatcttccagatagctacaaatgtgttcgagattcttgatgaatatggcaataaaaagtcagcttgtatatttaaatagtgttgnggaagtcggtccggactctgggcgggcctttccggatctgtggngaattcgggctttgtcaatctttttccgatgaattccgtgcacaaaattaccttnctattnntgagtcgcttttttanaattttaacaatttgtgc

SEQ ID NO: 20363 - DNA, 2672 bp, Heterodera glycines
  misc_feature (677)..(677): n is a, c, g, or t
cagagtctgtacaaccgaaagcatccaaacgatggcgccgaatgctggcgaaatcgcccaaatcccaggcggatgatggagttgtagttatgcactgacgagaacgatacggcactcggccgacaccaccgccgacagctcaaagaaaaagtggctaattttgagagggggaggaatcacttttagcaccaaagtgcccttcttccgaccgcacctgccacccgcgtcggtgctgcgccccctccgccgtttgctgcgtgaaagaatgccctgctccgcatgttcgactagcgcagcagtgagcactccgccggtggttccatgggcatttgattcggttctggcgaaagcattcgtcggtgttgtcctctgcccaattccaaccgttgttgggctgcgatggttggctggtgaccgagtgccaatgacggaatcgccacgttactggcggaggagaagacatttcgcgccggggcggaaagggaagaaaggagcgaacaatgggcgaaactgaggggggaatgggtaataaatgccaaaatggacaggtggatggggaaatgccaaaatagacaaggaaatgccaaaattgagaggggaaaatgccaaaaagttgattacggaatatttggcctggcagtggacgaacccttcctcatttgggccattctctgtgncattgccgtgtgatagtctgaaattattctctcttttggaaataatgcattaaatgcattcaaattcacacttctcggctcaggcgaagtcggtgctgaattggcctcacttccgtttggcgtttcgtccaatttttgcctattcgctgccgtcccaaagtctcttcgatcgccactgaccacagaagaagccgaagacggatggtatgcagaagaagggcgagcaaaagtttggtgtgtttcttcgttcgcttaataaagcattccgttagcaaaatgaatgcttttcctttgctttacctatcctcggtgtgcttgtcctcagtggcgaaccgatgccgcccaatcgtaacgatggcattggcacattctgttgagtatcagccggcgttgttgacgccacggagagtgaaaagcggcgacggccaatgggtggagtgggcgccgaactgcttgagggcacggccagccgaccacccccggggcactgctgctggaagaaccgactttggtgctgctggttccgataaatctgtgccggcttttgctgctggcttcgatgttctgccaacgttgctctgctaaaaccttcggccgaagcggcgccatcggcccaatgtgtggtgccattgttcttcaaaatggacgttggcattccgttcaaatgctcgccttgtccagaaggaccattctgttgcgagtgccgaactttggcatgatggacacggacggaggggagcacttggccggggaaatggtgttgcagttcatgcagttcgtcctcctcctctacagacttgccgagagacgattcattgagtggtggggacacaatgccaatgccattgtagtcgttcgctgaggtgccgccacggtcgctggtctgtgacacgtctaacatcgtccggtctgagctgctcggcgagttcagcagaaggcgtgtccgcttcttttcggggcttgaccaattctgaagcatgcttttcgttgttgcatcccctgggggacattcacctgaatttgctctttgcctgcggcgacatcctcggcaaatttaacaaagcccaagtcaatgtgaaagccgtaagggcagcacccgcaacgatgctgctgctgctggtggtggtgttggttttgctggtggagttcgccgtcccctcttccgttgggttgcgcaaattcagtgccattggcaacaaacgaatacgctgcggtcttaactcggcaattcctcgctgttcaatccccctccggcaattatcccgcccccggccgttttttccttttaccttttgccgatttttgccgaagccattagccacggcatttccgcttttcggtttctgttgatggacaatttgatttcgcccgttttcgtgttgacgattggaaacatttgctgtgggtgcgccgcgattcatttggccgtccgcaaaagaaacgccgccgggcggacgcatttgccccagggcaaaagcagcaaaaaaatattagcaacttcgaaataaatttatggttggtgcaatatttatttaatggtggataaaaaattggaaggaagctctccgccagaacgattaattgcgtaatttacccccccccccccccccgagggcagggcctgttttggctaagtttggctatgatttgtcattgtcaccggaagcattgataaagcattagcctaactttgtcctcgccgcatgcgtagaaaggacaagtttcaattcgcgttggaaatgagcggaataaaatatattattatttaatgatcacaatcgtagccaaaatatttttttgagtaaaatcgatcagaaatggtttttttcattaatctgatttttgagacagtgaatttgaataatcgccaatggattatgaattaattaaatgatgaagcattgattaattgctttgggtgggcaattacgaagaaacccaacactttgaggggggggggggggggcgacagcggtttcaccccctacacataga

SEQ ID NO: 20364 - DNA, 1722 bp, Heterodera glycines
tggtctcataataaagaagtaaaaaaggggttatgcaattcttttacgcattggctttttgaacctctaacccggattcgaacatttttcgaaaattaaaattcgcgtttcttgcaaaaattgttaaggcattgttcgaattttacaataaaacacaagggattcagatatgaaaacggaaaaacacattggctgcattcaacaagcaatgttagtaaaaaaaaatgagaattttaaattttcaaaagagttcgaatctcagttcagggtacgaaattaaccgaaagaaggccagattcgcgctaagcgcatcggattaatttttgggaccgataatctttaccattgccttaaatagatgctgtcactgctgacaatgaacactttcactttggccaaaaccgtgaggaaacgattactttgaatgatgtgcatgagcaacagaaacagagcgatgaagtaattgacagtggttatcgtgatgaggaggcaaaacggcagtttggaatcacttcccggatcgaaatcccggtttcgcttcaaaaattcaacaaattaattgataaggtgcgagtttttgcacgaattcatatgctaaccaacaaaccttgtattatgtattactagtatttaatctttcccgacatgggcttttacgaactgtttgcaaacttagtaaactaccgttttactctgttcaaatcctccgtttttacaatattttagctctctgaacaacaggagaagcccccctatgatgacagcattgaccaacttgaacgccaattgcgtctgggaaagcgtttgctgagccaatttaaccgcaaaaagacaccaaaattggctgatgaacacggagaagagcacaaagaaggggaggaagatgagcaacagctaaactcatcggaagaaaacaatgacgacgaattggacaatgaccagccccaaacatcaacagcaaatgccaaaaagaaacgtggaacaaaacgaaggcacatgcccagcagagttgccaaggtcagtccaacagacagaggggaaaagggatcgcactttttgattgatttgaaataaatggatttcccatgtcagaagagactttcatccaaaacgaatgcaaatcgggaaaagaagcaagacgggggagaatggttatcaaaagagagtgcaagtcgccgcgtttcatctgcggaccaaatcgaagaatcacacaaaacgacggaccatttgcgcgactctgaaaacgacagcgaatcaaccggcggcagtgaaaacattccgccgccaccgaaaatgacgagggcccagcaccagaaaaacttggtaattccatgtcattttattgttcaactaatggcgtatttaaattaaggagatcaaaaagcttttccgccaagcaaaccgtgcaatgattgaggacgacgacgaggaagaggatgaagagaatggacaaagtgatcggaagtcaattaagtcggaaagtgacggcgagaaaaaagcaaccggaagacaaattaaaaggtttttaaaatgttttggtctttttgaaaaatgatttaacaggcgagaatctctgaactcatcgagttccgaaattgttctcgacagtgaagaggatggaattaaaacgtcggaaggatacgaagtgttaacattggacgacagacccttcgccaaccgacgcagcgcaacaaacaaaaaggttcaaaaacactcgatttt

SEQ ID NO: 20365 - DNA, 1109 bp, Heterodera glycines
tgtttcttacattctctactacatattcctgccgcttatttggctcttcaattgtatgcacaattggagcaagccaatcaaaacaactccatactcaaaacgctgtggcctcaacagttcgctgattgggcctcgggttcgtttttattttggtattttatttgactttgttttgtctaaggaccgaactcccgagtttaatatgccgtcttcgtctgacctttcgcgacagccgatcagcagcacaccgttccgtttccggctgaatttcgacgatccgtctgcatacagtgacaatggtacggattggatgtcctttctaacaacccttctaattttgatttggaattcagagaatcggccctctccagccaaccaaacttccgtctctctgcctgacaacggctgcaacgtttctccgtacgcgcgttacacgggcagcggagactcaccgaccagcagtcggtccggcaacggacggaagcggcgcccgcgcagaggcgacgaattgttcatggacagacggcacttgcgcaagagtcgagaggtggaggaggatgaactggacgaagtggaaaatgactacacaatgggcgacgactgacttttctaatctcctttgaaacggtgctgactatatatcctattcttttatttattacttatgctttgattatttattattgtattttttctctgcttcgctctgagtttttgtttgatttaaaatttgtttttcggaaatgtcgtataatatattgtttgttaaaggacttattattctttgcttatgcacatacattttgcaattgtgagaaaattacagagacacaataaaataaacttattacgggttaaacagtgaaacttattacaaaattgaattaattactaacaatacgcaagtgaattaaatgtacgaaaaacagtcattggataaagcttcagtgctgcacaaaggtcctcccggtgattgtcttcttttccgtctttccctccggcagagcgcggttgagcaccttgaggaagtcattcgtctttgaacgcatccgcgtgtgtaaataggcctaaattttaggattatgttaacaaattttcagggtctggca

SEQ ID NO: 20366 - DNA, 635 bp, Heterodera glycines
tcccataggaaaagtgttttacacgactttgttaaaatttttattttttttcgaaaaatggggggacaaactgcactattaccataaaaactgctggaaattgattgttttaaacttcttttttaattcttaagaaaaaagcaaccttagagcatttgatgtgataatggagataatctcgaaatgtgtggatcaaactgattgtgttgtcgcgcgcttttttgttcgtatgtcgcgggaacaaaacttaactttcggtgtgcttttgaatgcgcatgattgagcagcaatgaaaatgagagaactgactgaccaaatgtgatgtatccgacgttgtccccaacccttgcctcggggttattcctcagttctaacggaggttcgcccaccgaatagagcacttgtggcgcagtttgacttgcccttctcccctcacggaactcctaaatgtaattacaaaaaccaattttgaatatccaaatcagcaacatcaaacctgaaggaacactttgccgattaccacatcgtccgggtctttgaacaacgtgctgaaaatgacagtcacccggtccgattttgcctcaataaatctacaaggaaaatttgaaacaatttaataatagaaattgcattat

SEQ ID NO: 20367 - DNA, 1050 bp, Heterodera glycines
aaaaaagaaataccctttttcggagaatatttattcttctgagacagcaattttcaaaccgaccttttgtagggctcaaccgcagatagtaatgcgtttttggggaaaacccacatgtacaacggtgtagaaaaaaagagatagccatttttctgagaatatctattcttctgagacagcaattttcaaaccgaccttttgtagggctcaaccgcagatagtaatgcgtttttggggaaaacccacatgtacaacggtgtagaaaaaaagagatagccattttctgagaatatctattcttctgagaaagcaattttcaacccgacattttgtagggctcaaccgcagatagtaatgcgtttttggggaaaccccacatgtacaacggtgtagaaaaaaagagatagccatttttctgagaatatctattcttctgagacagcaattttcaaaccgaccttttgtagggctcaaccgcagatagtaatgcgtttttggggaaaacccacatgtacaacggtgtagaaaaaaagagatagccattttctgagaatatctattcttctgagacagcaattttcaaaccgaccttttgtagggctcaaccgcagatagtaatgcgtttttggggaaaccccacatgtacaacggtgtagaaaaaaagagatagccatttttctgagaatatctattcttctgagacagcaattttcaaaccgaccttttgtagggctcaaccgcagatagtaatgcgtttttggggaaaacccacatgtacaacggtgtagaaaaaaagagatagccatttttctgagaatatctattcttctgagaaagcaattttcaaaccgaccttttgtagggctcaaccgcagatagtaatgcgtttttggggaaaccccacatgtacaacggtgtagaaaaaaagagatagccattttctgagaatatctattcttctgagacagcaattttcaaaccgacctttttgtagggctcaccgcagatagtaatgcgtttttggggaaacccacatgtacaacggtgtag

SEQ ID NO: 20368 - DNA, 2602 bp, Heterodera glycines
taccgtatttgctctttttatatgccagtctccattaatctgccggtctccaattatatactccctttgaactaggttgaaaaataatctcccagtctccatttatgtgccggggggggggggataaatagaattttttaataatttatttggccggcttcttcgtgatcgtttcgtccatctttaaccgtttcagttgccctaaactcgcgcaaaaaagcccagaaggctgtttctatgcctcaaaacataaaaaattacaaaaaaaacttcattttgatcacgttaaaaatttcgacattttgaccgacttgtcgacactttgtcccactactcccaaacattgttagacctgtcaaaacattgtttaacccatttaaaaacaaatatcaagctctacgcactcaattacccccaaaatcccccactcactgcgaaaagccgacttttttgaccaaatttttagacaaatgaccaactcaactttgggctagggactcaaattttttaaaagaaccgcctcgaaatgctctaaccaaaaaccacctcgcccattacccacggcaacttaaaagccgctacgggcgcaaaaaaaagatgcaactctaaaaaaattcggaaaaattccctttttgaccagtttttcggacaaatgacctacttaactttgagctaggggtccaaaatttttttttaaatgtgactaggtgagctctacaataatatacaatagcgcctgagctaacatttcgctaaagcacacccgcccgagtctaactttttgagaccccttcctggccaggggctaaaggggggtcaccccttcaacttagtgctggcgcacaattttttttttttaaagaccaaaacgattccatattttcttaacttttcattaaaaattccaattttttatgcataccggaagcaagaaaattacatatttttgccattttggggtcattttcagaagttctttaacaaaaaattcaatagaaaaaatttttttttgacgcgatgacattttttggcgacatgttcaacatattcaaaaaattttccactaaataaatcaaccgaaaaataatctcccagtctccattagtctgccagtctccaattatatacccccttctgagaaggttgaaaaataatataccatggtatataaaaagagcaaatacggtaagttgtttgtttaagcaaatgtttcggaaattaaaacataaaatacaatgagaaatcaatttacagtaaaatccaatattaaacttaataagtaattttggttcataaaatactgaaaacttccatatacgtaattgagttatgtcctgatcggatctaacttttaaatgtccaagctgtgcgagtttttggcttccagcaggttaagcaaaaacttcaggttgtaagcaattctttcgtcgtgtcgtccacgaaacaacaattgttcgttcacctgtccaaagcgagatggagttggaagttgggactacttttttttgatacggaaaagtccaagcttttcttggccaatttggagaagcgtaaaaggagcgcaatgctacaatttaatttcactgatggagaagcgaagaaaacaaatgataatttaaatccataattgtggagaaattttaatggaaattcaaatgaatgaaatttaaaaatcatttttttaaacttcagttaaaatgtttctcagcctttttatttcttcaattttccgaaggcttggctcaaattttgaagaaatcaagaaaattaaactaataaatgttaacgattgatcataatgatatttttgtaattaatttttaaaaaatcaaattaagctagaatagggtatttaaagactaattttaatcgtttcttaataccgtagttatattaaactgcattaccgttaacacgagagattgtgagattaattcgatgaaccacactattgtgtttttctgtaattatacacgaaaaaatatctttttgaaaatattaaagtttggatttatgttcgtaaagatggtaaattatagtcaaattcctaatcagcattttccgtgataattaacttaacaaaaaaattcttcaaaaaatttcatttttggccttctgttaattgcaagaatattcttttttgctttaaagcaacataaatcccacaattcattaattgttcgttaatgattggaaaacaatgtaaattcgccataagcatgctttatttgccctggggccctattccggtcttccggttaaatattaaatcagacaggattaaggcgttaacgactgttaatttaaccggaagacgggggcataagacccctgataagtttaatacaaaaaatctttttcatagctgaatgagtatctcgttcggctctagtgcactttatgagtccaatcgagttttatgagtccaatcagagtttttgagtccaatcgagttttatgagtccaatcagagtttttgagtccaatcgagttttatgagtccaatcagagtttttgagtccaatcgagttttatgagtccaatcgagttttatgagtccaatcgagttttatgagtccaatcagagttttgagtccaatcg

SEQ ID NO: 20369 - DNA, 2306 bp, Heterodera glycines
aaattcaaacaaaaaaggaccaattcattaaatttattttaaaaatataaaaaattcaaatttgaagcagactcgcctcttttccgtctccgtcccccaacaaaaaataaacatcggcgtcctctctcgtgctcatcaaatgcttcatccggataagccactgattgggacattataaacaattgtgaaattcgtaattatcttatttacgcaataaaataattcgaattatgaaattggaactagacaaaataacattgtaattgcctttgaggaactaaaatcgcaaattgccaaatttatgaattctcttttttaaataatatataaaggggaacttattgaacatcagtaagcgtggggggaagggtggaggagccacgcctgttgtggtacacgcatcgattatggaagccgcgcatgcactagcaacgaagtcctttgcgcgaagcgctcatgtcagcgcccgcccatatataccaaaagtatactgtctacaccgagcaattactgtgcaaagcatactgtctacaccgagcaatcactgtgcaaagccaactgcctacaccgagcaattactgcgccgcgacacgctagtttctactatatatagagaaaaggtgcaactcgtagaaaaaattataagtccccgtggtttgcccggagggggctgaaattttgcaggcaggggtaacttttgacggcgcatctgggaaaaataaggaaattccggtccggaggccaactgagcgccagcggcgctgaaacggccaactttgaaaaatggtcgccgttttcgggctgtaactttttcctgggaaccgggagcggaaaaagtctgctgagagggcacaccccagacatgttggctacaactttgtcactgatcactttttgatcagatcaaatgccgagcctgtagaaattggcgactgaacggcgctcaaaatgccggttttggcttttcgtgaataactcgctgggggttaagcggagcggattggcgccgcttgagcatttgtgtagtttttaaagctgcatccgatggagttttcagattttgaaaattttcaaaatttttcgagctaggccccctcgaaaatttttcgtttttgaattttattattttttgccgatttttcccaggaaaacggagaccactttcaagcaaccgtttttcgagctctatcgattggtgtcatttttgaaaaaatttcaaaattttccggaaatagaaaaattttccggaattgagctccccatttccgttcaaggcttataactcgtcaggcgttgattttagcgaaaatttgtcttagagcatttttgtagagaattttaagctctatctaatgtgctttatttggtctttttatctttaatataaaaaaagttataaaactaaaatgaatttttaaatgcaaaaccaaaggggggaccccatggatttgcatttcatgagaaatttttttgctcctaaaattgccaaaaaatacttttctggggtaatttgaggtgctgaacacgaatatgcactttatattgcgttttgaattttttggagggtggtaaaaaaattttgaaaaatcaataatttttggcccttgaaaattcaacctaaattttaaaaattcataactcgcctcaaaattgtccaattcagctcatttaaagcattaaaaatcgagaaaaatagggagaattttatgagatttatttgaaatttataccacaaaaacaaaaaaagttattccagaaattctggaaattttctatttttcagaaaaaaatttatatctcggttctgaaaagtcattagagaagagtaaaatactataaaaatccgcaattttttgctctattatataaattttatttgacctttttatcatcttttaaaataaagatacaaaaataaaagtgattttggcattcgagaccaaagggggtggacaggatttttgagtaaaaaatttttttcaacaaaaatcttccaaaaacatgtgtttatgggttatttgggccgttgatcacgaatacgtaatcagattttacttttgacattgttaagacctcagaatccctgtgtgattggggattctgaggcatcatattgagggggcggggggcaagttcgaatccgggcggtaacacattatttttctaagtattttttttacttatttttagatgtttttaatttattaaaaatagttttgatttaatatttaaaaataaataaatttttaatttacttttttatcaataattgttttaaattttaaaattcacattgtacctcttct

SEQ ID NO: 20370 - DNA, 1770 bp, Heterodera glycines
  misc_feature (1741)..(1741): n is a, c, g, or t
  misc_feature (1758)..(1758): n is a, c, g, or t
gaattattttgttctccatcgactgttcggagaaggattaatgtaaaataaatacacagcgaattgaacggcataatgacataaattaacaaaacattatattaataaaagacaaaaaagagggattgaatttatgtagaaaaaatatgaaaatatttcctgttatgagcgattaaatgtagaaaaattacaaaataccaaaatatatcgataaacatttaattttaaaaaacaaaaagaccaaagcatgaaataggcacaaaatgtgaacaaaaaataaataattcatagaatttgaataatttaattgatttaaatttttgaattctttaaaatatattttgaagaaagtaagtttatttttaagaattattattttggatttaataaaatcagaccccaactatcagcaacaattttataattattatttttatattatataagaaagtgaatcaactgatgacaatttattttttagcattgccaatgtcagggcattattctttccaaatcggtgattggcatgccaaatttgcaagctcattctgaaatattttcattgctatatataaaactatgcaaaagttggcaccaaatttataataaaaaaatatggctgagataaaataattaatgtgttttttgttttctgttgaaatggtaatggcatttctttttgcttcattaagcatccaacctcctctttctcttctcctattcctcttcctcctcatcctcctgttcctcctctttctcttctcctattcctctctttctcctcctattcctcctcccattcctattgctcctactcttcctcctccttctttctcttcctcctcctattccttctcctttttctcctcctcttcctcctccttcttttcttcctttttctgctcgccgtcctcccatttcgttaccatttcaaatttttcgcgtcacgtacgccatgccttgtgctgcgggcacaaatgcattattatgtgtagccatcaacactggtttcgtcgcttggacaacttttccgccaacatttaacacgggggggccaacagttttactaaaaaaaaagcccagagtttcagtgaaaattcgtttaatttttttttgaaacttgcacagtcattgagacaaatttctttgctatcgctgggactggacattttcttcttgcgttagctgtgcctgcaacattggcaccactgctctctccgttcaatggcttttcctcgctggcactctcatcatcaccagctgatgagtgtctctcctttggctgctcatcaacactttgttcgccttgccgttctgctgcgtttgctttgtccgggcaactttgcttctcgtcaccattttcgcttctgctgctgttggcactttcacctttcgcttcggcactttcagcggtcgctttcggcttcaatacttttgttgctttttcgtacacgaactttgcgccctgccccgccttttgccgtgccggggacacaactaattgattgacctcatgcgctcccttggtaatagtcgatccaactttcattcgaagttgtcttaattaggtatttaaagatttgctatatttaattaattgaatcaattagtctgattcggcattaattcctcctcctccgctgcttcacttaccttatgccattaaatccatcgaacaatgttttttcgtcctttttgctttgtttcaatggcgctttttcggtggtcgatttcttcgatngtcgtctgctgtattgngccgccttcctc

SEQ ID NO: 20371 - DNA, 1601 bp, Heterodera glycines
  misc_feature (25)..(25): n is a, c, g, or t
taattatttatagataaagaattcnatagtcattacatttacatattatatgcattattattaacaaagacaactttacatctcgaatattattcccttcctgagaaatgcgtttttactacagtaccctactgtcccttgcttttgtcctatctctgtgcttacggtgtcccactgtttggtcagtgcacagtaagaacaagaatgactccatgtctaatcaccaaagtgaccacgattcgatggcacaacactcggaaacggaaggcggcggcaaattaaaaatgccagaatttattaagaaacttatgcgtagcaaacaaacgaaaaaagacaaaaaagcggcgcaaaatgacgcccgaggggaacaaagtgaaagtgaaagtgtacagaatgggcaaaatgacaactcagcagaaatagcgaatatgctaaacgaaatgcctaggtggacgacgagtgccgggacgagtcgaaacatagccgaaaacaattcgccactccatggatcatcccccaattattacaacacggtcagaggcagcaggcaccaacggacaaaaagcagcaaccctaatcaacaaccaggggccgtagtcaaagaaggtggttatttgaccagggcattaaccatggtcatttgacctggtcaaataacgaccaaccatgtgaaaaacggcagtaaaagaagatggtaaattttctgctggagcaaccaccgttttttaaccgccaaccgtcttcttttactttaccaccaactttctaccatgaactgattaaaatttgcacttgtcatattaaataaataggcaaaataaggtttaaaggccctagaaaatttgtagaacaaataaaaataaattattatttatgcattaattttttgtttaaaattttttattgctatttaaactatttcgacatttagaaactattcacttaaaaatttacattggtttttttatgatttgaattaatacaatgtttttgatgtaattacataatctaaaaattcgagaatcacccaaaatataaaaattatgggtaagtttgtttttaggtaaccaccaaccatgttcttttactgtgcgttcacaaaccaccaaccatcatggtcaaatgaccaggttaaatgaccatgaacccgtggttgctcatttgctacaggtaaaccatgatggtagtggttatttaaccataaccaccttctttgactacggccccagaaagtttaaaatacgagttggtttcgtcctttttgatggttcttttataacatatgtatctacatagagtgtctagctgggaaactcaaatttgaattcgaatttttaattgacttttaaataaagttaattgttcataaaaaactcaaatacaaaaaatttcttgagaaaaaattccataatttgatcatcacttctgacaaacttaaagagcaacagaaacattattgaccacgacttccgatcataaattgttgtccaggaatgacccttggaagaacattttggaaattcaaagaaaggacattttaaaaatgtttattatatgaaataaaaaaagggcttgaattttattccatggtttctgttttg

SEQ ID NO: 20372 - DNA, 1426 bp, Heterodera glycines
caaagtgccgtgcggttgatctccgaggtttgacggaaaatgcctattccctatagtgccggatgatggctcactgagttggattgtgccgcgtttgtgcgggtgacgggctatttgtcatacattgggggacagcccattgaataagtggaagagtttatgcgttgggccgagacgctatgcgctctattttgcacgtcaaaccttgcaaaagaggcaaaattataggaagcgcctatgggtaatgagtaaatccattgtaaggaccccgaggggaaagcgctggcatgtgccgcattcttccacgagccacggggcagcgaatgctttttgcactcaaaaatcacttcaaaagtgccctgtgcgccggagacatcgccgacgctgccgtggaacatacgcatagaactgctgtgctcctaactacgagcttttactgcttcagcgactaacctgctcttgacatttgttcagctcatcgattctgcatttgccgttagtccgtccgcttccatgtccgtctccaacagcgcttttcccccaaatttcatcccattggtcggcatggaccaaattcacactttgacggagtgtttgaacaaatgcatggaccaccagaattgtcaggtccgttcgaccatctcctgtccgtccattatatgcttcaattcacctaaagtccgcttcgttccatgcccaatcacttcgttgtttgctctacgaccaattcccttccgctgatattctcttccccgccgaccaaagttgggcattggcagtcaatggctgtgtggtgaccaaagcgggccaagtcggcgcagttgacaacgaagacgggcaaattgcaagcacgaaagtggcacagcaaaagaaaggggtgccgaacaatcagaaggcttttggggtggcgaacagaccgtgcggagggggagagaatggaggaataatggcaaatttatttggaaaaaaatgaggagagaattttattattattttatcaagattattaattatgaatatcaaattgtgagatgcaaaaccaattcatacaatataaaaattacacaaaacatcgtttgccataaaattcattctgccaatcactgcttttgtccttttctctatcggcgagtgaatccaaacgatccgttgggccttttcccattgccaaaggcaacttcagccggtggaagtgccattggtccgttcgtctgctgatcactttgtgtttgttgcgtgcccagcattagtcctgcgataatgacatttatttgtttaattcgccgccttccccaaccgctgtcctcgtggaaagtgtcgtgcacagtttgccttccggcatcatatccttgatcagtctttttctcaaccggtctttcaggaatcggtttctcaaagggatgcgcagggccattagaaggcaaat

SEQ ID NO: 20373 - DNA, 1139 bp, Heterodera glycines
  misc_feature (729)..(729): n is a, c, g, or t
  misc_feature (744)..(744): n is a, c, g, or t
  misc_feature (786)..(786): n is a, c, g, or t
  misc_feature (845)..(845): n is a, c, g, or t
  misc_feature (924)..(924): n is a, c, g, or t
  misc_feature (947)..(947): n is a, c, g, or t
  misc_feature (978)..(978): n is a, c, g, or t
  misc_feature (980)..(980): n is a, c, g, or t
  misc_feature (993)..(993): n is a, c, g, or t
  misc_feature (1007)..(1007): n is a, c, g, or t
  misc_feature (1016)..(1016): n is a, c, g, or t
  misc_feature (1019)..(1019): n is a, c, g, or t
  misc_feature (1021)..(1021): n is a, c, g, or t
  misc_feature (1025)..(1025): n is a, c, g, or t
  misc_feature (1039)..(1041): n is a, c, g, or t
  misc_feature (1046)..(1046): n is a, c, g, or t
  misc_feature (1060)..(1060): n is a, c, g, or t
  misc_feature (1069)..(1069): n is a, c, g, or t
  misc_feature (1072)..(1072): n is a, c, g, or t
tttcctcacattaaggttaaatatattctgcgcagattggggcgtttgttgtacggtggtgggggacggagaagggaaaggagaagaaacagttacagcagagtcaagttggagttgtgccgcttaaggcaacaagttgagagggaggggggggggggggggcaagaacggacagccacgcggtggaggaaatgccaccactttcccaaaattcactcccgccccaccgatttgctgctgttggtgttggtcctcctcctccgcctccggaatgcctttttttgtcccgttcattctctgcgttccttcagcagcagttgaaccaggtctttctgtacttgcccacgttgttgttgcttcagccgttccttgtttgttttcttccattggcttgcttttcctctcggtctcttcgctcttcctcatcccttcctcgtcttttgctgtctctcccatggtcgtgttgtcttctttcttctgcttctcctgctgtactgctccattccgttcctccccctcttccttcccttcttcactttcctccgtctcataactttctccctcctcttccctctctgctccttcctcctcatatgatctttcttccttcttctactatttttcttcactcttcattttattccttaattccacccttatttcctcctcctttttattatcaattattatcattctactactccaacttctcattttgataatattttnatcccccatttactncctcaaccaatacccattcatccccatctccacatccaccancacattctcaatctccactatcaatttaactatttctttctccactctttccaataccntctcattcattccctcaaattcaatttcttttattatttccatttatcctttccttttctcctccacacttatactcanatcaattatctctcccacttttnttataaaatactaattttatcccttcttttntntctcattaattancccattatttattntaattctcnaantnttcntttctctttctttnnnacttnccattgtcgacgtnttccttttnctnccattatcttcttcttccacatatggaaaatcttccctttttcctccgtttgtaatttttgccattt

SEQ ID NO: 20374 - DNA, 797 bp, Heterodera glycines
aaaaaagcaaattattaattttaaaaaaagaaaattagacagaaggatcaaagttttcgttctgaattgctttatttatctttttgcattgtatatttttaacggatacatgacaaaaaggatttattcaaccaacattgtgatttaaattatattatactgttgcaactaacatcactttgagatcggaattctagcactaaaaattttcctggaatcggttttattatgtaaaaaaaaaaatgcaaaatcagaagcaagccaaaaacatcagtaaaccgaaatttcatccttcaaaatcgatgaattaaatgaactaataaatttattatccaagaaaatattaaactcttctataattatttttatttctcttgattgacaagcaatgttatacaaatataaaaataacagttaaaaatgatagtaataaaatcaaataataacgaaataatcaaaaattttaatgagtaaaaaacaaactaataaatttttagagtataataattcagtaaatatttctgagttttcttgccaaattctattttatatttcaatcatctataatatgtttgttaaattcatattattaggccgtatctgcagcattggccttctccaaaatgtccttgaagaagaacggtgtgaacgcatagccttggcccaaataaaatttgctttgaaattcgacccttaattattaaacgtaaattagtaacacaaattaaacgggcgtagcatttaaactttcaaataaaatctaacatgtaaaattgagggctctttttactaatttg

SEQ ID NO: 20375 - DNA, 1036 bp, Heterodera glycines
ttataaaaaatatttcatggattacaattgcaaataatgatattttttgatttttggatgcattttttccaaaataaattaaaattacaaaaatcaaaatttgggtcaagaaaaaaataaataacaaaaatggaaaaacttttaaaaaaaaattaaaatgaaaaagttttaagggaaaatttttgaaaaagcgcaaaaaaatgaaatatttttttccaacaacaataaatttattgacgaaaaatgacacccaaatgaaaaaatttaatttgtcccagcccgactaattaaaatcaactcatatcatttccgttttttttaattgagagtttatatgtggccaatttttttatatttaaataataattaatttgacttaaaaatgccaaaatttctattaaatattttatttgtttcattctaaatattaattgacatctgaaaataaaatcataaaatagatggtcattttacattatcaattatttttcttttttttctttttggattttattcgtccatttttcaaattccataaattccatcaccataataataattaatttacttcatcatgatgcgcaccgccacctgcaccactgacatggtcatgtgcctcgtcaacggagtgcacttcgtcatgtttggtcccatttcgtccatttcgtatcacatgcatctcctccttttgcatattaatacgaacactctaaaaaataatttaataaaaaaaaattatttaaataaatttatattatagccatcaaaatgagtacctaagtccaggttttggcctgttttgaccgggaccgggaaaatcccggtttcccagccaaaaagtcccggttttaacccgaaaagtcccggtcccgttctactctagttgaaatgtatgctttgcatatttgatttaattaacattttgattttacgtgacattttattattattaggttataaattttatggactaaaaaagcccgaaatatggacgaaaaagctcaaaatggccaaatatggtgaacccaaatcgata

SEQ ID NO: 20376 - DNA, 860 bp, Heterodera glycines
ggacgggcgcttcgcgcccgttttttaaaattttatgggggatattcggccgcttcgcggcctcaggacgggcgcttcgcgcccgtttttaattttgttgggaacattcggccgcttcgcggcctcaggacgggcgctttgcgcccgtttttaattttgttgggaacattctgcagcttcgcggcttcaggacgggcgcttcgcgcccgtttttttaagtttttgggggacattcggccgcttcgcggcctcaggacgggcgcttcgcgcccgttttttaattttgtggggcattcggccgcttcgcgacctcaggacgggcgcgtcgcgcccgttttttaacaacagtgatgagaagaggtacaaaagtgataaaagaggtacaaaagtgattagaagaggtacaaaagtgattagaagaggtacaacatggtttaaaattaaataaataatgaaaagtttttataaaaatcgattgcattttaatttaaaatttttttataataaaatactctttttattcattaaatataattttgaaaattaataattgaatatttattttgaaatgaaattcattttttataaattcaaaaaataaataatgaaattctttaattaaaaaaataaataaatttaaatattttataaaaaatatttgaaattaataaaacatgtaaaagtaatcaaaaatgcacagaaaaataatgtacaccgatcggatccaaacttcgccccccccttcaaaatgatgcctcagaatccccaatcacacagggattctgagggcttaacgatgtcaaaagtaaaaactaattatgtattgatgatcagcggcccaaattacccctaagacatgt

SEQ ID NO: 20377 - DNA, 1365 bp, Heterodera glycines
  misc_feature (41)..(41): n is a, c, g, or t
  misc_feature (43)..(43): n is a, c, g, or t
tcaaaatgcccgacactagcgcattctttagacaacgaaantnaattctgaggatttcccaaagccatgcgcagctttgttagaccgatgccgaaatggcaatataatggaaaaggacagacaacaatgcttttctttatatcagctgatggtttacaaaaatcgaaatacttcctgagtactttccaagaaccatgagaataaatatcgcactagcgccaaaatcgaacaagaacgctaatcatcagaatcatcttaattttcccccagtgatttgtgagtgataagaaaatagaagaaattcagggattaattccagaggaatttccaaggaccacgtgcatcattgctacaacggtgccttaatggctttttaatgtcaaaatgcccgacactagcgcatttctttagacaacgaaaattaattcctgaggaatttcccaaagccatgcgcagctttgttagaccgatgccgaaatggcaatataattggaaaaggacagacaacaatgcttttctttatatcagctgatggtttacaaaaatcgaaatacttcctgagtactttccaagaaccatgagaataaatatcgcactagcgccaaaatcgaacaagaacgctaatcatcagaatcatcttaattttcccccagtgatttgtgagtgataagaaaatagaagaaattcagggattaattcctgaggaatttccaaggaccacgtgcatcattgctacaacggtgccttaatggctttttaatgtcaaaatgcccgacactagcgcatttctttagacaacgaaaattaattcctgaggaatttcccaaagccatgcgcagctttgttagaccgatgccgaaatggcaatataattggaaaaggacagacaacaatgcttttctttatatcagctgatggtttatttacaaaaatcgaaatacttcctgattactttccaagaaccatgagaataaatatcgcactagcgccaaaatcgaacaagaacgctaatcatcagtatcatcttaattttcccccagtgatttgtgagtgataagaaaatagaagaaattcagggattaattcctgaggaatttccaaggaccacgtgcatcattgctacaacggtgccttaatggctttttaatgtcaaaatgcccgacactagcgcatttctttagacaacgaaaattaattcctgaggaatttcccaaagccatgcgcagctttgttagaccgatgccgaaatggcaatataattggaaaaggacagacaacaatgcttttctttatatcagctgatggtttacaaaaatcgaaatacttcctgagtctttccaagaaccatgagaaaaatatcgcact

SEQ ID NO: 20378 - DNA, 2994 bp, Heterodera glycines
  misc_feature (2981)..(2981): n is a, c, g, or t
gtttcgccaactaaccataattatgacatttcgccaactagtcatctcgccaactgacactttgccaactgacatctcgccaactagggcaaattcttacgtttcgccaactaagctagattcggacgtttcgtcaactgaaatttcgccaactagagtacattacattttttactcatatcttgatcggtgactcgaaattattactccaagtgcaaggctcacataaaaaaacttatctgcgaaatatacattgctccagaagaaagatagaaaacttgggtacttttagttcctaaatcttggccttatcgtattactaccacttataacgacataataaggtttgccccaattaaaataggtctcaacaattttgatatttaaccgatttgggctagattttcgggattcgaccctaaaaaagagttgggcgaaaacgaattgaatgccgtccgtacgtttcatgacggaaccgaaccgaattatatgtttttttgccggtgcaatgataccgagggattctgaatctctaatcaaagaaatacagacactgcggtgaattgataagtgatatggataaggagaataatctgtgagagccctggctttcatagagatacattggcattacattgtattactattctagtgcaaaatcttttttagagtaactggcaatattatgaggtgatacgtgcattgttgggagggagaaaatcactgagagccctggttttcatagatatacatttgtattaaattatattactattctagtgcaaaattttttttagagtagttggcaaaattagttggcgaaacgttcaattttgggtgagttggcgaaacgtccgaattcggcttagttggcgagatatccagttggcgaaatgtcagttggcgagatgactagttggcgaaatgtcataattatggttagttggcgaaacgtccgaatttggcttagttggcgaaatgtcgtcgtgcccttattttaggctaaatattaattttttttttaaacgacaaagtctccgcgtggtcatgaaaatgaatcatcgaactttgaggaaaatgtgagccgaattttccaattctatggcaaatgataagggctttttgcatttcagctggatctgtacggatgtttggatggacattttccctcattttgaccgtcctcaaattggcactgatttcgccacgtttcaatgcgttggtggacaaacatttcgatggcaaaagcgaattgacaatttggaacaaatctccaaaaggtgctatggcgttagtcaaaaaaccgccaaatgagaccctttatttttttctcatgtcttttactgattattttgtataaaattatctagcaataaattttaatatttgcctttaccaatttcaaatatatttttataataatatttttatatatatttttttttgtctacgtttaacaaacaaactacggtcatttttactgatttttgtgttttaaatttgaaagtattaatgcaaatttccctacagaatatgtaacaaattatttttaacaaggtcttgcttaaggactaacaagcattacgaatcaaattattttcaacacatcgaaatacgaaaatcgtcttttttcgtcgcgtattaaagcaatatttctatttgtccacttcgactatgtctttttctgttgccatggtgatctattaaaaacttttagttcgacatttaatttgtattaaccataaaaacaaatctcctcaaggtttggtgttttatcaagccaagatttcagacaaagatgtttaaaaatggaaatgaaattgtttagttaaaattaatctttattttataattaattaaatttttagatgtcttgcttaaggactaacaagctttataaaattcatagaaaagttgatattccttataaatatctcataatttctgaattgctgtagggcttgggttaataattgcttcaaaatctccaaatccgtcgtagtaaataaaaagggaattaatggtattgatttgttcgaccattaccttagaatttatttagaaaataataaacattttatgtaccgattttgttgtctcaggcgtatagatattccaaacaaagttgatttcttttttggaatttgctgtatttgggctacaaacaataatattaagtttgtataatcttgcagcacataaaaaatctatatttgatgcccatttaaactgttcagaggcatccaaagcggggtttttatgattttcaatatattctgacagattttccaaagatgtttcaaacatttgccaccagtttgatgattcggcattaattcattctagcaatttacttattgaatgaatttcacgattttcaagaataaattaatttgaataaaaattttttgtaaaaaatatataataaaaaactattgtaaaaaatatataataaaaaactaaagccaataaatattatggaatcatttttacattaatcaatgaatcgattttacattaataaatattttattatacgaagtgtttgtttactaatattaaaatttattgctagataattttatacaaaataatcagtaaaagacatgagaaaaaataaagggtcacatttggcggttttttgactaacgcccattgtggcggtttttgactaacgtcccagcaccatctgttgtttactttttccacccttcaaacgaatggacgggttcttggttgagtttgtcgtctgattaactttctgatgagcgcaattgtccctttcagttgaagttaaacccaattgatccattttaagactatttttgggactaataatttacacaaattaaaaacaatttaagccaaaacagaaaaatgaaattgcttatcagaaagagttattatttggtaaaaaactcttattttcgtttatttgctgcgatgaaccgaataatatgtgctaattgttatttcttcanatttcattcaaat

SEQ ID NO: 20379 - DNA, 2136 bp, Heterodera glycines
ttatcatcagatacctgaaaagttttgttttaagaaaggactttggacagacgagaaagacatattttaacacaattggtcgaatggtgaaggatcaccggctgagccggagcgataccacctgaggctgttgctgttgaatgtgaagggagcatgctcctatgatgatttgaaaacagttattgatattaatggtattgcaaaagtttgtgaaactttttcagccgcatgtttagaaaaaggttttattagaaatgatgaagagtggaaaagagcattagaagaagcagagagttttgaaatgcaatggaaattgagagagttctttgcattgattttagtacattgcaatccggccaaaccggaagagctttggaatatgtttaaagactcattgtctgaagatttttgcaggagttttagaaaagttggcttatgctaaagcatataaagagattgcacttagcattatgaaggctggaaagacgcttgccgattttccaaccatggaacagataaatgttgatgatgatgttgaacaactgtttgacctagccgaaaaattggatttgggacaaagaattattctttgatgtatgataaacagaggaatgtttgtgatgccattttgcatagaatatggaatcctgtaaatgaaccccccttctactttcttagtggaccgggtggaacaggaaagacacatgtgaacaagacaattgtacatatgctgagaggtcaaaagaagaaagtttgtacaatggcttttactggcatcgcagcaactttgctgcctgctgggagaacattgcacaatagatttggactgactttggatatgagtaattcgagtattagtccgagatcaaaggcttggcatgaggtgaaagacacagatttgtttatttgtgatgaggcgcctatgataaataagcgcgcaatgagaactttggatgagaattgagagaaattatgaataatggaattgcatttggtggcaaagttatgctttggacgggagactttcgtcaaacccttccaattcagaaacatgccacgagagctgagatggttaattcgactataaagagagtgagtattggagattagctaaaagatacaaattggcaaagaatatgagagctcttgaaacagagcaagaatttgcgagagatttgttagaaattggcagtggaaaattgaacaatgaaaatgatgagataattttgcccgagaattgtattagcaatggtgatttagcagaagagatttttgcaaattgtattgcttctgagaattggaatgaaatggccaaaagtgccattttagcaccgaagaatattgatgttagtgaaatgaataatagagttttagaaatgttgccaggagaagaagttgtgtatacgagtatagacttagctcaagatgagaatagacagagagcagatgaatatttggatgagtatttgaatgctttgaacccttcggggtttccacggcataagctgaaactgaagaaaaatgctattgttttgttaatgcgaaatttgactatagaaatgggactttgtaacggttcgagaatgaaagttgagcaaatgcaaccgaatttgattgtgtgtaaacttttgactggagataaggcaggtcagactgtgtacattcctcggatcacgctttgctgttctgaggattatccttttgacctgcataggcaccaattcccgttggtgttagcttttgcaatgacaattaacaaggcccaaggtcgaacccttgagcaagttggaattgatctgaggaaagatgtttttagccatggtcaattgtatgtggctctttcgagagcaagagcttggaataagctgagaattagattagatgatagtaatttagagagaaaggtgatgaatgttgtttacagagaactattagataatagtgattagataatgttttagactagctttattagaattggtttttcttagagaaatccgttgttctttgtgttgctcaagacagtacgaacacaattcaaagtaagtcattccttttaatttcataattaggtaacctttctccaaataattgtacgtaacacattcgtactacctagcgggggacgcgccgaag

SEQ ID NO: 20380 - DNA, 1633 bp, Heterodera glycines
  misc_feature (95)..(95): n is a, c, g, or t
  misc_feature (122)..(122): n is a, c, g, or t
gttagcctcggatcagactgaaacttttgagccaagacgggaaaatattattacggcaaaagtaaatgagtgtttctcagcaaatcaaaattttntggtaaaaggaattaaacatcagtacncaagtataataatcggcagaactttggtcacaccaggggacagtaattgtgttacagtacgaattatgaacgctggaaaaatgccagtaaaagtatataaagggtcaaacatcgcggaattggaaatggtcaaaattaatgctttaccaggggatgaaattccaccgaaagattatattccccccgagacaaaatggcatgaaaaattaccgtatttaccgacagaaggaaaaaacagactaccatctcaaagaataaatctgatggggacgagattgagtacaaaatcacaaacggaattaaaaaatattgtggataaacattatgaagcatttgtgggcgatgatggcaaaattgggttatataatggaccaattgtccataaaattgatctagttcccggttctttaccatttcattttcgaccctacagatacccacccgaaacgcagaaagaaattgaaagacaaattaaaataatgttggaccagaatatcataagagagagcgaatccgagttcgcatcccctatcgtaatggtccccaaggcagataaaaaatcttggcgttttgccattgattaccggtcgctaaataaaatgacaaaaaagcgagttttccatttaccgaacattcaagaattgttagacttaatgggctctaaaaaatattacacatcaatggacatgcaaagtggtttcatgcaaattccaatgtccacagaagacatagacaaaacggcatttatttcacaccttggcatttatgaattcataacaatgccatttggtcttactgctgcccccgatacatttcaaagagtgatgaattcacttcggaggcgtctaacagcagcaatgttaatttatctggacgatattataatcggaagcgaaaccgaagagatgcatttaattgacattgaaaactttttaaaattattaaaagaagtgggacttaaattgaaaatggacaaatgccattggggaatggcagaaattcgatatttgggatttttgctaagtgaaagaggcattcggatggacccaagacaagttcaaacggttcaaaattttaagccaccaaaaagtctaacggaacttaagtcattactcggtgcgctcacatattttagacgttttataaaaaattttgcacatattgcccgcccgctacaaactttaacacaggataaattcgagggcaaaattgaagagaattggggaaaggaacaggatgaatcattaaatttattaaaaaatttgctaacatcggcaccagtattacagtcgccgagatttggtaaaccctttacaattgagtgcgacgcgtcaaaaaaagccattggcgcggttttattccaagaaaaaggtcctgttgcatatgcctcgagagcattaaacagacacgagacaaattatccatccattgaaagagaggcactagcattggtatatgctgttaaagagttttccccctatattattggctcaggggtaaccaaaattatt

SEQ ID NO: 20381 - DNA, 871 bp, Heterodera glycines
cagacaaatgggtaaaattttggaaaatgaaaaagaggaaaattcggtaaaaattttgagtacaaaaaatgagggtgaggaaaaccaattggaaataaaaggagcaaatatttctatagaagaagtggtgaaagagcaacgaaaagtgaaagaactcgcacaaatttattacattttgaactcaggaaaaattcccccggaattgaaatggaaaagagtcccaacggattattgtctgataaatggcgcaatatattacaaaaaaggaaaagaaaattcggaacaaccaaaattaatcattccataccagttaagggaaaaattttttcacaatattcatgatgagggacattttggttttgaaaagacatggccagaaataaaaaatcgattttattgggaagaaatgaaaaaggatgtccgattattaaccgagacttgtgaattatgtcaaaaaagaaaaatatacccaggacaagcaaaatcggcaccaagtgttccaattgtgccagccgaagcaccatttcaaagagtacattgtgacctaatgggtccacttaaaaagacgagacttggaaatctatacataattttaacaattgacagtttctctaaatgggtaacggccaaggctataccaaaccaaaaagccgatacagtatctgaggcatttatagaaacggttatccatcagcactcggtaccagaaattgtcattacggaccaaggaagacaattcacatcacaaatttttgcagaactttcaaaaatatatgggtttgaacataaaatgtcaacaccctatcatcagcaatctaatggattagctgaaggctctatgaaaatcctagcaaatattatgtccccaata

SEQ ID NO: 20382 - DNA, 1798 bp, Heterodera glycines
atttaatttttcatatcagttcagtgactttctcagcaccctgaactaggaatgctgcaataatcagaaagcattttggaccggcaaaaactgttaaatataatacctatttaatagaattgacattatttcatataataaacaaatattagaatatttttatagtctggtacagattattttgaaaaaaaagaattcattaaaattactttaaaaaattaaggtgttattgaaaaaaattcgttcaaacacaccacagaaagatcaaaatattgaaatggttaaatgtgaattttaaaatataccataaaatttaattgtattggtaacataaaaagtaagttatatatcagattacgatgtaaaattttaattttaataaattatttcatcgattctcaaggatttttgcggaacataacaaaaaattttcagtctcacatcaatgtttcatgaaattttttgtcgagaacgaaatctgaacatccccgaaacgatgttttgtatcaaattagccctaggaatcgaatatagcaaataattaaacacacaatgaatttaatagcgcaagaattttattttagaattctaaaagatctgcttaagtaatacataaaaagaaatttaaaatttaaacgacaaataaatacaaatacaaatatttctttaaatggttaaaagatttaaccatgtatagataagttgctctgttgtaaccgtattaattatttaaacgaaaattaccgaataaaatgaaattgataacacaattttatcaacaaaaaaaacaggcagccaataaagaaaaatttatgtaaataaattaatttaaaatatactcgaaaatttattaaatgttatataagcaaactaataaaaatacaataagttaactaaaaataacaaacaaaaatttcagcaataaaattaaatacgatcatatgcattaattcttaaatattatgattttccttagtcctcattgtaaaaacgcaaaaaagtcttaaaaatccgaaaaagtaaaaaaattcaaaaaattatcggtaaaatgaataaagattacggagcatgataaaaacgaaattgtcgtctttcttagcctaacgaaaagagcggttttcttgtcatgaaagttagaaacgaagaaattaaattaaattttactattgctaaaattaatcgcaaaaaattaattaaaactaataataaaagaaaatcattagattacattaaagcaattacaaaagaatcttcaagaagatagggagaacatatcgtcatttatttacgaaaattaaaataaaattgataacacaattttatcaaaaaaaaaaaacaggcagccgacaaagaaaaatttatgtaaataaattcaattccatctaagtgtattcagtcaagttcaaagaataaacatcaacatttatttaggcttattttgaaccggaactttaatggaacaaattgtttaaaataacattttaaaattcaaacaatttattcaacaaaatcaatttgattaaaaaattaactcgaaaaaattagcttaatacagatacgtgtaggtgtgtgatcgtctattccatttaaatttttatttattatttctttttttaatataaatcgtgtataatcgcgaattcctgttagtagtatatggtgtcaaaaccgcccgggtaccataaggacccctccaaaatcccgagcctattgaaggggtattttcctttgaagatgccgcccgatcacattcccgagcctactgaaggggtgtttttcctttgaagttgccgcccgc

SEQ ID NO: 20383 - DNA, 1461 bp, Heterodera glycines
caatcacaggtcaatcccgtcatatgaaaatcaacctttgtcgccgtcgcatccgcaagatcccctgctgcaattttctcaaacgcataattcgcatccagaccaaactcaccaagcggaacagcaaaatttgccttctcagttttcaacaaatgaaagctccccaaaacaaccgattcaacctcaacagaatatcccattgcaacaaacgcctccgtctcctccgcctacacaacagtccattaaaccagggacaattccagccgaacaaaacgacaaccgagaacctgtatcatctgtggattcagctactacaacatcacaattggataagacaacacagccgattgagatggcggttgctggtcatgacaacgcggaaggaacgaacaaaaaatctgaagaggcactgcaagcggaaaaaagagatgaccttcagcaaataaatgtcaccgaatcgcgcagtcagccgcaagaaaagcaattgcccatttcccgggacgctgtgcccgcgcagcaatcgattgggaccggaactccgagtgaacagtcaattacatcgcaacagagagaaacaacccccgacgaaagggagcaaaaaagtgcacaaatagtgagagaaggagttttggacgaaacccaaaaaaggaatgagttggaaaggggaaaaagcagcgaagtggcagaacagcaacaaaatgagcaggtaaaaaaatctatgacactgatctcatgtcattccttgaaactagagtgccacgggaccgggaatttttgccaaaaccgggaccgggacctgagaagtcgggaccgggacttcgatttttttttcgggaccgggaccgcaagaaaaaccgggacctcggatgaccgggaattcccggcccggtcccgtggcactctacttgaaacaaataaccgatattgcactcaaattgtcatccacgaaataataaaaaaacaatgtatatattataacagtgtggcatgtttttttttcaaaataaggacaaacgaggctaaaactaagatttggaccccaaaaataagattttctaaaactaatagtagcgcgagggaaacgcaataaaaccatgaaaaatcgacttaaaacaatattttattagcgcaaaaacaattgaaattgattatcaaaagtatttttcccatccgccgatttcctccaacaatttgtgattggaaatgagcatttggtacatttgtgggcaagaaagatcaaaattggctttgaaaaatattgaaatgaattttaaaaattaataaaaatgttttttgcggcgctctttttccaaaaaaaaattgacagttaatgttaaagtttaaggcttgttagtgcctattttccatttttatagcctattttttggggtagggtcgtttggcgccaagccaaaaattaaaaagtaaaatggaataaatttcaaaattttacaaaaaaaa

SEQ ID NO: 20384 - DNA, 1981 bp, Heterodera glycines
aaaaaggcgaatgcccttattcgagatgcatccgatgagctcttttgtgccttgtcgaaatctgcctaaacattctaaagggccgagtccctttgcgtccccggcatttgaataagctgaaagctcatgcacaggtgcttcgtcgtctcgtccgcacacgctgctcgcgctctgccaaaaaggttttgctacaacacggagatggcctcccagctattgtggggctcattgcgtcaattgctctcccgcttattgctgatgtcattgaaaaatataaatagtttccaaaaaattaaaaacaagaaaaaatgcagcatacaaagcgctatttgctagtccccgaagagatttatcagagtttggcagcaccgccaccatctgacggaacaccaattgggctggtccgtacccgaattaaacaaataaaaaatgatgacgccataaatgaggcggaaagggcagtcaaatatgagcaggaagttaagcgtctcaacaagctcacaaaggacgaagatgaacgtcccgtgggtgttaaattagaaaatttgagtgatgtggttgacgccatgccaaaaccagtcaacgttacaaggccaattgttgtttctacgcgtcgccatctcaaggttgggcgtgcgcgaaaagaaaatgttgaacaattagaagatactgatgatgatgatgattatcaaaacccacggtcgtcaagtgcaaataaacgacaacccacacaaacggaaatcttaaaattaatttataaaaacgcccaatctctaggggtgtcggaggaagggcaagttttgagagccggtgggcgtccatttataaccagcagtgttgatgacattgttagtcacctgttgaacaaggacaagcgtggccaaaataaagagccaacggcattcaaagaatttgttgaaagggcaaggcagaatccgctcttgagtaggcatttatttcccgaaggccaatccggcaaaggaatttataaaaacaccccacttaagtttaagccatcattatggatttgaaaaagcttcgtttgctcgagtttttgtacaaggacctaagttcgcctgtcgcattcacgagcgttgaaccgctgctgagagaggcgcggaaaagtcaaccaaaaatcaatcgaaacgatgtccaaaattatttgaccagccaacgtacatacacactgcatcgccaggcgaagcggcgctaccgccgattgccaacattggcgcccggcttgcatactgaatggcaggccgatttagctatttttgaccgacttggtaaacaaaatcgtggcttcaagtacttattagtctgtattgatacccttagtcgacaggtgtttgttgagcccgtaaagaccaagacgagcgctaacatgatcattgcctttgatcgtatattcaaaagatcaaaatatatcccgtggaaggtgttaacagatcagggaaaggaattcactgcccgggcagtacagcagttcttccgcacaaaagacgttgaacacttttgtatgctcatttctccccaatttcatgccggaatggcagaacgtgcgaatcgtagcatcaaagagcgcctttaccgctacttcacggagcgcaacacgtacaaatggattgatgttgtgcaagacattgtttgcgcaattaaccactcgacaaattcgagcattggaatgcgcccagtagacgtgaactttaaaaacgcagaagcattgcgacaaaaattacatgatgcagctgaaaatgttgtacgacgcaagccaaaataccgtgtgggagatcgcgtgcgcattgaaaagtacaagcacgtgttccaaaagggttacctcccacgcttcaccaatgaacctttcacggtggcagaggtacactctgagcgttcgccagttgtttatcggttacgtgatgacaataatgaaattattagtggttggttctatagaagggatttatgcaaaacgctagaagac

SEQ ID NO: 20385 - DNA, 2533 bp, Heterodera glycines
  misc_feature (133)..(133): n is a, c, g, or t
  misc_feature (1305)..(1305): n is a, c, g, or t
  misc_feature (1374)..(1374): n is a, c, g, or t
aatacacctatttaattgttttcaaatgggtccccttcgcttacgaccataccacgtgaaaagcacgccatcccggtccgatctggcaagttaagcaacgttgggccttcttagtacttggaacggagacgtnctgggaatcgaaggtgttgtaagcttttttcttcttttttcatttttatattgtaaagaaaaagctttttatttttttttgttaaaatttatctgcttaacattataaattaaggctaaaaaattaaaatttgaattaaacaacgaatattatctctccatttttcgagtttttgaaccggttcaaaaaccagtttttttttgttaaagagttttgggtgacgccgccgggaaaatttaggaattttttaagagattttcacataaaaataccaattcaatcatacattgtcgaatggtggaatgggaaaaccaagtatggtgaccaattttgttctttcgtaatttaaaggacacctgattgtaggatttattcaaattatgtacattaaatttttaaataaattccgactgcgtctgtcataattgccttacacatcaataaattttaatgaaaatatttacaatcacaaattcattcattgaaacaataatttttaattaaatgaattaagttcacaaagtttaactctgatgtttgtttgctaaccaacagaacattttaatccagtaatttcttcaatccacgcgccatccaaaagtgaataaatgcttgaatgacctaaaaatgaatttacaaacacataaactttgctaattataaaatttaaatttaataaaaatttacaacataattttatttgagggactgaaattacaatattaattaatatgcttaaaaaatagaatagaatattttgtgagattaattgaactcaatcagacaactttttaaaataaaaatggctaatgaaaatttacttaataaataaattagtggaatccattctttcattaataattcacttatttttggaccgaatttttgatttttaaagtcttatcagatttgaaaattcatcagcatttacccctttttgcccaccaatcgcataagccagccgaaagcactccaacttgaacaaagtgtgtgccattgctggccaacagagctccgccgctatcaccctaaatttggatttttcggtttttactaaaaaatgatttttttatttgaatttttgctattatacttttaagtaaatttatttttttaaatttttatcttttgcgctgcagcgcccttgacacaaatattgttcgaatgtctanaggcagaatggcactctgctagctgaacgaatcggcccataagcattgttgcgccatgtcctttctctntgcaatcatcttaatgacaataattaattcattagagcattaaggtttcttcgacttttaaaaaaattaaaaagataaacatttttacaattaataattaataaacatttcatttctgattttttgggttttaaccttcttcttgtccccatcccgaaacaaatgcttttccggcacggaaatcatttgcgtctccacaatggatgcatacgggataaattggcccactgaggacgcaattaagctaaaaagtaatcataaattattaaattttatggactatagttgtttattgtatagaatgaagtagtctgtatttccggccccaatccaagttttttgacattacattttttagttgttattggtattatatttaaatttaaaattttttacctatgattgtatcttaattgctttgcaatattcaaccgaatttaaaaagtattaacccgaacccaatcattgttttttgccaccttaattatggcctggtcgtattgcgcatgtccaatccgttttgggtcgggcctatagcttggatgaatgaacacattgaaattgtttcttcgttgatgggctgttgaaagagcgccattagcattattgaacatgtcatctgcggagctcgaattatagcctaaaattaatgttcgtaggcatttttacatttttggctataaaaattgcgatgtgactgaacaaattcatgggcgacatttttaaaaaaaaattaattttaatcaaataaaaagaaaaaaaggatttaaaatatctaaaaacttaaggcgtttcggtcttttgtcgaagttgaaatattgtttaagcttctcatagttcaatattctccaattttttttttaatacacctatttaattgttttcaaatgggtcccctttgcttacgaccataccacgttgaaagcacgccatcccgtccgatctggcaagttaagcaacgtttggccttcttagtacttggaacggagacgtcctgggaatcgaaggtgttgtaagcttttttcttcttttttcatttttataataaaaattttataattattttatattttacagactttttttatttaatattttcatatgatagaaatatgtatttttagttttaattaatttttacagttgggcaaagggtttg

SEQ ID NO: 20386 - DNA, 2465 bp, Heterodera glycines
atggaaactggcaaaaggaaagttcatgctagcgacatatttgtgcgaaggtaaaaatgaaaataattttaaattttgtgaaataaaatttttaagacgactgagaccgactgttccataaccaacagaaagttgcgcgcttgggagatgaccgttgggagggaggggggtgtggggatgagccggctgaaacatattagagggtgatgacaggcacaagaaagaccatattgttcattttttgccgtttacttaactcgaactgaaatgttagagaaatgggcggccaaagtaaaataattaaatttaattatttttagtgattatcattttagcacttttcgccttatccgttcgacacaacttcgtcgttttcgccattcgttctgcgtgaatcgttcgatttgctgaagcagcaagaaaagtgcataacgtcatggccgatcggattctgcgccacggcaatgtagagatgcagttgtgcaaactgctctcgcatcgttaaaacggactatttcgtcatcgtcatcatcatcggcatccccaccacctgaggaatcattgcccgcagcatcgtcgccaccatcaaaaaagcggaaattattgtccacttcggtaccaaaaggcttatcggaagtggacagaggtactgtaatgcttatttattattattatttataataaacatttgttcattttttaaagattgttcatatagatgccgcctctttgacaattgccgcattcaggcagatgaaacagctgctttccgaatggagatgggagaacgattggatcagaaatggacttcgctggtggaaaaagagcgacaaagggcacagcggatcgcaacacaaagttctgcggtgattggtcagctgatggaggcaaaggtaacgaagagaaagaaaataaaaaagagggggaggaggagaaaaaaataattaaaagcggtcattgtcgatgtgtttgagtaagggtccagttacgtatggggttacgaaatgtggtcactttttttgctgtccccaatgctcagtcccgataattgccagtgatgaacccaaatgtttgatttgttcgagaatgtcacccaattggaatatttaggatcttaataaacaaatgaaaaatttcagatttaaaaattttgaaatatgatcccaaaaaaccattgatctcagatatacccaaatgcttatgtatgcttcaaaacttttcgctttgtaatgcgaaataatctttaataaattaacaccaaattcatttttatagtacccaaatctttgaatcaatatatttttattcaaattcaatgtatttgatttcgctaaccttttattttaattttcaccttctgtttgctattcaaatgtataacaattaatcaaatattgtttaataacttcattaatttaacactaatattgctctacacggtttaattatttcaattaaaaggatgttagaaaagtatatggatatgggggggggggcgtacaaaggatatgcgagaaaaagtggtagcaaaattatgtaaaaaatttattttgaaaaattaaagtgtttgtaatataaaaaaaaaaatgtgaacaatcaaatttaaatttgaaattcaaaaaaaatttatcttttaaagaaaaaatttccataatacatctcttctttgtacatcctcgatgccattttttgtttgttcgttctggtacgtgtctgaaaatgaataaatgttatttttaaaattatatttttaattaaactctagattttattaagctttatttttaatggagtgcatgagcactctacctttttttaattttttttaatttaggagtgcgtgagcactctagtagtgacccgtgtacttttgttacaatttttggcgctaaattcaaatttgaattttcgcgtcgatactcggtgggtggagggacgcttgctggggacgtggattgtgccatagggagaggagggattgtaaatcaattaaattgagtaaagacagaaacgggtttattcctcggcatataaaaatattaacatttaattaattaaatttttatttagcattagaatgattatgttttttcactttgtcctcttcattgtctactcggcaaaaacgcattgtgtcaaacaggtttatacattttgtattaaaatatgcaaaaagggggtgtgataaagaaaattaaatatggatttgttttactgaccctgtctaaatcgggtttcccttttcaagatggacctgaacacactgcgcatggacatgatggaattggccagcagtgccggggacgagggcaccgtcggcaaagccaacgcactattggaacgtgcgggcgacaaattggacctgtccatggagcacatcgtaatattaaagcgccgggtaccgctcaacaaccacgtgcaaagggtcattactgactgaccttaaattggctttttggcccttt

SEQ ID NO: 20387 - DNA, 1723 bp, Heterodera glycines
  misc_feature (1584)..(1584): n is a, c, g, or t
  misc_feature (1620)..(1620): n is a, c, g, or t
  misc_feature (1688)..(1689): n is a, c, g, or t
gggtgcgttgtcctcctccaggggcgccaaccatttggtgcagctgtgcctgaggtgaacgtaaagacgaggcgccgctgcgagtggttgtgaccggcgaattgtcagatcacatggcaccacttccgggcgtcccgggggttcggaattgctgatgatgggacggcaaatgcatctcagtgggcaggggatgggcagggttttgtgcagcaaccgccatctgggactggtgctgtgtgatattgtgtcatctaaaaagtaaataatttctcaagctcttaatcaatgctttacaaattcaaaacatcgccaggcttgggctaaatctatcaagaaaacaatcctattttatattttcgacacctacaaacccttcttttcatatgttattttttttaattttaataggtcttcttttggctgtgagcaaaaatcgttcgggtaaaaaagtgaaacacaaggtcttttggtgtcgatcatttttacattttgctgttgcggcgatgtgccccacatgcccggcggggacatgtaatgcatggcagactgcacggcacccaaatgcggatattgttgcggtgacggttgtggaggcgtgctttgttgattagcgtaatgtccaccgagtgaattgccatgcggaggcgaattgaacatgttggattggttactttgttgcgattgattgtggttggcataatgctgctgctgatggtactacaatcggacaaactcacaaaatacaatgattggaggatgttcacctgtgccacgtgctgttggtaattctgttgcggtgctccgatgagtgccggcgaagtgagcggcaccattccctgctgttgcatggccatttgcctttgctggaagaacatctgctgctgttgtcgttgctgaatttgcaccagcgctgcttcctgctgcactcgcaactgtttctgctgctgttctcgttccttctcctccttacaatttgcaaaataattaacaaccatttaaatacctaaaaccgcctaccttttgttgctgctttttcgaaattcgtttccgcttttttggaggttcttccgcttcggttgcatggtggttcgctttcgctgagatcgtggcagccgattgctgctgctgcgtttgcattgcgtacggcggaggcattccacaggcggaagccattggcatcccatgaggagaagcagagggaccaccactgggcgtcccatggggtctgatctgctgatgcgccaattgcgattgcagcataaacgaagggtggggaggctgataagcggcaccgacaattgctgactgatgaggattcatttgtccagaaattgccgaagttccgccaggcccgaaaataaatgcattttgttgctgctgctgttgttggatttgttgaaccctttgctgatttatttgttgttggtacaaatgctaaaagagaaagtaacagcaaaatgcaaatggagaccgaacacctgttggtactgccgttgttgcggtgttaaaaccggttgactagacgactgttgcagcggagcattgcccacaattctttgctgagttggcagtgagttttgttgngctgagaccgaattctgttggttctgagactgatcncggtgggacgttgctgctgaacataatgggaaatagaaaataatcatttacatcataccaacctcaanncagtcacgagcagcggactgttttccgcacgcta

SEQ ID NO: 20388 - DNA, 1045 bp, Heterodera glycines
atgtgatgattggccaatggtgatttaagaaatgtgtaaggttggctgatctcagcgtctggccctgagttgttttggttgtccaaattgtgtcccggtatgaataaacagaccttgatctctacttccagatggtattatagatggtcggttgttctgggctgaagggcaaggctgcgactggtggttcgtgtggtggttatctgactctgtttgtccgtagctgctcaaatggcgactgttgttgcagttactgctttctgatgttgttactgatgttcttttgtcgagccaattgttgttgcctttcactgtctcatcgggcaaatgttggacaaaatgggcggaatgtgtcgggaagggactgtgggggaaatggttgttcacttccaaattcacaagcgaagaaggtctgcagaagaaaaactaaaagattcttattgttttaggcgattttatgaaaaacacgtatgagataataaaaataactgtatgggttgtgggacccctgtatgttagcaatatgcaattggaccaacaaaggaattataggacactgccaattatttgttgtttttttggaaaacgaaccttgctgcgaaatgcaccctctgggccatccttctcagaattgactgtcaatggccccggtgttgcttgtctgttatttgttgtccctgccctcgtgcttttgctctcacttgtctcacaacctccaacaaatttctgaacagctttgtgtctgttgttatttgtgcgatgttgttgttgcgaaaaaaaatgttgtttttgctggagctgtttttgctgatccgctgaggaggtgttaaaagctccgctcatgcggcattcagtcgatttttctgagtgccgtttacgtttgtactgttttaatgtgtcgttgaatgcttttttgaaggttaatcgaaaaaggcaaataatgggactttatttcacctctcagaaaatttaatcgctataaagtaacaacagcagtagttgccagagagcacaaatttgtttaaagctaacagctggaccacat

SEQ ID NO: 20389 - DNA, 780 bp, Heterodera glycines
cgtgccatcaatcatcattcatttcgataaacaccttcactttgctgggcattaatgagtttgaaatctatcagggaaacagcactgacactttgcactcaaattatgtgtacaagtgagtgattgggcgggaattggttgtactgctcgagaatgggcatcttcttgacgagactctcgagctttgagaaaaacaaattagtggaaacaagggatttagaacaaatgaatggctttattgaattaaagagtccaaaacgggtgcaattttcttaatggtcagaacattactgctgctggcaaaaccttttcaattttcagatattctttgccatttgaacgtgtccatgacaaagtgagaagaatgggctgtggagggcgggggcagtgccgaaatgtgaaacaattcttaaacacgttttaggttggctggaccatatttttccaacggcattggcaccattccatcacgggtccgttcacttttttgcactcacatcacgcatttaattaggctccctattcttgacgccattgttttgtcttgccccattttatgatagactattctcggtctcccacttggctcttctctcacatttcaatctcgatatctattctcgactctcgagcagtttcatttatgttcctcctcagtttccgtcctttactacgtatttgttccgccttgtccagcatctgatgcgcgatcggcctcccttttctttgcgttctccgcttcttctttggaacgcgtcgttggcactgttcagctttgtc

SEQ ID NO: 20390 - DNA, 1398 bp, Heterodera glycines
cgcttattttcctgcactattaccatcatgtggctgtgctcgtttacacggtccattcgggtgggattttatttatctgattaatttataaaggttttttaattttgaggcactgaacacactgcgccaggtcaagcgttcatttcgtaagtgaataaaattaattggttaattaattaattaatggatgggaaaattaggatagaaaatggaagagaagtcatttagtgaaaatgcattgagatgttggcatttagcaattcaaattataataggaacatctaaaactgattttcaaattcaaaagtgggaaaaagggctgaccaaatacggaatttcacataatccgagggataccattccatacgggatacggtaaaacggaaagtatccagccaaggttctgatcagttacgatgagatagatctcttctgtcccatcatgtctttgtcggggtctccctctctctcgctctctcctctctctctctcctctctctctctctctctctctctctctcctctctctcctctctctctctctctctctctcctctctctcttctctctctcttgctctctcttgctctctcactctctttcgctcgcgctctttctctctctttttttcgtgttttcttcatttttttcccacaccttcacttttttcttttttttataccaacttttttctctttctcccccacccctcccctcgcactctcaatttttttctttctatgttttatctctttctttctcctttcctcctacctctttcattatcaatattttcccatttttaatcattttctctttccctgtccctctcgctctctatgttttctctctctctctatgtttttctcctttttcttccttcttctccattttatagctctttttttaaccaacttctttcctatctcctctttctctccctctccctctcccctcgctttctcaatttatttatttctatctttatctctttttctttcctttctttatcaccttatcttttcccaccatttttttctctcccctgttttttcctttcttttgttgccaaaaagtcgcggtgcctcttctcacgaagcacgcattagttttcctattaacacgctagctaattagtaggggaattagagactgaaaatttcccgagaccgatacgcaaaaaaacccgagacctttatcgagtcgagaccgtgactctcgaacatcactactaattagcatttcaaattattggaaacaaaaaaaaaacacttcctccccctttttttggcatttacatagttgcctttcgcactttcaatgtttgaaaagcgtgtgtgccagccatatttacctccccgttgcccaacagttacacatatttttccccctcgagcg

SEQ ID NO: 20391 - DNA, 2188 bp, Heterodera glycines
  misc_feature (1094)..(1094): n is a, c, g, or t
cgagaccgaaacggtataccgaaaatttttcttcggctttttcggttttttaaccgaaaccgaccgaccgacaaatttttgagtttttcggtttttttcggtttgggtttttttcggtttttataccgaaaccgaccgaccgaccctcttgtccggtctctacttatatccaggcaacgtttcgtcggcgacgttacggtgacgaaatgacagcggcgacaacgttttggtgtgtacccgtttttttggggcacatattttatttcctaaaatagagcccccggggctttatttttcaaaaaaaacctatttataagcattttccgaatcatagcttggaatattcccttgtaagaagtggaacgaattgcttgttctcttataactgaaatttatttttctctaatcatagttggaatatcgatttgtttttgactcgttcttttttcaatatcctcgccattctaagagtttaggccccatacacaaatttttttaaatttcagaataaaagaagtcaactataggttttcagcagcatccgtttcgactcatttcgaacccctaatcctagttcgaacaaaaagtcaaaatttcattttaaacgaaattcatatttattgcccaaatcaattcgaatgcaccaaattcatagcgaatgaaaaggaaaattcgtaatactgccgatgcccccccccctttttgaaaaaagttttttctgttctaaaaagtcgtgaaaacacgttttatggggtttttagggccgctgatcacgaatctgacattcattttgaccaatttcgaatcccggacccgaattcgaacaaaaatcgaaaattcaaaatttttgaaattcttacttttggtcctaaattgatctaaataagctaaatttagtcaaaaaccattgaaacatcaaaaatggtcattgtgtacaggcacgaacataaaagtaaattttgaattttcgatttttgtaccggaaaattgttcgaattcgggttagggttcgaaatgggccgaaacggatcttgattcgtgatcagcgacagtacagaaattttggaattctaataatatttcacgagtcttanaaatatgtttcttggcgatttaagaaacttctgaagaattacaaatatgacaacgatttagttattccgatcacccaccgtacccggtttcgaacaaaccgtaccatctgaactattaacatatatttttaaacaaatggaaaatttgagtctgccgatgccgataggctgataatattaaacattttacagatcaaatacaaattttcatctgctttcaatactttctctcataataatatggcatcgtcttcaaatttgagtccgtccgaagaattgcgtcttcttcgggacagaagcaaagaattggagcaaatgaaaaaggacgggcaaagtgagggaaattgtgccaattcagtcgctgaacagcaaaaggaaatgaaggtggacggaacacaaaacattaattaatgaaaaatgacatatttttattatttcaggaattgcgtaaaaaatttgccaaaatggaaatgcgggaagcaaaacatttgagcaagattgatgaacttgagaaggtgggcttttgcttttgaaacttagcgaatttttagtagcatcaatgttccgggcttgctataatgagataatagcaaaattgaatttgtttattaaagaagagttattaaagtaattcaatattttattttaagatttttgagtgacgtcagagcatcaaaaaacagccaaatttcattattaaaatttttcagataacccatgaagccgagtcggagcagcagaagctgatcgccgatcgaaacgttttgcaggcgaagatggccaaaatggagaagaagcgaaaagaagaaaaggaaaaatacagtaagcgaattgcgagtgaatggttactgtggtttttccattaaattatcgtaattttaataatccctccccctttttaagcagctgcctttgctcaaatcatgcagttacaagcggaaaaaaacaatctccaggacaaaattagcaaaatgaagaagcaacagcatcaacgggtaaattatattaatgaatgaaatatgtgaaagggaggcgaacttaatgagaaacagataaaaagaatagttttttaggtacttccgggttttcatcgc

SEQ ID NO: 20392 - DNA, 2416 bp, Heterodera glycines
  misc_feature (1593)..(1593): n is a, c, g, or t
  misc_feature (1615)..(1615): n is a, c, g, or t
  misc_feature (1676)..(1676): n is a, c, g, or t
ccgacatttgcggaccgacttctgcggaccgacatttgcggaccgacatttgcggaccgacatttgcggaccgacttttgcggaccgacatttgcggaccgacatttgcggaccgacttttgcggaccgacatttgcggaccaacttttgcggaccgacatttgcggaccgacttttgcggaccgacatttgcggaccgacatttgcggaccgacatttgcggaccaacttttgcggaccgacatttgcggaccgacatttgcggaccgacatttgcggaccgacatttgcggaccgacatttgcggaccgacatttgcggaccgacttttgcggaccgacatttgcggaccgacttttgcggaccgacatttgcggaccgacttttgcggaccgacttttgcggaccgacttttgcggaccgacatttgcggaccgacatttgcggaccgacatttgcggaccgacatttgcggaccgacatttgcggaccgacatttgcggaccgacatttgcggaccgacatttgcggaccgacatttgcggaccgacatttgcggaccgacatttgcggaccgacatttgcggaccgacatttgcggaccgacatttgcggaccgacttttgcggaccgacatttgcggaccgacttttggggtcataatttctggatttaattttcaaaaaaaaaattttttcttaaattggatgatcatctgaatattgaattttatatgtgattttgcggagttaagcaagttaatgcgaatgaaaatatgaaaaacgacatttgcggaccgacttttgcggaccgacatttgcggaccgacattttgcgaccgacatttgcggaccgacttttgcggaccgacatttgcggaccgacttttgcggaccgacttttgcggaccgacatttgaatattgaattttatatgtgatttttcggagttaagcaagttaatgcgaatgaaaatatgaaaaatttataaagtttttccaaaaagttcttttttcaggggtgaataatgatgggtcggtgttcagctgtgtggacggctgaaaatgttcctaatttcatggaaatgtacggtaactaagactgtcgggaactcagcgcccaaaaggattaatgcgcaacaaatcatacggtaggagacatgtctggtcatgatgatgtacggtaatgcttggtacccatgtggtagtgttgtgcacgatgactaatttctgacaaaatgggtttttaattccgaatctgtcccatagatggtcagaaattaaaaaatctaaattttttaaggataagtttttgggaaaatgcttatatgcgcgttaaataggagctttctctgctcattcccagccgattggtggcggctgttactctaaaaaacgaccaaaataaaaactttattatacatattttaaaattcatttcattataataaacagggctgtcaaaaatatgcaaatacatattttttcatggattctacgtagtctaattagtacgaaaaacaccttctttttggtattgcgtataaaagtcgggacttttttttgtcgcatattttggggttttctgcatattncatgtgcatatttgcccatttnttgtacatattttcagattttttgcatatttaccatttttcgttaaacattttccgattgnaatatccccaagtaaaaaaaaattatttatactttaaattaaatccaaatctgaatggatgcgcgagtgggtaaatagtgaacttcctgtcgaaaatcttgacaaatttgattgcaaaaacaacgggcaaaatttattggaataaaatttttaattaatttgcacccctaaagttttttgtgcatatttggtgtatatttcacgactttatttgcatacgtaatgcaaaaaaaggccttttatgcagacagctcatagacggccaataaaacgttggccgtaaaaaacaaaatccccaatgtttaaaaaaaatttttttttcaattctagagaaatgaataaattaagatttaaaatttacgcattgtgggttgttgaaatcttaaatttaaattgctctaaaagctcaaaagccgtgttggagtgaaagtccgaccttgaacctaaatatttatctcatcaacaaattttaatttgatttaatttttcgaattcattcggaacattttctttaaaatacacagctattactacattacaactaagaattggtccctactcaaacattcttttcaatttgggtcgtgttttcattttcttacgtcatttctcttttcacgaggccattgatggcgaacacccgacgcatgtgaattctgaatattttttttaatgaaggttaattaaagggtgccgagcccttataaaaaaagccatcaaaaaagtgcgttattaaaaaa

SEQ ID NO: 20393 - DNA, 774 bp, Heterodera glycines
ttttttgtttgcttacctatgcattgttcatttataaaagttagaattttcaaaaaaaaatttggaaatttccaaaaatttacagttttttcgctaccctacccgctccatgtgctgctcagtgaagcgttcattgtcctcttgtttggcccgattgaggcattccgaatttcttcgggttgttttattggaggggtagcggaataatttggcgactgaaatttgcaaaaaaattttaaaaaatggaaaaaccgaaaattcgaaaaatatttaaaaccaataagcgttggaatattttcagggtaagggagtatcccaattaaatttggagtggttctgatcatttttattaagtttatttggcaataaatttttaataaaattgtaattttaaaaaatagaaaaataaatttgaaactttttaaaaaaataatcagcaaaatttctcgataaaataatatcaaaaataaaataatcttacatataaaataaaacaaattttgtgttcaattttccttgccccttaaaggttaagtaaaatccataaccaaccgggaataaaatctttttcgaaattttaaaaaccttggaatttgttctaaattcaatttttctaattcttagcccaatttttgaaaaattatcgaaaaactagcattttaaaaagaaaattgtttaagctcgcactggaaatttgactgaaacatcgtcagaactcttcttctctcttctgctaggcattgtcgcggttggcaaaaaaaaaatttatttttt

SEQ ID NO: 20394 - DNA, 2079 bp, Heterodera glycines
  misc_feature (92)..(92): n is a, c, g, or t
tgccgcggtggcaaaaaaaaatttttttttctaatcaaactttgttaccctgatttacgataaaaaaaagtcattccgctcattgccgattnttcaaaaaaaaaaaaaatgtcgcctcgaactgaaagtccgtttggatttacaagtttccaaatatgggttatccgagccttttttcaaaaatcatgaaccccgtctagccctaaatttaatccgttttcacaggcggccatttgtgcttatttggcactgctccaaacgtacgttgcttttgttgaacaaattggggccggcatcgaatttgtgctggtgacattggaagcactgctccaactgttcacaatgatcactttttccacgaaccgatcaactgcttctgctgctgtccaagcgcataattcatagtgccgccatttctcaagtccaagaatttctctgggtcgaaaatttttttgcatcgaagatttacatggattgaaaattttcagggactcgaaaaccatgagcccaaaacccaagactgaaaatttcctaaaactcaagacaacagagaactctaacttacgcaaacattccctgatcgagaattttataggactcaaaaacggacttttttagacgaaaaccctaaaccccaaagatagcagagcactctaacttcaaggcctgctgagcccgagtctttgccagcaggaggaaacagaccgagcaacacttaatccacaaaatctcgaaactaaaattttctagacccgagactgatgagatctcataatattgatgttcccaaaacaaacaaaaaccaatataaaatcttttttttcattaaaaatgatatataatggcatcgtgaaagtgttcaattgtgaataataaatgttccttttaattttgctaaaattaaaacaattcttttgctaattacctataaaaatgcttaaaatagctaaagttttctctttcgaatggtatatgcaaattaatcttaactacatatttgatgatgacaatttaaaaaaaaatcagcatagaaatttttttttgctatgacagagcttattcaataccctaatacatcagaggtaaaaaatatacaaaagtatattcgctataaaaaatatatacaaagtgtatatatgaaatatattcgctataaaaaaggtatacaaaaatgtatatacgaaattatattcgcaaaaatgtatatacaaaattatattcactatataaaatgtatacagatgtaaaaataatattccctattcagtgaatatgctcatagctcataggtagtagcattggatgaaagtgcataagcacttgtaaatttttattatccaatgtctatgtcacattttctattcatatgactaaatgccacatcttcttgtttgattttattaataaaataattttttgtgattatataaaataataattgtaaaacttataaagtgcatatgcactttcttatccaagcttttccctttttggaaagtgcaagtaatgacgcgcggcgtttattaagcataataaaaatgccaacatggaaaaatggcacataaatacacagctgaatggtgccttacaatcaccacattcccccaaaaatggcaatgaattttttttattttcctaaaagattttttttttttgcttttatggcagaatttttaattttaaaaattttctcccttatttattaggggtggttttgaaacagtgagttttataggtgcaggcaccaagaaccggcatttcctatagtaatttcgaatttgtaaattatagagcacggaaaaagtcaaaaaatcgcgccaaattcataaaaaaagtcttttttcccgtacatattttttttaatcattttgacagtaagcccgccaattaagaggtttcgtctgaaatctgttccaattatgcaataatattttttgcgcgccattatggtttacaaaacaggaaagtacctaaaaacttaaattttaattttatttttttgtaagattttactgacaacagtgatcgaaaatgtaatttaaaatattttaaaaattcaggtactaactagcctgaatc

SEQ ID NO: 20395 - DNA, 2165 bp, Heterodera glycines
  misc_feature (83)..(83): n is a, c, g, or t
accattctttaacattaaatgaaaaaaacttttaaacattattaaagacacttcattaaataccactaaaaatccttcttaanaattaaaaaaaaaattaaacattaattatagttatttaataaataaaataaattcattttacatttaatgtcaatttaggaatttcatactaatttttcgaggaatttggtaccgcgggaggagggctggctattcattacatatttaatgcctgtctattctcaatttctagattgacgctgatcagttggagcagttcctggactggcccgagaaccgttattggaagtcattgatccatcttccggcaacggtggcggaggaccgacaaaatcaaagtgtaagcagtgccaatgcaaatgccaatgccgttgtgaacagcttctacttcaccacgggttaccatggacagcgtttgcgcaaatgggccgagtaagtgctataggatcaatgatcattgatcactgatctcaagcacattgcgacatccaatcaacaaacagtttcatttacatgagtgcactaatcgtttctcaaccgcctcccctccaaaaattttccaaaagaaaatttcaagaaaatttttcgaaaattcttgaaaaatgtttcagtatttttttgaatttttttttgcaaaaaattactagttcatcatactattgaaaaaccgctagcaaaaagttttcaaaacaaatttttttttaaattttttcttggtttttttctaagattttttcctaaaatttctataaaaaactaagttttactggggaacggcggtggcaagatttttttctttaaaagaatttaggtaatctgctcattttctaagattgattttgatttttttgcttcttattgttagcacaaatgaaatgttgtgggcctttttgtccttgaatttttgggcctgaattgaccctcccgaatttttttttttttgactgttttaaattatcagacgcacccatttgctaatggactggcgttctgttgtggaccgttacgctgatctgaacgcctccgtgttccatgacgagtccattttcctcgacctgatcgacaatatgccaaccgacgcgtggcaatccgggctggccacactgttgtgcatgtacgtgtacagactgagagacttagaaatttaaaaaattgaatttttttatgaaaagccctaaaaatttccggcaaaaatggctaactgaaatggaaaaaaccgtaattttatttattttcattttgttaaattctctgagaaaaaatatatagaaatttaacaatcattgggcacgaaaccaatgattttgttgcctaggtgcttcatttgtgccgtgttcatgggccacgattggcgcaccgtcctcatggccggcaccacaattgggtcgatcattgtcggcacgcttggcacactgagttggattggtgccacaatggacccgatcatgatggtgcgtttaacatagaacaaaatattttagacagacgccaatcagacgccttctgatcactattttttattgtttctcaaaggagcaaccgctgatcaagggtcccgagcacttttttttagatataataagaggaccaattgggctctcgataaaagcatgtatcacttaaatcttcttctataaatatctccgatcaccaaaccaagagcttctccgtttcagtccgatcaatttgaccaacggcactgatcaaactttattgacttgaaaataggactcaataaaattcctattattcattgtgtttattaattgttttttttccaggccgctcttatcatttcgattggcttcagtgtcgacattccggcacatttttcttatcattttcacagtgcaggtcggttggcatttggccgattcttatgataatgaatgcaatcagcttttttccatttttgatcaatcattcgatacattctttataaatttaactctttccatttcttattcatctgatcactttcatttttcagtatttttgatcaaatttttatccattctttataattttagcctgtaattttccatttaactgatcattttcccatgttctgatcaatttaattacagaacatgaattttatatgataaaatctgagccaccccctttttttatctatagat

SEQ ID NO: 20396 - DNA, 1190 bp, Heterodera glycines
  misc_feature (111)..(111): n is a, c, g, or t
  misc_feature (117)..(117): n is a, c, g, or t
ctgccaatttggcgatgtgtgcacgggtggtgtccacgcgtggtgcgcaaaccaccggatgccagaacgatacatcgaattggacgaaaacggcaacaaatttcggccacncaacancaacagcaccagcaacaacaacaccgtgtgccaccactgtccaccatgtgcaacaacgcgacgggcccaagcgccactgcggcgctgggcgcggacgggcgcaagcggcgtattccgtcccgggaacggttgtcccgcgcacgaacgggcgcaattgcgtcactgatggtcaacaccaactgttccatcatgcaaaatgcgatgactgttgaattggtgcacaataccaacaacaaacgatcaacgagggcgaagaaaaatgccgtcgatggaggcggtcaaaaaggggaggaaaaagctgatgatgatggcaacaaaatgccaaaaaatgatgatgatgatgagtggaaacagcgcaaaattgtgctgttgaatggcagtgccacctccacgttggcggagcagcgagacggtaccaagcgcattgctgctgttgatcagcaacagcccaagcgatcgatgatcatgttgggcgaaaatttgaacaaaatggcacaaaagtttgcccgacggcgctcctcactggacgagcaggacacgcgcaaacactcagacagcggtggcgagctgttcaaccgcagcgggctggtcaccaccacactgttgttggccacatcgaagagtttgtgcggtgaggaacagctacggcacgaggagtacaacggtgacaccaccatgtgcaacaacaacagtttctatcacggcattagacaaggggcggtgccgaaaaatgaaaatgttgccaaacggagtgcatcaacgacggggggtggagagcgtacgggctcattgcccatgtctacgtcattttcctcgtcagaggacagcgatttgactgcagagcattcccagtacagtgtacgaatgccgtgcaaattgccggtgaagaaatggcagaaggaaaagcaacaacggggaggacgaggacgaagacggcactccatgcatggcattccgtcaaaaggcagcaacagtgccgaacagcagaaaatggcaccggcggcaacgacagcggaagaggggaaaaggtgtggcaaaaaatgtggcgatgaggaggaggaggggcacaaaat

SEQ ID NO: 20397 - DNA, 3342 bp, Heterodera glycines
  misc_feature (55)..(55): n is a, c, g, or t
gagaggatgaaggagttatggtggtggaaaaagttgccttcataggcaacacagnaacaacaacaacaacaacaacaccacattggggctgatgcaaccagcaacaacaataacaacaacaatacgtccgctgttgttgctcaacatcagcagcaacaacacaaccttgtgcaacaccagcaacatcatcagcagcagaaatatactgcacaacaccagcaacagcaacacatggaacagaatggtgaggaattttgccacccaaaaaatgggcatttgcccttctcctcccccaaataaaaattttatttttaaacgtttttttattttttgtaattttgattaaagacaatttgtacaaaggcgcagttaactcttgacccattaaatggccgatttttaatagaaataagtcgtaaatgaattttcggttcagcgtcagcaccaaacccggtcgttcccacctcgtttggcccatcggtagcgtccaactttggccaaatggcaccgccgctgagtgcgccgccgatcatctccgtcccatcacaaagccagcaacaacaacaacaacacatggtaatgatgatgcagcagcattatgctggtggagctggtggtgttgctgcaccgtcctccgctggaccatacagctccatgtcgtcgtcgtcgtcgtcttcaatgtcacaacaacagcaccagcaacaatacggggtcacttttcttaacaaatttgactaaatttccaaaaaactatgaagcttgttcgcaccgctggaccccccattttactacacatatttttttaaattgacttcaaaattgttcgagtctttgatgagagtgtctcgtaatgatgttgttgcacagatcatgatgagcaacaatcagctgttttatcaccaacaacagcagcaacaacaacagcctcagtaccatcaactgcagcgtccacagcccaacggggacccgtcctacaaggagacattggactgctgggaacagatcaagtcgggcgtggacactttgtacgttttatatggagtatctcgtccaccccccccccccgtatcattctagtgctgttcgagaccgaaaatttcccgagactcgagaccgagaccaaaaaaacccaagacttttctcgagtcgcgaaacagcattaatcgtttcctccaagaaaagtttttttttttaaatttaaacacttagaaaacatgctttgagataaaactataaataattttcagcatgtcgacgagtgatgcggatgctgttgagatggttggtttatcacatattccggggaaaattttaaaaacattttcgaaattattatttatttttgcctaatccaatgaatttaactttaaaaaacaattccaaattttgaaaaaattttcgagtgggaaatgaaatattttctattgtaataaatgcgattgtgaactgcttgtcaggctcgaattgtggaagacctgaagcgcagcgaggaggacaccgccgagttcagtcagcaacggtcacgcgttgatcaacagtcacaatcgcaacaacaacagcaacaacaccagagtcggcaaagcgggggtggtggtggtggtgccaccaactttttcacatttggccctgtgccagcagctgcttccacgtccgccggcaaatcgaatgccatcacaacgccaaaaaatgataataatgccaacgccagcagtacaaattgcttccaaccaccggcggcggcgacaacgtcggtggtggtggaggagcagggcacggtgggacaacaacggcaccagcagcagcagaggaaggcagttgaaaaggcggaggccgataccacgtaggtggacaagaatgattgggtgtggctggcactgtgcttaatgcccgaagaatttctcgagactgaatgctaattttccatcccccaaatttttttaaaaaactgaaatttttctaattttctgagaaattttttctaagaaaaaatcaaaaaaaaaaagaataatttctcacataatttatcttacagtagcaaacaatgttgggtcaaaaaaatgcggtattttttgttttgtcaggttctcaccaccttcccagtccgacgaggccacctcagtcgccgctgctgccaatcgtcgtcgaatgtccatgtcagtgatgcaacagcaacagccgcaacaacaacaacaattcgcacaacgcacatattccgtctcttcagcaaccgccggcggttcatcaaatatggcgagtggaggggagatacaattaattaattaattaattgactactctggtcactaattatgatagagtatggaattatcacgaaacactgattgtgagactttgagaaacgccttgggactaagacccagcgattgagggggaggggctgcacgaaattttcgcttgtcctttccgtttcgtccaatggcaaaattggagtccggcggtgccgttaggcgccatcaggaaattttttttagaaattttgtacagtcagggacacagttggcccgaatcgaaaatcattgattgattggctttgccaatcgtgtttgattttttgcgcctcttttacaggacgagcgtgtacaccaccaacttcaccacccttttggtgtccatgccggcggtgatggcacaatgttaatgagagtagcaggtgcaaatgtgggaagccagcagcagcagcaaatgccaatgccaatgttcaaccaccatcaccagcaacagcagcagcaactgtactcatatggcaacgtccaactcccgcatcacaaccatccgcaacatgttgggacgacgaattatcctccacctccgcccaataatattgctgttggtgatgatcaacatcatcatcatcttcctcatcacaacagatttcaccgtggtgctaaatttaaatcgattatcattaattgctaatgaagtgcgaccaattagttcggggatgcctaacaaggatttgtgcaaacgctctcaaaaatttcagaaatcggaattccaacggccaaataaattcggcaatcggaattctaatgacacaaaaatgccggaaatcggcattccgacacatccctggtgcctaaattattgtatggcactcaagacagaagattcccgtgacccagttggccatcgcccagttgtccctttctgttttacaattacccattttccggtcacgaattgtggcaccatttaaaaaagccattttttaacagttgctggtaatgaccatccgattgcttcgggtgcgcttccgatgccaccattctatcatcatcatcaccagcagcagcagcagcacccacaaccaatggcacaaca

SEQ ID NO: 20398 - DNA, 1589 bp, Heterodera glycines
gattattaaattttccaataaattgcgggaggggatcccgggatattaatcacgcaaatcctgcatttaaaatttgcgggatcgcctgcgggattgtgggattttggaaatttcgaaaaaattttccaataaattgcgggaggtaatcccaggagattagtcacgcaagtcctgcatttaaaacttgcgggatcgcctgcgggattgcgggattttggaaatttcgaaaaagcttttaaattaaatgaaaaattccaaaataaaagcctttgcactcatcaagagcatacgatgaatacgaatttctccatcaccaccaacacaaatattagacagtattacgaaccctagtaccgtacccgccgaatacagaaaatgtcaataatgcccttaactgtggactggaaaacagtcatcatttggctttgagtcaaagcagcacacaatgccaaatttgttaataaaattaattaaaattcaaattatatagataacagagatggaacccgtcagttgggccccagcatttttttttgactataacttttttttctatgtcaaccaaatccaactctattgttggtatcattcgaaaactctttacacgctctattagccttacaaaaaccgaaaaagatttaggatagtatataaaaaatttatgaagaaaaacttcaaaaatttcgactttttaaattttcatgtataacttttttggcaattgtttaaccgcgaagcaatagcatagaaccaagttctaaacatattaagctttcgaatgatacctaaaaatattcgatttggttgacaaagaaaaaagttaaagtccagaaacttgctggggcccaactgacatagacccaacagagattgaattgaaaagttacaagaggatcgagaccaagaaatgacatcataaaacagcaagaaatttcttgttctgaaaattctcgctcagcaggtcccctaattgattggccctaattgaagccataattttgattttcacttttttttttgcttctagctatgaaatgaaatcatttttttaacaaaggaaatgaaaaaagcaatataaaaaacagcaacaatttttaattcaattgaaaacaatgtttacggaggttttcgaaagaaaatggcttttgttgtgcttttttaattaaaaaatggaaggctttaaacatagaaacatttgaatggtaacaaatcattataaatttttgaaaaaaaaaaaattatttctcacttttgctctacagtgaaaaagcaaaaataacaaaaaaatttcattttaaatttcctctttttaattttgtttttattctagtgtttttaaaaatttaaaatgtcgacttcatcgaccctatttttggttgttgttgttttggcatctttgctgatctcggctaacagtgagttgttacatgcagcagagagttggaccagtaaaatcaggggtgtgatcgagaaattttcaaaatcagaacatcaagtccaaaaaatcagattttggggtccaaaatcagaacattttgctaaattgcttaaagatcagtttttttacaattcattctatcaaatatgta

SEQ ID NO: 20399 - DNA, 1021 bp, Heterodera glycines
ggggggactgccccgaaaacaaaaaaatcgattttttcaagtgtcgtttggggtactcaaacaattatgggagcaaaatccaacgcagattaaagtacaggctataggaagctattcggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttgagcca

SEQ ID NO: 20400 - DNA, 1634 bp, Heterodera glycines
  misc_feature (16)..(16): n is a, c, g, or t
tataatgtgtgtatantgtggggggagaccaaggcttaagtaagcagatggaaaaaagggggcggacaacaaaagtatcataaggaaaaagggacggggtttgcagatgtgaaaaaattggccaaggaatacaaagagaaaaagggggagaagggagctgagaaagggcgacggcgaaaatggggcggaatggaaaaacgacaaatagaagcgagaaaacaaaaacgggggagcaaaaggattggtggcaaaaagtgaagggaaaaagagaacagaggaggagaggggtgcaacaaaaagcttaatttgatttcttccgaatttgatcaattcccctcgtcgcattcgcgacattggccggcgcgcgactactcagttctttggcagctggctgcacacttcgggcggaggcggaagcgagaacagagcgcccgtaaggcgcaacaactccgcctgcactgtggacatgtgcgccttcgtctcacggagccagagggccatcggagggggcagctccatgggcgcggcgagttcagcctgggcggtagcgagcagcgccgctgtgttgtgcgtgcgcgaacggaggagccagagggttcggagatgttcggccggcatagaagagtggaattgcagggggtatggggacgggggagatgtcgtgagatcggccgaacggagggaagggggaaagcgcgaaggagggactgaggggggggggaagagcggacagacgctgacgacgacgaagatgatgccgaacgggaaggctttggcggtatcgaacgacggggcggaaaatatgatcggttgcggaagtcgggcggtgggggggggggcattttttcggtgtggggggcgcgggctggaggggacgggacgtggtgagcagggttcgacgaggccggcgcttcgtcttttccaatttgggcaccctcgggtgccgacgagcagacgacggcggccaacttgggtattttgaacgagggcatggggtcaaaaatgcagttgtcctctccgttggcgtcggatggtgctctgacgggctcgtggtggcgtttagacattatgttattatctaaatgagggggaagtgatgacgaacggaatcggtgggaaattgaccgggtggcggagggggtggtcggtaaaacggggagggtgggaacatcggcaatttcggcttgacgcacgtcggttgccaccgtctcggcattcatagccaccggaagagggccgggtgcccaagacgagggaataatggggcaaaaattgacgaaaatggggggggggagggcgatggtgggaaaaaagagatgaggaggcggcggcaagagcatcccgacgatcggatcggcacgggaattcaggcgattggactcgtctccccaaaaaggaccttcgggtcgggattcagactgaatgggaggggggttcgacggcgcagctggttggacggaaagtccctcaaatcgacggaataggggggtcgggccagtctcttccccggacgaggagtcggacgagggggagcgcgagcgagggggcccgtagatggactcaagactctcgacccctaccatttcgagaggaaagtaatcgaagtgggggggagccggccatccagaccggca

SEQ ID NO: 20401 - DNA, 3089 bp, Heterodera glycines
aaattttgagcttatcaattgtctgtgccaatgtgaagtcggtcggcagttttggaagtacacgttctgcatgacgagcgtactcctcatgaccgagctttccaagcagcagtcgcacttgcattgcgtctggaaggtccttgccatccacgtgaatgaacgggccaaaacggtcgaaccatgcttgaaaagttacaattgtggattatatgtgaattggccaagttgactattgatagtcgaataaatagtggaatgattgacggaatttggatttgtttggccattatggagaaggattttaaaaacttcagtgtgattctcgtttaataagagaagatagcgatcaataacaatggtcattatgaacataagaaaaaataattttgtaataaagtgaaaaaattttcaaaagaggggatcttttataaaaacattcccacttttgtgtttattaaagcattttttatatttcttcagctacattgaccattccgtcattgaatttctccgttcaaacaagcacatttgggacagaagaggcaccaatttggaagtgtttgtggatgcaattgatatgggtgttcaaccgatttgggatgtttttatccgtcaaatttggcctatttttgcgacaaacattcgccatttgagctttaccagtggcgatgctttggacaacttgcgcagtcgcacttcgccaacatttctcactgatcttgatcaattgaattcaattgattccggttatctgtgccccgatggaattgctgatgatgggccaaatgcaactgctggccaagcgttgaccaaatggctgcacactccgacaaaaaatgggcaaccgaagcaattacgtttccgtgcttatgtgggtccaccaaatttcgaatgggtcaacaacttcaaagaggtcgtctcgccagaattttcgtcaaattgtttttattttaccaattttgtttagacatttcgccgtgccaccacttctgtcagttacaaaattcaactttatttttgggtggaaccaatgccaattgaaccatttgaattgatgaacgaagtgacgaaagaaaagctgacactgaaacaggagatcgacgaattcgacttaaatgtgtataattggctgttgcaacggtgcccaattggggagacggcgacggcgccagttaagtgggaaaaccgcgaaaatccgagtgccaatttgaacaatgtcagatttgatctgtggagtttcgataaatccattgggtgagcagcaacagcatttgaattttatcgaaaaataaaatatttaattaattttaggccattggcgccaccagcggaagaaaaagaaggagaagaagaagcggatcaaagcaacaaaaatgtcgtctgattaagtgtacgaaaatgaataattaattgtatttgagaaatgatcgatctcaatttgttgtgcttaatctctcagaaaaatcgattcagaaggcaagataaagtatttcgtgcatttgaaccggttttgctgcatatttagaatttttcgaaaattgaattttcgaatttttgttcgagtccgggtcaggggttcgaaatgggccgaaatagatataagaatcgaattcttcgacccagaaaacccataaaacaactttatttcgaaaaaattttgaaaattttctttatatcattgaaaacctaataaaaaaataaaaaatttggcacttttttactttagataatccgatgctttttctggcgctagttgcaaagagggcatttttaaattatcaaaaagtaaaaacaaaaggggggagacccttttggtttgtaaaatggaaaatatatagtcatgaaaattttaacaaagtttgaaccaaaaatgtgaaattcgaaaagtttgaattttcgattttttgttcgaattcgggtccgggattggtcgaaataggtgccgcattcgtgatcagcgaccccgaaaacccatagaatgttaccaaaaaatttgcacacaaaaagcaagcaaataaattgaagttttgtatattcaaacgaacgaatcaacaaaagcatttcctagagagaaaatgagagcatcaaatcaaattccaattagtgagatgggccatttcatcaaatataaattaattaatttccgttgctttgatccgcttcttcgtctgcttcttccgatggtggcgacaatgggctaaaataatttttattttttaaatttcgacaatttcaaaattgatgttgctgctcacccaaagcaattactgccgtgccaaaaaaaaaattggatattgttcaaattggcatccgaatttccgtcgttttcccattggtccgccgccgtctccccaataattgggcatctctccaacagccaatcactgaatagaccagtgccatctttcgtcagtgtcagcttctcatttgtccgttcattcaccaattcaaatggctcaattggcattggtaccaaaaataaattaaatcgaattttgtaactgacagaagtggtggcatggagaaatgcctaaacaaaacaaaaggcaatcaattaattagtagtttaatgaaattatggtcggtcacctccttgaaatagttgatggactttgaaaaatcatcgcaacgcaatcgcttcggttgtccgtctttgctcggcgtgtgtaaccatttggccaacgcctgccaagcagaaattgtatttggcccatcaacagcgatcgcactggaagacagataaccggaatcgattgaattcaattggtcgcaatcagtgagaagtgtcggtgaaaccaaacgaagcaaattgtccaaatgatcgccacagtgaaagccaaaatggcgaatgtttggcgcaaaaattggccaaatttctcgggccaaaacatcccaaatttgatccgtttcgtatgaatacactttcaactcaaatttggtgcccattctgtcccaaatttgtttgttggaacggataaatgcgagcacagaatggtcaatgtacctgaaaagggaaaaaatgaccaaccacattaattggtttctgtataattttttaaattactcaatccgaaggtccttaaagcgga

SEQ ID NO: 20402 - DNA, 1843 bp, Heterodera glycines
aaaattttgaatttgggtgtaatttgttaacagattttcaacaaaaaaggttaaaatgtggttgaaaaatgcgccgtaaagacccctaaagattgaccaaaatttcaattaagggaggtttcaatcagaatatcaaattgattatcatttgtcctccatttttgcttctttcacagtgaaatcgatggccaatttcacgttgtcttcgcctttgtcgtagaaaccgttgcttgggtccatcaattccttgaatgtcttccccctttacacattccccactgggggtgcacaatgtggacgaaacccaaactcgtatactgttgttcgacaaaaaaaaaatagtcataaacttttgtaaaatttgacaaaattaaagtatcattcgatagcccttaattttttccatgagaatcaagaaaaaaaaaattttttgctcaacttttttcaaacaggactaaatttttagttatttttccaaggaaatagatgagaagcttatgagctattgaacgatacccaaaaatgttttttatttttgtcaacgattttgacaaaagttatgacgatttttttttgtcgaaacaatacgaatttggctttttaccgcacaatttttgtgacaaatttttaaatgaaaattagaatggacaattctttgcaaaaaacgtgtgctttgatttttaaaacatttttataaatgctcaaacaaaattttccaaaaattttctcccctcttcttccccctcaaggcttgtacaagggcgtgttggccggcaccgtcaagcagttgccctattccgtgatcacttacattgtgtatgagcagacgcgctacgctatccgcaatatgtcggcttccgaataatattttttcccaattttaccaccacattttttgttttattttaactcaattttcgttatttttctaatttatttgactgtttctttcatccacaaaatctcacatttgctcaaaataatttcatcatcaattttacgaaaaaaccacatcaaattctacaaacatgatgatggtatactgtatttgtgtgattacggtgtccttacaataatctgttgttgttgttgttatttattttaatattttttgctgatatttttttgtgttaatgatctgctcatattttttgaatggcgcttatacgatatcataaatagggcccggatttttagctgcttagaaacggaaaaaatagaaaacaaaattaaatacaaaatttgaaaaaattgcgaaataagccgccctaaaatctccaaaataggtgccgaaaacggaaaaatttgtaaaaatgcatatcaaatttctttgcgttatatattttttcaaatgctcattttcaaggacttcttgaaatcaatgatactttaaagtgagagggttcaatttccaggacgcccttgccattcaaggacgaatccgagccctggctaaaaggacaaaataaattgttaagtgccaaattccctaaattaatatttttaattaaaattgtgcagaaaatgagtttccgtgttttcatccgtgccttaatcatgtgcaatttgcaatggatgaataaaattttatctgcaatgattcatttattaacataacaatgtttgagcgggagcgagcctaagaaatcctggccaagcaattatttctaaacaatttttgccaattataaataaaaaaaattttaaaggaaaattttaaaaaatgatggaaattacagtgaatgatcgtctgggcaaaaaagttcgaattaaatgcaatccgaccgacacaattggggatctgaagaagttggtgtcaactcaagttggaaccaagtaaaaa

SEQ ID NO: 20403 - DNA, 1556 bp, Heterodera glycines
  misc_feature (12)..(12): n is a, c, g, or t
tgaaaaaggccnttaatctccagaattattggaaaccgtgaccggaataattctgtttttcctttgcgacaggaattccttttctgaaaatggtcaggagtgtccagaattcttttccggaaaccttgaccagagttccaattttggaaaatcgtaaaggggttttatgctacttattttgaaaagggccttaaatctccagaattattggaaaccgtgaccggaataattctgtttttcctttgcgacaggaattccttttctgaaaatggtcaggagtgtccagaattcttttccggaaaccttgaccagagttccaattttggaaaatcgtgaccgggtttttgctacttattctgaaaacggccagaaacctccagaattattggaaaccgtgaccggaagaattctgtttttcctttgcgacaggaattccttttctgaaaatggtcaggagtgtccagaattcttttccggaaaccttgaccagagaagggccttaaatctccagaattcttcgaaaccgtgcccggaagaattcttttttcatttgcgatcggaatttttctgaaaatcggcagaagaggcctgaattctgttccggaaaaccttgccgggagattccgattgggaaaatcgtgactgaatttttcactacttattctgaaaacgaccagaaatctcccttattttgaagacggcctgaaacctctagaattatatgaaaccgtgaccggaagaattctgtttttcctttacgatcggaatttttctgaaaatggccaggtgtgtccagaattcttttccgggaaccttgaccagagttcaaattttggaaaatcgtgaccgggttttatgatatttattctgaaaagggccttaaatctccagaattattggaaaccgtgaccggaataattctgtttttcctttgcgacaggaattccttttctgaaaatggtcaggagtgtccagaattcttttccggaaaccttgaccagagttccaattttggaaaatcgtgaccgggtttttgctacttattctgaaaacggccagaaacctccagaattattggaaaccgtgaccggaagaattctgtttttcctttgcgacaggaattccttttctgaaaatggtcaggagtgtccagaattttttccggaaaccttgaccagagttccattttggaaaatcgtaaccgggttttatgctacttattctgaaaagggccttaaatctccagaattcttcgaaaccgtgaccggaagaattcttttttcatttgcgatcggaatttttctgaaaatcggcagaagaggcctgaattctgttccggaaaaccttgccgggagattccgattgggaaaatcgtgactgaatttttcactacttattctgaaaacggccagaaacctccagaattattggaaaccgtgaccggaagaattcttttttcatttgcgatcggaatttttctgaaaatcggcagaagaggcctgaattctgttccggaaaaccttgccgggagattccgattgggaaaatcgtgacag

SEQ ID NO: 20404 - DNA, 2053 bp, Heterodera glycines
aacatttcatgtttataaacacatggtgaaaaagccccacctagatgtcttcacactgattatatttaaaaaagaaaacatgatacaattttcgaactatttttatagagtcattttcctttagttgcacatatatcaatcaaacaaaaaatctctcttaatttgttgtctctccatcacatattaaaaattgtgccatcgcagtttctttaggtcaagaagaagctgtacacatgttgaagagccacctgaaaatatggcaatttgtgagaaaggcttaagaaagtttaataaagtaaaaaaatgggagtgttatggagagtgaaactcccaatttcattcccctcttttcctctccaaaaattcatattcaatgggtaacagttaagtttgctcccttcccgtttcgatttttttttttcaaaagtcataaaatgtttcaaataaaattgtttttttaatttctttaaaaaaatagtcaaaaccgggagttttaactgcacaatgatgtaatattcacgaccaacgaattacacagacttttacagattggagggggggggggggagcaacgaatgtcaaacgaaaaacaaaatgaaattattatgtaaaactgacttcaaaacggtccaaaaatgtgttgtagctttcgtacggaggtattttcagatactgaaaaagaaaaatttatacataattatgcaaaatgaagggtttcccctccccatacgttgtagcaagtcatcgcggacggcagttcgttttcgttgccgacgaatgatgcggttttcttgacgacagtcagcggaggcgacagacccttaaaaccgccgacgggcaaacgaggcgaaccggtgcaaaattggaggaaacggcgacgctaaacagaaaaaaattcaaatgaatgaaaccaaggcaacgagcccaaagaaccagcaaaaaatatcccgcaaatatttaaccaccttctctttgggaaatccgtgcaacatgtcgatcagccatttgatttgctgtgaatcgtatgtatagccgtggtcctggaaaattaaagttatggggaaaaaagtgaaattatgaataataaaaaattaaatttaaaaaaggaatcaaaagcgcaacatggaaaaaaacaataaattggctggcatattaattaagccattagttggtgccaatgagtgaaatcaattgtgtggtttaccgggcggatgcaatgctgcagcaccgatttgctccacactttgtcgtccgcgtcgtcggtgccgcagaacaactcggagatttcgtcgggtgtgaaaatttgaagagattcgctgccaatgatcagctgaaagccgcgccgaagggcctccatttcggcacgaacgccctcaacaagacgccaattaaacacgagctgaaaagagccacttttacaaaaataaaatttgtaaatgtttcaaaaattaaatacgattattattttgtttgaattaaaatgggaaattgaataaattaaaaactacacaaatcacctccataaattgtttgcagtttgccttcgtgacttggacattctttccgcccttgaccagctccagtgtaagatcaccaggatatgtgaaatactggaattaaaaacggatttaaaaaagcacttatttataaacatggtaaactattaaaactacgatggtgtcactcattgtcagaataggtgcactacgtttcccgctcgcattgatttcagttttttttaaattttcgacgtttgaatttttttttaaatgctaaaaaaattttttaggaaatctaaaaacattttatagagggggaaggcgaactgctttcatcaacagaacagcatcgacatcactttttattaacaaacaaaatgagtgtgcccagcaggtgtcactcaccaattgcaattcgtcaaattcttccgcagtttctggttgcgcatatgctacgcaacgagcggtaaacggtgggctgcaggttttctaagtcgactgcgccaagaggattctcacgaccgaccaaacatttaaacaccagcggagacaag

SEQ ID NO: 20405 - DNA, 1679 bp, Heterodera glycines
ggggggggggaaatggaaaattagacaatttttaaaccagattttcattgaaccaaagtttaggcgaattttgcgtcccggcggtggcgataggctaaaatagccaattttgagtttatataccgacatagcaccgccaattgggcgctccccgctgattcttaaaattgagtatgtgtggattttttaatttgttttctattatttttgtgttcaagacgattaacttcgctaaatttggctagtaatttgaaaaaaataataaaattactttttatatttaaaaaaaatttccaagcagtgaaattcgttattgaatattctactgatcatttttaatgtatattcttaaaaaattaaaataataaatcagtataaaatttatgcaataaatttgataaacatcgatttttaaataattaaggaataaaaatgtacattatccgtggcttgctataatattaggaattataattaatttctaatgcttaaatgatgtccgcatggaacgggtcgttttggcgggcacccaaatttttcgtatctctaaaaaggtacggtacttaaatgccgtgtttccaaatgtcacgcctatgtgaaaatctgatcataaatctgagctttgtttttttaaatggtgccgagaaaagggcgtttaataaaaaacaatcaaatgaaaatttctaacaaaaaattatccataaatttgctcaaaagcaacaaatttttaatcccttagagctatagaataatatcaaggtttcttaattttgttggttcgcagaaagttttgaacagattttttgatgatataaattcttttatggctaatggaaaaaattttagtcataaaatgtttttattatttattttcatgatatcattcaatagcactaaatgtttcctatgcctgcaatatttcgacaaattttgtcatgtttcaaaaaagttatgacgaaaaatatttgaaaacctggtgcctggtgtacttttggccataaccttgtttaaacttaccataattttttgaaatttaggtgaaccaatagagaactattagggctatggaattatattaagaattaaattagttgcttttgagcaaagttatgtgatattttatataacgtcctttttgatggttttatacaaggttgccagatgaagcttttcaaaatcatcattacaaatttttgcgtttgagccattttttgaaaaataagtttcggggcccggcgaagacgataggcgccgccggaggggggggggggggaattggaaatttagacaatttttaaacagattttcactgaaacaaagtttaggtgaattttgcgtgccggcggtgacgataggctaaaatagccaattttgagtttatataacgacatagcaccgacaatttggcgctccccgctgaaagttcttaaaattgagtacgtgtggattttttaatttattttctattacttttgtgttaagcacgattaacttcgctaaatttgactagtaatttgaaaaaaataataaaattactttttatatttaaaaaaaaatttccaagcagtgaaattcgttattgaatattctactgatcatttgtaatgtatattcttaacaaatcaaaataataatcagtataaaatttatgcaataaatttgataacatcgatttttaa

SEQ ID NO: 20406 - DNA, 2903 bp, Heterodera glycines
agtctactgacgaattgtccgtcactgatgaattgtccgtctctgatagatattgtcttccgaagattatccactgacggattgtccggataccgtcagtggttggaccgcaatccgggagtttttgcgccagaattacacattccggcatttatggcttgtaaaatggcatttttaggcgaaagcaaaacattcaactggctcctccggtggtggaccatcagtgccggcgccaaacaatcggaagaaaacgcaaaatcaacaacagcaaaaaggaaacaacgaattgggaggagaaggaagagaaaatggggggaaaagagaggaaaagggaggagaaaaaggagcagcagcggaagcagaggaaaaggaaaagaaagttgcagttgaacatcatcaaaaacaacaacaacaaaagcaagaagttcaagcagtacagcagcaacaacaaaagcaagaagttcaagcagtacagcagcaacaacaaaagcaaattttggtgggaatggagatgaagatggataacagcaaaaatggagaaacaagggaagaggtggaaaaggaaggaaatagcattggggaaggaggagagacggaagagaaagagaggaaaaggaaaaattctaagcaaggagggggagaaagaggagagaatgaagcagaaaagaagagagaggaacagcagcaaattgacactttttaaaatattgccggtgctaattgctaacggacgtcgtaaatcccccgtcaaaatcccgaaaattaatgtcacaattttcaagcagagagaaattcatacactcgatagatagcaagccatttttatgcatccgattgatttaccaattaagaggtttttcttcataaattgcatttgatcactgatttaattatgatcagtcggtcattcttctcaattaattcatttcttcttcttctgcggctgatcattgtttttttgttgttttgtccgtcactcatttcgcccttttgtgatgctttgtcccgcttcttcttctttcggtggcggagacaattagaatacctgcaactgccaacacttgagaataggcgaaagctgtttgatctgttcatggcgcataaaattgtttatggccgaacagatctgaaactattttctatttttaatccatcaacacgctttaacacagggttaccctttgtccttatttgtaagatttgtccttattttgagggtccaaatcttacaaattttaaatgtccttatttgtaagatttgtccttatttaagctctttgtccttattttcgtcttattttttggattcagggagaaatttagatttttaatgataatttttgaaagaaatgttttttgaagcgaattaatatgcaaaatcttaacaagattcagttaatattcaaatttttctctcggcggtttcttattctctttaaaaaattggctcaaaatcgtaattttgtcattttttgaacaaaatcgttaagaattcgtattaaaaattacaaaaatttttccagcaacgtctattagagctgtatctgttattatttctaagaaatgttctgatttgggagtgccttattttcatttaaaagaggaaatttctgaaaaatttggctaattcctaacaaaattcattaaaattaaaggcatttaattttgtcccccagcggcgcctatcggcaccgccggccccccaaaactcctattttttttttcttaaaattagcccaagatcgcaaattttggtcattttttggacagaacttgttaaaaaattgcattaaattttcaaaaaatttccccgcggcgcctatcgacaccgccggactctcttccctcatccatacccaaaaaatttaaaaaattaaaattgattttcggaaatgtataaatttctgatttctaagccggaattgcgcagaaaaatagttggcggtgagtaatgcttggttttgttgaataaaaatgcatttaaagttttggaagcgtgttttaaaaaatgtccttatttttgaccctaaaatcttatttttgaccagcgatgttcttatttcgggaaattttcaagggtaaccctgatatacttgatgaaagaatcgtaaaaatcacattttatccaaataatttctgaattttgttcgccttaaattgttgccaattggcgtccgaggggttggacaatgtgccaataggaggacttgagaagctcaaaaaaccaagttttttacaacatttttagtaataactagggctgggaattttagtgactaaaaatctcgaggcgctagtgaaaaagtcaccgtttttgaaaattttttaaacttttttttggtaaattttttttgttttgtttataaagtcatgaaaccaagtgcccgggggttttagaggtcgctgatcacgaatatgacaattatttgggcctattaacaaacttggcgctagttataaagtgacagatttttaattttatcaaaacaaaagggggagtgacttttgttttgcaaaatttttttgagacaaaaatttgtgaatatactttttattcaccataattgtactgttaatgctttaaaatgagagaaaatgggatggacaaaagataataaaaagagaaaggttatttgatttgagtcatttatgcattattcgaattgcctttgattgttcagggcaaaacggtgacccaaaaagacaggcacaaactgctgcaggcgaaagagttgggaaaacggcaaaaatgagataaaaataaaaactttattatataataaatttaaaaaaaagtacaatggcgtcaggctatgtctactacaaatggagaaaattggcgagaagtgatgtcaaaaattgaaaaattaaaaaatttgaaatgacgcgtcccgccgcacatt

SEQ ID NO: 20407 - DNA, 1571 bp, Heterodera glycines
  misc_feature (1538)..(1538): n is a, c, g, or t
aactagcgggtgcgtgaaccgtcggctatttagctgggaaaaagcgcttcgcgctttgggagcttcgctacctagatatgctattgcgttgtgaagagatttggaatttttaaaagattatctgggatttttaggccgcttcgcggcctcagacggtcgcttcgcgcccgtttttaaatttagttgggccttttcggccgcttcgcggcctcagacgggcgcttcgcgcccgtttttaaattttttgggccttttcggccgcttcgcggcatagtacgggcgcttcgcgctcgtttttcaaatgttgttttgctctgacgggcgcttcgcgcccgttttttaaatttgttaagctcagacgggcgcttcgcgcccgtttttaaatttagttgggccttttcggccgcttcgcggcatagtacgggcgcttcgcgcccgtttttcaaatgttgttttgctctgacgggcgcttcgcgcccgttttttaaatttgttgagatcggacgggcgcctcgcgcccgttacaacggtgttagaagaggttcaatagtgatcagaagaggtacaactgtgattaaaagaggtacaaaagtgattagaagaggtacaacagtgattagaagaggtacaaaagtgattaaaagaggtacaacagtgattaaaagaggtacaaaagtgattagaagaggtacaacagtgattagaagaggtacaaaagtgattaaaagaggtacaacagtgattaaaagaggtacaaaagtgattagaaaggtacaacagtgattagaagaggtacaaaagtctaacttgttatgagatgtacaaaaataatttcataattttaaatataattttatagaattaggtttatttaaaaattttaaaaaaacaaaataataaaaaatgtaaaagtttattttttaattaataaacggaataatttattttactttattttgaaatgaattattatgcatccaaatttttaaatctaattttgcttaaaaataaatctatttttcaaaagaaaaattaaatttaattaaaataattttgttaataataataaaacaaaaaataatttctttaattaaaaaaaaaataaatttaaataatttaaaacaaatcttcaaattaattataaacagtgaaaataacccaaaaatgcatagaaaaataatgtaaccgtccgggtccgaacctgccgccaccccccccccctcctcataagggtgcctcagaatccccaatcacacagggattctgaggtcttgacgatgtcaaaagtaaaatctgatcacgtattcgtgatcagcggcccaaataacccctaaagacatatttttggaggattttgtgaaaaaaaatttttcactcaaaaatcctgtccaccccctttggtccataatcccaaaatcggttttatttttgtaacaattcgtaagaaagtgataaaaatgtaaaataaaatttatattataaagaaaaaaattgcggatttttgtagtattttaattttcaaaaatttcttttcaganagggggttatgaatttttttctgaaaaatcgaa

SEQ ID NO: 20408 - DNA, 2688 bp, Heterodera glycines
  misc_feature (1890)..(1890): n is a, c, g, or t
ttactaattaaaaaagaactaaaaaggattttttatttctttctttattgtttttttaaatattttttgtaaaattaaaaaaacaatagtatgaaattcccattattattattattattattattattttacagttagcctaacctttgttttgcagaattattattatttttgcatcttttaacaggtggtagaatttctgaacgacgatttgccagaagtgcgtgctgctgcggtgttcgcactcggctgttttgtgcacaacacgtcgcgcaacaatgagcacgcgacggcggtaaaatccgcttttttcatactgttaccgtaaccagaaatttaagacaaccccacttactgtacctataataaaattaactataggttgaaaatgaagtgtgcgacaaactgtgcgaaaaatgcacctacgacgggtcggtgctggtacgtgccgaactcgctgctgccatccaatggttcgtaaacggcaaaggctgtgccaggggtttatgcactacgagggcgtattaaaagggtgtctaaagaaaattctgtaagcatttgttgttattgttttttttttaaaacgcacatacgttttggatttttaacatatttaaaaaaaatattcgaaacattaaagaaattttcagtttttaaacttttatccaaaatttcgattcaattttttacaaatttttagaaaattgttcacttttacttttgaagtagtaaacttttattgcaagggtccattgaatcgcgccgagactcgccatacattcaataaatttgaaagtaaaattgcttcttctaggttcgtcatcgactttcagtctcgctttgccaccatctgtgccgagttggaccgccgggtggccacccaatcgcccagctcgatgatgatgattggcaacggcacggtgcagcatggccaggaattggtgagtggcaaaaaaatatgccaatttccttttccaaaaagtttttttttggtaggatatcaattaaacgcaattgaaatgctctaagaattggagttgtaattccaaaatcaatccaaaaacaccagcgaaagttacttcttttcgcgagtttggttctcgaaccgttttttaggaaaacgaatcttggcaaaatatatataaaaaaaagtacgacaaaaaagacgattcaatttttttttcttaaattattaattaaaaaaagttcacttggtcataggtttttgtggaaaattgaggcccggaccggtcaatgtttgtctggtcgtggtatttcctggtcccggtttttcctattaattccggttccaattcacttaattttatgcaaagttcaaattattgcaacctcgaaaaaccacttttctttcaaatttccaatctttttcatccctaaataaaatatgcctgaaaaattaaaacccatttgcaatatatcaattttaaatggccatttattcagtccaaagcgatggcagcgatgtgtctgtcgccgacagagtccgaacttttgttgtccgacaccgcctccacagcgtcggcagtaccaccgggagcagaccaccaccaccacaattcccattggcctgcttcatcctcctccgccttctccacgctgccgaggcggaaaatcagtgcccgaagcggtggaggcggcggtgcttttggcaattcaaatcaccacggcttacagccccaccagcagcaaaggcaagcgccaccggcgccgtcgcaagggcgtcgtgcggcaccggcgaacagcagcagtgccagcatttatgccatcttaccacgctcagcgtcctccatcattccgagtaagggggatgctcgtccgagggcttacaattagttttttttttattgaaaattgttaatttttggattntaaaaatgatgaaatccatggagagggtaccaatccaggatttgtgtcgacgccctcaaaaaattccgtcaagcggaaatcggtattcctacggaccttaaaatttcggaaatcggcattccgatattccctggtaccaataagaaaatcggaattttaatcaaaaaaaccttaaaaattaagcggatttgaacattcctgtcctccactgccccaccccctccttgctaaaagttatagttttgttgggagctaaatttctggtctttctcatctgtctatgtacatcattttgaattttatagtgttttttcagatccaactaacatccgtcgacggttcagtcccattcgcaagatgagttccatcctggccggtccgtccacagcgtccgcagcgcccaccagtccgtccggcgaaacggccggtttgaattcgaatagcctcttcaagtatgtaccggcattttcgcaatggaaatatatatataatatgctcatcctattttacgggattgtagcataattatgtgtgccattttttattagtgtccataagcctcccataaattggctcaagaaaaatctgctttagtgacgttcccctctcccatttgttttaaaaaagtttgctcagttttcaaaatttttgaaaaattaatgcattttgggtcaaaatgatcaaaaccagttaggtaattcctgttgaaaatctatgttttacagaatattgaatagatcacaatcagttttttttcacatgcctcgccaaaaatcacaaaacagcaaatttagcttg

SEQ ID NO: 20409 - DNA, 1378 bp, Heterodera glycines
ggtcaaaatattgggcctatgcaaaatattaagaaaattcaataatagggaaaaaattttctacaagggtaaaaatttcaataattttaattcttttttagccaagtccacaatttaaggtcaaaccaaataaaatttacaatattctccagaattttcccttcaaaatgagcatgaaatggttttatttgctctagtattcaccaagttataagctaaaaaaatttcataaaattgtcgatgttgtacgtaaccaacgctttttgaatatgattttttattgccacgaaaacttttattaatgaaaaaataattctgccttctttaaaagaagaaattgaaattaacacacaacatagggaggacttgaacctgggaccccccttttggtgactaactcacagaccactaagacgaaaaatccagcataattgtacttggagcccaaaattgggtcgctgtgttgacaaagtatatccaaaattttaaaaaaaaaattgaaatgcactaattgccttttttggccgttgctcgcctccaattcaaaatctgcaggccttagtctattgcagggctcccatcgtccatcctccgtttccaaggacgggtatgccgattttcaaggacatagtggggaaaattcatgaaatccaaggacatttaaaatttttattatatgcaatgcaaaatggttaatatttattcaaatggcttgtatttttcaccggaatggattttttccaacatttttttgttttcacttatcattttcttcatttacgacgacttttttctgctttaaaaacgctttttttgtggcgcgctttttccaaaaattttgtgggacagagggggggggggcggtgccgacaggcgccgccggggaaaaattttgaaaatttgaatgcaatttgttaacagattttcaccaaaaactgcctaatttttgcgattttaagccatgcaacgactttttttgtttataaaatgggtttttttacggcgcgctttttaaaaaattttttgaggataggagggtccggaaaaatttgtaatttttaatgcgagttgtttacagatttttgtccaaatatgaccaaaatttgcgatttttggctaattttttaagaaaaatagtgacttaatgccataaaatttcaaaaattctcaaaaattacatttttaaatgatataatgccataatttaatcaaaatattgttgaaaattacaaagatttctcaaatttctttgattttttttaaacttttccaaatgctcattttcaaggacgtccttgcatacaaggacattttttattttcaagaaagagggcccaatttcaaggacgtccttgccattcaaggacggatggcaacc

SEQ ID NO: 20410 - DNA, 2288 bp, Heterodera glycines
gaaggaagcactgacagaagcaaatgccaaaagggaagtgccgttactcaaagtgggcttcgttgatgactcggctgtagtctttgctcgtctccggattcgtcccgtaatattccacaagcaccgccttcagttcctcgaccagtctcggcttcatttcgttggtcaccattacgtagtcgggtgccaagcatgtctggccacagttaagccatttgccccaggccaatcgacgcgcggtgatcggaaggtccacgttggagtcgatgaacacgggcccaaagggagagagaaaagtgaaaacaaaggcgggggggggggtgaagcctcacgacggattattcaacgccatcaaatgggaagttgtgaaaatgttattttcaaaattgctatttcccttaaaatatttgacttttcaattaagtggtcctaaaagtcgtgagggttctcacaaaacttgcaattaccgctcaatttcatttgcagttgattattttatcccaattatttgacaatgcctccccttaacatacgattttccgccgagttccaaagtgcagggcgtcaaatgttccgcggccgccctggaaatgtggcgggcgaccagcgctgacccggtgaacacaatgtggtcgaacttttccttcagcaattcgccggtctgttcaacgccgccctgcaccactgccaaataattctgaacggaattggcactgttcagaagaatctttggcattaccccccaaaaaaaattggcacactcacccggtcaaatgccttcgaaataatttcgtcaacggcggcggcggtgttcgacgcgacttcggacggtttcaaaatggcagtattccctgtaaaatgacaaaattttggttgaatttggagcacaaaaaaagaaccagcggctaaaacgtcgaccaaaggcattagcaaagtgttgagggggtaattccatggaccaatgagcaaaacgacgccctaaattggagaaaatcagcgaaagttcttgcgattgtttccgttttcgtcccgattttaagaatcatttcgacttcgactgaccttcggctcgcgaacgatttgcggggagtcgagaagtgtggtgaaagtcttttcgacatttaaaggcgccgtccatcgctgaaaatcccttttctcaaatccctcaaatgtttccttttcccacctccaaattgtcgagtacatattcaatttcaatgatcaccgacgaaatttcgagcggataattcagtttcgcgtcccttttcaggtccttttgcacggcttcgcagagaaattcgctgttgtcgaggattgtcttgcgcagtttcttcagctgctgcctccgatgtgccaattcggcggtttttcccgtccgaaagaattcccgctgagactccacgagcttaatagggaaaaaacatattaaaaagcaaaatgtattgaaacaattacggagtgaaagggggaagtcatcggagagaaaaagcggagaaagcgaacggaattaattgggggagaaggaaaagctgaaaaagtgaaaagcaaagttaggaaattgtgcattagttgatatgacaaaaaagcgaaaagacgaaattcccacatttatccccgaggtttccttccgttgattttttgttttgaattaattcgcctaacgaaaaatgattctcgttttagactctcgcccatttgttactaattaatttgccttttcggttattttttgataaaatgaaaattgattcttttttcttttcttttttctaaaataatatttggaaaacattggaattgaattattagggcttccaattaattatatgcatttttttccacgaaaattttatttttagcttaccgtatatgctctaattatagcccagtctctattaatcccgcagtctccaattatcccccagtctacgaggtgtttttgaaaaataatccctctacatatcataatcccccagtctctaattatccccccttttctgaggaggttgaaaaataatcccccatgggctataattagagcatatacggtagtttgacgcttctaacaataagacgaatttccatatgcatatttcactatttatgtatattttggcatttccaaaaacccattattaaagcggcttcaaatcaggattaatgaattttatgatttatgtgcataaattgtaatccaaagcgctaggaattataatatatttattggtaaaaggttgcattcgatcagcggagcaaaaggggcaccgaagcgaacattcccttcactt

SEQ ID NO: 20411 - DNA, 2135 bp, Heterodera glycines
  misc_feature (609)..(609): n is a, c, g, or t
  misc_feature (928)..(928): n is a, c, g, or t
ttaaataattttgtttcatcatttaatttccaaccgacgcttgaatttatgaattgctatattttacagctttctgttcggtgtattaattaaatttatatttttaagtttgaaatttaattatatttatctttattttcgaatatcacctgcttatttggcttaaagattaatattttaatattcaagccaatttgaatttaaatttatcttattttctcatttacttgaaatcagtaattttaatgaacttttaaattgaatttagagattaataatggcaaattttattattgctttaaatagattaacgttttatttataatttttgctattcttaattagtaattaacaagtaaattatataatttatacaatttaataaacttacttttatgaataccaaaagctccaaacaaaggtaaaaacgtattacttgcttttaaaaaatgtattccactttgtttgtttaaatcttaaacaaacggtgctatgttaatttcatgaatattataatatataatcgagttcgaatttttttatatgcattttttataaaagtattgcttaagtatgtcaatataataaatgtttaaaaaaccaggagtnagtataccccccccccctatgtaccgcagaattctcccccgtcttgtcacagcccccgtcttgtcacagcccccgtcttgtcacagcccccatcttgttacagtgcttttacgctttatcccccaacctgtaccatttgcatttttattacgaggaacattttaaatttcatttaggtttttaataattttattattttttaaattataaatatatagaatgattaaaatatatttgcttgaaaatttctttttattaaattaaatgggatgatcgttatcatgattttcattaatatttatttttttttcctttcganaatattaattatgagaaacaaaaatattattagcataaatagccatatacaatttctgcctcgtgattacgaattaatttgtatttgttatttgacgaaaagagacaccaaaaaattaaaacaaataaaatgaaaattatttaaaaaatatattttaataatttatttctgagtaggggcctgacccgactccaaaaatttgggccatttatttcatatttttatattaatgaaagtaaggcgaattaaatttcattttgttaaatcttcatatacaaattcatttatcctatagctagatttgttggttatttatgtcatttttaattatgtcttctttttggtattcatttttaaattcctttttaaacgattatccctgaagataacatttaactgagtcgctggataggttaaaaagattcaattaattaatttgttttcttaaaaggattactttatttctgtcttgtattttcagtttatgatttagtgccattaattttatgctttttcttagttatataatgtaaactaaatttattgataaatttgtttgatatttataaaaattaaggtaaaaaaatgaggcatgtactcgaccgttcattttcacaagttttcagaacgtagtttttttaattcttttttaaataatttaattttttcatatattttttaaatttaagaaattttttttattttctgagacattaaatttcagtgcataatattaattttataaattttaatcaatttataaatcatcttttaaagtatttgataatgtgaattgtttttaacacttaattttttttatttaaattttattaaagtgtcggcgttgctcttttttgggtccctggccgggaaaatgattcgatcgtttaatattttacagtacaaatcaatcaaaatacgttaaattttccacccttttctctttttatccctttccttttctgtaattattttttcttctttttaacgaaaatttttttatttgttaaatttattaattcttatttataaatggctttatgagtttgagttctcaggatctacgaattttctattatttttttggttcgaaatttcttgctaatataaaattaaaattattatttttttataattttatattattgttcattgaaaataaaaatttggcgatctttttttaagttgttagagtactaatagttca

SEQ ID NO: 20412 - DNA, 2154 bp, Heterodera glycines
  misc_feature (14)..(14): n is a, c, g, or t
  misc_feature (2091)..(2091): n is a, c, g, or t
aaaataagattttnagggtcaaaaaataaggacattttttaaaacacgctgccaaaactttgaatcgcttttttattcaacaaaatcaagcattactcaccgccaactattttctgagcaatttcggcttagaaatgagaaatttatacatttccgaaaatcaattataagattttaacaattttgtcgaaacataagcaattggtaaatttcagtgcatttagaatcaaaaaaacagatttttaacaattttttcggcgcatttttccgaaaaataaatttaatgcaatttgttaacaagttctgtccaaaaaatgaccaaaatttgcgatcttgggctaatttttaagaaaaaataggagttttggggggccggcggtgccgataggcgccgctgggggaaaattttaagaatttttaatgaattttgttagggattagccaaatttttcagaaatttcctcttttaaatgaaaataagacactaccccaatcagaacatttcttagaaataataacagatacagctctaataggcgccgccggaaaaattttttgtaatttttaatgcgatttcttaacgattttgttcaaaaaatgacaaaattacgattttgagccaatttttttaagagaataagaaaccgccgagagaaaaatttgaatatttaactgaatcttgttaagattttgcatattaattcgcttcaaaaaacatttctttcaaaaattatcattaaaatctaaatttctccctgaatccaaaaaataagatgaaaataaggacaaagagcttaaataaggacaaatcttacaaataaggacatttcaaatttggaccctcaaaataaggacaaatcttacaaataaggacatttcaaatttgtaagatttggaccctcaaaataaggacaaatcttacaaataaggacaaagggtaaccctggtattaacagtttttgttgggatgattttttcaagatttgcttgaagaaagacgggtcggcacgtcgatagagtttttatttttaaagaaattttcgccaaaaaagacttttcttgaatttggcaaagagttctctttattaatcaattctaaagtattatctttgtgacacattgggatatttacggacaattttggggaaaaaatagagtttctttgatttttttttattaattagaaaaaattctatatcttttttttcggccgacatttttaaatttctccagccattcccgacaaattttattggggaatttcctccctgaattttaaaaaaatattttttttcaagcaattttttttcaaaatccaagactcaatagactgcgttttgaaaaactcgaaacttttctcaaagtcgagactctcaaaacgaatttaaagattctttcatttttttttgaaaaatttcgtcagctattttctcaatgtttttgttataatatgcaacattaatgccaaacattgtcatagattttttatttgcatcataattttgtattgcgcataaactgcagcatttacgtcatcaaaatttgtgaatattattataatttatgtacatttcctcccatagacgtaagcaaaagcctatcaatattaattatccaattttaatatgccaattgattaatttaatagcgacggataatggttacttaaataatcaggcagtgtataatttttataaatttcatttcatttttttctaaaaaaaagtcatcaaaaaatgtttttaatcgctttatttatgctaacattctccttaacatttgatttggtcgtttcttttgccgaaagtgaacaattagtgtattataattacaaccctaatgattattactcaacaagcgggagttccctttccgaactgaaaggtgaaaaaaaggaattttaattattaaataataataaattaatttgttttagatattcttgatagcggggacaatatcaagtgagacatatgacattttattaaactctcgactttgggttaaaaaaaactttttgttttatgcattcagataataaattttatttttagcgtttaggggggaggtagaaaatccataatttcccanaaaaatgctcaaaaaattcaccatttttatttttagctctttgtttgcgtgggctttgaagaa

SEQ ID NO: 20413 - DNA, 2435 bp, Heterodera glycines
  misc_feature (2393)..(2393): n is a, c, g, or t
cgaaaggtagcggcggagaatggcggcacttcgcttctccgcctggaaaaaatgtgcaatcatttcaccattttttgacatttgctcaatggcaatggcacaacataaaactaaaaaaatgtgacgagcaaaaagaaagggagggacaacaaaagacatcgcatgttgctgctgatcatcgacggattccgccagtcacggaaattcgatccgatgaaaacgcaaaacaaacgaagaaaatgatcagaccaaaacactgaaaaggattggaaaattgtgaataagcagtgggaaagaagaatatctggacattcgatttaatttggtgacccatcgccggagggattaagcggagcagaaaatgcggtaaaaagtgcataatgcctttcgctggcactcagtccgcttaagttggcacccaaatttggctcctccgcccatctccatgacgactttgccgcttttccatctgttggcagaaatgaacccaagggcaaatgccgaaggaggaatccattcatttaaagacgatttgccatttgttgcttttgattggccgttcttcgctctctccaacaaaagcgaagtttttatttattatttgaaattccaaatttttttactactttttatttttcaattaattaattattttgacctctcttggaaaatgtccctcagcagctgaacagccagccaacctttgattgtcccgtcccttttcgccatgtccaatttggcaatgtcttccgatgacgagggcggccgaggagagcaaatgtcgctgaaagtggtccttttgggggacaatggcacgggaaagacggcgatttgttgccgttttgcgcaacacgcgtacccacagaaatacatacaggtgaagcagaaaaggcaatttgaattaatttagcaaattggcaaacaaatttcactaagtccggagagaatttggaagaatttggccaattaacttaattaattagctttaattggcccatttcttggcatagacttccggcgtcgacttttactcccgccgcatcgcaatgcctcgcaatgtgtcggtgcttcttcaggtgccctttttgtgcccttcgatcactgactgaccaatgctgattgaccgccactaatttcagctttgggacgtcggcggtcacaatttgacttctccggcaatgctcaacacttacattttcggtgcacaagtgagaagggatggacaatgttaggttgtcatatacacttccgacaacttaggccgttttgttcgtttacgacgtgaccaactcacaatcatttgaccatttgaccgattgggtgggcgccgcgaagaaaggcggcgctcaaatggaaaaggtaccggcgcggaaatggctaatggaaaaatgccgggggagggggtaattagaattcattttatcatttgatcattgatcagcctttttgcttggcattggtgggcaacaaaacggacagtgaacaccaaagagcggtcaaaatggaccgacacaacaaattcgcggaccaaaacgcactcagtgccttttatgtgtccgccaaaacgggcgattccatcgatttgatgtttaagtgagggaaaagtgaaggaattacaaaaaatgactaattaactgattaattagttaattgattaataaattttaattattttcatattgcctttctctttagaaaaacaacagccgaagtgctgggcattccgttgacaaaggctgaccaggaatggaatgtgaatgttgtacaggcacagatcacaacggtcgatcggagcataaataagcggaaacagcagcagaaggcggaggagccgcggaaagaaaagtacggtaggagaaggggagtggatacggtaggcaaaaaaagttgaattgccgtaattttaattaaagtgtgacttatatgaaatttaaattgattttaaatttatagtaaagtcggaggagaagcgaatggtgcagcagaagcaaaaacggcgactgctaatgaaagcgaaaaaacgatcaaaaaatcgaccgtttgctcattacaataattaaaggacaatatgcaattacttaattacgcaattaaataattaataaaatgccacgaagaacaaaatccgcttttaaagtttctcagacttccaatattaaaattagtgctaaacaacacctaaaaatattttttgataaaatagaatcttctaaaaataatgtatacgtatactgtgaagatgatggggacgttctatttagaataaaagagatcagtgattatggacatctttttggtcaaaagttagaaaaactaagaaatacaaaagaaattttttattttttttgtatttttattctctttggaactaggtattactgtattatacaaantaacattataaaaaaaattcggagctgtcgccttattgtccc

SEQ ID NO: 20414 - DNA, 2714 bp, Heterodera glycines
  misc_feature (19)..(19): n is a, c, g, or t
  misc_feature (1282)..(1282): n is a, c, g, or t
tccattgattcggttttantttggatgatcaacctgcattggttttaatttatcagagtgatcagatgagcccattgattcggatttgtttgggtgatcaatatgcatttgttttgttttgtcagagcgatcagatgagtccattgattcggttttattcggatgatcaatatgcatttgttttaatttatcatagtgatcagatgagcccattgattcggatttgtttgggtgatcaatatgcatttgttttgttgttctgtcagagtgatcagatgagtccattgattcggttttattcggatgatcaatatgcatttgttttaatttatcagagtgatcagatgaattcatagatacggatttgtttggctcggcggtgccaatgttcaacagccagctgctgttgccaaccatgccaatcagccaccattgcacaacaacgatgaaacaaacgaattagcgttttcggttttttattgcgagttcgataggctaccacctcagcgccagtcacatcgttggccaacttatcgctggacaccaattggaccattccgtccacccattgcatcagatcacggtagtcggacaagaagcgctgataatctaaaaaatagtaaataaattaaaattttataatgaaatttttaaataaaagtgtgcaaattataaatcagcccccagttccatacttaattcaaagcaaaaaaatggcaaacataaaacccgatcagtaacaagtgcaaaaaaaaaataatttttttttacaattttgatcacttattcggagaagcctaaggcttgaaatttttgcaaaaaactctcaatcagttcagtggatgcagaaaaatgaggcgcgatcatgaaaatttccgcccgagtcaaaattaaattaaaaaatgtttttatattaaaaaaaatcttgttttcttgcgatggcattttgccccatttttgcagcaaatcactgccaaacgtggccaaattttcgagcgttaggatcatctgaaagcggaactgatggaaaagccgtcaaagttggacgagtcgcaaaccctgcagcaattctcacgcgacgcggacgaagtggagaattcgataacccaagtcgcgcaggaggagacacacaatgacccgaccaacattcagcagacaccaagggcaacaggtagagtcgggagagggggacaaaggttttggcgtcgagactctcgatttctgagttgaaaaaaaattccggaattttgaactaccgggaccgggcgggctgcatttttanaataacacgagtaaaaaattcggttcttttccgttttgtgcccctctaaaaaaatttttaagtttctatgacaatttttaggcgcttgaaacgaatctgaaataaatttaaaaagaatgccgtttaatctggaaactaaagtttgaaatttcactagaactaacattgggagtcaaatttcgattaactcacataaaatagatgttagctttaaataaatgtcacatttgttcagcgcctaaaattgccataaaaagtttttaaaaaaaggtttttttaggggggacaaaacggaaaagaaccaaaaatttttggtccgaagagcaaaaagaaagaagctcttggcttgtccctcccgaattttatgctggttatggtcctgccttttacttctctaaattatttcttaatcgtttttcaaaacttaaaaatcttccttcataattaatttatccttgatttatacacggcgattcaattttgggctccaagtacaattaagttggttttttcgtcttagtggtctgtgagttagtcaccaaaaagggggtctcaagttcaattcctccttgtgtttgtgtataaatttcaattttttgaagcaaataaataaaataataataaatacagaacgccaaaagaacaaatacaaacagtaaaaggtacacactatattttacccttgaattatttaattgtgtgtgtgtgttcgcccatttgaccccgacccgccgatccgagcccgacttacccctgaccggaccctgaggcactaccttgtgcaaattttgtggaggctcctccacagttttttattttctcaggagttgcctacgaaaaaatatgctttttcatttttattgacacatattttattattttttaaagaaaattcgttaactaattgagcctagtaatccttaaaatcggcatttttattaaaacaaattgtattcaaatttccaacaattttcccggcgcctatcggcaccgccgtaaaaaagcgtgctgcaaaaatcataagtgaggtgttaccttcaccaaggcaaaaccatgttgcgtccctgactttggactcaacattccatcatctctgttccggtagctgctactgcacagccagccgcgtctttttctctgtgatgccacgcatgtacaacattgcgaagccttccgtttccccaatgctgcacaggtgccacccatgtaccgttgcgaagcctgccggcctccaatgttgcacaggtgccacgcgtgttccgttcactgctactgcccagccaggtgagccattcaccgaatgctacccatatgctattgcagaaggtccacgcatgcaccgttgtaaagcttaggtagctgctgctgcacgaacatccagacacgcatcttttggtagctgctactgcccagccaacctggactgtgcacc

SEQ ID NO: 20415 - DNA, 1051 bp, Heterodera glycines
  misc_feature (1029)..(1029): n is a, c, g, or t
accgaagggactcactcggcctcttcgcggcctcgtggtgggccttcgccccccccccccctcccacgcccttcagagcacgacaaatatttcaacaaaaattttgaaaaattgactagagcaatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgcccccgaaaacaaaaaaatcgatttttttcaagtgttccgttggnggtactccaaccaattatgggg

SEQ ID NO: 20416 - DNA, 1543 bp, Heterodera glycines
  misc_feature (137)..(137): n is a, c, g, or t
gatcgattggtcgaaaaaatggtggaattaagtgtgcttaggagtcgcaaataatcactctcgggtatgtgaactacttcttctagtaacagttcaaaattcaattttttgcgttgattaatttatttattgaattnatcaaattttgcaattaaataattattatagtatattaaagtggttcattttttaaagatatttagtaattgtttttctatcccttggcagtaccgcaataaatcttttaaatcagattcattttattttcttaaaatttaatattccttgaaattcggcaagttcatttcttagtctgatgctctcatcaagcgcttcttcgtgctttaatacttcttaaattttatttttgaatggtttttttatatttttgataaaaacatatgctcgcatattaaatgattacggtaagtcacaaacaagaatctgtcagaaatttaaatttttcgaattacaattttaaatttaaaaactttgattggagtcatccattttaaaaggtccgtgctcgagcttaaaaagaagcgagatgttttattttatttattttttaacagcttcaaattgcttcttaataccaacttaattactattaacaatttttttaaaatttaataaagcataggtgtgtttcttttaaaattgatgattttaatcaaaaaaattatcgttattaatatcataagtcggaatttttgtacaggacttttttaaaactcaatgaaattttttaaaattttaaagaataatagagtaattaaaattgttaaaataaaatttaatttaatagcttcagaaaaaaaagttataaagcattgaagaggctatgtttttgccatggtcatgccacctaataataaacaattaaaatttttaagtcattaaaatgcaattaagtcaaaatgaatttttatatttaatagttctatgaattctttatttttgttaacatttcaaaagatttcatcgagttttaaaaagttctggacaaaaaattccgacttaagattgtgtggaattcaagaactacatatttttttatactatttaaaaaaattttgaaaattttaatctcatagaaaacacatggagctattgaatgatacttcgaaatataaatatggttgaaattgaaccaatttatgaatttatatgttatacattttttgttttcctaccccttggcggtgtttagaaaactaagaatttaattgtatttagagttgtcaagtttatttaattaatgaaaaaattgatttattgccagtaatttttcttttagcaatatgtgtaatttcaaaaattagatggcagtcctgattttaaattctcattttcaggttaaaaaatgtatgcttaaagataaaaatttgtacaacctaaaatataaacttttgaatatttccttttgatttggtttattttctacttttttaaaattcaaaatacccctataaatagtctgtcaaacagtgtaatttggtcaattgtggggaaaattgttgatcatttcgtatttcgtatt

SEQ ID NO: 20417 - DNA, 1954 bp, Heterodera glycines
ttcttaaaactgccatcccactcctctcacttgaaaaattcttaaaaatttgaaaaatctttaaagaaattaagaaaatactataaaaatgaaaaataaatttttttttgaacttcataaaaaaaattttgaccaataagaatttcatagaaaaaattagaatttgataaagaaaaatttcttttttttaaaaaaggttaaatttttaaaaatatcagcaaataatttttcatagaaatttttttaatgatatttctctttaaatttttacaaaatttttaaaatcttccctcaatttctttaaatattcaaggattttttcaagtgagtggacgggtaacagttttaaaaaaaaacctcataatttgattgaaaataattagttttaatcacttaattaattaattttcagttgatttctctctacgagcgtgccaaggcggacgaacgaaatgtgccgacacttcgtgcgaacactgctcgtaataatggacaacagcaacagcagaaaaaagtgcctgctgctaatggcgggaagaagaataataatggggtggcaccggtggtgaagcagcaaattgttgtgatcagacaagcagagcagcggggagagactgtggcgaaacgagaggacggcggggtgacgagacggcgaaagagaggcaacacagcaacaacagaagttggagagcaagagcagccgccagacaacagcacagacgatgaaaagagtgttgagcgtgaggaacagcaagtgatggaaaagaagcagagaaaggcagcggcagccgcagagagtgtggaaagcatagagacggaggaaaagaagcagaagacgggaaaagactaaaaagagttaagaccttaagacagatgtttttttttcttcacttttttgctgaattttttttttttgggtgtgatcggaatatttgttgtttcttttttatataaatttaaacttctaaggtatgtaaaagtatattcaatactttttgaattttggtggctattagagaaccaaacacttttggctatcgaatgaaattaagaattattttaatttttttttttgtcaaaaagctttcaatttacatcgatttatggctcttcggacggatgattatttttcttcaagttataatccttttaatgccaaaacagttacaacaattatgaatataggccaaaagcccgggcgcatttctagtggacaacgtcatcagtagggcgtgtaattatatggaaatccatatttttttcctggattattggaggcctgaaacgcacgaaaaacatgtttttagcttggtttgaagcttctaggatggattcctatatccattttttccatatttttccatatttcgcgatttatgtccatttttccatattttgggcatgttttgtctatattttgtgtccatattttgggatttttccaaaaaacctctattagaacggcccccagcagctaaatttgcctttttgagcccaaaaaccggaaaattttacaaaaaattattttttcgctaaattttctcgagaatattgaataaattcaaattttcttagaaattaataaatttatgttaaatataagcaaaaaaacgaaaatttcgcttttcgggttgatttttcgctaaaaataagtaaattttagcttatcgtgtttttttcttctaaaatgatttctaatactatatttagccatttttgaaggttttactttatatttaacaaatttaaagaccttttgggaaattcttccctcattggaaaaatttatgtccatatttttgccattttatgtccatattttgggatttttggtccatattttatggccatatttcgcaattttatatccatataattacgcgccctagtcatcagcaccttttttcttgtaatattataaaggattgattttcataattggtggtttcgtctc

SEQ ID NO: 20418 - DNA, 2732 bp, Heterodera glycines
tgtgttattaatgatgatttttatgtgcatgtgcatttattttaattaaatattaataattaaaatgataaagtattatttataattttcactaggaccctattcccttttatttctgagaatgatattctgagaactctatcccttacaaacttataaatttttactaatttacatatataagcagagaagaaaaaaacaaaacaaaatatagataacatggaagaaatgagaaaaaaaaatgcaaaataaggccgaaatatggacaaaatagttgaaattcacaaaaaaaaaaagaaaatatgtaaaaaaaaaatttttttttttttaattttcggaaggaaaaaaaaattcaaagaccaaaaaaaaattttcaatgaagatgcttatttaatacatgaattatagaatgacataattttaatctataattattgtgtttaaagatgaaaagaaaaaaatatatttacataaatttaaaacttttgttaaaaattcattttttaaaggaattttgaagtgaaagagaaaacattttttacatttaatatggttttccaaaattttcaattaaggtcgtattttacaaaaacaaacaacaaaaattcttgagcggtgtctttttgagattttgtgaaaatgccttaaaatgaatatacaatatggaaatagtgacaaaaatctaaaacatggaaaggaaaaaaaattcatgaataaagctcaaaatattattttgtgtttaggtcaaagtgtttaaaaaaataggagtcaaaataaatccgatgcctaatcatagaattcattgttttgcctaagattttggttagcgacatttactgctcgccaagcttttctaaccgaagtactatttttttagcctaatatttctcatcattaaaattcattaactttttttggatataaggtggtcaatgaggaagatttgatatttagcgcattttggaaagccatatttgataggacaaaggtgtaccgaagtaaaaaaaaagattgaaaaaaaaacttggaaactaaatccatataaactatttctcagataagcattaaaaattatagaatatcctaatgatctctacggtacagtattgccttaactccattgtggaacaacaatcttgtttaagtggaatatagataattaaaaaaaacggcaaaatgccaaaaaaggtatttaatgcatgaaaatcccgaaaaaggcaaaaaaaaaagaagacataataaaagtcaacgtagaagcctcaaatcaagtggaaaatgcgttatttatgctcaatatatcgaaactagtgcgcagaaaaaaaaaggcaattgcctcaaaatgcggtctctattcattacttaagagaataagctgaatgatcggttaaacgtggaaagcggggttgataagattataaaagaaagaacggatgtggatcgatagctcaatggtagaactgaccacggaatgggcatacgagtgagttggattcctaaccaaggccaaacattttacttattttaagtattaaaacctaaaaacataaatatattttaatgccgaggcaattgtttgtcttttatctggtcgatgcagaatataattaattcaagcgataataatatttaatatgctcttattttcattttcaatttattattttttttgagagaaaaaaaaatgtgccacgtatttaagcttattagagaatttagagtatgcctaagctgatatgttcagaattctttgcaaacattactgtattaagtatagaaatggctaataatatttactttctttaaagtttttcttaaattcatttttcaacctcttatgtatgtctaattagttggaaaatcaaaaattaatactgcttataaatgttagaatgtacattgcaggtttattatctcttctatcataacagagaatcagattctaacttaattctttcagttgtctgtctttttcttgccaaggcattgaattaaaattgaaatttaaaacaatcccatatgttcgaatggaaggaatagtcaaagtttgaaaataagtttgttctggaactcaaccagatattcaagtgaccaattttatgtctctatgtctctaatatcttatgatttatgatctacgtgtggttcaacactcgacatgaaaatgaatattgaattgccaaggcgtgaagaaataattaaaaaaaaatatatatataaacagttgtatcagctttcgaggtataagttgttctaataaaataatcaattacagaaaattagaattatctaaaatagaaaaaaaatttttttttttttttatatatagaattttcatatcttttttttaagtccaactcaattcttattgatgattccataatggatggagatgttagatgctttatgaagaggcttatcattcagttttatatgactaatttaataataattcaacatttcttatacgtactttcatgcttgccgaagcaaatatttttacggtttatttaaacaagactagcaaatgcaatatcattctttttttttttttttttaatccaagaaggaatgatttccaaatttcatgtcatttacgtcttgttttcatgcgtttctggtccttgcttacagcaccaaccacttcttttaccacttaggtcttcatttcccattcatgagaaattatctgtaagtatactgtcgtttcgatcacttaacgatttatgacaaaa

SEQ ID NO: 20419 - DNA, 1186 bp, Heterodera glycines
ttcatttttcccttacatttcaagtaagattgtgtccgatcagatacaagccgctccgcaacaacacattcctccaatggcgccaattcaaattgatcagacacctgtccgtgatcaaactcctgtccgtgaccgcacacctgaaccagtcaaatctcctcgtccgcagcgacagcgcaagaagccaattcgctattcgcccggctaattgccacggacggtctttccaaaagagggagatgttggatgtgttgatatttaatattattaagtttcgacacgaatacttttattgattagttatttgttgatgggtactctcccatcgactcattctttggatttgtgttattttgcattcggtgtttattttcggactctctaatttgactccgtcgttattttattattattttgtgattctaattttattgtttattcatttaataaatttatcttgtttgtgtgttagcaaaacacaacaaaacgttatattatctttattttaaagaattataaacggctttattttgttaattttttaaattaatttatctaatattaatttaatataaaatatttgttttcaagaaagttaattttttactttttttaaaaatgtatatattttttttctcattgtatcttttcataaattagttttttaaattgaatggaccgaaaatgatgggcaagatgtacaagcgtaatttattcaaatcattttttaatttgatattgctttataactttttctttttattatttggtactataaatggtataataataattatttatcattagaatattttttcatgcacggatgttaatctatcataaaaaaataaaatttttgtttgaatattaatttattgtttcaaatagtttttttttctttatttatttatcgagcaaccacaaggtattaaaaaagtacatttacagtggtgcaaattaaaaaaatatatagcaacgaaataaaataaaataaagttcacaggatggtacaaaatatatattgaaaacaaatcaataaaatgtaaaaggtacccaatgtttaaggcagacaaaaacagcattaagaatttagtgtttctaggagatagtttctgaaaatcttgtatttctgaatttccattgcctctttaggcagtttattccaaataaatatagttctattaaa

SEQ ID NO: 20420 - DNA, 1837 bp, Heterodera glycines
aaatgttttaattttttacgtttctagatcaaatcatggcccttcttcgatgtcctgactgcatacattctgagcatgttgaagatacgcgcctctttagcttaagagtctaaataaattatttaatgaggaactcctcgctttcaaaatgacctctccctaattgctaactcatttataaataaaaaatatttcgctaataatgatttattaaaatgagttaaataaaattaaaagttgtctgtccactactttgagatttttataaaaataattgtttaaatttctttaaaaattaaaccaatgattatataagaaattaattttttttgcttaaattaaataaaaattaagccttgagagtgatattttatataaatcattgtcaaatttttttaaaattttttgaaatttcctttcatataatgattacaaattttttatcttgtttattattccttaagtcgatttattttgtatatttaagaattggcgctaacacatttgaaattattatgttacctattataagttgctgacttggaagatatgtacacatcttaagctaacaattttaataggatttttacttcacgcgtttcgttcagactctgatataaatctttctgtttgtcatttattatagagttattcgtttgtaattctcaaaggttcaaaattaatatcttaaattttgtaaatggaggatattattttaatatttaaaaatttgatttcaattctttaatacattttaaaccttattttgttattccattttctgtttttaatagaatggtaagtcagtatattagatgtaaatcttctgtaagaaatctttttattgtttacaaattttaattaattttggttaaataggctttaaataaataaaaaaaagttatttagaaattgtataaatttttaatttgtttgtacttagggtgtaacataatttttgatacccaaattttttttattaatttttttttttaatttcaacaaaacacaatcatgattcaaaatacccgccattattatcaataatatgttgccattattctggcaagagatcaataccaatggaaaagtatttagggagttagagttaagtaagtaaaaatggtaattttagaggtaggtatttttgatggctgatttaaagaaaaataaaagagatacagagccagagaactagtgattaaatagagcaaagttaggactataagaacacaaaaatataaaattttaattacaaaaattgaattattggagagccgagactgaaagtggtctccaaaaacggcatttttcaagaccaccaagtaacataatgttttaaaagtggttttggaaattctgaatttaattaaacaaggtaaatcgggtatgttgagttcgaatatggtcttagatttggtctctgggatcgcaacaaacctgtacagcttgaacttcatgcatggagttggagcagtacaagctcaggttgaaaagataggtcacatttaaggccatattcggattctactggtctaaattgtatagaaaaactaagattttgttatatcagctttggtttttgaccataaaaaattcgagaaaaattagtggaccaattttcaattttggcatggtcgggaaaaaaggcagaaaaatctatcaatcgaataaaaagtgaaacgatagtaagatataaaagaggacaccatgaagaacaaaataaaaaaagaatcatttaaataggctcagaaataacggaattatgaatttttaaaaattggaaaaaatttgggtatcaaaaattatgttccaccctaagtatttgattttttaa

SEQ ID NO: 20421 - DNA, 1751 bp, Heterodera glycines
ttttgtctaatcttcctgtcggggcacctagcaattcagaataaactagggtgggtcgggaccggtaattttgaggtaaaccgggaccgggactttttgggttgaaaacccgggactttttggctgcgaaaaccgggaaaaaacgggaattttccggtcccgctcaaaagtggtaaaacttcggtactcagttgtccgtgttttggtcccggtcccgacctaccctagaataaacacatgtaatttcgtaacaatacaaaatttgattgggagacgttcggccgcggaggtaaatgattcaccgatgaaaaagcatcagcaaaagcagcccattgtggatgagaaattgcgaattggaataaaaaaaaacaacaacaaaaaagatgggaagtctataggatggagaaatgtgatgaagaattgaataaaacgaaaattgttcatcatcatattcatccttttctccatttccttccctcaattcattggccacaaacatttctcggaagatttttatttgtttttaaattatctcttacattttgtaaccaattggacaaaaaaatggatcagggttggtacagtatctctatcataaagtaaaataaattttaaaattttcggttaataattaagtttttcagctatgcttataaacaatcaactttcagaccaccaaacgacgacttttgggccggcatatggaagcgaaggagtcaaagtgaacggcacggacacaacgacgaacaaaagcaacagcaatggtagcagtttgaaaattcataatacataaaaatgaaataaatgaaattaaattcattattgggatattttgaaagaaattcaaatttaaaaaatttttaatcaaaatcaaataatttaaaattaactaaaccactgtatttgtagcataatttaccgaaaatattttacatttatttattttggaaaaagtttcaacaatttagtaacattaaaaaataaagaaagaaagaaagaaaatttattttaattcttccatctttataatttaaatttcttgacaaaaaactgaattatgctaatgaatatgtataaatttaatataattttgaaaattcgtttttccagagtggacatattacttgtacgcctttttaattttggccattggcgccatgggaatatatggactctatcggctttgcagaaggagtacgtttacttataaaaaagtgaaataaaaataataaaataaaaattattatttcaagtaataaaaatgaatgaaaatctttaaaattgttatttaaaataataaaaatgaatgaaaatttaagtttgtctttgtcgcaaacgagccattgcaccttttgatgacacagtgagttgccggagtgtacaatcttcttcgggctcgacgttttcggcatggctcgtagagctgaaaatggcgtgtgccatctcagccagaagaagagaagcggcaagagaggcggacgtggagcatgtggaggcggagctcgacatgcacgtgccggagacggaagagcaacgagaggaagcgaaggggcacgggccggagacgaacacggacgggaaggagatgcaccgggagaaggtggatgggccgaaggcggatggacacggggtggaggcacacacgcaggaggcgtagcggggcgaccgtccggggcggaggatgcgcgagtgattggtgttacccttaacgtattatctctaattacccccccccccccaggtggactact

SEQ ID NO: 20422 - DNA, 542 bp, Heterodera glycines
tttttttttttttgagggaagattggggcaggggcttattgtcaatttcgttgggaggccccctccaaaagttcgatatttttataatgtttttttggaaaaaatgtcatttttaccttgtaaaatccgcgaaatccatcatggcgccacgtctgtcgcacacaatcagcgagtccacgatagtgatgtgcctaaacaggggcgtatctagaaacatttttcggggggggggacccgacctgaagaccttttttttttttgctatttaaccaataacttttttccaactgctaggtaaaaactccactttttcactaaaatgacccaattttggccgttttaaggcaaaaaacttgtaaaaatagtggaaaattgaggtccggcggtgccgataggcgccgccgggaaaaatttttggaactttgagtgctattttttacgaaaattttttaaattttcgtttggggggggggaattcgaaaaaattttcattatttgctggagaattttttaaaattttcatttcgggggggggggggggg

SEQ ID NO: 20423 - DNA, 1664 bp, Heterodera glycines
ttttcaaaaatgagtttttcatttttattcaattccaggttcgggggttcaaaatggaaatcagaagcgaagcgacccctctacctctgcctaacgaaaacccctaaaagttttacacgaaaaaaataggaaaattcatcgaccaaatttacacttttaaaggtaaaaactaaaaaaatgtggttagaaaatcaaaaacgaaaattaaaaataatttttgaattttctgcacatttaattataaatcattaattaaaggatttggcgtggagaaacccccccccccccccgcaaaaaaaaactgaccagaaaatcgcactttcaacaggtcaaatgggtggcaaatcgctgtgctggtaagtccaccggcaacgccgccaataaaatgctcataaccggtgaacatttttttggcaacaaattggtagcgaaaatataccctaaaattttcaaaaaaataaaattttttttttaatcattgagacttgaaaacaaaggcctacaaatttggagggagaattaagtattgaaaataaaatttttgagtgagttgccttttacgacaaatagaaaggaagaagttgattgtgggccccgaaaatgtacaacaaacaaaaacaacaacgaaaaaaacgacagaacgccaaaaaatttttttttaaattttgctgattgtgagaaaagacaacttcaatttgccgccggggctgctaaaaatgacatctgcaattttcattatgggaaatgaaagtaaattttatccaagtcgaacatttagggacaaaaaaaaagagcttttccccgttagggctttctagggtcggaaaaaccgattctcgcatccatttgtgcccattttgaatcccgaacccggattcgaacaaaagtcaaaattaatttaaaatttgaaaaaacagaccaaaaaaagtgcaaaaaactttcaaaaacccatttttttaacttgtgcgtttcttgattattattattattatgtccaaccaaaattcgtccaccggtggcgcggacagtcggaaaattgaccatttgttcaacaaatatgctagaggtttgttcattttattatgatgataattccggtgtgcccttggatcgtaaaaaaataacgcggttcggaaaatttgaatttacaactttttgttcgagtttacattagtagggattagcattggtcaaaatgttgtcagagtatcgccccgtgatcaaaaagtttccatgacttattatgacaaaaatttagcaaaaccaattgaattttaaattttgttttttatggtccatcctaaggtcgagactatccctaacaaaaaaaaatttttttttcctaccccccccccccctctttttcagatgcaaaggacaaagcgcagaaaatcggacccgatcggatcggtcccaatggcatggtgcgtttcttgcgcgacttgaacatcgagccaacgagtcgggcagtgatggttttggcgtggaaaatgggtgctcaaaaacagtgcgaattcactgtacaggagttccgcgacggaatttccacactgatgtttgtgtctttattttaatggggagaaatgcagttttaaatttttaaaaattgacaaattcagaattttaaggagtttttgagtcgagaaaatttttttctgcatttt

SEQ ID NO: 20424 - DNA, 1783 bp, Heterodera glycines
ctgaggccgtgttttgttctcccattcgtttattgttttgtctgcgatgaacttttgttcaaatgtctttttaataaattttatttttaattcttccattattgttaaaaaaagaaggtaaataaactaatttacttaattgagtaaataatggaattatctcatcagaattggtctaatgaatgaccaacaaaagtcgcattttctactaccaccaccccgacctcggcaatttccactacggtccgcagcatccgatgaaaccggcacggttgggtgcgttcgccccttttgacgtgccaactctgaccctttaaaatgttcagcggccactcacagtttggtgctcaactacgaactgcacaagcatttgacgtgtgtccatccgcccagggccacccaacatgacttggcccgcttccatgcgcccgaatatgtgcagtttttgaagcggatttcgccactgaacgcggatcagtacgagggactgtttaatcgctttaacattggcgaagattggtcggaacgcggagggagggacgggcggataacaaattgtacggcatttcagtcccgtcttcgatggcattttcgacttttgttctctgtacaccggcggaacactcggtggttgctaaaaggaatgtgtccttaatttgcttttgcgtaaacagagggcgccattcggcttaaccacggccaagcggaaattgcgattaattggagcggagggttacaccacgcgaaaaaggccgaagcatcgggcttttgttacgtcaacgacattgtaaaacacacagaaaacagatggggaaactgaaacagagaattattgaaggtgatcggcatcatcgaactcttgaagtgccatccgaggtgatttcgggatgggcacccgaagatttttttattttttgctcttccggcctaaatttttttgtcagatgttattttccgaaatttttggggcttcgtgggaaaaaaccggaaattttagccgttttcgccaaattttagccattattacgggactgaattaaaccatcggccgaattatttttttttatcgcctcaatggcctttcctattttcccctaaagagtcctttacattgacattgacattcaccacggcgacggcgtccaagaggcgttcaacctcaccgaccgggtgatgaccgtctctttccaccgctatggcagctatttcttccctggtttggcacaatttttaatgaaaaaaggtggaaagtcagtcccttgccttcgtttgccaaggcactggcgacatgtacgacgttggcatgggccatggccgctatttttcagtgaacgttccgctgagggaagggatggacgacgaaagttaccacagcggtaattgcaaattatttatcattgattactgtaatttggcattttcagtttttaagcccgtcattcaggccgtcgtggacaatttcaatccttcggtgattgttctccaatgtggcgccgattcgttgggctccgatcggctcggctgttttaacctcagctttgacggccacgggtatgtttagaatggcacaaaagagagagagagtggttgagaaaaagagaaaaagtctggccaaaccattggacaaattgactcggaatacccttccaaattcattccctcagggaatgtgtccgctttgtcaaatccctcggccttcccctccttatcctcggcgggggcggctacacattgcgcaacgtggcgaggtgaataacacaaaagacaaaagaggagcaaaata

SEQ ID NO: 20425 - DNA, 2633 bp, Heterodera glycines
  misc_feature (2603)..(2603): n is a, c, g, or t
gaattggaatttttttcaaaaatttcttcccccaattttttttttcaagagaaaatttttaaaaaagagcgaataatcaaataaataattattttttaatattttcaactaaccacttttttccgaaattcattcataaaaagaaacatttggctgccatttgcttcataaatttatctcctttccataaaactaaccaaaagtcatcaaaacgagtaataaaaaattaaatttttaattattttttaacttttcaaaatgaacaatttcgccaatgattactttcatttaaccaaatgttctgctgctgctgtgttctgcttctatgttttcttcttattttctgcttccatttgcgttgcgcagaatgtaagcatttttttatatttggcattctttttttttggaatcattttgccagagggcaaaagaaaacgtcgcgttgcatattaaatatgtacaaaaaatttacataaaaccaatttacctttcaaaaatgctaaagacattttaaattcatttaaatgaaattattttttcaaaagcctatcattagggggtgtaaaaactctcgggctcgaattccggaaccgaaaacccgataccgatacgaaaaaacaaaacttgagtcgaggactcaagaacgagactcttgaacagcacaagatgaaagcttgcaaaaggggcggagcggagtcttccgatggcacctggcaaagaaatgacttttggcactaatcaaaagtgaagagctattgattaatggcaaaattacaatttcagcagaagcagatgtccacgtccgacttgttcaacgcgttcatcgacggcttaacattgtttggcagagaatctttggtgcccaattcttccgcggatcatccgcagcaaatcaaagaacagctacaacggctacagcagtggattagcaatactgcggcagaagttgtggtcacttacgatcattttgagggcaaatatttgtgccaaccgagggcaaacgaccgaagcgatggcaccgatttgttcagtgccgtcagttcgcatttcgaaatgtccgattggcaattgaaaacacttggcaaagtgtttaaagcggtggaaaaatcgtcggagcaaaagttccaatttttgcaattgctgttctcgtttggtgccattttgggcgcccaaatgggcgccacggcaaaatgcgaaggcggcaattgcattggccaactgttgaaggcgttcgaatgtgccggtggaaattggaagcacttagaaaacaggcaaattaattcaggaaagaatttccatttttccttggaaattcggcatttgcgtgttattagggttttaggctcgtttttagctaatttcattaaaataggaaatttaaaatttaaaatcatttttcgatacacttagggctaccgaacgataccacggttgttgtatttggtgaccaatgaaaaagttatagctaaaaacttgtgctcgtacgaaaacctgcacgcgaccccttctctcccccacttcttttacgaaagggtcccccattttggggcagtttgcaagcgaaggagcaggaggggagggtcgacccttcatgcatctttctaaacccggatttatcggcctaatgagaagtaccgcatgttaaaagtgtaaacgcgtcgagttataatttaaatttttaagtatcccaaattttggcatacttactgtgatggaaagaatgcatgaaaaattgatggaacgaattttgctgaaagcgcattcggaagaaactgaggagcatcgacagcaaaacattcgtatgccggcggagcaaataaatgggctcccccctgacaatccgggcccgtagaataagaaagtggttatggttaaatgaccacgaagttgctgtctaactgtaaattaattttatccctctaattggggccatgtgtctcatattatcccatgaatagaagaaaaaatgaattttttatgtgcaattaccccaaaattgtatgtgttcaaataacccggtacaataagatcatagtttatggtcggtcgtttgacggaggttggtagtcaaaacggcttcttattcaacgggtttaccaccaaattcgttgtcatttgaccaagtcatttaatcaccttcttattctacggtccccgtctgtagacaatctgtcagtatccgatttttttaagcgataatcgcaagatttttgataatagctcaaaaaaaaaaaatttgctgacgaattatccactgacaaatgtctattactgacggattgtcctacactgacggattgtcaattggtcttattgtccactgacaaatgtgtctattactgaccgattgtcttctgacagattgtctattgatcctattgtccattgacggattgtccagaccccaaattaatgcgtcaattccatccccgatttgtcatttttagggaaacttttgcttctcaaagatctaaacattggaatgagtggaattacagcatttcaagtggtacttttttttgccgaaaaggctagcaatccactcagcgataagttttttgccaaattttgaaactattgcccacaatcggaccggatgattntggcacgcaatttgatgcaaaaagtgctca

SEQ ID NO: 20426 - DNA, 2382 bp, Heterodera glycines
atttttatcaaaatttacaaaaggcctatgttataaccctgcgaaaggtatcgtccttttaaaaccatatttaacattacctatcgaaataattatgcctttgaattatacaagcataaagaagcaactaatagagggtaagaatgggatataccccataaacataatcaacatgattataaaaatatgtaaataaaatttataaagaaaaatcataaagcgtccataataaaaaggcatatgcttttacatatgtaataaacaaagcatagcaagaaatttcaaatatttaaggaatttgagaatcaatttctacacgtgaacagctcaattgataaaatataaaaattaaaaagataatttgtaatattttattaatccaaatcaacaaaaaataaaacaaattgcagaaaactaatgttttaaaatgagtgtagtcaggatttctttcgcaaatgaccaaaaattgatttattaagtttgggtgtcctcagcgctcattaaataaggtgtcaaataaactatagaaaaaaccacaatttattaagaaaaataaagaaaaattagaattttacactaatttaaaacaatataaatatttggtaataaaaattatacacaaaaatacaaaaattatttgaaaaaataataaaaataataaataaccaaagaataattgacaaaagaatttaatggctaaaaacagaattaaataattagttataaaattactatttatatgttcaataaaagaaaaaaaacaaatatacaaaatagtaacgattgatttaaattatttatggaaaaatagcaacaaaaaattgcatttgcggagcaatcatgcaaaattaatattcgtattaaatatttttatcttttttcaactgtttatcgttcattatgaggtctgtgattcatgtaaagtgatgaatggcttttcttcacttatggtttaattttataaagttggacaaatatatgatttagtttaatggaaagacgaagatcacttgccattcataaaataaaatacctttaaccacttaattaattaaaataatgcgtttataaaaatattaaatcaaatttcgttgaaaataaagttaaagcggcaagaaaattgtttttaattttatatttaaaaatacgatggtcaaattaaaaaatatagtattatttatttattaataaacttaaaatacatcgaaattaatatttataaatagagacacaagtagtatagggatcactttcttgaccttttttttgccccccccccccctccctcgcgcactcaacccatattcaaatgaaagcaaaaaaaaaattgatgaaagcatgtaacaagtgatcagatatattattagtcggatgtgaatttaccgaccagagcaaaaaaaaaaaacatttagaaaaatctaaatatttttttatgattcagttcctcctatagggactataaaaatttcagataattgttgtccatgtataattcggttcctacggtatggcgtaaaaaatatttcattacgattattatcatttttgtctttgatagattcttctggcggatttaagtaatttatagctaatgatacaatattttcgaataaatcatcaatttctatacgaaattttctcatctgcttccggtatttataacaggttgccatgctatgttttgaagagttctcattttcctgacatttttttatatttttatattttaaacaattctcaaactcacccagaattttcgaaatatttttatattcctttgaaatttgtagatatagtagcctaatattttgcgctatctctaatattttttcatatagttgatgtattcctggagcactaaatgcgatgatcatatatgttttcgcatagaaagaaatattattacaatatgacactaaacgatctgcctccataataatttttctttcttttttccaccttgtaacaatttcatttttgatgaactgtatttcttggtcgatggttgtcattttctgatttaatttttattctttttggtactcaaattctcttttattcgtgaagcccaataaaatcccacactacagattgaattctgttttccaactccaacattttggtgtgaacccggcgagattctaaatgtagttttctcgtttcactcaatcccttaagtaccttttcctctagtttggtgacctgatcgaaatctttggaccgatcgacctcactccacattacctcaactttttcagactcggaattaattttatcaaaaatggtgtaaatttcccagatacaatctgacatttttacataccattctcgaacaccgggggcatagggggccttttctcgggatttattgcccgattaagg

SEQ ID NO: 20427 - DNA, 2203 bp, Heterodera glycines
tttccctggccctttttccctttccctcagatcgggtccctttcgtttttctattggtctgatcagttcccatttccatttcaatttattcgttgttgctaattagaaccaacctaccaacgcccaaaaggcggattttttcgttggaaaggttttctcagttcaatcaattcataaatgagaagccattcttgcgaggcaaaagcatggaaaacatagagcgcgattgatctcgcgggtcggcccggcacaaatgttgcgtgaaatgtgcggcaccgatcactcccttgggaagaggagagcacgcagaacacatcgcattttgaacattgtgaaagagggcgacaaaataaggcgaaaattattgtattttcggtgttgactccaaacgtccgccccacccctcaaaatccacaatctcacagggattctgagggcttaacgatttcaaaagtaaaatctgattgcatattcgtgatcagcggcccaaataacccctaaaatcatatttttggaagatttttggtgaaaaaaattttccactcaaaaatcatggtcacacccctgtggtcccaaattacaaaatcacttttatttctataacttttttcaaaaaagtgataaaaagctaaattaaaatttataaaatagagcaaaaaattgcggattttttgagtatattatttttataaaatactttttcagaaggcccacaggcgtttttttctgaaaaatcgaatttttccagaaatcctttgaataacttttttattttggaagatagaaattccaaataaatctcataaaattctcccaatttttctctatttttaaagcattattccactaaatttgaccaaaaacgaagagatttatgaattttcgaaatttcataggattttccggggctcaaattttgacgatttttcaaaaaattttaaccaccttccaaaaagtctgaaacacaaaataaagcgtatatacgtattcagcacctcaaattatgccataaaaatgcattttggctaatttaggagcaaaaaaatttttcatgaaatgcaaaaccatggggtcccccctatggttttgagtttcaaaatcacaattaattttataactttttttaaactcatggtaaaaacatgagataaagcacattagatagagcttaaaattctctacaaaaatgctcttagacaaatttccgctaagatcaacgcctgacgagttataagcctcaaacggaaatggggagctcaattccggaaaatttttctatttccggaaaattttgaaattttttcaaaaatgccaccaatcgatagagctcgaaaaacggttgcttgaaagtggtctccgttttcctgggaaaaatctgcaaaaaataataaaattcaaaaacgaaaaattttcgagggggcctagctcgaaaaattttgaaaattttcaaaatctgaaaacgccatcggatgcagctttaaaaactacacaaatgctcaagcggcgccaacccgctccgcttaacccctagcgagttattcacgaaaagccaaaaccggcattttgagcgccgttcagtcgccaatttctacaggctcggcatttgatctgatcaaaaagtgatcagtgacaaagttgtagccaacatgtctggggtgtgccctctcagcggactttttccgctcccggttccctgagaaaagttacagcccgaaaaccgcgacgattttttttatttggccgtttcagcgccgctggcgctcaactggccgccggaccgaaaaatccttatttttcccagatgcgcctcaaaaagttgcttaagcaatgccgcactttcaggagcctccgggcaaaccacgggcacttataattttttctacgaactgcaagtttattgtatatatatataaactagcgtgtcgcgcagtaattgctcggtgtagacagtatgcttttggtatatatgggcgggcgctgacatgagcgcttcgcgcaaaggacttcgttgctagtgcatgcgcgattttgaaatgaatttatggatgtgacgttttttaattttttgatggaaattcggccgcttcgcggcctcaggacgggcgcttcgcgcccgttttttagcttgttaggccacttcgcggcctcagtcgggcgcttcgcgccggtttttcaatttttgttggccttggacgggcgcttc

SEQ ID NO: 20428 - DNA, 2182 bp, Heterodera glycines
gagtcaatttgtaccaattaatatattcgtattttcattattctctttctcttcgtttttataaaatttctttttactttacattgtatgcatcaaaaataatttgctaggcttttactaaaatgagtaggtagggcttccaattttaggaataattttcacataggaataatgcgaaatccaagtcccaactttttttttggctcgggattttaatttttcaaaaaaactagggtggagtcttttccaaaaaaatctgggtcgcaaaccgattaccgagaaatgtaagggcctcaaaagcctcggaattccatctcaagcagtgatgattcaatgatgatatgctcttttttttagttttttttttggattttttctgaagagctttgcttaaaaggtttttcttcctgctactattaaggcattccatcgccctgggcggcttcgtctcctatcagctaatcttgctctttttctccattccggacatgttttgattacgctgcccacccctctcactgctcgtcgctgtttcgccccatcgctagtcgccccgcgggcatctttttaatctcgtcatctttcgtcgtgtttctcccccccccccccgccctccctcacaactcagcttcatctctgatcactcactactcactcatcattttgctcatttccctcatttgtcttccatcgtccgatgagttgcctccagcagtttcatctctgatcacatcgttcatccccccccgcccctcatttctttttcacacattccgcgatcttctcatccggatccatccgatctgtccctataaagagggaagccgcttctccttgttttaccaatttgcaataatgcttttgctcggcgtgaaaaccctgtgatttataagttatcataacacttccatcagccaaagggagcggcagcactataaatagcgaactcaatgaaaacatttgatcattctgctgatcagcagaaagaatcagcagtgtgaatgtgcggcatgccaattgaatttctttctttgactttgtgcttttatttgtccatccgcttctttcgtctttgccacccatttcccctttagacacttttatttattttttaaaaaatttaattgactcacgaggagtctcagaatgattttaattaaatattaatcaatttttattttttatacataaaatttagaagcacaaaaagatgaactgtgacgcccaggtgaaggcgtacaaatttgtcgcttattccgcgctgaccttctcgctggccgccgtgctgtccgtgttcatcatgatgccgttgatgtacaactttgtcagccacgtgcgacgtcagctcagccaggacatggtgttgtgtcaggtgggggacacagaaagtcaatattatttatttgattaacgtaacaaattttaaaaaataaaaagaaattatataaagcaataaaatattgaaaaagaatttagtagtatttacaaaatagaaataattaatttaatgaattataattaatttattaagggttcgtcctctgacctttggcgtgaggtcgaagtgttgaaaaatgcgccgttcattgctcacaatggcagcacttcatcgtcgttcaacactgctcgaacagctcgacaagcgtacggaggcggcgccgaagttggcgcaggcccagcgcacggagctggcgcacccgcggcgggcgctggacgcgcagcggcgcccggcttttgtaaaccatgttgcgtgcctggaccgcctggtccccaggggcgcccaggacggcacggaaagccgggcaagccgggcgcgcccggtgtgcctggcgccgccggcactggcccagcaatttgtaagcttttccatttgaattaaatacctcaaaattaatgcataaatttttggaaaattatggactaaagccctcaaaaaaaataaaaattaattcttttagtaaaaaatacttattatctcatttcttaggcgaggccactccaccgccgtgcccacgctgtccccaaggcccacccggaccacccggcgaattgggtccgcctggcgaggttggagccggtgagtcattctcatatttaaaaaataaataaaatattttattttaagagggacctaacggtcgtccaggacccgagggttcgcccaggagagccagggaccaaa

SEQ ID NO: 20429 - DNA, 1215 bp, Heterodera glycines
  misc_feature (38)..(38): n is a, c, g, or t
  misc_feature (43)..(43): n is a, c, g, or t
  misc_feature (54)..(54): n is a, c, g, or t
  misc_feature (100)..(100): n is a, c, g, or t
  misc_feature (116)..(116): n is a, c, g, or t
aagaaaaaataaataaaatggtttccataaaagggccngcggnaattataaaanaaacaaagaaatccctgctagggtaataattacaagaaaacacaanactcgaaaaaacaatnacaaaaaaagaaaagaaaacttaagacatcggtgaaacggattaagtgaaataaaatggaaaattaaataaaacaatccgaaataatgttacaaattcaaaaatgcttttgtcataccatcgaaagaaatttccagtcataatgtcgtgttcacgttgttattgcactcatcgacaattttgcccacgaattcgctggcggatgtattgtattcattttgttcgtccgtttcgaagtcgccaaagagagggacggccgagtcctaaagaaataaaaaagcataaaaccggaagtccaaaagaattgtcattcgcctggtccatcccggcattgttttccgattcgcgcatttcgtagcggtaaaactcttggaaattgatcagacagaggacaaagtcgtggccttgtttgcagtcgagcagttgttgaagtgatatcctaagaaaagaaatcatctggacagaaacaattagaaaatggttgaaaagagacacaatttatgaatgtttaataaaaagtaattaaaaccaaaaatgtttcttttttggaatggtcctcctcttattggaaaatggcccaatctttgacagacggaccttccgtcttcaatcggcttgaccatgtcaaagaattggtcacaaaagtcgtcaaattcgggcattgctgcttcaatggccaaccattcgttgtaacaggagcacaactcagtgtaaaagaaacgaagttcgaagcgagtcagcagaccatcctcgtccacgtcaagcaatttgaagaaataggccattgaagacggatgctaaaacagaaactgccaaattgtgccaccttttgtcagactgaccaccaaatgattgtacgcaatttggaagacgacgaattcttcgtaactcatcgcctccccgccattgtgtacatgaacttcaaaaaggcggtccacaaatgtttgggtcatggccccgtccaaatgtctcttgaagtcggccttactcagaaagtttttgtgatttgaatccaacatttggaatgtggcgttttgttcgtgtgtcttctcgggggaaaacggaacgaaggcgaaaaaaatgaaaagggaaataaacaa

SEQ ID NO: 20430 - DNA, 908 bp, Heterodera glycines
gctgaccaaagcgtccgaaatgcgaatgcgcccactgtgtttggggtccaggaaaaagaaaaacatcgtctccactgtgttcatgtaacaaatttgaaaggtttccttaacagaaagggtgaaaaaaagaaagaaaaaaggcaaatacctccaaatccttcaaaacgtcgacccgtggcatcacttcgtgcagataatagtcacaaagttgctaaattatgatttatgttccatatattgttactattcgttgcattttgttaattgactcacctccctgctcaaacatcctgtcgaattcgggtcgtactgtgccattttgatacggtatcgtataaacacaattttgagcgataaatactccacgatggtttcaatttgaatgcgaaaatcctcggaatgtaaatgccaatcgggaaaatgtgcagtgaaaaaagtgacaggcgagagaatatttgtgagtgattttccgacggtacgcagcacagactaaaacaaaaaaaaaatgttggaatttgcatataatgtgaaattctcgccattagtccgccgaaagaaattgtcttcacagtttttccttcagtttcttgaagagtcacatctttggaggcttctaaacactcgacaaagtcctattaaattaaatattattaaatttattgactcattaaaaaattcatattacgttaatgtcctcatccgacggcaatttattttcctctctttcgagtataattttcagacagagcctacgaattgactcaggcacaagttcttcacgagttttgtttgctgatagtggaagacgtaacaattgtccatggaactgaaaagtctaataaaataagcaaagaatgcgcgacaaacttcctcagcaaattttttatacttccgtaccattccttcgt

SEQ ID NO: 20431 - DNA, 1586 bp, Heterodera glycines
tacaggtgaattgccatttagcgctcaccccaataacgtgccaacgcctggataagggagggaggagggccatgatgtgcaacgttagggcacttccggtttccattgcattatgcgatgtgtcaactccaattattggaggaaaccaagtgcatgtcggctgacgcaaagaccctaacagactaaaacgcgcctaggtagcgaagctcaagaagcgcgcagcgctttcccaagcgccaccctcgcatgcacacacccgctagttaatatatacgttatattgacaaggagtttcgttgctaaaaccattttctcccggccgaaggccgggagcgccctgaaagtagtggaagggtcttacaactttttgaggagaatccgggaaaactatagagaaaaattcagcgcggacgactgagtcccggggaccgatttctcactttttcttgcgtttgttagcccataactttttttctaaaacccgaatcaaaaagtgcccgctgtgagggcactccccacaactgtcctctacatgatggtattttttatttttttattagagccaccccctggcctgcacgcttggctaattgaagtgtgctcaaaatgtacacttcagtaccaggcgaataactcgccaggggttgctttgaccgaaaaattgtttctgagcaaaaatgtgtagtatttgaaaggctatccaaccaagttttaaaatttcgaaaattttgaaaatttttcgagctaggcctaaaaaacggttttcgggtttttgaattttaggattttttaacgatttttcccagagaaacggagaccacttccaaaacatagtttttcgagctctatcgactggtatttttttcggaaaaatttcgattttttcccggaaatagaaaaaatttttggcctgagcgggacatttgagtcccgggcctgtaactcggcaggagttgagtttatcgaaaaattgatttagagcaaaattgtagagctttcgaaactctatcgaatggtgtaatacatgtttggaaaatttcaaaatttttcgagctaggccccctagaaattttcaaaaatttttttggggtcgaaaaagggtgtgaaaaatatttttctggggtaaaataaggtgctgagtacgaatatgatgtctattttaagtttcagaattttgggaattttttaaaaattctttattttttggcaattttttggccctcgggattttggcctaatatttgaaaattcataactaacctcagggtaagtcaattttcatacaacaaagctttaaaaatagagaaaaatcaggagaattttatgggatttatttaggttttctaacatcaatatgaaaaaagttattccagaaattctggaaattttagatttttcagaaaaaaattcgtaactgccttctgaaaagctatttgagaaaagtaaaatactacaaaaatccgcaatttttttctctataatataaattttattttaaatttttatcacatttttaaaaaaagatataaaaataaaagtgattttgaagtcgggtccaaaggggggagcacatggtttttgagtgg

SEQ ID NO: 20432 - DNA, 653 bp, Heterodera glycines
aagaggaggaagaggaggacgaaagcgggcaggcgcaagacgacgaagagcagggagacactggcgaagagaccgaggcggaagaaagtggtgaggagaccgagaacgacgaggagggagaaagtcgcgaagagaaacaggaggaaaacagtggggacgacaaagaggaggaagaggaggcagaaagtcggcaggaggaagaggaggaagaaagtggggagaagaaagaggagaaagaggaggaagaaagtggggaggagaaagaggaggaagaggaggaagaaagtggggaggagaaagaggaggaagaggagggataaagtggggaagagacagaggaggaagaaagtggggaggagaaagaggaggaagaggagggagaaagtggggaagagacagaggaggaagaaagtggggaggagaaagagaaggaagaggagggagaaagtggggaagagaaagaggaggaagaaagtggggaggagaaagaggaggaagaggaggaagaaagtggggaggagaaagaggaggaagaggaggaagaaagtggggaggagaaagaggaggaagaaggtggggaggagaaagagaaggaagaggagggagaaagtgcggaagagaaagaggaggacaactgtgctgaggagaaagag

SEQ ID NO: 20433 - DNA, 2550 bp, Heterodera glycines
  misc_feature (2453)..(2453): n is a, c, g, or t
caatattatgaaatgaaagaaaataacccaaaaattggcgacaaaataattgccgaaaaattggaaattggatatgaaacgatgagaaaatggaaaaagaaatttgctccaattcttttttgttgatatgtgtgatttattttccatgttctggaggaataaatccattttttcaaaattttatttgacgtttttcttaaatttgattaaaatcgctttacaaaatttggtatggaaacgtgaagacaattatggctaattaattttataattaggctccacacaaatgagttagagtaaattatttcacattcctttgagaaattttgatttgtagaataatttcatgcatttaaaaaatgtattggccacaattaattaaacatttttttattattttttaataatacttaaaatttattttttgaaaatccgaaatcaatggaagaagaaatttgctctaattcttgcttgaatgcgattaattttggttgtttagtgctggaagcttttaaggataaatccattttttcaaaaattttattttatatttttttgaaatttttgaagaaaaattattattttatttgtcaattaagatttttttataattgactaaaatagcagttttagaaatttgattggatatgaagaaaattataactaaattacctaattgttttttataattatgcctaaacaaaatcagtgaattcgattaaatggctacgctttcctttgtgaaattatacaaataaaattatttcctttatttaacaaagtttcatgggcctaattgaaatttaaacttcgattattttttatattattgcatatttcagtgaatttaaaatagtgaaaaaaatggaaaacaacacccaaatgatcaacaaaaatgagaaatggtaaaaatttgaagtaattagcgaaagttgaagcaaaaaaaaaaaatatatcaatgtaaaatcaaagaccaaattggggccaacaaaatgaaaaagtattttttaaattttatggccttttttaaatggaaaaaagaaaagttttttttattttttttcttcaattttggtgtcattcattgatattttcctttttctgttgatttttctttaattgctccttttctcacccctaaaggtcagagcccttttctaatttatgataataaactgataaaaattaaaaaaaaatttacctttccatcagaaaaattaccaacatttcgcaacaaaaaagccatcccatggtaattaatatattaattattctcagaggcaatcaatcaatcctttaatgaatcaattttatcataatgtttgctttttaaaaactaaaaatattttaaattattaaaaaaaatccaagaaaatgggtattattattttttattttacctaattttcttaaaaaaattgacttaatataccaaaattatttactccctgccggggcgcctaatgaaccgctgaatctcaatttttccaattcattaaaattttttaaaaaattatatttcaataataaattcctctcactcacctcttccccgtcccgatagaagtgttccgtcacgcgttcgtccacaattggcgcctccccattctgtgcatggtgcacaaagcgttcagtgcgcgtgacaaccgtttccacgttgccctcctcctgctgcatgggctgttgctgttgttccgctgcaaccgatgagggggttggcgaaatgccagcggtgcttgatggcgctaaatttgaattacgacgattttcaattaaaatttaacataaaaaaatcgattaaaaataattaataattttcatatgatttttaaacatttatacttttttagatacccaaataaataattttaaaaatataaaactcacgtgttgcactgagcgcttgcgacagcgcgactgcagcggttggtgcagcggcgaacgcaagtcccccagtggcagccgccagactgcccttgctggaatggtcacgacgcagtgacgctgcagaaacgatgggcgtgccgccacgactcgcactggtacgccatgcgtcgtcaatgtccgccgcggtggcgcccgtgatgtccaagccgtacatgcgatgcagcacaatgtcgtcacggccaatttggcgtaatgctttttccaagtcgtcggacactgaaaatgattaaaaatgataataaaatattataaaatttatttattttaattctatctttaaaagaaaaggttaattaaaattaattagagaaacttttttaaatttattaattacatattattacctcatttgaaaatgatcaaaatttgctttttatttaaaaaacattttttgaaatttaaacaaataaacaaataatatattttagtgattggtattttataaatgaatcatttaaaaaaaaggtaaattgaacatttccgcaatgaatataaaaaatttaaanaattgaaaattttcaaaaaataataaaataatttttatttaattttaaatttacaaaatttcctcaaaatttttttaaataataaattaattcattt

SEQ ID NO: 20434 - DNA, 3081 bp, Heterodera glycines
tcatttaatacgccacatttggccacaatttaagaagtgccacgttgaaagccttcgagccgagaaatgtttgtatgccaaaataagcgacgcaaatgagcatccgaacgagggatggtatatgggcaccatggatgccgaaaatggcacgacaaagcacgggaaaaggaattttatgcaccttttggaggatgggcaattaaaaagttaaaaattaaaaaaaaatcatcatttaaaaaaattaaatgtgccagcgatggaaatttggcagcacctgacttggctttgagctgagattgcacaaaaagagagtgatcagaacagacaaaattaacacgacaaacacctgagaagggactacgggacagcctaattagcataattaattaagcaaatcaataaaaattttagaaaagccaaaggaatcaattaagtggaaaattcttagctaagataaattttttaagaaataaacattaaaaacaactgccgaaatgagcgtaagcaaaagattaaaaatttttataatttcaatagtaattttaaaaaaatggcaatataatttgttaaattttgcttacctgccagctggccaatctgagcgaaaacaaagtgccggctgtcagataaccggcaacactgtggatcacttaattacaaaattgaaacaaaaatttatttattatttttgaatgaatgaatgcccaccggacatccaaagtgccgtaatattgtaagcattccaagtctgcttctcgactggcagcaaatcggcattgctcaatttctgatcaaagtcacggcccgcggaattatcagaattttttgaagaaaatttcattgaaaatcttcaaaattgaagaataaagaagaaatttgctactaaaattgcgcatttctcgtgaaattttttgcataaaattaaaaggaaaagaacgaggaagcaattatgaaaagaaattaatgttattaatgagtcaagcaaatgaacgaaaggtgatcagaaattatcggtggggtgaatttaaatgaattatttatttttatttttaatatttttcgaattaactaaaataaacatagagaatagaggaagagaaagaaattttttaattacaaaatatcattgataggcaattaatgatcaagaaattactaatgattaaataatatatatgggataatgaggataattgtttgcaaatgtgcaataaaaacgaacaacaaaaaaagagagagaatatgaacaaagtgagagagagagagagaaagaaagcgatcaattagggggggggggggcaacgcaaaaaagtgactaattaggcaacaaaattgaattcaattcttcgtcatgccaattctccaacaaattcaatttcaaaagcaccgccacggcacaaaccaccgactgatcaaaccaaccaaaatcggaaattgatgcaattactatttttataaaagacacgaataattttgaattgctaataaaattgccaattaattttcaaattaaatggatttgatttaagcaaatggaaaatatgcaacagaattaaggaatcggcactgatcagtgagaacccgccaaaaagagacggattaagtttaaaggctgatattttcatttttattttcaaaattctccactaagctcagttggatgagcatttcaatataactattttaattgccaattaaagcaaatgcaaccaacaaattagtaaattagtggtgatcattacgaaaaaatgctgcagaatgaaaggcatcaaaaccaaaaaacgtaaaatgtccatgaaatgcaaatgccgagaattgataagtgagagagagagaaataattaatggccgcaattagcgatttaattggttaactttgttcggaagaacggtcatcgcaattaccagcagaaatggtcaaagataacaaaatgatttctgatttatcaaggaagtaatttattgggaattttttattttactatacaaaagtgattttgccaattagttacatttccaagtcgtccccctatacattgactgcatttttcgtcactttgtccgcttcatctttcgctcacccatttggtcattttgtccgcttcatctccctcccattcatcttcctctatttcgatggccctcttcatctcttcggcctgccgttcaaatgcaaattcgtccataaagtgccgtttcgccctctcatccaaaatgaaatccgccattttgaccgtttccgcgtcgtatctccgccgcatctccgcgatgcatctgcgcactgctttgttccggtcttgccccaacggccaacacccgtccgggcgcgccgggatggacacggcacggttcagcaccgacagataggccaattttttggccaacacacacaaatccttgccggggtactgtaattccatacagtatccagaccggttaatttattttcaattttttaaatttattcttccattttatttttttgctataaaaattcaaaaaattcaatggcgaaattatattttgaataaaaaattatagaaaatccgttgatgaggctccgaaaagggaggagtgccgagtgtcagtcttgaccaactcctctcggggggggggggcggatgattccaatacgaaaaccccaaatactcaacaaaaattcacgtcttcccctaaaaattttccggatggtggggactatacttggtacccttccccacccccttccccgctctcgtgccgtgaaccctataggcattgttttaccccgccgtaaagtgccgtgcatgtggcgtcaatttcccactgattggcgccgccaccgccattgcccggccgttgcagcagcagcgttttgatgctaatgttggccatttggtacgcgttgcgaaaagtgtgcagtctgtccacatcgaaaatgtattttttgcaattgtccaacagctcagtgagcacatggccgacccatcgctggtcaatcgggcgaaagtcgaagccaactgaaaggggcaaaaacagaagacaaattgcaacagaaaaaagtgactcccaaaattcgaatcctaaaaatgaattttgaaa

SEQ ID NO: 20435 - DNA, 2149 bp, Heterodera glycines
atgcgatcgcagctctgacttcatttctcaatgacttttccattgcggcaaactaacgttaaactgtacaaagaatttttttatcgcaggggatagcaccgaaaagagcctgaccatggaatgttaggagacgggtgctgacacatgcttgactcgcccaccaccgattggatgccgaatgaacactatgaaagggtggggcgcctttttcgtggttgatcggtatatgttagatttgatttttggcgttttattttttaattgtgttgtcccttcttaatgttgtcttattgataggtatttactctctcgcttaatcgatgttttgccactccgtcccagcagaaaatgtttccccatctttcgttctggtgttagtgcatttttttatttaatcattatttttcctccgacttatctcccttttatgttgctgactttaaataaaagtgatttcttcacgacttggtcattttagacagcagagaaaagcagtgagaattttccccaacgcacccaacttttcccgggttttgagaaaaaaaaattacggaatttaaaaaagcgggacgtgggaaccccgcctttttctcgtttccgaaaaatccagtccgggcaaaaaagacggaaactggaattcccgtcgatctcaaattttggggatgggaggtcattttttaatttttttttgcatgtacatactcattattttcatttgtatgttatttgttattgtattttgctcattttaaagcaggtatctaatctctttttgtcaacttttatggctactgaaatcctaacaaagcgtggaagaaaaaaattattgcatgagggttttctgtatgtcttcgaaaaatcaaacacatgtggtgacgttaagttctggaaatgtgaatttttcggaacccaggacatcacatgcaaatgttgtttacacacagatatgaattacaattttttggaggttcaactattcaattataaatgttaaatatgtcatttttttgtcaatcggcgtgcacaattgtccgtctggagccgaaaacattcaagttcaaaaacatacgacatcgctgaagaagctgcgcaaaaaacgatggagaaccattctgttacggtctataacacttgacaatattccgactccagtttggctcggtttccggataaagaagcaacaaaaaaagttttcggagacttacgcacgctctactcgcactggaaatgcatctgttaccagagcttcgaccaattctcatttggttatatttgttatagattgaagtcaacagatttgcaggttcgccacaaactacactggacgtgttcggcgtgctgacgggactcggaccgtaccaatgttttccccccaattatggagtgtctactctaggacgatcaactgagaagatcgcaccaacaattttgcagaggctgcacacaggcaactgcagagggcttttaactgctctcaaccatcagtatggcgtttcattgagacattgcagaaacaacagaagctacgagattccgaaatgtccaagtttgaatattgatgatcctcatcgtctcaacgttgataatttcaatccacagtctattattgattttcttgcgggtgtttcacactggcaatgaaacctcccccgcaatgaaaccgcggcaaccctcatgttccgtgggcggactcatattctagcaaattcttgatcagcgacccacgaaaactgcctggaaattttcacaattgtattgtatataatcttgaaaaaatgcaaataaaagagtcgtaggtaatattaccgctggtaacgtatcttgcacccgaattcggataaaaagtcgaaaattcaaattttttaaatcccgcatttttgttctaaaaatactttacatatttttatttgaccaaaattttaaaatttcgacttttggttccaattctggctcggagttagaaattgatcaaagtgggatgcattattcgtgatcagcaactccgaaaacattttatggtttttgaaaacaaaaacggcagtgttactaccgagttctcctcccattggttttggataaaaaaaattacggcaatggtaaaggttattggtccccgaaattttttttttaatgttttaagaaaatattt

SEQ ID NO: 20436 - DNA, 1810 bp, Heterodera glycines
ccaaaaaataaattttgaaaaaaataaatgattaatccaagtaatggagtttaaaattattcaaattaaaatttttaataaatttcataataaaacgaaaaattaaatttttaattttggtataattattaagtaaaaagaaatcatttataaaaaaaaaaatttaagaaacaaaaattcattcaactggtcggcaaaaagacgaaaatattttgcaacaaaattaaatttgaattctctaattaataaatcaaagtaacacaaggaagaaaaggaaaaaacatacatctgaacatgatattaaaatagtaaaaaaagatttaaaaaaataatattttacaattttgaataaataaatgaaatgaagtaaataaatgattattcattacaattagtacaaatctaatgaaatataaaaaaagtaaaaacaaaagataactatgcaattaacaaaaacaacaaaaagcacacaaaaaataattaatatatgagtgaaaaaagtaatcagattcaaaaaattaacttcgaaaaaattatatgaccgtaaaataaaaaatatggtaatttattaaaaaataacaaattaaaatttataaacgaaaaagaataaatgtaatttagcattgaataatgtaatataataaataatacaataaaatagtaatcattttttgtacaacatacaaaactaaattcacaaataataactattcaattctttcattagaaattaaacatatttaaaaaatagtaataaaaatacaaaatcattatcaaaactgaagaaaatgtacaatttaataatataatctacttatttgcaagatcaaatcataagaagaagaaaaaacaaaaaacttaaaaatagcaaaattataaaaaataaaagaaataatcttgaataacttttataatctagtaaaaaccaatttaaaataaaatgtttttaaattattgcaaagtaaaagatatgaattgatagtaaaaaatcaaaaaattcccaagcggcgatttcaaaatagtggaaattggaagaagttagtgcagagatttccaccttttcatcatcaaaaaaatgctatatgaattgaaatttataaaaaataaaatatcaatatatctgattgaaaaataagcaaggcatcgtaaatataactgaataaaaaattaataacaaattaattatattttgaccgaacataaattagtttttatcttaataaatacttgaaaattcgataaatgattgttttttatataacagcatagttactttcatcaacattgataacttctacaaagacaagacatttattaattcgaaaaagaataatacaataaataaaattattaaattatttttgccaaaaaatgtaaaaataatgaaagtttaacttttaaagcaatttaaagtaattcaaagcaaaatttttttaataaaattttttgacaaattttaataattcacaattattaattttaattcaaaatttgagaaaaataacaagaattatttaacaatgtatatttttaataaagagattaaattaaaataaataagtaaaaactttaatttattagccaaaaaataattaattttcattaatgaataaaaaaattattaatgaaatacaatttcaaatatgaatttttcaatatgaaaaatgttaaaaaatattatttaattataaaaaactaaaaaagtctaaatttaatttaattttaattaattattcggaattaaagaaataaaaattgcatttgttaatattaaaactgcgacgacgaatgaacgataaagcaggatcat

SEQ ID NO: 20437 - DNA, 2271 bp, Heterodera glycines
cccggacgagggggagcccgttcgggaggacgttcgcggggctggatgtccatgtcctggaatgtgcggacgcacaagtccacctgctctttgtcggtgacgattgtcgcaaatccctcacgccaatttctgagccgtccaggaagtgtagctctcacgctccattcggatcagttcaagcagtaccggtggtggaagtttgcttttgatgagattggtgaccagcgagctgttggcgattggcgagagctccccctcgggctcgaggctgcaaagttgggtgcagatccgctcgatctcttgctggagttggcgcaactccttgaggttgttccgggcaggtttgaggtggagaagctgggcattgagttggtcccgtcggttgccgacgtcgccgtagcggtctcgtagaatgctcacgactgtgctgtaattggcgtctgacggtgggtaaccttcaatcatccgtcggggtggcgatcccttctcgaggtactgtaggaggaggaggtgcttttggaaggcggggtattggcgcgagtggacggcaaagtcgaaggcggcccaaaatgtgacccattcttctgccgatccgctgaacctcgggatttcgattcggctgacccggagtgcgtcgtcgtcattggtcgactgtcggaagtgaccatggtgaggttccgatcgatgggtggggcgattcgatgctcggggaaatgtgaggttaagcgggaatgccggggttcgctggttgaatagggtttgatcggctctagccgaattggacggctgatgtgcattcactggctgtgcctgagtcggtgggtcggtggattgccgttggcggtggatccggttttcgtcgtcagccccgtgatcagaaacacgactgctgctgcgagaagagatggcgtccgtcgtgtcgaatcgagcctcgatgtagacttggaggccgtcgaggatgagctgggctttagagagaagagtgatgactggccattcttcgacatttgggtcggcttgctcatcgtcgaaggtcgggagtgcggccaggaggtcctcctccgcctgcttcagaaacgggtcgcctagcagctgaatatggtcaaaacattctcgtagcatgccattgacgcggtcgatgcttctctgtagcaattgccggtcagttcgtacgcccttggcgagtttggtctcctcggcgagcgggatttcctctggcgccatcctggtgaattcagtgagcctcccgaccctttgtcggaggcgcttgacgaggtccgaaagggttcggacttcggcggtgagacgttgacgaatgagttccgacatttacgaaagtctaggattggcggctggacgcaagagtcgggcttggttggtcgagagcctagagaaggcggctgtcggttggtgggttgagtggagattagccgagagcccgagagggacggctgacgataagagttgagtggtgaaagccgggagcctaaagggtcggcttaagaggacggctgacgactcaattgagggcttgtcggaagcctaaaggggggctggcgacaaagagttgagtgatgaaagccgggagcctgaaagggcggctggcggcttggagaagagtgatgaatggtcgaaagcctgaaatgggcggctgacgactcggtgagggtttgtcggttgtcgggagcctaaaagggcggctggcgacttgagttgagtgatgagtgccggaggcctaagatggtcggcggacagcgaagggttgagttgccgggagcctaaagggtcggctggcggcagagaggagtgatgaatggtcgaaagcctgaaaggggcggctgacgactcggtgagggtttgtcgggagcctaagagggggcggctggcgacttgagttgagtgccggaggcctaagatggtcggcggacggcgaagggttgagttgccgggagcctaaagggtcggctggcggcagagagaagagtgatggatggtcgaaagtgaattgaatggtgaagggtttgtgttcccgggtcgtggcaccagaaagtttgtcggaaaaggagggggacaaactggggggatggaagggaaggaggagattcgagactcgctcaaaagagcggcgacgcagattggcgatggagaaggcgagagaaagggtgtgccgctcgttcgattttgggggagtttctcgccgtctgtaagcacatttcccgtgtttcccgacccctacccaacgtgggagtttcaacaacaatttattgaagc

SEQ ID NO: 20438 - DNA, 2139 bp, Heterodera glycines
caacagttgcattcggttttcacttcttcctccattctaatgctattttgctttagaaaattctgctagcgacctgctaagggcattccgtttttcgagtttaggaaaactcggtttgccccagtggcaacagtatttggggtttgctgttgattctgctgaggaaaagacgatgggaattcgttcggttttggcgggacattgtcttattgcaattccgtgaaacatgaccaggttcgttacaagtgtaacaaacaacttgatagggtcttaactgatttttggaacttgtttcaacttcacggttgttcgggtgcatatattttcgttcctggtttggtcggtgttccgaactttgcctttttgcagccatttgtgttgcttctgcacgagaagctaaagctacaaattcatcaaaagacattacgttacggcgatggagctccaaattcaatgctagatctggattgttcaaacttcggataaggtgttttatggaatactcatcggccaggtttcgtgttagccctggataagcacgacgcactaggctcgaaattctgtcggccaaatcgtctaagttttcgccatgctttcgtgtgaccccattcatcaagtcattaaacgcgctcatttctctgcaatcagtgtcctctaattgttgcaaaatgtttcttttaacattttcgtagacaaatggttcattggccaaagcggcattataagctctttcggcacgaccgcttagttttgcctctagcgattcgattcgctttttgttgggccaatcggctgtgtactgtgagtacttcttaaagaaattacggatcgaatcgccgccctcatttccccttatatccggaagccggtctaaaatcattgcatattcgaggccacttagacttgtctgttgtggaaaaatttgttgctgtctattttgtccttcttctcgctgatttactgcttgctgattcaccatttgacgcgctgggtttattgcagtgtttgggtactgcacattttggggtggaaacattacaggcatttggttgttaaaaaacgttgaaaaattttgagctggtagctgtggacccaaattttgagcgccgtaaaattgcattggctgttgcaaattttgcattggaaattgaggccagaaaaatggcggtggaagcattccatttatcccaaactgttgctgattgtttgcattttgttggattggaatgccaccaacctggaaatttgcaaattggttcgggttattcaccaaaattgggtggttttgccggagattttgggcgttcgcattaaaatttcgcgcattttctgcttcttggtggttattatcttctaagcgtataaagcgaccgcgtgcgtctcggggtctttcccaatttctacgattaccctcaaaattcaactgtcgttgcgcgtggtgaattggactgatatttggagttgacgtaagaaaattatcattttcgcgtggtgtcacatttccggctatttgattttgttgaataagacccgggtttaacaaattttcgtccctatttgcaccccgatttcgattactttcatccaatagacggcgctcgtcttctgcattcagctccctcaattgttcattcacattaagcaattggttgtgtatctcctgctcgtccatttgagtccctgaatggttccgatttccattatttcgctcattattctcttcatttctctgttgaaaattttgttgattgtccaaattaattggtggaaatgctggaaaattttggtttcgaggctgaacattttccggaaccgcctgtcgctgatttccccctctacgaggtgaccgaaaaatcatgcctttagcctttatttccttccactaattgctgaatgtaaaccacaatctgtgtggtgcaatctcttgctgtgagtattgctgaagatttgaattcaatgcaacctattactgatagtgttgccttcaaatgatgtgattgtagattgattttgtccggactagggaacaaaatgagtttgaatggcgtttgatgccttaacactgcagcgcggcttgtacaaacaaattttttacgtaaaattgttagcccaatctgtggatctaacttttccgacttt

SEQ ID NO: 20439 - DNA, 1349 bp, Heterodera glycines
  misc_feature (1334)..(1334): n is a, c, g, or t
tttgaaaactttcatttgggagaacaaaatttccattccttttagaattcttagaaaatttcatttttatgaagtttattctaaatacgaatttataagttttttttttgtcaaattaagtaaagcaatcgcatattattttaagtgtcattaataaaaatttagcggaccaggagaaaagcaatcttaaaatatttgagcataaattgattctaccaacaccttcaaatgaaaaaagctacaaatttaaaataaatttaaaaatatttaaaaaaaaattcaatttgtttaatggcaaaaaatcttgcaacattgattcattaataagcaaattgttgttaataacaattttttatcaaataaaaaatcatcaaaaatcatcatcatcatcatcagtgcaaatgctcaaaaaatagtcaacaacatatgatttggttatgatctgtgcactgatcagtgatcactcatcataagagctaggaattttagttactaaaaacttgcacaaatcgtcaagcggtattttttaacttagctcattgttttcagaagagtttgaacttttgcatgaaaataccggctctaggtctaatcgacttttatgagtccaaagatattttatgagtctaatcaattgataatacctggttttcatacaataactttgttcatgatcgaacaaacccaaaatatttttggtatcattcgaaagcacaaagtctgaataatgtaataatacgagaaaaaaccagagaattctaacattaaaaaaaaaaacttacgaacgaaaataatcagcaattaattaattaatcaaatcttttttggcaattgcctaaacgctgagaattttatatattttcgcttctttagactttttgcattcgaatgataccaaaaagatagggtttgttcgaacatgaatgaacaaagttattgtataaaaacccgggattgtcaattgattggactcataaaatattggaccagggatgggcgaagctcgtcttacaattagcactcgaagccgaagcacaattttttttcgaagcacgaagttcgaagcccaaaaaacccgaagttttcgaagtttcgcccgtccctgctttggactcataaaagtcgattcgattcataaagtgcaaatgagccgaaaatactttggcatgagtcctacctaacactctgccaaatttcagaatttttttatgaataaacttgagtaaaattcaagtttttagcacataaaaatgctagagctctactcctcctcctcctcctcctcatcatcatcaacgtgtttagtgtggtcagcatgtttagctcctttcagnattttttcatcatga

SEQ ID NO: 20440 - DNA, 1944 bp, Heterodera glycines
ggggggcaaaaagtgggggcccggggacctcggggagcgacatgtcgggggtcggggcgggaaataagcccaaaaatgtcggggatcggggtcggggagctcggggtcggggcttaaccctaatatcaaccatcaaatgaatatacatttttccaaattgaggggaaaattttccaaggttttttttaattccttaaatttaatcaaaaaactcgaaaatagctaaatatgatatatagaataaacaaacaaacaaacaaataaagctaaattaattttgaagaaatttgagataagaattgcaattttttgtttttatttttggcataaaaatacattttttattgaattttcaagaaatacccaaaaacgaagtttttttttttgttgccagccctagtgatcatcattttacctccatccaactgtctgtgtccggatggtagtctccaaaaccggatgttgccattgttgtaatacttaaaaaataaattaagaaaaattattatttatttaatttgattaatttgtacctaaaataaatggccgaaatgattggccattgtttcagccaaacagaatatattaacaggccgacaacattgtgcagaataaacaaaatgattattggcatcattggcatgcgttgtgcctccaccaaagatgaagcttcagaaatttcctaaattattattttttgaaattattggaataaatttctttgaataaataatttttagaaatatttatgactcattattaagtggaaaaatagcatttgaattttattcgataataattttgaatatatctaattattaagcccctttatgatttatttaattttaaaaattatataattattaaatctttttatgattatgttaatttaaaaaaacaatttttaaaattgttaaatctctttaagaattactttgggtatttgttggagaataaaatattctacaaaaattagttatatataattaattattaaatttcgttagaattgaataatcaaaaaataataatttataaatttattctaaaattaattttatgattatttcacctcttcctttttcaaaattttgcgcaaccatttcaataactttggccataaaacacaacaatattcagtcaatgtacggcccaagttggcaaaagcagaaaataacattggaatgcctaaaaaaggaaaactttttaaaaaaataagaaaaaaattaccaattaaaatgtataataatgtaaatgcttggcttaatgaattgctcgcgcgggaatcgccccaaccactgaaaattaaaaattctttttaattgtgttatgcctttattacgagaaaaaagtaaatttttttttaattcttaacatgcaaaaagtatagcattaatcaaaattaaattatgagagatttaatttattttcaatttttattcgttgaaaaaagtccaatattttatttctatattatctataaattttcaaattgcattaatcatcattattttttatttcaattaaacagattaatgattatattttaattctttacatgaaaaaaaattaattaaataaagtttaataaaaaaaataaatttatatttttttaaacatttaattttaaattttacatggttgttaagagctgaaaacaccaaataacagaacggggaaacgattttgcaccaatttcggagtcaataaggcgaaaaacaagcgatccagtcagaagccaacagatcacagaggcaatcagagcaatatgtgccaaaagattgatcaaaaactttaaataaaattgaatatttttatttttaatttttatataataatacccaaatcgtggtgtcctcaatttctttcatgtgaacaaaactttctgctttttggtccattcatcgtcgaaaactttttttaaaataattttattaatgctaa

SEQ ID NO: 20441 - DNA, 2222 bp, Heterodera glycines
  misc_feature (2183)..(2183): n is a, c, g, or t
aaaaatggggaatgcaagttttgcctgtttgtttgttttgatataaattaattgttccctcctcccggtgcacagatttacctctgttttgaatgtgtgccgccgcgcaatctgtgcaacgacgtgcgcctgtacaaccaccggacaaaattccatcgtggccaaaattcggggttcaaatgcaacctgtgcaatcagaagtttttgacgccgcgcaagttgcgcaagcacaagaaaatgtcgcatgtgttcaccaagacttaccagtgccatttctgcgaggaactgttcatcagcgaaacggcggtgggatatttttttttacacattttatgtactgatgccataattattgggatttggtacctcatttaaaattgaaatgtcaccagtttggtaagcatttattgttaccgccaacttcaaaccttggtatcttcatttctaaactcaaatgtcatcagtcggagaatttcttggtacccccattttcaaatcgtggtacccctattttcaggtcttgctaccttccttgataaaatcgaatgccatcagttggcaaccatttcttggtaccccaattttccactattgatacttccattttcgtaaattcaaatgctcattgtttttttatccaaaaatgccattttcccatgataggtgaccacccacgagcgcatccacacgggcatcatcaaatttgagtgcaaaatttgtgactacaaatgcaatcgtttcctgaacatggaggaccatgtgaaggaggaccatggctatctgtgctccatttgtcagagcaaactcagcgaatggggtgacctcaaaaatcacatgctcatggaccacggcggctatctgtcgtcagagttcaactcaggtcagactggacaggaccggcggcgtcatttcaatctcttcctcctggtgtggtggtggtggtcaggcaggctcgtaaccagaaaaacgaaaattcggagaggagttagttccatttttgtcccaacaaatttttgcggtaattttcagtatccattttggtgatttttgtttcaaaaactgagagagtaaccaattgataggcgctgccaacaaaaaaaatttttttttaccaaatttgaaaaaatatttgacagaaatatcaaaaaagaatgaaacctcccaccttccatggttatgtgcctgctttttcttgggtcatatcattcattatttattaatggcgttttgaattttcggccgatatctcatcatcgcttcccatcttcaacattaccaagaaccattcaattcattatacgattttaaaaaaatggattttatcattttaacaaatttgcgcattgatcaaatagccagccaaagagtgctaatggctttgatcgcgctgctttaatgtgtttttaaggaatttgtttattcaaaacccatttcagccaaccaaactcttacggtataccacaatgggacgaggccgaatttgttgttgttgttgttgttgttgttcttattgttgttacccacccattgggcgaagcgaacatttcttattattacaattactgtcatttaaggaaaaaaaagacaattttaaccgctcattttttattcgcttaatcacaaacattttcaacaaatcttgttacacatatattacttttttttttacttgtttcttggcgaaatttttgtgatctgacatataatcaaccggcacaaatcccatggtggaaaccgccggatgggacacactttcagagactgtgaatggagatgtgctgtttcagggtacatcgaaagcccgcgcgtttggctgatgttcaagggggactgattgatttgacggacgatcgatcagaggaaggaggagaaggaagaatgccgccgtcccggactgatcggtggctgtggcaaatgatctgagagaaattccaatacgttttttttttgtttctggcaaagtcgatcaatttccgttttatattacagcactcgaattttcacatgttgttaggacacatttccacaataaaaacaataatgataatgagtgatcttttccccttcaaatgaaaatggcatggcatacggggcgtatagcctttgatggtgctgattattttaaatgggtgccaacaaaatttggcacaaaaaccgtccgccattggtggaaattttattgnggttttttttggtccgtaaattcacccaattttgcctcc

SEQ ID NO: 20442 - DNA, 347 bp, Heterodera glycines
cgtttgcgctaatttttgtatccgtgcggggtaggcgatgtactagagctcggagcgggacgggatcccgcgcggggtcccggtccgcaatcccggcatttttcggaaaattcggcaattgcatgataatcgcgcgggatcccatcccgcaaaatattttagtaatctaatctcgaagcaaggatacaaaaatttgaaatttccttgctctgttgcatatccccccccccctcaccacccaaaaaatttctagggaaaaaatataattgtttgttgggaatttgtcgctttatcccctctaagacaaacagccacttaatttttaggcgagaattggtttctgaaaa

SEQ ID NO: 20443 - DNA, 2236 bp, Heterodera glycines
  misc_feature (66)..(66): n is a, c, g, or t
ttcatcaaaaaataatttaattaaactaaaaaaatttatctactgtggaaccaaacatttaaattnattaaaagtaatgaactttaacccaaaaaatacaaagaaaaataatgttcaccgtccggattcgaacctgctgccccccccccctcagaacatgtcccagaatccccaatcacacagggattctgagatcttgacgatgtcaaaagtaaaatctgatcacgtattcgtgatcagcggcccaaataacgcctaaagacatgtttttggaagatttttggtgaaaaatttttttcacttaaaaaccatgtgctcccccctttggtcccgaatcccaaaagcacttttatttttgtatctttttttaaaaatgtgatagaaatgccaaataaaatttatataatagagcaaaaaattgcggatttttgtagtattttacttttacagtatgacttttcagaaccgagttatgaatttttttctgaaaaatcgaaaatttccagaaattctggaataactttttttcttttgaacattataaaaccaaataaatctcataaaattctcccgattttttgctatttttaaagctttaattcacttaaattgaccagtcctccattgagttatgaattttcaagttttaacccaaatttccaaggaccaaaaaaattaaaaatattttcgaatttttaaaaaattccaaaaaatctgaaacttaaaataaacatcatatttgtgctcaggaccctaatttaccccagaaaaaattttttcaccctctttttcaacccaaaaaaaatgtttgaaaatttctagggggcctagctcgaaaatttttgaaaattttcgaaaatgaagtacaccgttcgatagagcttaaaaagctctacaattttgctctaaggccatttttggctaaaaccaacccctgacgagttatgggcccgggactcaaatgtcccgctcaggccaaaaattttttctatttccggaaaaaaatcgaaatttttccaaaaaaattaccagtcgatagagctcaaaaaatgatgttttggaagtggtctttgtttttcctgaaaaattcgttaaaaattcctaaaattcaaaaaccaaaaaaccgttttttaggcctagcttgaaaatttttcaaaaatttcgaaattttaaaacttggttggatagcctttcaaatactacacatttttgctcagaaacaatttttcggtcaaagcaacccctggcgagttattcgcctggtactgaagtgtacacttttgggtaaaaaaaattagccaaggctacagccttgggcgcccaacgtagggcttaggttttgctggcaaagttgtcggggatagtctgacttaaaatcctaccagcaagagctaagcgatcccggtccaaagaaaaaatttcgtagaagaaaaactgcaagaaaaagtgagaaatcggtccccgggactcagttgggcgtcgagaatttttttctatagttttcccggatgcgcctcaaaaagttgtaagacccttccactactttcagacccgtcccattagccgttaagctcaaattagtttttgaaacgaaactccttgtcaatataacgtatatattaattaattaaattaaaaattaagtaattcctttttttagtcatgccttttttttatattaacgaatggttggttatgaatgtgatttaaaaagcaaaaatttttattttatttatgtaaatcacttaattttgcactttattaatttctaaaaataccttttatgaatattaaaaaagtcattttagttagaaatttgtaatataaattttaaatataaatatttgaattcttaatcaattaataattggtttctcatttactaatatgttcaataacttaaaggaaaaatgaaagaatttcataattattttcgtataaattattaacgctatatttattatttataaatttattaaaaattctgattatttaaattggtgaaccttttccaataaaaatatttttttcatcttttcatataaaaaaattcatttataaataataaaaaggaaaggaaataatgtgtaaatgtaaaataaatggtactctactaaatgataagcaaaaatcaaattataaaataaaaagattaagaattaacttagcaattaaataaaaatataataactaaggaaggtaaataatttatttttaatataatatacataattaa

SEQ ID NO: 20444 - DNA, 2439 bp, Heterodera glycines
  misc_feature (181)..(182): n is a, c, g, or t
gatttagagcaattttggaggatttttttaaaattatattttatttttaaattataaaaaatatttgaaaaaaatattttatttaaaatgtttttgaaattctggaggagaaccaattatataaaaacatacccggtcccaattagaattaattatccctcattaaaaataaaataataannaccacttcacattttcagtgccattttcccgcttgtgccgccctgtaccaatggaatgaaagtgatcggattagagatggaaaggacggacaatgtgcacagttccaacggcgtataggtcagcttgaacagattggcgccccacagcggacttttagcacgatcacctgacaaaaaaacataaaaaaactaaattccgaatttggcataatgcacattagcaaaattcaaatcgtgttttataacacctcaaaataattagaaaataattcatctactgggcctaatcaattccgataatgtaaattttcggaaaatgatcgagatgagaattttgaaagtgggcctaatgagcgattgaatggaattttgaatatcgaaccaaatcaattttcaatttaattacaatttttccgatcaaatcttcgtcttcccatatgggagacaaattttgctctggggctgatcagagtgattgcttttatcaatttgcaatcgaattttagaacatctttagtcctacaaaaagtccgattctgtctgtcatcaccgtactttgtgtctaccgtactttgggactcaaattcgccgtagccaaaggtgtaaaaatgggactcggccagcggactgatcaggcaacagaaacgggccaatatatatacggtattcaatgtcgaaaatgtggcccaacaaaatatggtgaatagttttgcgcgtcgtaccgtaatcaattgactgtactgaccgtacaacctgacaaaataagaataatttggtaacaaatttacaaagcaaatttattattaggttaagcatcattcagttaattgcaaatcctcacgttatggcaagaagacgatccaaacaaatggcggacatctgttttgaatttcaacaaaatttataaaatttaatttaaatataaaattataaaaaaatattttatccaactttaaaaaaaatacatttaaaaaataaataaaatcgcaattttgtatcagaaaataacagaattagatataattttaataatgattaattatatacaattttattaaaacaaatatttgaataagaattttaaattaaaaaaaagaaattatttttattagagaaaaaaacttttttaattaaattattttttaagtattgtcaatatttaatatgtgtatttatttttattaatataaaaaaaaattttgttcaaaaaaacattatgcaattattatatatatgctcacatgtgttagagtgatgctcctaaaaaacaattaaaaaaagaaataatttgtctaattagtgcctaattattaccatgccgtccaatcgattacattaaaaattcggacaccaatcgctgggatgacaacacgacggagcaaaattggaggatagaaaaatgtggtggtgacaatgccatgcaaaatgtcagccaacgccaggctaagcatcagaacaaaactgaatcaacaacaaaaaaaaaataattggggaaaaatgatttaaaaacatttaattcaaagtaattagattaggaaatttttaagtaaaaaaaaaaatcgtttttttacaaatttgttttgcattaaaattttaaatgttaaaaaaatatatgaaaatttgagaataattcaaaacatattaaatcataaaatttaaaagcaaagaatgagatgaaaatttatattaaaatttaaaaaaaatttaataaataactaaacctaaaaatatttaataaaattaaaataatataattaaatttaacagaaaaaatatatttaaaatatagaaaaattgaaaaataattttgttttttcatttatttagtagcaatttaaatgtgaaatgaaatgaatttcaattttcaaaaataaaatatactaaattattttttatatatatatttttttaaatgttccacctcgccctctgaaggtatctgttcctcatcagcacaacaacaaggcaacagttgccaacaattgccaaagtgcccaatgattccaacgcaaaaaagacgaacttaattagcattaaataaatttgttggcacaattttggaaaaattaaattttcaaattcaaattttactgctggatttacaacaaaatgtgatttgggaatttacaattaaataattattagggacgtgaattttagtgaagaaaaatcccgaaatagttaactaaaatagtgagtaaaaagtccaaaatagtgacgaatagtgacataattttcagccaaaaaatgagcaaaa

SEQ ID NO: 20445 - DNA, 1028 bp, Heterodera glycines
aaaaaagcaataaatttgatttcatgttaatttgttttctgaagaatgcgatcatctttagctcaattgcgcaaattatcctctggcaaggcttttgtaagcgcaaaattttattcggcaaaatttgattatataaatataaatttttaatcaaattcattaattatagtttttgaaaaaaattatctttaggtttgtgaaacaggagtgatttcgcaaaaattaaaaattgcaggatattaaattttacattgttaaaacaaaaattttaaataaattatttaggtattttgagtggaggctaatagaagcagacggggaaatctttatgatttcgattatttcttatagtaatggtggaggtcgcagcggtgcctttctggcgctggatgccaccccccccctcacgggggcagggggcgggaaatgtgccgaaatctgccaaaaagtgaaaagccgtggcgccacggcgcggaatggcttttccaccggcgagccaatttttgattgtgccgccgccgcctgcgggtcgatgcgcttttttttgaagtgaacggtggaaaagcgccattttggggaacgcaaatttgaaaaatgtttttgcttgggccaaaaatttaatggtgaaattaaaatatatatatatatatatatatatatttaatctcatgataaaatgaaaaaatggaattttaaaatgtaaaaaactgaaattttatagtaaataattttaaaaaattttaaatttttaaaagtcgaagaattatttttggtgtgtttcgttcatattaaaataaacttaaaataataatttgtataaattatgtaagaatgcaaacaaataatttgattaaggaaatattaaaaagtattgaattaaataaaaatatttttattattgaataatcatttttcatttgtcaatgattaaaaataattcagaaaatattatttgttaatcttgagtagaaataaaattaaaataagaaaataatgctttttcttgtcatttattatttacattttcc

SEQ ID NO: 20446 - DNA, 2790 bp, Heterodera glycines
  misc_feature (67)..(67): n is a, c, g, or t
agatagtactaggcttttctctgcacagtggagttgacccatagtgcaagaatttatgttgaaaatntgaagattaatttaaatatatggaatagtccaataaaaaataataatttaaattacgcgagccctttggacattaagaaattcgttcaaaacatgtccaccgatgagagaaaaaatttcacatttttgatgaaaacccaaatccatggggaacaattcttatccacctgccccctgttcgaaaatagtttttttggaaaaaaaacttgctgctaaaaaacatttttattggttttttttcatttgaaataaaatttttctaaatgctggcttttgacccctaatgattattttttaggccaatactgattttgaaaattttcagttgatgtccctgattttgaaatggtaaaaaattttttttaaaggttttaaaattttctgactttttttatcaaaaatttccgaaatgggaattgttcggggaaatcggaattccgaccctaaaaatatccgaaaccggaagtcggattccgtagcgtcactaatcactaatactcgctactctttcggcaccggcattgatcaagacactaatacccgcagaaaaaaagcacattctgccaaaaatgaatgctattttaaccattacatataacaatgaatcgaaaattcaattttctgcacaatttcaattaagataggtatttaaaaaattgaaaatatatttccccaattggtttttccccatttttctgtccgcgccattctccgcccgatttgtttgctcactgaagaggccggacaccgggcacaaatgaagcgaagttgcatttggtgtcatccaagaacagggccacttgtcggccaaagcgctgacgctcttcaacattggacataaattctaaaaatttctgatggctcgtgtttgggtactcccaaatttggcgccggttgtccttcggcgtcacatccgtccgcactggccaagtctggacagcgttctgcaaaaacaaatgtgaaaataaaaaaaattatgatattaatggacaaaaaaagcatggacatttaaacaacgtggttttttgccaaaatttttactgtccgatcattcattaacggattaattcggaaaatgataatttcccggctaaggcggggtatggccaatgccagcccgagcaaagcagggatgtgcaggaacgagaaaaagtcggaattcgggtcggaacgactaaaaacttacgagtcgggactcgggatgagaaaaatttgggagggacaaaaactgatgggattcaaaccgtgatggccacaattttttggtcgagattcgagacaagaaaattatacggggttcgggggtagtaagcatccctggtgcaaaggcagattcgtttctacccaccggaccatcgatgtccaattgccaactcatgaacagcttggcggcctccgggtgctttgcgtccttcagaattgcgccgtaaatggcgtacgcggtgaacgggtcgttgtccgcggggatgacatattcggtggccgcccccgcgttgtttgggtatgagccaaagccgccaatgatcgccttcagagtgccgttctcgagcgcctgttgcaactgcacaccgccgcaagtgatcagctggtttcgttgcgcgaactgttcaagccattgccaactgtatttgtccacaatctttttgaatggaatttgatatacggtagcaataatacatgtagcattacttataagttaaattgatttaatttagggttttaagtcatttagggtaatttgttaataggcgaatttaacgaccgatgctcctcctacctgtttgtaaatgaacaaaactgcgtcatcatggtttgggtcagcagtaccaacagtgccattagcgaattctgctgactgcaataaatcaccgtaggtcggcggattggtcgaatttgagaccaaatttttgttgatactaatgcctagtgtcatcaccttcaaatgaatttgaattaattattcctttttaattataattattaaagctggaattgtatgaaaaagaaatctcaaaatacaaattttttataatattttttttcacaaaaaatctttgaaaagaatgaataagaccaaaatgccataaaaatgaacttattaggcctagaataatgttttaatactttaatttaatttttgataacaaggtgacatttaaaaaaatattttttgaattttttatttaaaaaatatgtaaaaaaagtgggaaatatttaaaaatatgtaaataaaagaaccattcacaaacacctattcagagcacttagaaatcagaaaatataatatcttaatttacaaccctaataattatttttcacaaaaagtttgttaaaaaaagcaaaattaatagttttttttaaaagttttaattggcttttacaaaaaattttagattattaaaaataatatttttaaaaattttattttacaatatttttcagaaaaaataattttaaatttagaatatattttaaaaaggtgatgttctcaggctgttttttaataaaatatttgacttttttaaaaactttgttatttcacaaaataaatttttactttttttaaattttttattaaaataaaattttaacgtttgaaaattaaggaaattattttttcaaaacgatttttaggacaactttacagcaaacatacgtataatccggtgaagtagccatccgggtcgcggaatgcgcggtacactttgtcccatccgcgcggtt

SEQ ID NO: 20447 - DNA, 315 bp, Heterodera glycines
cccccctcttttccaaaatgtttctctttccccatgtgtgtttttgtctcccccccctccttctcaatgaatgtctttccctcttcgactgtttgtctcccccccccccccccctcttccccaatgtttctccttccccatttgtctcttcgtctccccccccccctcttccccaatgtttctcctttcccttttgtctgttcgtctcccccctctcctttcccttttgtctcccccccctctcttccccaatgtttctccttccccatttgtctcttcgtcttttccccccccctcttccccaatgtttctcct

SEQ ID NO: 20448 - DNA, 2146 bp, Heterodera glycines
  misc_feature (1977)..(1977): n is a, c, g, or t
  misc_feature (2020)..(2021): n is a, c, g, or t
gaatttttttctgaaaattcgaatttttccagaaattctggaataacttttttccttttttagatagaaattccaaataaagtccataatgttctcctgatttttctctattttttaggctttattcctgtaaaattgatcaacccttcgatttgttatgaattttcaaatattaggccaaaatcccgagggccaaaaaattgccaaaaaataaagaaattttaaaaaattccaaaaattatgaaacttaaaatagacatcatattcgtactcagcaccttattttaccccagaaaaatatttttcacccccattttcgtccgaaaaaaaattttcgaaaatttctagggggcctagctcgaaaaattttgaaattttccaaacatgtagtacaccattcgatagcatttaaaatgctctacaaaaatgttctaagacaatttttcgctaaaatcaacccctgacgagttattggcctgggactgaaatgtcccgctcaggccaaaaattttttctatttccgggaaaaaatcgaaatttttccaaaaaacccaccagtcgatagagctcgaaaaacggttgcttgaaagtggtctccgtttctctgggaaaaatcgttaaaaaatcctaaaattcaaaaacccgaaaaccgttttttaggcctagctcgaaaaattttgaaaattttcgaaattttaaaaattgcaaaaatcgagctcattgagctctacaataggtctgctggccaccctgcgctcaggtcaaagcctaatgagttattcaacggggactgaactggacaaagttggtactgaatttttgtagaagcacacaggccagggggttagagatagaggcctggaattttttttaacttttagccaacacttcaacttagggccctcacagcgagcattttttgatttgagttttaggaaaaaagttatgggccccaaactgcgagaaaaagtaagaaatccttccctgggactcagtcgtccgcgctgaatttttttctatagttttcccggatgcgccgtgaaaagttgtaagaccaatgcacaactttcagacccctaccgatagccgttctcgagattttggttttaaggatgagttgccttgtcaatataacatatatataactagccggtgtgtgcttacatgtttcttggtgcttaaagcgcttcgcgctttgggagcttcgctacctaggccttgtgttagggtctttgcgtcagccgacatgcacttggtttcactcacgtgatgagctgacacattgcatttatcagtgcaatggaaaccggaagtgccctaactcgcacgtcatccctcctccctcccttagtccaggtggcagcacttaatagccatatttaagtgcagatgagaatgaggcggcatcggtaccgcacacactggactatagctcgtttgatttatgcaattagagatccaaggctttgcacataatcatgataagcgctaagtggcgaataacctggaggccccataagggccgaccagtttcaagactatgctcaaggctatcaccacctcgcactcaatatgttaatgtgaaaacagttggcatgacaaactggcttggattgctctttattgcaatttgagcatgtttgttgccacaatattcagcacctttgcttgtccttggttgtctgtttcccttctgggagcgtacactcggacattgttcccatccgttgcccttgaaaaggctgtgtacaatttaccatgggaaaaaacatccctttctaggtcaattccgacagtgctgattgtttggccttgacctttgagaatggtcatggcgaatgcaggtttgatgggaaactgcaaacgctcatattttacgccgccaggcgttttgtcctcgtagacattgcgtgttctttctatgaagaacttaacctggccaccaacagcgttgctgttgattacgcgaccgaccanggcgatcgtcgccaagttcttcaagaacaatgcgccgtggcgnntgatcagtccttccttaatcactttttgtgataaggagaacaacgacgctgccgaccttgagtcgcagacgggggggggaggcatcccagagctggtgcgccggttcacgctgccacttctgact

SEQ ID NO: 20449 - DNA, 1533 bp, Heterodera glycines
taaaaacgggcgcgaagcgcccgtcctgaggccgcgaagcggccggatccctcccacaaaattaaaaaaaggcgcggagcgcctttgagtccgcgaagcggccgaattaaagtacctcttctaatcactcttctaatctgagtccacaatatttagaagcgcaaagcgcccgtctgaggccgcgaagcggccgaatgcacttgctcatcacttatcaaacgcgcatgcactagcaacgaagtccttcgcgcgaagcgctcatgtaatgcatattcttttcatctctcacaagtatactgtttacaccgagcaactactgcgccacacgctagtttatactactatagagaaacgttgcagttcgtttcaaaaaacaaaatctcccggccgaaggccgggagcgccccgaaagtagtggaagggtcttacaactttttgaggcgcatctgggaaaaataagggttttccgctccggtggccaactgagtcctggcggccaatttctcacttttgcttgcgtttgatggcccataactttttttctaaaactctgatcaaaaaatgcttgctggtaggaaactaagttgaagtgttttctaattttcaaaaaaaattccaggcctctacctatacttggaagggctgcagaaattggcaacttttcagtaccaactttttccagttcagtccccgttgaataactcattaggctttgacctgagcgcagggtggccagcagacttattgtagagctcggtgagctcgatttttccagattttaaaatttcgaaaattttcaaaatttttcgagctaggcctaaaaaacggttttcgggtttttgaattttaggattttttaacgaattttcccagaaaaacggagaccacttccaaaacatagtttttcgagctctatcgattggtaattttttcggaaaaatttcgattttttcccggaaatagaaaaattttttggcctcagcgggacatttgagtcccgggcccataactggtcaggggttggttttagccaaaaagtgccttagaccaaaattgtagagctttttaagctctatcgaatggtgtactacatgatgtaaaattttcaaaaattttcgagctaggccccctagaaattttcggaaattttttttcggacgaaaatgggggtgaaaaatatttttctggggtattttgatgtgctgagtacgaatatgatgtctattttaagtttcataatttttggaattttttaaaaattctttattttttggcaattttttggccctcgggattttgggtgaatattggaaaattcataactcggtgatggttgcatcaatttatctataataaagctttaaaaatagagaaaaataaggagaattttatgggatttatttgagttttttatttcaaaaaagaaaaaagttattccagaatttctggaaattatggatttttcagaaaaaaattcgtagctggcttcttataaacgattcgggaaaagtaaaatactacaaaaatccgcaa

SEQ ID NO: 20450 - DNA, 1670 bp, Heterodera glycines
tccatttttgactgtttttagcgtatttttaagtctgttttagcaaatattgaatatgaatatactttttggaataattttttaggctttaaaagatatattttggcagtttttagtccatataaaaaatgcaataaaaacggaaaatatacccctaaaaatcgaacgaaaattaaaaaaaaaatacaccattaagaaaaaaagacttaatttttttatttctatattttttctgattatcttcgagaaaattcactcatcatatacagagcagcttgttgttccgttcgcacaattcaaatttgactcttttgtcttccatagaattcgtttttcttattgttttaaatttattgttttttaaatttgagcgactcatcaaaatattttttcatgtaggatttttgtgaaggtagtaatttcatttgttctcttccagcaattcacaaatctcatttgtatttaatttaatttatttatattatttcatgcttttagaagtaattaatgctaatattttatttgttataacgtgattccaacgccaattatgtctccatcctagttaattcgtatttaaaatgcatttattttatgtgcatttccttttctatttacatttatttatttaaaacaaatcaaactctaatttattaactaacaaatagattttaattttcttgacttgagacatctctaccgaactatccacaacactgacttggttatattaatttcaatgaattgttgttctattaactatataagtttattattttttttattaaatgtattttgattatttaataaacacaattttttttgctgttattaattacctgaataataaaaatattttagttgaaaaatattttttattattttttttgaagtatgtttggatatttttcatttattttgatttatatgtattcaaatttatatttctcaatttattatatgggtttttaataagaaccaattagacagacattgtaataaacacaatgaaaaaataaattagcttattatttgcttgcttacaaattaggaacaaattgggtctccttgaataatgattcattggcattaaaatttaaagtgttaattttgctaaatactttaattttgatttttttttttatcttggaaattcaatgttaggttgttttttatatttattatttatcgtgtttctttcaataagcaaaattgtctgcctatacggtggtggatggcatattgtctggacaacggttgtgaacgaattaacggaatggcttagtatattaattgtacactcaattgtttatttcgcagagcaatattttcctttcacaaatataatttaataagaatttctgccttgtcttaaattttacacatgcgacgaactgtttatcgaacgaacccattaaggaatatttattaattttttcaattctatgtaatgatattttttttacttcagtcaagtatttttagtagaaaattatttatttgtaatttcaatttccttttgttaatttagtatgcattctccaatatctcttatcgttgaagtaagcaatttctaattccaatgagcaaatattaatttccgtagctataccacagatgcagcttgaaattctcttgatcttcatatgctctttgaattgtttatatgt

SEQ ID NO: 20451 - DNA, 1089 bp, Heterodera glycines
tgggttcgtgagggatcttgctttatgaaaaccaaattgtgatacagaataattttgtattgctcaaaatttaattatttccctgactaaaattctttcaaatactttcgtgattgtaattgtttgtttgaaattattcgtgaatatgtttggatgtggttatgtgtttttcttaattgtttgtgtgtttgtcgtatttatattcgtgactgtaattgtttgtttaatagacagtatttgtgtgttttctaattatttgtgtgttttctaattatttgtgtgttttctaattatttgtgtgtttttcgtaattgtttgtgtgcttgttgtatttatatattcgtgattgtattgtttgtttgaaattattactgaatatgtttggatcagtgtttgtgtgtttgtcgtatttttattcgctttctctctcctctctctcccggtctttctctctcatctccctcctgtctctctctttcggtctttctctctctctcaccttctcctatttctctctctctctttcggtctttctctctcctctctctcatcttttcgtgtttctctctcctccagctctctccaattctctctaattttctcacattctcttacaaagggaggtggccaagtgtccgtgggatttccaaatgaaacttggttggatggatagagcacccatgggttcttaagaaaaattgttttattttctgccaaatgaacacgagtgccgagttatgacgtgccaaagtttttagttttataattaaagaaaataattaattatttacatatctccaatgtgttgtttgatgtagaagtaatgtgttagtcaaaatttttattggtcacaagttcgaatcccctttgtgtaaatccattttttaatttttatttttcctttttatgagcacttcaattagcaaattttatttctttatcaaaatctttattttaattttattccattaaaaattgcattaaacataaagatgtaataaaaaacctgtcgaattaaaaaatatatttttgtctaatatttttattgagtattttatgcactaaataatttcaaaaaaataaaaataa

SEQ ID NO: 20452 - DNA, 2022 bp, Heterodera glycines
  misc_feature (1877)..(1877): n is a, c, g, or t
  misc_feature (1941)..(1941): n is a, c, g, or t
  misc_feature (1976)..(1976): n is a, c, g, or t
  misc_feature (1988)..(1988): n is a, c, g, or t
  misc_feature (2006)..(2006): n is a, c, g, or t
cattttgtggctttttgataggtcaatgaggatttttttggaaaatgaggatttgaggatttttgtggctttttgagaaattttgagaatttttgaggcttttggggaaaatcctcagaatcttttaaattttgataaattggcataatgtttggcaattatttaatttgaattttggtttttaataaagtatcaaacggaaatctcacccaaatttagccagaaaattacaatttttttcgaaaatccacaaaattatgaattttttagatgaaaatctgctaaaaatatggtcaaaattctcaattttttcccctccggcggcgcctatcgatcggcaccgccggaccctaaaaatcctttttctttttttttcaattttactcaaaatcgcaaaatttggccattttgtggacaaatctgttaagaaatcacattaaaaattacaaaaattttcccggcggcgcctatcggcaccgccggcccctcaattccccaagttttttggaaaaagcgccgcaaaaaaaattaacttcgatttttcatgctcagaatctcacaaaatgcttatttcgaacaaaaaaaattactcaaatcgatcatggacaataaaaaatataacatttgaacattttatacgtgttttgaataaattttgtaaaaatgaggctttttgacccaaaatgaggctttttaaaattttcatcttgcaaccctgttttaaaccgataattttccttatacatagtcagcatcaaaattatactgtaaaattaatttttataattatttttcttgaaattttgttagaaagaatttatttctcttaaaaactaactttgaattttttttcaattttaggagagtgggaggaaatgtaagtgtgaaaatttgacggtatgcccgggcatataattagagaaaatacggtaatttataaataaatttaaaaaaaggcaccgctggccggcaagggagtggagggggaaggtaaaaagacagagggaagggaagaagggtgagcttttgtcattattttgtgaacggaaggaacagttctttttttctttttggtagttagggatgtacgagtctcgactcgagaaatttctcgggttttcgcttcttggtctcggtaaaatcacttctcgcacatccctattggtagtgcattcgttgacaaaacacacagtgctgggacgttagtcaaaaaccatcaaatggaaaatttttgacagaaaattattcataatttcgtctaaaatagatcaaatttatgtaggctaatagaaaacacttagggctctctaataatatcaagaattaaaaatctagatgcttttgagcaaagttatatcaaaaattattttcatttgaaattaattcatacattcatttgtcaatttattcgtaaattattttttaataattcgtacagtcaaataattaaaaaaatttctattaagaaagttgagccagtactttacatttaatgtcgaaaaagggtaacatttatttttttatttttaattgtctaaaataataaaattaattttaatttttaaaaaaccatctctagccaaagtcttatcagccacaatcacagcattgtgatttggtgccatgaatgaatttgccaatttgcaaaaaattgagaattttttttgaattatattgatcaaattaaagcctttttatgtttttacatttctgtataaattgcactgaaattttaaaattcccggcggcgcctacggcaccgcttgaccctgaaaatccttatttttcttgagaaatttgcctcaaaatcgctaaattggtcattttttggagaaaatttgttaacaaatctcataaaaattccaaaattttcccgngcggcgctttcgggcaccgctggaccctcctccatgttagcaaaaagtttttgaaaaaagcgcngccgttaaaacgttaaatagtcactccttttcccnaaaatttctaanataatgaaaatgacatanaaaagattttataaat

SEQ ID NO: 20453 - DNA, 479 bp, Heterodera glycines
aaatcttacttcatttaaatttgctgaatttcctgaaataccaaatatttcaaatttattttcgtttccttgaattttctcagtgtcccgacatttgcggtccagacatttgcggccccgacttttgcggcccgggttttgctcaatcctggacaaccttcgaaaggatattcccccggaaatggggtctccaggccgcgaactgttctcatggttctccgactgaacttctggtgccttggcgcgtgggcatggcgatgcgatttgttgccaggggcgttacgattggcgtcgtccgtctccccgggggtgggtgcagcccgtgccctggcgatgtgtgatgctgggttaccgcatccggatactgatatactctccgtccccgtggtgatggtcgccaacacaacggacggaccgatggacggagggcactgccggggggggggggggggggtcggaatgtgccgaaccgaacctcg

SEQ ID NO: 20454 - DNA, 780 bp, Heterodera glycines
aaaaatgtacgagttgccctgtgacaccaaggatgggttatgatgccctgtggtagaggggaaattgttcaaaaaaaaacaaaatttaaaaaaaagtttcaaaattttttggaaagaggttcatcttgaaattttaggaaacactgcgcgaaaaattaaaaaaaaatttgcttaaaatttttctaaaaaatttataaatttaaaaactctttttttaattcatgtgagggagagggcgaaaaacttgtaaaggggcgaaagattttttaacagatttggcatgaaaatgattttttattttctggcggaatcttttcggacaacctggcaaaaaaaaaaaaagaaaaatccaggaatctagaaaaaagccactgatgggcgtcaaaaaagcccgagttttcgctgacctgggccttacaattaaaacttttttttccaattttactcgaccactcattttcacaggcgttggaacgacgcattttggagtacatacacaaggccggtgtgcacaacaggaagtaccggtacatggactacaaacagcaaatccttgcggaaggtgaacacgaagaggaccccgtctatccgccatttatctgatcactgatttttgatgccgacacatttttattgtttcaaccatacattttttgtttaaaaaaattagtaaaaaataagttcgtctttattttattgtataatttattcgaatggtttttggcctacaaatttatcgaaagggaaaaaaaaattttctgattaaaaaaaatttttttt

SEQ ID NO: 20455 - DNA, 2572 bp, Heterodera glycines
  misc_feature (2568)..(2568): n is a, c, g, or t
tcatagcaccgaccgaagaaacggcgagcagaaaaagggaatggcacagtgaattggaatggaacgcaacagaggagaggaggaccaccaaagagaatattttgcaaaattatgaccatttgccgggcgttttaccttatccccccacccacaaatcaatcaatcaaataatcaattggacggatagagagagggaaaggatgaaaatagcattggggaaggaggagagacggaagagaaagagaggaaaaggaaaaattcgaagcaagaaggaggggagaaagaggaggaaaaggatgaaaatagcattggggaaggaggagagacggaagagaaagagaggaaaaggaaaaattcgaagcaagaaggaggggagaaagaggaggaaaaggatgaaaatagcattggggaaggagaagagacggaagagaaagagaggaaaaggaaaaattcgaagcaagaaggaggggagaaagaggaggaaaaggatgaaaatagcattggggaaggaggagagacggaagagaaagagaggaaaaggaaaaattcgaagcaagaaggagggggagaaagaggaggaaaaggatgaaaatagcattggggaaggagaagagacggaagagaaagagaggaaaaggatgaaaatagcattggggaaggaggagaaagagagagagagagagagaaaaaggaaaaattcgaagcaagatttttgccatttttatacgtccgaattatttaccaatttagacattattcatcaaaaaaggcatttgatcactgatgattatgactagggatcggattcttagttttttaactattttttctgcggctttaactcgacgaaaaatgcacgaaaaacacatttctttttcgaaaatttttcatttttagtgccactattcatcactaggaatcactattttggagcttcgccactaaaaaaaaactatttcggaagttagccactaaaataattttttgccactattttggcgtttcgtcattatttttgccactattttggcattttttggaaaatttcccaaaaaatgcaataaaaacgaaaaatacaccccaagaatcgtgtagaacataaaaggtaactcgcccggtgggactcgaacccacgaccccagcaatccgtgccgtgctctaaccaactgagctactggcgcctcttttagaggttctctcaggtcctttatcccactttctcccacactccgttccttctggcatcacaatcgacctaaaaatttttcaaaaatacacccctaagaatcgacctaaaaattttcaaaaatacatccctaagaattggaaaaatttcacaaaaattcttcccccaaatttttttttcttgttcaatattttctaagaaaatattttgtaactgcaatcagtgaataaaatctttttccttaattttaaattattttcaaattaaaaaacagcctatttaaaaaattgcacccctaaatttggaactttttcgccactatttttgccactattttggaatttttttctcactatttagttaattatactttcagcctcagaaaagcataaatcagatccattcatttttgcttttcactttttggttgaggattaggttgcttttcccaaagtgccgttgtgcgagcaaagaaaatgccgtccgttcccattcactggcagaggagggcattaagccactcaaattaacccaaggaaaatcaatggacagattaatcaatggcaattaatctgagagaagagaaccaaaatgggaacagcagagatgggcagggaaatcatggcatataaaagcacaaatgaaagatgccaaaaccattcatcaccaaaatccaaattagcactaaattctattttgctcccctatttattttatttatttaccgttttttaagaacataaattttttttaagcacaagggttcttaaaatttactagattttaacgatttatttagcattttacatatttattttgtattatgcaataaaaccaaaaaatacaccccctaagaaacgacctaaaaattttttcaaaaaatacacccctaagaatctacttaaaaaatttcagaaaaattaccctcctaaaatcgtcccaaaaattaaaaaaaaatacactcctaagaaattaaaaattttcccagaaattcattttcatggcatttttggccttaaaaatcccagtcctactcatttgcaactgcaattagtaaataataaatttttggctcaatttttgttcgattcttaaaagtgtatttttcgcttttattgcatttttgttgcgaaattttccaaaaaatgtcgaaatagtaaaaaaatattgacaaaacgccaaaatagtaaattttcactattttaagtagagtgccacgggaccgggattttcggtgtcaaggcagttcgtacaatttcaaatgggaatggccataatttttttgttcgtcatttagtttcttcaaaatttgtttcaacgaaagctcaacgtgtttagaagctatcattaagcagaagctaagcgattaatcatctcaccanaaaa

SEQ ID NO: 20456 - DNA, 843 bp, Heterodera glycines
aaatccaggttgtcaaaaaatgacctggatccaggaaaaatccagaccttattgaactcacattttttaaaccaaaaaaatgtctgcaaatttgtgcatatattccaactattattaagacaacgatgaaaaattagatttataatcgtatttattcaaatttgatgtgatcaacagccattaggcacaattgttaacgatgcaatcaaagaaacacatcaacaatgtgcgcgaacaaatgatttatactgaactcaattcctcactcaaaatgcgagcagcacaaattcccacgcaaaagccaagagcacttttcacaaaggacctaaatttgacagagaaattattaaatttaaaaaaaaaattttcttaaaaaattgttaacttatattcttgaaaaaagatggctcaagtacagtttatgcgtccattcaatttttgtgcgtccaatcaattttttacatcgaattgtattgcattgacaatattcaaccaagattttctggtatatttttacaaaattttgaatatcttagcagaattaccagtcataatataacataagttgttttccgtttcttagctagattcgttaatactaacgacctttatggtagcttttgttagtattaggacaaattccgcaaaaaggccatgggttcgctcttcagtatccaaattagccaatgattaagccgtaccattccctatgatgaattaagctgcagctaaacggaaatagagctagcataaacatgatcaccggatgaaaaatttgattggacgcataaaaattgattggacgaacaaaagtccattggacgcataaattgtacttgagcc

SEQ ID NO: 20457 - DNA, 1307 bp, Heterodera glycines
  misc_feature (80)..(80): n is a, c, g, or t
  misc_feature (1303)..(1303): n is a, c, g, or t
tctttggccttaaaaatagcacgcgagacacaatcgccgcctcattcataatacctaattatgcatatccatttcatttntcgtagggttcgactggaatgaacccttgccaaagccaaccgttaaacgaatttgcgtatttacacacagtcagaattagtagaatacaattttaaatctcaataaaacatgtaatttacaaattgaggttaagtgtgcggtatttattgaaatgggagatggtcaaatactgacagtaatttctgcacctccagacgcttccaaactaaatttcaatagcctccgaagttccgagtctaccagttcagacgaggtgcttgtaaatgagttgactaaaggtgaaaatcacttaaaaatttaattaaagttaataaaactatagatttattgccagctttgcgtcgcacgaggactcgcacaatttccagttctaaaggggaagaggacattgtgacaacagagagtggacaagtgagttcttaacattacatcataccaaaggttttgtattgttcaaaattgagtttagaaagtgtacacaaagggaaggcccccatggtacgatctggcggggaagcagctcaaaaaatcgtatttgattggcatatgtggtggctcagcatcggggaaaaccaccgtggcaaaaaagattattgagaggctcgaaatgccttgggttttgcctttttttaatcttattcattttttaaatattgcaggtcactgttcttgcgatggactctttttataaagtacccgaaattctttttttaacaaccaatgatttaaaattttaggttttgaatgaagaacaacatcaactggctgcgaaacaggaatacaatttcgaccatcctgacgcatttgactttgaattgcttcgagagtcgttggtccgacttcgagaaggcaaatcggtggaagtccccgtctacgacttttcgacccatcgacgcgccaaaaacccgaaactgatgtatggagcggacataatcattttcgaaggaattctgtcgtttcataaatcggaaatttccgacctaatggacttaaaggtaaatgacaaaactaacaatacgcatggttcactaacatttaactgattatgctcaaggtttttgtggacactgactcggacattcgtttggcgcgtcgcttggaacgcgacattgccgagagggtaaactgtgagcagttttattattcactttttaatgacctttagggccgagatgctacaggcggaaaggtatccgtcgctttttcgcacattatataaaanggaa

SEQ ID NO: 20458 - DNA, 2085 bp, Heterodera glycines
ttccccttttaaattaaaatgcttaattgaattttaccttattattattcaacccctaaaaggataatcaatggcattttccatagcatattaatcgtttctctctctctgtccctttttccatttttctccattttaattttctctcaaattgccccccccccccccgagggtcgcttcaactgattgacttcgtcgccctttcccatcgctcgttttttgtcccaaattcactttgacactcctttgaccgaccccccgtcgaatgttcaaaattggatttgtttttgccctgatgttcttctgtccccccccccccctccgaccattccttcgacaattccctcggcactcatccgtcgctcaaaatgccaacccccgcgcccgacagcggcgccctttgttttgtccgcctaaattcaattgcctcgcccacaatctctgccgaatttggccaattccatgggatgggaagcctttaagaagtgggaatttcgtgtcaaaatgataagaaaaccactcaaaaatcacccaataaataaaataattgctctgatttaaatcggtggccgataattaaggcgagagaaatgccaatgagaaaatggtgccaaaaagagaagcaaaaagagcataggcatttggtaatttggtgaggtaacgaacgaagtgaatgtaattaatgatgccaatttggtaatggaaaatgtccaatttaattattaaagttacatttttaaaatttttttaaaattaaaataaacgctttttgaatgactttttaaaattaatttttttttgcaatttatcgttataaaagcaatttaatgggcaacaaacaaatggccaatgcaaacactgcgacacgcgctttttcgacgcaatcaccgccaacggcaaaaaaagtggcgaatcaccggttaaacaggcaaatgatcaaaatggataagcaattagaaaacaaagaatcgaaaataagaaaattaaatttcagacgccgttccgactttcagcaaaacagcaaaagaagcgcagaacaaacgaaggggggtaagaacaaacattggcaaaaagagaaaataaaccaattagaagactaattacataattatttcaaaaaaattaattccgataatattttatttattgcattctgttgagatcggcataacaataacattggcaccccatcgaatggaagtggcgatttgccaatgaattcggcggcggaaagggcccggcagcgtaaaataattcattcatattaataaacttatttaatttatttgttcgcttttaaggcagacggtgcagcagcgcggcgttagtcgcagcgcgaaacggcgcaattcaaaggccaaaacgaatgactccgcgccaatgccatttggtgggcatttggaaatgaagctttacttttaaatttgaggtaatcaaatcgtggagcaaaaagtcaccaaagaatcgaatggccaaagacatttttgaaggtaaaaagaaaaacaaattaataaattctattgaatttaagcgatttttgtggaagccgaagagttaaaagcaaccttcggaattgagaagggatcgaatggcaaaaggctgagaatggagccaaattttgtggcacatacgaatatgtactgtaaaagaatggaaagtgattaaattttattgttttatattttgttttattcatcaaaccgttcttttattggcactttcttttttaaggtttgccgacactttggactttgtaattcgcaatttggacgatctttcgttggtcaccgaaaacgcagaacaattgggaaggtaataagagaatgaaagaaagaagaggaggagaggaaagggaacaagagagagagagagagaaaggaggggaggaaaggagaaagggagagagagagagagaaaggaggggaggaaaggagaaagggagagagagtagagagttaggggaggaaagggaaagagagagagagagagaaaggaggggaggaaaggagaaagggagagagagagagagaaaggaggggaggaaaggagaaagggagagagagtagagagttaggggaggaaagg

SEQ ID NO: 20459 - DNA, 1230 bp, Heterodera glycines
tcggttgccatgaatgcttagtaataatttgaccggtgacctctcccctccgggcacatcgttccgcccttttctttactgtttctcctttatttagttatttttctggtgtttttacattagtttattctttttgtttatgttttcatattttgtgctcaacacattccctccttttcactcaaaaattcactaattgttcagtgttgaatatgtcgctttggcgcgtttaattgacaagaaaaacctttttttctaatttctcgaataaaaatttgtacaaatcaaaacaagcgattcgtgcaggtactgaaacctttttaaaaagccgattttgaggatatttgacggtgccgaaccaagccttaaccgctaaagatggtaataaaagcggacactagcattttgaatgccttttcaaaaagcgccatcagcgaacagtcaattacgcttgtattaacaattcagtccttaacattgttaataccaacataaatctccatcttatttcaaaccttaccttccctttcctaattagctttttcccttttttcataatccattttcctattattggcgtcgcaatttgactatctttccaccttcaaattttttacatataatctccattattgttgaattttaaaaacattttatttgataaaatgtttgaatgatgaataaaataattaaaaggaattgcgctttaattggttttatcgtttaagcttggttcatcatctatttgcagtgttaatttcgcttaatttgtgtgaatgtcgctttataaggaggatgtgtacgagacggaagacccgccaaatgcggagccaatcgaaacggtggagaaatttgagagcgaagaagtggagaaagtgcacatgagcatgggggctgcgaagaagcggttcgaccactgtttgttggactcggaaggggcaggtaaaaagggagggagctaattggttttgattgttttgtttttgcaaattggcttttatcctcattaattacttaattttccccgttcagatttctccgattcggtcggagtgagacgccttaagcggggattcaaagccagcgaagtctttgaatcggaaacaattggcagcgaggaggaggaaacactcgaacagaaatttaatcgcctcaaccgggaaatcagaaatttggcagccagaagttgaacaagtgaagacaatttgtgctttttactgttccataaaa

SEQ ID NO: 20460 - DNA, 1376 bp, Heterodera glycines
  misc_feature (1331)..(1331): n is a, c, g, or t
atcaccaatatgacatcagtcctttttattaccttctaactttgtttttcgactcttacttatgcgttcttttaattttgaggtgtaggccaaaaaccgaatataccatggcgctcttatgaatgattgtttttctgtgaaaaattcccgctatcaaaaacaaggaattaacataaaactattacaatatattttcccaattcgcagagccagaacgaatctcctagcgtcaaaaaggaagacgtcgtggccctggacgagttgctaaaaacgatcgcttcgaactgtaagaaggaaggacgccaaccgattagtcatggacggtcagaggaaagctgaaaagaacgatggacaatgaatgagtgacgattcattccaaataacaaaaaacaatgaaataaatcagtttggaatgatcagttgaaatcgttgatgaaactgtccccgtgcttttccatctcttttctgcaccgcttcacatcgatgaaaagacttctcgcctttctcacatcttcttcagtgacctaaacattttgtctgattttgtgttccctttttaaccctcgtaaatagaccttttcgccttttcttctctgtcgtaaaatgtcggcagttgaaatgagttgcatgcagtaacgcatcgatgtttccaatgctatttggacgagcactgcgatgctggcatcctccatttcaacgagttcatcagaagcacggattttcagtatctctccaatttcctgaaggtttttggtcaaaattccaaaattgttgttggatagcaacgctaaattaataatttctttttcggggcccaattctgattgaccaataaagaaaggtattaaacataaataattgcattaatttttcaagttttggattttatatttacaagcaaatgttttttttaattttcgggccttaaagaatcgaaaggattgtttccccgccggagtaaacactcacattttctttgtaactcgacgtcctgatgataaggctgcggtccaataagtccaaaggcacgccgtggggagactcaacggaagtgccacgaatgttcacaatgccgcggttggtggccatcaccaaaatgggcgaaaggtccgattcgatgtaacggttgatgaaggagaagcactcgaggtcgaacatgtgcacttcgtcgacgaacagaacacccgggattatttgcgctttgttttcctcccgccattccatcacctttcatttcattccatttaattttgcttttccgtgtcaatttgtcccctttttcctcacctttttgtcaatttgctccctcacttcgcttttaatttcgcccngtatcaccgcgaaaaaaccgccaaatacccggaggaaccttaaaa

SEQ ID NO: 20461 - DNA, 2871 bp, Heterodera glycines
ctaatgatgctaatttcttcaatggccttttcaaatggtttaatggacaaaaatgaatttgcttcatcaatttccaactgttgaagctttgtatgaaaatattccaatattttttcttgaattgttcctccacccttttttggatcatcataatcaacaaatttgttgaatttctctttcatctcatccacaatttttgtttgatcattttcatccatttcaacaataaactgtttgtattccatcatccaatcccacagcatcatctgtttcaatatttttgcttgatccgtttgggcatttgcaacaacaaattgtttgatgccctgctccatgtcccatagtgccatctccaccactaatgtgttgaactcggctttcaattggccaaccaatgcgcggacaatgggccaacgagtgaccaaatattcactgtttaattccgatccatcaacatccattccagtgagcaattctccttaaatagtgaaatttcaaaaaatgttttttaataggggcccggctcattacggcggtgccgttttgatgacactaaagcttagacaccaccataaaattataccatattaacatttattttaaattattttttaaattagtttaaatatatttaaaaaatgccaaaatttaaaattccataagaaatttaaagaaaaaaaaattattaatttcatacaatccaattattttgtgaaagcttttcagtttactcacctgtaaacccgtaaatgtgtgcaatcggcagttccattctggtatgatagagatgctccatgtcctccgatatttcggcaaattcgttaattaaataataatttaatcttttatttttaaatatttaattgttttgcacaatcaccccctctcgcgagatttcggcctaagatactcgagaattgggcaaaatattggcctttctcgagacttaggtccaagatactgaattggacccagagacccgagatttggtactgatttggatccagagatcgagatttaggctcaagagtcgggccggagctctcgagccttgaagtaaagatatgggccatgacttagacgtaggcctaggaaagtgatttggattaactcgaaaactgggcaaaagtatgggaggcccgagactctgatttgggcctagagactcaagtcttgggcccgagagtcaagacccaaactctcgagctcacgatatgctcatgttaacaaaaaactcactgaaaaagctgaacaactcatttcggctggtcataattttctcaacgttttgtcgaaaaattttcagttcatctaggcttggtcttgaagggttctcaaaagcatcgaacatttcttcaaccgtgtcaatcctttcaaaatataattgtttgaacagctccaaattgcacagctccgaattgccagtgccaatgcaaatgatggaaaagcagaaaataaattggaaaatgaatgggcacaatttccggggggaaagcattctaaaaaatagcgatgaaaaattaaacaaaataaaaattgttagacaatgtatccgaaattaaacattgaacacttgaaaaacttcggaaacttagaatttttatcaaacaaataataaaaattatttcccgaaattaaacagtgaaaacatgaaaattctactgaaaacttagggaaattgctaagaaagaaatacggagaattattattcacactaactttttttgaactggagacaaaaatttttagaatttttttaatacaaattcttaaatattgacaaaaaattttaccggttatttggcttttacaatagtttgagaatttgtttttttccttaaatattaaaatgaattggaattattgggcctctgaaattacatatttatatttttaaaaatttgtttttacctttttgggccagacaatcagcagatgcccaaaagtgtgggcggtgcccataaaccaattttaatgtgtttatatttaaaaatataattcctaggccatcattaagccatttccggcatttctaatttcttgtttttccaaaatcctatgctttaagcttctcctatgtatagttggtatggcgtaaagcttcaacaactaaacgaataaatcgctaggctttatgatacaaaatttataaaataatataaaaattatatataaaataatatataaaaaaatttttcaactgccaaaataaaaaatctcaatcaattaactaatgcgtcattgtcagcattaaatcattgtctctattgtaaatttaatattaataaatttaaccgctgaaaaatttttcccataatataaaaataaatttatcgactgtaaaagatgaatatatatatgattttgatgaaataagaataaaaatagataaaatataggaatatataaattttaaaataataaaatataataataataaaaaagcaaaattaaagctaagtttggaattttttaaacaaattattattaaaaaattgttatcataaaacttaaataaatcttctagtttaattttttaataggctagcaataggtctgagaaaatataaccaaattgctttaaattttttttacaaaaatttttgaaaattctctgaattcataatctatcattttttaatcagaatcatttcaattaaataatttcaaaatgatgttttttaaccttttttaaaagttcacgaattcatattcatttttatatttagaaaaattttcaagttttaataggaactggtacaaagttcaaacaagtcgaaataagtgcaaatgtgttatattgaatatttattttagttttaaatttacttggcgttttgttgttattttaatgtttgtgaattgtttagt

SEQ ID NO: 20462 - DNA, 1172 bp, Heterodera glycines
ttttttgaaccgtccatacctcacatatactcaaacggcccggaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaagagatttctattaccagattgcccaaaaaagagatagccattttttttggaccgtccatacctcacatatactcaaacggcccgaaaatcattttttagagcataacaaactgatga

SEQ ID NO: 20463 - DNA, 994 bp, Heterodera glycines
tgacagtggctgtcatcagttgttatgctctaaaaatgattttcgggccgtttgagtatatgtgaggtatggacggtccaaaaaaatggctatctctttttttggcaatctggtaatagaaatctctttggaaacaatgacagtggctgtcatcagttgttatgctctaaaaatgattttcgggccgtttgagtatatgtgaggtatggacggtccaaaaaaatggctatctctttttttggcaatctggtaatagaaatctctttggaaacaatgacagtggctgtcatcagttgttatgctctaaaaatgattttcgggccgtttgagtatatgtgaggtatggacggtccaaaaaaatggctatctctttttttggcaatctggtaatagaaatctctttggaaacaatgacagtggctgtcatcagttgttatgctctaaaaatgattttcgggccgtttgagtatatgtgaggtatggacggtccaaaaaaatggctatctctttttttggcaatctggtaatagaaatctctttggaaacaatgacagtggctgtcatcagttgttatgctctaaaaatgattttcgggccgtttgagtatatgtgaggtatggacggtccaaaaaaatggctatctctttttttggcaatctggtaatagaaatctctttggaaacaatgacagtggctgtcatcagttgttatgctctaaaaatgattttcgggccgtttgagtatatgtgaggtatggacggtccaaaaaaatggctatctctttttttggcaatctggtaatagaaatctctttggaaacaatgacagtggctgtcatcagttgttatgctctaaaaatgattttcgggccgtttgagtatatgtgaggtatggacggtccaaaaaaatggctatctctttttttggcaatctggtaatagaaatctctttggaaacatgacagtggctgtcatcaagtgttatgctctaaaaa

SEQ ID NO: 20464 - DNA, 2773 bp, Heterodera glycines
tgtcttgctgaatgtaattctcccacaaatgtttgttgttctatttaactatgccatatatatgtgtatttttaataattgtaatatgtttgccctgtttatccatgttttatggtcatttattctcattgccgaataaaaacggtaaaaaaagtggttgaagtaccgagtcaaaagctctttctattcgagatttaattgagacgagtcgggatttgttgcttaatgatccaatcaatcgcaaaatgcctttgtcattttgcatttcgacctcccttttccgtcattctctgttcctttggtcgggaagggtactgataaaatcccgatccatgtcgaacccgagcaattaaaaaaggatcggatacagaggtcggaattccggattaaaccttttcgttttttaatgcttacaaaacattttccatagctttttacaaagactttttctattctcagagattattaaatccaatttccaattgaatttttaagtaccatctcaattggagccattcttatttaggtcgctattttgctcgataattaataaaaaaaaagagtaagaattaagaatgagaaaaaatgaatagataaatgagtcaattataatattttcttttgctcttctccaatttttgagtcatcattttgctccttgaaaaaatgtcaatttcaacgaattcaacaaatattggcaaattttcatttgatgattatggtaatgagaaatgggaaatggtagaaatttaaatttgggaaacgatagaaaatttaaaattaaaataaaatcatctaataatttaaaaacattaaaatgcttttttcagaaatgaattatgatgaattgagtattttgaaggaaggagctgttgttaacacaaactgtgaatcattcactgatcagcaacaattgaaggcggaaaaacatagaaattaggaaatatttataatttattaaaattataatttagtttttattgcgaaattcctttttaggaattcactgaaaagtttgccaaaatggaattgatattgaaaatcaccaaactagagctcaagaatgtgagttttacataaagaataattttttgacaattaaatctaaattgctaattaatttataaataattaaatgattttaattattaagtcatttttagaagggactccaagaaaagttaaagcagcaggaaacgaatgcactgctcgcaaagatcgaagcggagaatgggaaaatgaaaaatgaaattgagaaaatgaaggcaaaaatggacgagatggagaactctttggcgggagcagacctcccgcccgttttggtcatctcgtcgcttcttgcgacactgcccccggccggcaccacctccatttccgaatcggcaagtgacactccatcatcctccatcggcactgctggcatggccaccgctttcccagcgcggggagccaccgcctccccatttttcccgtctttgcccctcgaccacggccagctcgcatcgcccaacatttggcgcaagtcgtcggcttgggttcccaagtcccgaaggcgcgcttccttcgccgatttcagtttctgttcctcctcctccctctccattttcgccttctttgcccgggcttcgagctcggccacttcggcccgagctttcgcctctttctccagcaattctccaaaactgtcccccggcggagggagcaccctcgggcggctgcctctttccttctcggccatctcacggccttcctcttcgttctcgtttcggccatgggagttcgatgcgcccggtgctgcgccgccgacatcctttgaagggagcaactctccctggggcgggcgtaccaccattgatgccaattttggctgggactttccccctttcagattgccccccacctctgatcgacgccggcgggggttggggagttgcgggaattggtgctgcagtcggtgaatgtggtcatctcccaggcgagagagctgatcagcataacgttcggcggtcattcggatgtgccgttcctccgatgggtcccgttttccgtcgcgctgccgatggcggtggcggttcattcggtggttgaggtgccgtgccaagtcttggacggcacgaattcggcgctcattccgcttccggtttgcaacttttgccattcctgaagattgggaagacaaatcagctggggatgtgctaaaagaaaaagtgtatgataaaagatgggagaatctcccaattgaaggtggtgaattgtgcgttcacggatatgctgcgcggagatgaatgaaggggagatgccccctttccttggaagtgaggaatgaacaaaaattgccattaatccaatgattttgcgattgtcaattgaaacaacgaatgaatgccaaacaaatgaaagtttaaaatgaataattcaactaaatttatacaaaatatttgaagaatagttagggaaaatgtttcaaaaagcgaaaaataaggaacaaaagtataaaccatggaaaatcaatcaatcaaaagataatatgcataaatagtttttatattctaaattcgatgataaattggcatgggtgagagagagtaaacattcaatgaaaattaaatatgtaattcaaaatttagaacgaagatgctctatttttggaatctatcaaaggattagcaacaatttagagaaatttttttaagagggctaaagaatattcaaattctattaccaaggcgaaagtgattttcaccaaaaatatgagactcatcttggcattatg

SEQ ID NO: 20465 - DNA, 1476 bp, Heterodera glycines
acttaaaggttgatccccgatgaaacaatttttgtttattagaaaaagttgttttgcctttctctaccttcaacatggcgtacactcacgaagagaaaggcaattcttcaaacaatttgaatataaattcgttattcgatttatatattcaccatttgcactcctaatgatgtcgccaagaaactgttgcattcgagcatcacttttaactgaaatgcaaaacaatttcttgagtctaaattgcattggatttttaaatactgaaatcgttgtcctccgtctcaagagtgtatgcgttgatacaccctaggtatttaagttcgtccttagatttaagcaaaatgggatgatactaaaaaaggataaacatttggatttacagtttttaactatttaaacaaaattttaggtttaacattagtccaatagaaaaaagcgaaccaaaaaactagggttgctccacgaccccgagtcccgacttttttgggcctatcccccgacccgcccccgactattcagccaaatatttaaattttgcctagacaccaagccataataaatgtttgtttttcctatatgaacataaaataggtaacagatttattaatagattttatcgaaaatgaccagttttttaatttttaactgatttcatgaattttgttaatagattttcacaaaaagtatctataattttgaaaatttaaaaataaaactttgtaaaagtttaagaaattagaaccgaaattaatttctttagaaaaaaatttgttcgtatttatcatcgcattttacgaaattgattactgtccgtacccgcttccgtctcccgacattttgccccctgaggggtcgggcaacaaccctacaaatggatttgacctaatcatctataaagtttaaaaaaatgaggcattctctttaaaatataataaaaattacatttttttaatcaataataaactcaaaagcattctgcttgtcctcccgtttccatcgttaaatgggtggattcttagctgcaaaaagggtttttattattttaatgcatatttaaaaaatttgggtgtactatagtcaaccccccggacgatatgccacgctcgacattctcatatgtatctcccaaagatctatctccactctgtggcgagtgatgtccagaactgaacaaagtgcggcatatacaacgaattttttaatctttggtatttcctctattttgagcctgctctacatttatgtattgcgccagtatggctattgctactgaaattcattcaactttcccgagctgttgatgaaataattattctagacgatttttttatatctcaaagcttaactattgcctttttgtatgataactggtagatattgggagtaaaaaaaaggttttttgtgactatttacaataaaaatttatgctgtattttctaaaaaagatctaaaaataatttctttgcgtaaatattt

SEQ ID NO: 20466 - DNA, 703 bp, Heterodera glycines
cttcactgacactatcagatatgagaaggcgtttaatgacatggtacgttgttggaagaaacccccccccccccccctcccaaaaaaaaagcaggccagaggcagttttcgtacgggccgtttttgtacgagctcacgtttttggactgtaatttttttctttgctaaccaaattcaacattgttagtgtcattcgagagcgcttcatatgctctattaacctgcaaaattccaaaaaaattcgttaagtttaaaaaaagttcgagccaaaaaagttggaaaatctggttttttgaattttggccatattttgaaccaaacgagatttttcaaaatcttgcaggctaatagaggacacttagggctatcgaatgataccaacagtgctggatttggttgacaaataaaaaaagttatagccaaaaacttgggctcgtacgaaaaaaatgggtgtcgcgataccgtctcatccaccgttataacgatattttccgaaactaagaaaagcgacctttttttattctagaattttgttgtttttttgttaaattatgaattttttataaaattttattatttttttatcatatacgatccatttcaatgcttaacatgcactcacgcgaaaacatgcgaaaacatactggcccgaaaaaaatgatatacaccaccccaaaaatcgttgcaaagtcatgaaaatgca

SEQ ID NO: 20467 - DNA, 1613 bp, Heterodera glycines
  misc_feature (1598)..(1598): n is a, c, g, or t
  misc_feature (1603)..(1603): n is a, c, g, or t
aattgctaaattaaaataccagatttaaattaaattatagataaataaataaaaacaaaaaaaaattttttaagacatttgattttataaaaaaatataaatttaattcattttaataataaataaaataatttatgtaataacaactttaaaatttttttaaatatgtacaaattaaatgtaaaataaattttgcttttttcaggtaatgatgatttttttgattaacgaccaatggaatacaaatgaaaaaaacttgattattttcccatttttctttttttatactaaatttggactcaagcatgtaatgtttggtctgtcggctgcataatgttcgaattgtactccagcggaaaagcaaattagttttgagagctggacttaagctggcagctttgcacctcccctctccccgcattttttacagaaaatttcacgaaaaaataagaaaatttaagtgaacagtttttttcgttttagacttatataaaagaaattttttgagtttgtaggcctctagagaaaagtaaaaagagttaattttaaaatataaatcaaataaattattttttaatatttaattactcatcagtggtttaaatgaacttatatattaattaattttagaatatattatgtgtcagtagcttgtatttttcagtccttctcgtcacccatagtgatattctgcgatacttgttttcactcttttaattattatcttttttaaatatactaataattcttatttatttattttttaaattgtatattcatttttatttcacttatttttaaaaattcaattaaataaatttactattttaaatattttttattcatcattagtcatgaattaaaatttttttttaagttttttattctttttaatttgttttctttgtctaaattttaacaaaattatattttaaataatattttcagcatattgtgattaatttctcagttgtaaaattgcttttacataaaactgttgtatatctattaattactttataaaaatgtaataaccattgtaaaataatttttataggtttaatcgcttagaaataaactaaaataaagttgaatgtttaagcatcttcaaatttaaataaaaatttcatatttatttttttatatcatattagaagtgttaatttatatatttttctataattataaactgttttttatattaaattaaatttttctttaggtgttttatttctttaattaaaaaactcacaaaaatataggcattgctttttatttataaaatagttttaatgttagttatatttcaattactatattttactttttattgaataaaataaatatttggtgtaattctaaataattgtcttaattttaatttgtcagttcatcttgtatttttatggtcaaataaaattaataataataaaattttcaaattaattcgaataatataattgcaataattttttctttttgctgcttatctcttcaaatcttataatcacaccacattttgaacaaaaataatgttgacattaaatatttttttattattttgagctatttttgaataattttttatttattgattnatttntttttaaaat

SEQ ID NO: 20468 - DNA, 1503 bp, Heterodera glycines
atttttcctaatttattcaatttggtatttttatttaatattttcaaaataaaaaataaataaataatttttccctctaaagaccatacgtgaagttttaataaaaacaaaaataaaatatttttacttaaaaaatatttaaaaaatactttaatgaatatgaaataataatgattaatttgtgaatttaaataaacataaattaaagtttcttttaaaatttcaaaataatatttaaaaaaaaacaggaattggccttcaccagtgcaactgacaaaagaaaatttactggaaaataattttgatcataaaatttctatggaaatgctgatcatttcaccggcatttcctgaacaaaatatttcgactctaatcaatccgactgacgcaaggaaaatcaaaaatgaatttaaaaatggtaaatgtatttaaattaaatattattattttattttattctatttaattaatttctttttagcttttgaaacaattagagcattaaaagaagatgaatatgtcggcgaaatttttggacaatgatttataatgcaatttttagatcaattattttacataattatttttataatttaaatttcgaaaaaaaattaaaacattttgtattatagcttatgagagtatcgttattagtgacgtgactttctgtttattctgtgacttttgtctattttggtcttttcacgcataaaaatgtatgtgcctgccggttttggcattttgccaatattcaacattaaattataaatattttacaaatccgcgaaacttggttaattttaatgcctgacaaactttaaatgcaaaaatagcccgattggtgcatggactgaaggtcagatttcatgcaaaaaattgggaacgaatcatagcaaagcgaaaattaggaaaaacaagcacgttctacatgaataagataataaacaaggacacaaacgattgaactggttggaaaatttgatcaaattacaaaagaaaaagttagtgggttcaaatatgacagatcggaaagaaataaaataaaataaaattttattaataaaataaaattttatttatttgtcgggttaggcgggcccggatatttgggtaaaaaccggctccgaatattgccgggtacagaaaaaccgggattgtgtcgtgtcaaagtttttaaaccgtgttgtcgccaaagcgacacaaatttctttgaaatttcttttatttttgatccttttcgtcgatcaattttctcccttcgctcgctcctttaattatgactcatcttttcttttctccatattttcgctatgagtcatcatttttgagggaattttttccctttgcttgtgcacatttcttcacgtgcctggccccgcccccatcgattgtgagggtataaaagcccggcccattctccattttcttcactcggatcacttttttgattaagtcaggtcgggaacagttttctgtccaagcatttgcattaaaattgtaatt

SEQ ID NO: 20469 - DNA, 1379 bp, Heterodera glycines
acccacacccaaacgtcttgaattttgcgtcaattatttgtccgtttccgtcaaccttaatttcataatattctaaaaaatcaatgatttcaataaaccatgatttgaagtttcattacatctccgcaagccggtgccccgacaatccctgtaccaacagacggatcatttttgtccaaagagcccacatttcttgggttttcgtaatggtcaatgactttctcatggtaagccgcaatttgcagcagttgaatgttaccatgacggtggaagaccaaagtggggaaaagtcgcgtcagcgaaaaagaattaatgattttgttttgcattactaaaaaaaatatacctatcacataattttaaaaaattaataatccgatccgaatgagtgctatcatcgatcaacgatcgcgatcagaggatcaggcaaatattaagaaaaaacatattgccaaatcaatgccaatttaaattattcccaacccaaagggcaccaaaaacagctaatttgtaagagcgcgcccataggcgtcggtgtcacccagcagctacagtcagctaaatttttttccatggaatataataatttaacatgagaatgaacgaatttatattttagcgaaaaaattgaatatgcgtgaaatcgtccatattcaagctggccaatgcggaaaccaaattgggtcaaaggttatcatgttattaaatctgtttaagtgatgttcttttaaattagttctgggaggttatttctgacgaacatggaattcaaccagacggaacttacaaaggcgaatccgaccttcaactcgagcgaatcaatgtctattacaatgaagcacatggtttcttaacaaagcccagtctcgcccacacactttaaatttcaggtggcaaatacgtgccccgtgctgttcttgtcgatcttgagcctggcactatggattcaatccgagctggagcgtacggacaactctttcggccggacaatttcgtttttggacagagtggcgcgggaaacaattgggcaaaaggccattacacggagggtgctgagttggtggacaatgtgctggatgttgtgcggaaagaagcggaaggctgtgactgtctgcagggctttcaactcactcattcactcggaggaggcaccggctcaggaatgggcactctactgatttcgaagatccgcgaggaatatccggaccgaattatgtcctctttctcagtggttccatctcctaaggtaaatttaaaaactgtcggtttctgttaaagtgcactttataaatcaaattgacttttatgagtccaatcaattactgaccttttaagagttacaaaacgataaataatcagtaattatttaattatcatat

SEQ ID NO: 20470 - DNA, 1015 bp, Heterodera glycines
ttttgattgacaatgaggccctctacgacatttgcttccgtacattgaaacttcagaatccgacttatggcgatctcaaccatctcggtctgtctctgctccctttttagctatctctgctgctttcagtgtctgtgacaatgtctggcgttacaacttgcctccgtttcccggggcaactcaatgccgacctccgaaagttggccgtcaacatggttccgttcccgcggctccactttttcatgccaggatttgcgccgctttctgccaagggggcagctgcgtaccaagccttgtctgtgtcagaacttaccaagcaaatgttcgatgctaaaaatatgatggcagcgtgtgacccgcgtcatggccgttatttaacagtcgcggcgatgttccgcgggcgaatgtcaatgcgcgaagtggacgatcaaatgatgtcggtgcagaacaaaaattcgtcttacttcgtcgaatggataccaaataatgtgaagactgccgtatgtgacattccgccgcgcggtctcaaaatgtctgcaacttttgtcggaaattccaccgccatccaagaattattcaaacggatttcggaacaattcacgggttgttttttgcaatttttttcatttatattttaagtttttagcaatgtttcgccgtaaggcatttctccattggtacactggcgaaggaatggacgaaatggaatttaccgaagcggagtcaaacatgaacgatctcatttcggaataccagcaatatcaggacgcggtgatttatgtccagatatacgtgtttataacttcgcttttttatagacggctgacgacgaagttgaatatgacgcagaagtaacggagactgctgaggcttaaccaagaccaatcgataatttattgtatttgcattacgaattgtcttgttgcttaatgaagagtgactcttgctttttctgtgtgttcgggcgtagcgagtttaattggttttaggtgtccactattataaaaaaatattt

SEQ ID NO: 20471 - DNA, 1702 bp, Heterodera glycines
gcaattctttgctttttcacgtcctgaatcattggactttctcaaacaggtaaatattgatcataggccccaaactcgaaaatgcttaaaaacggtcagaatcgatgtaaaaatgttcgaaatgggttggaaaaatagaattaggtgtgagcttgcctttttcaggctgaaagtaccggaattggagacttccctcttccctgattcaaattcgtgattagatcacttgtcccaaaaaatggaatccgtcaggacaactcggaccatctcaccccccaagagttcctccgtagggttaatcttttttgtagtaccattgttccttcacttttccccttcgctgtttctcttgtaaggccgcggttcattttgacccagggctccaagatctgaggtttaaacctcattttatggttttttgataggtcaatgagggtttttttttgaactgagtattttctgacttttttaagcaattttgaggattttggggaaaatcgtcagaatcggtgtacggacatttcaccaactggccaacttgccaattgacatttcgccaactcacccaaaatcggacgtttcgccaactcacccaaaatcggacatttcgctaaccggacattttgccatcttagtataattttatgctaccgaaagaagcattgacaaattctttgcatatgcttggacttgggatgcaggactttgtgggcgattttccgtccgtggaaatgagtaaagtagtgaagaattgaggccaacgaaaaacgattcacatattttaatattttttctattagttttccttttattttgtaaagaattccttttaccaccgatctcttttcaaatcctcggactccgaaaaatcttagtaaatccaccacttccatttcatatatgccgccagtccctaaaattcctattcgaatcactagttattatgctagtgtcatgttttaaaaggcttttgaaaataaaatttttcaaaaatggggggggggggtaaactactattaccatttttatggtagtgtaaactattcaaagcctgttttaccagaatttatttaagtcaagaaacttttgcatttttaaaaaaactaatcattagaggtataaaaagtattaattagtcgagactaaatgaaagggttaaaacaaattggaacagctcaatttttacaaaaatttattcaacgaatacgacgcaacacatataaagtaacaataaaaatgcctccaatggttgctccggcaaaaagcaaattcccccaattgcgcgccggcaccagcttcaaaaaatgagattgtctttacaaaatgtctcttttttgctcgccctgtttctccgcgagcacgcgttgttcctcctggcaaaaaaataaaaatataaaatattcaagaatggcaatgcctgcgcagaaaatagccgaatggtgaaattggcctcttcatggaaacgaaactccttgaacagctcgtccattccgcaaattgggtgtctgttttgcagtgccactatcatattttggtaaattagccattttatctggttttaagtgtatttgtctgaaattcatttcacgtatttccgaaccccggacccgaattcgaacagaaacagcaagtgcggagtttacttttctacgtttaatttttcgtcctatgttaaatccgtttaaaaattttgcataccgat

SEQ ID NO: 20472 - DNA, 2777 bp, Heterodera glycines
  misc_feature (2765)..(2765): n is a, c, g, or t
aaggaattcaggggtttactaaaagcaatgagttctgagtaggaaattttctgtgccacatatacactatattttaatcacctgtgaattttaacatttgatttattttattcatttttattacggtattcattttgtattttttatttgatcatttttatttgtttgtttttggcaccatataagagcactaatgtgcctttggtttgctcgataaaattaaattaagtttaacttaataaatccgtcgtccttcgcctttatcctttatctcattgttctttcttttaagacattttgcgaaacaccttcaaagcccaaagaaagccgtcaatgaaccagcaagtaagttaatcaaatatatgaaataaaagttgattcatttgaatttttcttatcatttgggcgggttcgcaaaaaaggtgcgataaaatattaccatatgataaaataaataagcaaaatttgagtccattcgcgttaattattatttttggcagtaataaaagatgaatgagaataaaaagtgccgttttcttcccgctgagcttgtccatgcgttggtttcggcattgccgttaaaccaacgctgggcaaccgtgcgggtttcattgttatttgaccgttttattctgtcaatacaacatgaatggcttaaacaattgttttcttcggtagaaaattaattaaaaatattttttatttatgtattttaattgtgtttaattaattaaggtgcatgcttttcgtgcggccaaagatgcccttttagtgcgcgtggaaaacagtgcaggagctaatcttcgtgttctgttccaaggtgggaaatacgggactgggtcgttttggcgccgacgttttggcgccagcctcagtttttttattataactttttttcttgttgaccaaatctaacaatcttggtatcattcgaaagcccttcacaagctctattagccttacaaaaaacaaacaaaaattttagcttctaaaaaagttattaagaaaaaaactcaaaaatttcgacttttttggaatttcatgttataacttttttggtaattgtctaatcgcgaagcaatagcttagaaatatcttctaacgtcggcgccaaaacgatacggacccgggaaatacacacataaataacttataattattgaaagaattcaaacattttacaaatagagaaatccaaatttcaggaatttctgcggagttcaacatcccaaacgacattggcattgtagagtggcttgaggagaatgatcccaccaattacggcatcgtggaatttcgtgctcaaatgcacgcgcttcatttggaacttatcgggaacggaaacaacgaactgctcggggcggccacggcttgtatgtttttgggcaattaattaacataacatgggccgaggggtcgtgataggcaaattcttttgtggaaatgcgtcagtgatcgatactatttgtttaaaaacgaaatacggttaatgtgatatttttgtagccttaagcatggatttataatgaaccaaaattacccttacagtatatgatattttcaggaattttacagtatttcaatccaagcatgtttccatcctacaaattattttttaaacattcatacaaccttttaaattcttataaaaaaggactgacacattttccacttacttacgtattttacgtgagttccgtccgtgggtatgtaaaaattcagaggtcctctgattccgttttcgatcattttttgacttttttagtccagtttctagtgcatatttagtgcaacgatttccgagtatctcttattgttacttagccaattgactctggtctcaattaatagtacttactgaattaaatttttagatttggtcttcattaaaaccttggtttcccgcaactacgtctgatgcgatgatgaaaaattcattttagtaattcaacacatatttttaaacaattatttagcatttactttgccattgctaattgttattgcatgaatcgaattttatttaaaacggattttaaaaaattcgaattcaatttgtaatttattttgaaaagaattcatgcaataacaataaacccttaacaatgcatacacaaattcgatcataatcactatttttgttaatgttacttttaagtattgttgtgttttcaattctaaaacaaaataaatctattctttcctcaaatcggctaaaattttttgaatattgcttggaaaattttttccaattgttcaccaagcccttcccattttcgattttgaaatgaaattatcttcgaaaattgaccatctcaagctttttggtgtgatttggtgacaaaaaaaaattatcaagcagttgtagtcaaatttcgaaaaaacttttgctcatttaaaaatgaaaaaatacttgatttattttatggaagcattttttaattccatttcccagttcgtattaaacgacttcgagttaaattcctcgggttcattttaagccctggtccatattcaatgaaaatttacaattatccttcatattcttcatcgatttattaacagaaaaaaactattaaaaatgcacattttgtcattttaataaattcgtataatgtcaaaacaattaattcactatttaattgattccaagattcgcaagataaaagttaatcgatgagatgatcaattttctgcagataaattatcagacggagggccagcaaatcgggcagctaaaaaaataaaatttaaacctcaaaaantataaacattta

SEQ ID NO: 20473 - DNA, 1778 bp, Heterodera glycines
gggctgatcggtctttctcttgctaatctttgactctttctctgatcactctctttgggcttatcggtctttctcttgctaatctttgactctttctctgatcactctctttgggctgatcggtctctctgctaatctttgactctttctctgatcactctctttgggctgatcggtctctctgctaatctttgactctttctctgatcactctctttgggctgatcggtctttctcttgctaatctttgactctttctctgatcactctctttgggctgatcggtctttctcttgctaatctttgactctttctctgatcactctctttgggctgatcggtctttctcttgctaatctttgactctttctctgatcactctctttgggctgatcggtctttctcttgctaatctttgactctttctctgatcactctctttgggctgatcggtctctctgctaatctttgactctttctctgatcactctctttgggctgatcgttctttctctgctaatctttgactctttctctgatcactctctttgggctgatcggtctctctgctaatctttgactctttctctgatcactctctttgggctgatcggtctttctcttgctaatctttgactctttctctgatcactctctttgggctgatcgttctttctcttgctaatctttgactctttctctgatcactctctttgggctgatcggtttctcttttccgtccgttttcttttaggagggcgtttctcttcgtgagcccatccgtgacacctttttgcaccatttcgacgtgaatacggtcggccccgtcatgaccaccgccgcctttcttccgctgctcaaaaaggccgcctccgccggggagttcgctcgcgtggtgaacatcggttcgtcgctcggttgtattggacaggcggccgtttcgcctcggctgagtccgtatcagaacgtggcttatggcatgagcaaagtccgtccccttctccgtccgcccctttctttgatcagtgcttaggctgctcttcatcacttctccaaaatgatggctttggacgagtcggacattgtcactgttgcgattcatcccggcactcaactgtcccttctcactcacccaattttgttgttttaaggttgggttaaaacggaaatgggcggtgctaacgctatgatgagtgtttccgactccgttgcaaaaataatggcgcggatttgcgcactcacaaagagcgactcgggaaaattgctatacggagaaaaggaattgttgccgtgaagaaaaattgatgtcaattcttcccaatttgccttttgccgactttgaaccgtttctgtgaaattatgcctatttttaggcaacataaattcgtaatttatctatgaattattcaccattacctaatttccaattaaacaacattagtgtattaggttttgaattgtttgaaaacttttccctgtgtcaacgctatatccaaaagaaaaaagtttattgagggatttaaaagttgagatactcggacaataaaaataatggaagagaaaaaaaggatatgtatttataaagggcatgctaacaaaaaatggccattttgtggccgcgttggccacagacatacactgagcaaagtgagcggtgtgggaaaatgtacagaacagaagaaaaacgtgaaaaacagcaaaaaaagaaaagaaacgcaattgaataaacatttaaatgttcaaaagtttattattctcaccccattttattttatttt

SEQ ID NO: 20474 - DNA, 1966 bp, Heterodera glycines
  misc_feature (1947)..(1947): n is a, c, g, or t
tggtggatttgtgcatcggagcaccccgggggtgccttagcgccgtccggacgaagtacgcggagaccgagaaaagctatttgtgcaaatttgccttgaccaaaattccatgccacaaatgttggccttgagcattggccaaatgtcccctgacaatctgtcagtggacaatccgtcagtgatggacaatgtgtgagcaaataacccaagatttgaacaagcatttttaaaaaatgtaaaagacaattaccatagaatgatgaattaaatcgaattctaaataaatagaagttttgtaaaaccccatccgatttttaaaaattaaatcgagcaatcgcaatcgcaaaattttacaatttggggtaccaaagttttggaaggaattaatagaatacatacagattatgaaaatgcagaaataaatgctttgataaaattttttggtgtgaacaaagtttacagatgtattgttcactacatacgtgcaacataatgacaatgaatggtggtgtaagttggttatttttacttatttaagggttcatattactatttcagtgctttttgacagtattgaaaaaattcgagagcatattgaaatagctatcgcacctgccgctggtgctcatgaaactgagaaatacatgaacaatttggacctagcatcagtcagcaaattgtttgggataaatattatagtttgcgaaaaagttagcaaagaaattttccgttggcaggtgtattcgcccaatttagaaatttcggttagactaattattttatatgctaaaaattttacattaactattttaagctttcaataagtcaaaagaagtcttcacattcaatatttttatattaccatgatgcgcattttgaactcataaaacaaccacaaaagataaaatagttatttattttatttttaagtaacaatatgtattaaatttatttaattttcccttttgtaaattgcaaagaaatattgtggtacgtattgtggaacttcatttttcgactcttgcataatagcccctgttatatggttttgcaattttaaaaaaggttttatatcgagaagcttatttaaaaaattttaaactgtagttgaccgatgttgctacgaacacgatgtgtgttacataaataaatggcaaaaacgttacgattgtgatattaacttttgcaattgtctttataaaactactgattgctttctaacaaaagtttgccagtgttttatatttttttaatatttattatgtttaggatttgttatgcttgtcagttcatatttttggagaaagttttaaagagcaataaaagtttgcattttactcgattatttatttttactatatttaaattatataaaaattgataatcacgcatatgtacaatattttgtttacattggcggttttataaaacgcgactttccattgtggcggatttataaaacgcgactggcgcttttataaaacgcgactttccattttggcggatttataaaacgcgactggcggttttataaaacgcgactttccattttggcggatttataaaacgcgactggcggttttataaaacgcgactttccattttggcggatttataaaacgcgactaggtggcggtttttataaaacgcgacagcacgatggaaaagtaccaaattttgtgcctcctcaactgttatagcaaccttattgaattaatattagtgtaaatatgagtgattaaggatacgatcggcgcaattttaccttccatcgttcgtcgacccgaaaatgggtgcagaacaaagtcgctgcactttatccctccagcagatacatacacgcgtgtctttttccattggctcaaagggtgtttcagtcctgattatcgtgaaaagaagtgcagagatatgaaaataccctaacattgtaaagttaaaataaatatntttatataaaacagggatg

SEQ ID NO: 20475 - DNA, 2783 bp, Heterodera glycines
ttttttctctctctttctctgtgctctctgatcactttttccctctgtctttctctgtggctctttcgttactttttctttgtctttctctgtgctctctgatcactgttccctctgtctttctctgtgctctttcgttactttttctttgtctttctctgtgctctctgatcacttttccctctgtctttctctgtgctctttcgtcattttttctttgtctttctctgtgctctctgatcacttttccctctgtctttctctgtgctctttcgtcattttttctttgtctttctctgtgctctctgatcacttttccctctgtctttctctgtgctctttcgtcactttttctttgtctttctctgtgctctctgatcacttttccctctgtctttctctgtgctctttcgtcattttttctttgtctttctctgtgctctctgaacactttttccctctgtctttctctgtgctctttcgtcactttttctttgtatttctctgtgctctctgatcactttttcctctgtctttctctgtgctctttcgtcactttttctttgtctttctctgtgctctctgatcactttttcctctgtctttctatgtgctctttcgtcactttttcttttctttctctgtgctcttcttctctctctctctttcccctctgatcacttcttttctcattacctctccctctttctgttgctgaatttcttccgttatttcgtcgtgcttttccttcttttcactgtttcccaatcgttttgtggtattcagcaacaaataccgttgtccggacaatcgtcgcaattcattctttaattattttccatttccattttaaattcaaaattaccgcgcaatcgttggcgatcagtctgctgcccccctccttcaattgcttgtacaatccctggcgcccctctcaaatgaaatgaccttcttcaacttgtctctctttaacacccactcacttggttggtattccaacctcatactccccgcggtgccatccaaaacgggcacttttgtccccgcccccgctgcgttttgtcccgctccgtggcaacatgcgccattcatttgccattggtccggcggaatgaacagtcgcgagtccatttcaaaattgtcgctggtggacgtaacggagtcggaattgggaagcaaacagttggcacaggcagaagaagaactagtagaagggcaactgatcgaacagaaaaatgatcggtgaggaagtgatcggaggaaacgatcggagggaaagtgattggaagaaagtaatcagaggggaaacgatcggagggaaagtgattggaagaaagtaatcagaggggatcggagggaaagggattggaagaaactaatcagaggggaaacgatcggagggaaagtgattggaagaaactaatcagaggagaaacgatcggagggaaagtggttggaaataaagaaaacgactttccttttcctctcccacctttctttctttgtcggtgtgctgtttttctcctctttcagtagtattttgttctgatcgttctctccgtcgtcacaattcggcagtttaacgcggggcgggcgacgcataaacaaaagaatagggaaaaaatcgagaagcaaaatgcgaagctaaaggggaaaatgggaggggaagggataagcaaactcggcattaattagctaattagcacccatttgggcattggaaagtacgaatcggcttttcggtgatggaaattgagcacaattacagtgcaaatgacggaggcgcccacttcgaacataacgcaggtgaagaaaacttctgagaaggggcgaaaagcaatggaaagcgaatttatgagagaccaattaatggcaaagtgtctgaagtctgtggctaaaataacataattaattagttaaacaattaattaattaattgtctaaacgaaccatcgtttcggctaccattagcataaacacacaaagggacatgaaaatggtgacaccttttaaccatccgaaaataagcttaaattgcgaaaataaatttacaaaggttgagcttctccccagaatcgggcggaagagaaaagccgagcaaagcgagcgaagaaataagcagcgaagggagcaccaaattcactcctttttaaggggacgggggaatcgtttagttttccaaattagcttaattgttaccgtaataaagcgttcgccggcgcacggaaatgtgaaaagtgacgtcgacgtacggttcggggcaacagtcgtagaccaaataattgcggacagaactgacacctgcgaaggcgaaaggtcacaggaacactttggaaaaacgttcactgagcaaatgccattcgccgttgggagtgtacgggtccaaagagacggaactgttgaacagatcggtggagaagcccgagtaggtccacgagccgaacttcataatgcaagtttggtcatcgaagggaaacgaagtgacctaaagggagggataaaaaggggataaacggcggaggggggggatcagtcacatcgatgcgacaagacgaacgaatgatgtccggggggatccaagtgacggacccgttgaacatgacgatggcattcacctgcagagggacactgatagaagggcactcattcgccgttcgaccgaccggccaaagagtgtcgaaacgttggtccaccgaattgtaaagctaaaaccaaacgggtcgcaactttgcaacttgctgaatggccaaccaaaacatcaggcttccaaatggaattgatcg

SEQ ID NO: 20476 - DNA, 2882 bp, Heterodera glycines
  misc_feature (6)..(7): n is a, c, g, or t
ctgcannggtcattttgggcgggaagaaaaaagcgtaaagccgagaaaaatctttctggggagaaaaagcccatgaatatttaatgaggcaaaaaatgggtggttaagcagaaaaagaaaaaacgaaagtcctttcttctctctttagaaattattttattgaaattaatttaagaaaaaagaaattcgagaaaaaactctgaaaaataattagtaaattatttattcacaaattatttataaatgcattaatcattaattgatttccaattttgaaagttttctttttcaatattatttttttactttgttttttattgataattcatctttttcgatatgaaaatgcaaataaatggagaaataaatggcggaacaaagcaaaagttattggtatttatttgccctcacaaagaatgggcatttatttatttgtcatttgtaagtaattaattaaaattaaattaaaattaaaattagccgtttttcagctgggttttcgaaggaggagaggactaattgtaagccacaaaagaaaataaaatataaagaaaagctctttggggactatcaaacaaatttcagggatgagcagagaaaaagggcgaaagagagggcgactgattgggatttggagtgattaatcagccaactgattgggatttgatgggagtgattaatcagccaactgattgggatttgatgggagtgattaatcagccaactgattgggatttgctggttgtgatcagtggttgagtaggatgtcgcacccccggctacccggacgaatgatcggccaaccgaacttccgatcagtcactccgtcgcgagaacgactgcaacgaacgttccatcgtttggcggtgcccaattcgagtcactcccaaccttaaaattgtaaaattcgcaaaataaaacaccgaaaataagaaaacatttgttatttttaccattctgatcaaataaaacattgatcagctgataagacattgattaaacaacattaatgatcagcttatcagaatgtctgtcgatcagacattgactgatcagttgatttgcctgccaaatactctctttagcattttaaaatgttacgcggtgaatcgcgttcgatcgaatcgcagcaattctctgccggtggtccttccgaatgcctttgaatattcgcccattccaagcgaagccaaccattccgcgacgtcctcaaagtcccaattttcaacgagcttctgaacattgaaaggattcactgaataattaatttttgtttgtttttcacttttttgaaagtgccggcggaaagcggcgaatttccgttgaaagacggcgaaggcgaagagcaaacggcggaaacgacgacaattcctaagaggaggagaagcgaccgttgattgatcattgattaaagggttaattgaatgataacaatttaattattttaattttttgtgccattcgctcgtaattcatttttcgctattttttcctttggcattttattttcgcatttatttcgcttggtttttcttttgccttccgcggagtcctctgaaccggcggatgagccttggcccgagtcggacgagcagcttttcgtgccttggccacagctcgtggtcggctgttggtcgtcgtagtcaaccgccggaatttttaccgcattttccagcaaaagcggcgcacgtcgcgaaggggacggagaatcatttggcatggacagcggcattggctacaaattcaaattgaaactttagcaattagtcggtttttttgtgcctgtggttgcaattccgcgggcggcgccgacagtccgcgcagagagacgggcgactgcactgcgctcgccgccgcctccatttgctgactgagaacggagacgcggtgctgaacaggcagagacgggggcaccagtgaatgttgggaatggtggtggtttggatggctttggttctgttgttctgtgtcgccgtagtcgctgggctccagcgaagtgcgcgaggaagtgtaactgaagaggggaggattaaaaggattaagcagcagaagcattcaaagcaatgctaatagctaatcacccgcccaactcacccgctgtcctttttgcaaccggtgaaagcgcccgtgggcgaatgcgaattgggcgtcgatttgacggcgcttccgggcacgcctttgacggtgccggccgcaacattttccatgaccgactctcgcagactaaggccggcattgtaacggctaaactcagagaatatttctctagtgtttgggcgtgccttggcgctttctcctctctttggcattcccacattctttttccccgcccccttttcttggcattgtcccccccccccctccgattcactcactttaccatcgtcaccccattgccattgtttctgctattgtcgttgttttctgatgttgtgttgcaggtgctgcttggcatcgtctcattgttctgctgtccgctcgtccccgcttcgttttcgcccttttgctgcactttgctgcgccttttggccagcgccgatcgcaaatccgagtcgaagtcggccgggggtgggactttttcagatttactcgctgaatctttgcacaattatgggctgatgctttctcattttcggcatttactgcttgccgaagaagtgggaccatttgcgctgcccccgggcgtcgcatttctttcgtcccgcgcgattgacctcaatcggaccgactgcaacgcttcggccgacaccccgcggcagtcggcggtgcctccgcctgcgccctttgccggcgaaggcgccgaagagaaagaaggcgaagcgcaatgaacagaagctaaatgaaatgtcatctacacataactcaatttcactaatccgatc

SEQ ID NO: 20477 - DNA, 2287 bp, Heterodera glycines
aagtgagggtgaatgaatgggattctttcttcccatcttcaattagtcagtccctcgttgattggtcaatgtccatttctgatctgatcagtccatctttctaatcacttcctcttcccaggtcactttcccttttccacttgtccttgtttcctaatcagtctcttcttctccgatcactgctcttttctttgatcacttccgatcgctcttcgccccgccgctcctttcccgtcgtttcaactcacatgcgaatgcgtcgtacagttccacgcatcgtccgccgttgcggcacgcgttctgcgattcgcatgcgccccacgcgcccaattggacgccagcgcccaaagcgcgctgcgccatttggcccagtgccaattcgacgccgttcagtcggaaatcgcgcatttggccggcaaagccagaccggtctttgccagtcctggccccgatgatcagaagggaggcgcgcgggggcaccgacgcggcaaaaaccgttttctcggtacggtccaccaccaaacgcattgactaaactcagaaaaattgaaatcaaattcaaaacgaataaatgccctgaccatttcatcaacttcccagctgacagaatgccatctaaaaaaaatgccatcgcttccacagttaactccctttggaataatcaaaaatgaaacctcaaaaaatccaaaaatggtcaaatcagtcggcccgtccggtccctcttctcctcccctcccccacctgttatcattgatcaccatgtcgctgaccaattcgtgactgatgcccgcataaatcaattgcccaacaagatgtccggcgcgtacaaacagctgaaaccatcgctcgtggttagcggatgcataagtgaatatggtcagttgaggccgagcaaatcgaatctatcaaaaattaaataattttgttggattaaatacactgctgccattaaagcattgctttttgttggcttaaaagccgtgccggacggagaacttacagacaaagcggcatggaaagaagaagcggaaggaaaagagtgcgaggcgattagacgctgattacggtccatgaaagtgatggtttcgaacacgtctaatgagcaaaagtcgattatgaaaatgaaaatatgacagaaaatgatgcatttaaattaaaaagttaagccccggttttccgacatttcgtccctaatgaatcaggctttaaatacaccaacaaatttaggagcattatttaccaaatttaattgccccccccccctctatttttgccgattccttcccacatcgtccgctgcactccaacggcccaatgctgacatttgccattgcgttcgcttccgtgcctccgccaatgaacagctgcaggacgggcagcagttgctgatgcgtattcatgccaatgtccagcgcgtcgttgccgctgtcacaattgcagcccctgggaaagtgttgagggctttttcggcactcggattggtcttgagtctcgaaggcattccgaattttaaattttggtcggtccgcttcacctgtgccccgtgcacgagtcgttcattgcgcacgtgcaaacgcgcgagaagggcggtgcgtcgccccactgcagcccgtgctgcgcgttgcgcgtcgcgtaccaaacggacggccgattttccgccccataatgcatcaaacgttggcctgaaacagttccagtggcaatgctttaaagatggccaatttggcaatttattggcccatccgtccttcgacccacccaccgcctttgcattggaagcgcatcatctgcccgcattggtcgaacgcgcccaccaacctgtccaactccaactcgcccagtccgtagtggagcacgcgtcgcacggcgccgggttccgtaatgcctgcggcaaaataccgtatttcatacaataaagcccctcccacctaaattaaagccctccttgaaataaggccccttttgaggggggggggggggggttgaaaaacaaaaactgcaggggccctatcttaggaaaaacggtaaaatatttaaatttaattaataacttattattgaggtgccgggtcgttactcaaaacccatcaaaacaaaaaattttgaccaaaattattcataacttcgcccaaaatgaatcaaattttataatcttgttatttattattcgatagctctaagtgttttctattatcctgcaaaatttcacaaaaattcattaagtttcgaaaaagttatgacttgagaaaagggaaaaagcaagttttcttgaacatttatggtcata

SEQ ID NO: 20478 - DNA, 1294 bp, Heterodera glycines
  misc_feature (46)..(46): n is a, c, g, or t
gttttaagtcttggatttgtcaaataaattcaagacttcaaattanataatcaaaaattctcttaaaatttttttgactcaatttcaaaaaaggaaaaaaatttgcagtcaaaaaattattcgaatttctccaattttgtttccataatttccgaaagttattcggtatcataatgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccccttgcttctcccagttttaagtcttggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccccttgcttctcccagttttaagtcttggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatgacacagcaaaacgacatcgttttaaaatattcctttgctggactcgacttggtt

SEQ ID NO: 20479 - DNA, 970 bp, Heterodera glycines
cagcgggcactttttgattcgggttttagaaaaaaagttaggggccctaaactgcaagaaaaagtgagaaatcggtccccgggactcagtcgtccgcgctgaatttttctctatagttttcccggatgctcctcaaaaagttgtaagacccttccactactttcagacccgtcccattagccgttaagctcaaattagtttttgaaacgaaactccttgtcaatataacgtatatattaactagcgtgtggcgcagcaattgctcggtgtagaccgtatgctttgcacagtaattgctcggtgtagacagtatacttttggtatgtatggacgggcgctgacatgagcgcttcgcgcaaaggacttcgttgctagtgcatgcgcgtttgttaagtgatgagcaagtgcattcggccgcttcgcggcctcagacggacgctttgcgcttctaaatattgtggactcattcggccgcttcgcggcctcagacgggcgctttgcgcttctaaatattgtggactcatttggccgcttcgcggcctcagacgggcgcttggcgcccatttttaaactttttggggaacattcggccgcttcgcggcctcaaagggcgctacgatgatagaagaggtacaacagtgattaaaagaggtacaacagtgattaaaagaggtacaacagtgattacaagaggtacaacggtgattagaagaggtacagctgtgattagaagaggtacaacacgaaatagaagaggtacaacagtgatcagaagaggtccgtttttcaaattttgttgggcttgggcgggcgcttcgcgaccgttttttaaatttgtttgggccagacgggcgcttcgcgcccgttttttaaatttgtttgggccagacgggcgcttagcgcccgtttttaaatttagttggggccagacgggcgcttcacgcccgtttttcaaattttgttggggcca

SEQ ID NO: 20480 - DNA, 2287 bp, Heterodera glycines
  misc_feature (102)..(102): n is a, c, g, or t
ggcacagtgaatggattgtacaaagtgtgatgcatgtgcaaaggattcgcacaaaaacctgaaaattaattttaaaaaattattttatcaattttgaaaatntaattatttttacttgtgccggatagacagggacgacgagtagacaaagaatgcaaatgtttgtacctgaaacgataaataatcataaaaagtaaactaaaaatatactttttttaattcaaaatccttattaaaatctaaattttggtttgaattttttcaaaaactttttttaatgagtatgcttttcgtaattatctcaatgaattaattttaagtgtgcgtaaaaataggcattttgcctaataatgaaattttaataattttttcctttacaaaaatgtcattcttagatggtataaagtaacaccagtaccgagtcgggggttggtgttcgaggtcagtagtatttgtcgtgttttaaagcggtttgagtcaaaatggccaaaaatttgggttcggggcgagttttaatccctaattaattatttccaagcaaatttttttttctattttaaattttgcatattttggcattttgttgcttacatgtcgatgcttgtacagcgggaaagccgacagaagcgaatgacattcgaattcgttcctcaattgtccgctgtcgttgcccatcttctgtccattttgcgatgtggaaatggtaggagacgtgtgccggaatgtccacactgaagcccatggaaatgatcacagctgccatcaccacggggtcctggaaaaatggagaaataattttaaacaaaaattaaattgtaaatacatatatttttaaatgccaaaagatttatggttaaatccaaatgaatttttatgaaaatggcatttttctcctagcattaatacgtcaagggttgggaggatgtgtcaaagaaaaattgattttaggagctttaggagttcacaaaaagtcggggatttaaagccgatagagttgtgggtcagagttacagaggtccggaggttgaaaattagacttagataacaaatacatttgtgatagggacttggcaatatgccaaaaaatgtcgggaatgaaccttccccaaaatccaagctcgagcttagcaaaattactaaaaaattaaaaaaaaaaactcacaattgtcatcccaatcaatgccattatgccaagtgtctctgaaaaattatgatttatataattaattaattaattaaaaatattaattaccggtgagaatgcaggcaatgacaatgctcgtcacagcaacaacaaatgggttgaagttcatgaacgccgcacaaataatggacatgcataccaatgtgccaagtgccgattgccaaatgtcagttggctaaacaaaaataatgaattttaattaaatttttattttaatttaaatttttggaaaaaatggaaattgatcggtcatatatatatacatactatatatgaccataggttcattttagatgttgaaatttaattgcaaaaattttataaattttttacaattaatttatcggggaactgaaattttatgcgcacttataaatatatttaaattaaaaatatataatttaaaaataaaattaattattattatgataaaattatggaccatattttcgagcagatccaagaagagaccgtcatcatggagcacggacacattgaaatccttcacataattgtcggccaccttgcgccaccgttgcatcatcaccgcccgttcatgccactccctcaactccacgccatggtaagtgacgatgatcatgaacgagtccagcaccgttttagagccgtttttgtgcgatttgaccatcccacggtaaaggttatactcgggccaattcaaaactgaaatttgaatgaattaatatttaataaattaaaatttttgcctttttaatcgtttttttaattttaaaatttcattttttatatttgagtcataactcatggagactttttgaactaattatcagttatttatttattgtacaattttaattatttttaagagtttggcgatgtcataggtttcctatgaattttaattctgaaaatttaacgaaatttattggtaaattagcgttttttttaaattttgttcttttttttgtaaaaaaatgaaaagatggagaattttaatgaaaaaccttttataaaaggtgcaaaatattgaaaaattctcagggtaaaattttaatttatttgttttaaaattatggataaaaaaaaattcttccactcaca

SEQ ID NO: 20481 - DNA, 1514 bp, Heterodera glycines
tttcaactgcaaacagcatgacagtttttggtcatgcgaatttttatttttttattcaaattcaatcttttcttaatatttatctttttcataacaaattaaatatttcgttttttaatatacctatctatataaatcccatccctagttataaggtgattacgaaaaaaaaaatttaaaaaagcaagcataatttaaaaatccctgcatggacattgaaattttttctacgaaaatcactctccaaaatgcaatgcgtttaaagcaatttttcaaattttcatgtcctttggaattttttcataaattgaattctttgtgggacctcaactacaaaataagcattacttagcaattaatctagacaaagaacaggataacaaaactttcacattgatgcaaaaaagatcctgcgtaataatacgtgacaacgccagccgaaaaaaattttccaagtttttcatacacttggacactcgaaacaccacacatacccgtaccaccaccgtattcacgtaaaaccgaaaggttactgtaaaagtcatcacttgttaatgaaatgaattccgctttttcaaaattctcaagaagaacggagatagaattgatattgtagtttgcactgaaatggaaagtccatgagtttattcgaatcggcacggtgcattggtcaatggcagtttgtacataattttatataaatcattgggattaaaaactaatttagaattttcttaaaaatcagaagtctcaaggaaaaattaaaaaaaaccttaccatttttttaaaattgaaataaacttgcaaaaattagcaaaacttatttttttttttaaatgatgtaaagaaaattaaagttaattaacgaaaaaagttttgagtttaaaaataaaaacaattttgaacgaataatgtccggtttgacaactcccccatacccatgaaaaacccactttatgtgagtccaaagcaaatcggcaatgcttcggtcgaatgttggtaaaacattgaataaccattcccatgccttgctcgctctctcttggcctgcctttctcgctctttcttcgccgattgtcacatcaaaatttgtcaccatgatgttaaggcttttataatcactaataaagaaacagtttttgttgttgcaccgggtgatcatgtttgtgtcattttgcagattttttgaaacatatccttgtttggaaaatctgaaaccaaacgaaaagtatgtaagagtcgagcttttttgtccagcttaaacttcgaaaaattcagctgatgcgtttcctcaaatttttttacatctcttctcaattatttgggtcaaaaatgcaaatttctatattatctcacggatcgggaactggactaatcgatgattggtcattactcaaaaaccatcaaacggaaaatttttcattattttgcgcaagaagcaatttttagatcactatggttgtttttgagtaaggttagagacatggtagtaagtatactctgctgaataatca

SEQ ID NO: 20482 - DNA, 1516 bp, Heterodera glycines
  misc_feature (21)..(22): n is a, c, g, or t
  misc_feature (97)..(97): n is a, c, g, or t
gtgcgcggaattcattgaaannaattaacaaagcccgaattcttcacggattcggaaaggttgtccagaatccggaccgccttcccccaccactatntaaatatacaagctgactttctatggccgtattcatcaagaatctcgaacacatttgtagctatctggaagattgtcgcgttgtccgtaacgggctgagtaaacgtcatttcatcaataacttccttagcaactgcgttttcaattttggggaatgattttagcttaaaataaaaacaacatatttaattaaaattaacaaaaaatttctatttatttaaaaatatgctaaacatttacttcttactataaatgaatttatataaaaaggacaaaatgaaaagtttcattttttcctaattttttctttttcttttaaaatagtaactttaaaatctgaaagctttataccgtaatcattaatcggttaaagctgtcataaaagacttaattataggtttttaaggaatataaatttttaaaagtggtaaattgtttaagtagaaataaaggtcactacaaatttgtcactaattttaaattaatgtaaaagaatcatcttacaagttcgcctgaaacataaggctccacgttgtcgagtatcatttgagcatttttggaaagacgccccaaataccactccattcttgctttttcaccttcaaatgtgatgttggcgcaaatggaaccgaaagtcaactgaaaattttattcttaaaatattaccaacgtaactttcgaattttgttattatatttaatttaaaatgtgaaaaattcagcgctaccgctgtcgaactgaattccaaaacctaaaatctgctttttgaatatttcttcattgaaaaatatttttaattatataaagttcattaataccaattgcagaacgtcatatcttatgatgttcatgaattcctcaacttcttttcggtggtaatttttaccagtgataattgactggagaagacagctaaaattgtttttacatatttcattataataaaatttcatttctaaaagcgaacatgttgtacaaaaaaagttttgtgactacaaaaaattcttcaagctcgcttttcaaatgtccttaaaaaattacaaaatcaactttttaaagagtgaaacgtcaaatttctttatttgtataacaaaaatttacccattggagaatattggctcgttaattccaacattccgaaacaaatttacgaccatattatttgcttcatcggcagaattgtacgtcgtagatgtggctacaaataaaaaggttaaattatataattatacttgattaaaacaaaaaaagagaaaaataaaagcaacagattgtgttctccatttctttcaacaattttttgcgttcgtcctcctcaatttcactgaaccaaatgagaagctctgtaaatataaggcaaatatcataattaatataatttaatattttttgaattttacatgaagtaaatattgataaa

SEQ ID NO: 20483 - DNA, 2413 bp, Heterodera glycines
aaatcggtagagatttttgttctctttctgataggccttctcattttttactgaaaaattttggcaaccccctaggaatctttgttctaaaatttcccagatttcaatccatatgggggggggaggttgattggtgcatgacacattttctcgaggacaaaagagttatcggtgtagtttttgggtatttgttagtgcattaattaatgtttcttttagcgtaaataactcttttttgccggcattcatttttgagaaaaccggggttttttttttaaatttttgttccattacttttgcacctgactgtaaatctcaattgaaatttaaatattttcgtctgtcatgtcgggggtcgggtcggggaataggtcccaaaaatgtcgggggtcggggggctcggggttcggggcttaacccctttttttaaggaccaacgctcctcggccccgtataatttgtttggataaaataaatttataaaaatcataaaaagggtattgagtttcactcaccgaagggaattgaattcgccggtcaaaaacttgcactaattcaggccaataaaatgccaaaaattgcgggtgttcatcgccaccaccaccataaacaccaaatgaatggcgcacataagcaaaacaaaggaccaaatggagcaaaaaaagaaaagtataagtcaatggccgcgagggaattgggccaaaacgtgcgaaaggatcagcaaaaagggcacaacaaacagaaggccaaagtttgttgggataaaattcgtcatgtgaattgggcagaagaaaaacaaaaagtttttcggcaattttttccaggcgaatgtttgaatttttcatttaattccgctttcataattttaatttctcagagaaactaaagattctataaaagcttaattgattgaatcctgagaaatttatgaggaattatggggaaaatattcatgaaagcgaaatttaagaaatgaattccaacgcaccaaatggagagaaaagataaaacattttttgatttttaagaaaaattcgaatagaaagaaaaaggaaaagaagaaaaagctaaaagaaaaggccaaagaactagcggagaaagcacttttgaaggcattggacaaagtgaaattgggaaaaagtgaagaaaaagagaaattgaaaagagcactgaagaaagagatgggaagagaagaagagaaagaaaacaaagagatggaaagagaggaaaagaaacagacagacaaagagagaaagaaagaaacggaaaatgagaaaaaggaaaaggcagagagagaacaggtaaatgaagagattgatgctcgagagtctcggtcagaggtctcgtcggcccgagaaaagtctcggctttttggggactttggccacggatttattaacggactttttgaaacacagctaatttaaaagaaaaaattcaacacctaaaaaatgacattttgctaagtaagaaaatctatttttaaattcaatgttttaatgaggctttttaaatgtataagaaaaagtctcacttgggtcatgggtctcgggaaacgatcataacaatactaataaataatttaattaccattttaattaattgaaaaataaataattaaatttgaaaattaaagattaagaaaattaattccacgaatgaaaagacaaatttgagaaaaggcggaacgaatcagcgaggcaagcgaacagaaaaaaaatattacatattaataagaattcttttttatgcttttttgccattgttatgcacgacattcaccgccaaccaaacgaacaaagccaaaaagaggcttttccccacctcaaaacaaagaaagaagtgctcaatttggtcggttgcttttggaaatttaattttaaattttcaatgtgccaatgtttaattaattaatgtgccgttaagttgtggacttcggttgcacttgcacgagaaaaactcgcagtgggaaaggcgaacggaaaagcggccaaatgcttgttgaagtttttggcacggactgttggcggagcttttgcaccttttgcccaaagtgaaaaacaaaaaataataataattaaatgtgttttttattttccttaaggcgaaaggcattcgaagcactttctgcgcgagcttcgcagccaccaattggccttcctttccagcggttaccatcgcttttggcgctctcgaggtggcacaattcgaaattcgggaaattgaaactttgccatttttaggagggattaaacatttccatgaggccgaaaagaatgtgcagccaatttttgtgaattgatcatcataattcatttttattaacaaaattctcgcatttaatacatataaatacatattccccccaccacctcggcattcgctgaccttcaaaatgtcccacacacaaaat

SEQ ID NO: 20484 - DNA, 1308 bp, Heterodera glycines
gatcattttgtctaattcgcaaaattacagctcattcttcgcgaaatataaactgaatcagtgtttgcggaatgaccgagctgataatcgccaataatcttcgattacaattttcttggtcacctttttggaattccaccatttcaactccttatcctctaaatataaactgaatcagtgtttgcggaggaccgagctgataagtcccaataatctccaatttacaattttcatgatcacttttgtgatattctcaatatttcaatttcttatatccaaatgtaatctgtataagtttacagtaggaaattgtaatttgggggttattggcgatttcaaatcgatccttccggaacactgatgctgtttatatttagagcgtaatgagctgaaaatgtcagaattcaaaaagtggggtcgcgaaaatagtaaatctgaggttattggcgcttatcaacctgatccgtctgcaacacttaaacagtttatatttaaagcctaattagcagaatgtgaaattctctcatttgttactttatgatcatttttgtctaattcgcaaaattacagctcattcttcgcgaaatataaactgaatcagtgtttgcggaatgaccgagctgataatcgccaataatcttcgattacaattttcttggtcacctttttggaattccaccatttcaactccttatcctctaaatataaactgaatcagtgtttgcggaggaccgagctgataagtcccaataatctccaatttacaattttcatgatcacttttgtgatattctcaatatttcaatttcttatatccaaatgtaatctgtataagtttacagtaggaaattgtaatttgggggttattggcgatttcaaatcgatccttccggaacactgatgctgtttatatttagagcgtaatgagctgaaaatgtcagaattcaaaaagtggggtcgcgaaaatagtaaatctgaggttattggcgcttatcaacctgatccgtctgcaacacttaaacagtttatatttaaagcctaattagcagaatgtgaaattctctcatttgttactttatgatcatttttgtctaattcgcaaaattacagctcattcttcgcgaaatataaactgaatcagtgtttgcggaatgaccgagctgataatcgccaataatcttcgattacattttcttggtcaccttttttggaattccaccattccactccttatcctctaatataaactgaatcagtgtttgccggagaccgagctgataagtcccaataatctcccatttacaattt

SEQ ID NO: 20485 - DNA, 1418 bp, Heterodera glycines
  misc_feature (108)..(108): n is a, c, g, or t
gcccctttttacgattttcttttcatttgtaaaaaattttctcagcctggcaccgccgggcccccaaaaaattttcaaaaattgacccaaaaaatattggtcattttnaggtaaaaaatttttttgtttttttaaaccgcctgaaagttttccatttttgccagaaaaaatagctgtcaaaattggaaaattgaaaatttgctttttcggggatgccgtaacaatttttcccctccacagcgcctcgggcggcgcccctccgccgtcgtcgccggcgccgttgcgccgcttcccaacgctggacgcgcttgtcgactttgcacgcgcgcacgcactgcacgacctgaagcagaagggcaagcgcgtgcgcgagcggttgcgacgcgtggcgcagaacggcggactgagcggtgaatgtttttgccaatttttgttttcatatttatatatttaaaattttaagaaaattaaaaattattttagcttttttgaaaatctaagtgttaataaaaactaaatttgctgatttttaagaaaaaataaaaaaaacgaaaaaaaaattttttccttaaatttcttaataaaattttgataatcagcaccaacgggaagcttaaaattccctcctttttcacctaaatttttcttttgggcccataatggatgcaaaaaaaaaaagaatttgcttttctaagaaacacaaattttttgaaaatttggcggaatactaattgtaagacttcctctctttttttctcaaaatttctcaaatggacaatttttgggataaacttaaaaaacactaaatttgcggcccgacttttgcggcccgacatttgcggccccgacatttgcggccccaaattactcatttaaaaatttaacaaaaattaaccactttattcaataaaattttcaatagaatctattatgatatgttctatttttaactattttttgatcagcacaagaataattccagacgtttttcgaggcgtgcatccagctctttcaaagtaaattttaagagctctaatctcgagactttaattttaaagattcataaacggaattaaagaggaggaggaatatcagcgaaacagaattcggccatttgaattggaccccacaaagggcctgactgaaacaaggaagaaaaaatatgtggaaaatgacagagcgatcaaaaatttgattttgcgttatgataacgatgaaaataggaatgacgaaacgttattagggcacctcagagctctacagtatcgactggccgatactgtagaaattcaggattagtagaatggatggaaagttcaagctttgttggggccttgagcaagcccaattttgttgaaaaattagaataatgttctttaaattttgaaaagaaaaatttggttaaaatcaaataaatt

SEQ ID NO: 20486 - DNA, 2766 bp, Heterodera glycines
  misc_feature (36)..(36): n is a, c, g, or t
atataagaaaattaaattaattttattaagaaaatnttgcgcaaaaatccagatttattaatcaaacattaacaaataatttccaacaaataaattcttattcatttttttgtgaataatattaataatactttttaaaattttgaaaataaattttaattttgccttttaaaaaaagattaataataaaaaaattcataaaaaaaaaattcacgaaggagacaatgagaaacagcttaactttaaaccaataaaaaaattatggttgcaacctcggccgcgccccgaccccgaacaccgccatttttggcaatttttcggggctatcaccgaccccgacgcattcaatcccgacaaacactgactccgaaaaaaccgattcccgacttttccaatcccaacggtcggggttgcaaccctgaaataaatcctttaaataaattttgattttatttaaataaagaaatcataattattgcaattctgtcaatgaataattaattatattagcatatttctatattttgtcgaaaattttttttaaatatattagtttattgctgatctattaatgcatttgtgtggggtgggtaaccgtgggtggacggaccatttcagtccaatgatttaataaataatgtttaaatataaaataaaatgtttaatttaatttattatttttaatatttatgtgcctcaaagtaaaattaataacaataaatatccaatataagaaaaagttttttttcttatttaactaatttcgccaaattttataatgttaataagttattgatttctcagaaaaatgggattaaaaaataatctaatgcggccattaaaagattcattaaaaccaaactgtttaattgtatttttaatatttatgtgcctcaaaaaagaagtgttttttattaactgagttaattattagcaatagacttaatttttaaatatttataatattcattaatatatttctttaaatttaatatttaaggaaattttagtatagcgaaaagtttttgtctagcaccgacaataagataattaatatttaatacaatgcaattttttgggtaatttgtaaaaataatatttttgtttaaaatttaaagttactaattaacaatctgctttatatttagagcttttaaaatatatttatttattgagtttttttgacatcaaaatttaagtttccataggatatttttaatcttgtaaaagcatgcaaagaaaacattttattttcatatttttctgttttttaatattttctataattatttttgtgttttcaatacttgatttaaaatacagttttattcatttttatctttattattttcttttatcctgtctcatttgcgaagtatattttcggaggaggtgccgtgatttctttcatactgcacaattttttattttttaatcaaaattttgttttaaaaagaattcaattaaactcaaaaattctttaatttttactatttaattttcaaaattgattaaataaatgagcttttacataatatgcatgaatttttttttgtatatagtgggactattttttacagacttaagcagtggggcggagcgcagtttatttaagggaataaataaaatattaaacataaataattatcaattcttatgtcatttgcataattaattctctccaacttatgtacattttataagggcagtgtttatgtaactaattacagtgatataaatttttaaacgttttaatttgatttttccaattctttcacaaatttcactttacatatttttcattgctaattttttttaatctctcgtggtgatttcatatggtgttttaaatatactttttttatatgttgaattaattaattgttcctttgttgctgttttttcattgtaatttactgaattttttaattttaatcgatttaatttttttttattttcccaattcttacgaaaatttagcctcacatatttttccattttttagataaacaattgatgacactgagcatattttattccatactttggctaatatttctgtcattttcaaattttatattcttttaattttaatgcctaaattaatggaaatttaaatagaatttaaaacttaaattcttataaaattatgatttgttgttttatttcatgttgtggtttacaagaagttcacgtcgacaagagatatatttttaattttttctgttgagctaaaaaattaatttgttttatttatttaatttctttattctttttttattggggcagcctatatgtaatcaattattgtgatctaatatttttaaccaatttaaattggatgttttgcaattctttcacaattttcatcggacatatttttccattttttagataaacaataaataatattatgcatatatacttcgatcttaagggaaatatagttaatttaatttgttttaaaaaatgcccttttcatttcttttaaattcggcttttttaaatgtttaaattatttattattgttaatttttttaatctctcgtcgtattcaatgcagtgtaatagtaccatctgttgggttgttttgcatacattttgaattaattttattgatttctctttttttatttaatattttcaaaataatataggccaaatcggttgatttatgtaaatgaaataaattttatttgtttctctgttttgcaaacatttaaatttcatttaaaagattttatttaatggcattgaattatatat

SEQ ID NO: 20487 - DNA, 1148 bp, Heterodera glycines
  misc_feature (35)..(35): n is a, c, g, or t
  misc_feature (51)..(51): n is a, c, g, or t
  misc_feature (59)..(59): n is a, c, g, or t
  misc_feature (61)..(61): n is a, c, g, or t
  misc_feature (65)..(65): n is a, c, g, or t
  misc_feature (74)..(74): n is a, c, g, or t
  misc_feature (80)..(80): n is a, c, g, or t
  misc_feature (85)..(85): n is a, c, g, or t
  misc_feature (87)..(87): n is a, c, g, or t
  misc_feature (90)..(90): n is a, c, g, or t
  misc_feature (92)..(92): n is a, c, g, or t
ctttttaattttataattcaatttttattcttttnttccatccttctaccncctcaaantnattnatttatctnaacatnaacantncantnccattttataaggggagagcctaggcggtgatttctaaagatcacaattgtttttaatttttaggtatatcctagggataaattctctgtcatgacaaaatgccgtctttcaccccagctaagggccatagatagataagggacagaatcatttgtgcctggacacatttagagaaagcaaaaaaatgtatatttgtaattggtaatgatgctcaagatgacgaatttccggagactcgagaccgacatcgcgactcgatcccgagaccaagactctcaagcataaattactaattgtcgcttgataaaccactaaagcacaggaagctaggtgtgggatttaaaacaaatttttaaataattgcatcattatttaataaaaaaaacaaattatattaagtaaaaaattgatttgaataatcctactggtgagaaatcattttttcaaatcaaattttgctccattataagggctgggtaattttatatttttcattttattaattacttaacttcatttgacaatataattttttcttaaaaaattaattaattatttatatattcatatttatctttataagcaaaatattgcttaatttcttcatataaatatttttaatttactttttatgtaaataattgaattttgaccattattaaagaaaaacataatgttttattctttttctattatcttttttcatattattattatacatcaatttttatttcacttttcaatgcaattgcatcagtaagcttattaatcagggtaattaatttgtctaatcatttttaattaggaagacgacaacatgctaattgcatttgtaagaaatgatcagaaaatgcaaatcagtgaatattcaaagcaaaaatatgaggcataccttggaactatttattttatgagcaagaattggcaatgtgacaaaatagcagatgaatttaagaatatgaacggacagaatgccaaaaatttagctaaatatctggactattttgtacgagatatttgtctagaaagttcgtcggaatattaacagtgaagcc

SEQ ID NO: 20488 - DNA, 1257 bp, Heterodera glycines
gagtcgcttaaatgcaccccctttgacacgtaaaatattcaaaaaaagagatagtgattttttctggattaggccggagaaataaaaattaccagttatttgaaatgcagtgggcaagcacagcgagtcgcttaaatgcacacccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaagccggagaaataaaaattaccagctatttgaaatgcagtgggcaagcacagcgagtcgc

SEQ ID NO: 20489 - DNA, 1960 bp, Heterodera glycines
gatgatgagcgacagaaagagaggaacaaaccaaacgacgaaaattctgtgagttaaagcaaataaaataaaaatgataatgataattcatttttaaattttacaaataattccttacaaattaggtaatttcccagttttaagtagagctgagcgggactggtactgaaaaaaggtacaaatgagtaccaagtcccggtttttcccggttttcccagccaaaaagtcacggtcccggtttttgtcaaaattcccggttccgctcattgtcagctctagttttaagtcattgttatctggaatttcccaatttaaactgtccgatcaaacaaaagcagggtgcggcgaaagctcccaagtctttctgatcaattgggtttcgtctgatcacccgttttttgtcttatcatttgtttttcatctgatcggaaaaattgtgaagtcctgcaaaccctgcacaatcacacgggtccatctgctgattattttcctcattttcagcattttaccactgaccaatcgttcggtgcttccgtttccggcgccgcctttaaaatgcctttcgacgagtgaaagtgaaaataaaatggaaaacgatgagccaacggaagcggcaaaattggcggaggaatttgccaccaaaaatttgacgacgaaagaacggatggatgccattctgaagatgatcagcggaagaagcggagaagaaggagcagaggaggaggaagagtaaggggagggggaggatgaaagggaagaggaaaaagagaaagaagaggaggaattagcaaaatgaacattttcatggaataacggtgaaagtaaaatactttttgaaattaatccctttttcctttcaacacataatcttttttatcttttcatgaaccgctttttgccctttgttgtggttgttgcttttacttattttatattccataaaacgaagcgcttttactgaccgattgcccggacgaacaaatggcaaaaatacaaatagggcgcctcttaaaaactgttaagtttggtcattttgtcaaaaatgcataagcaagaatgtaaatatttgttttcttcactaagtgttgacctaactttgtcctttctttactaattaggtaattaattattcattagccgagtgggggcgggtgcccttttgatgaatgaatcagataagaaaagttcgtttctttcatttcccccaccctttgctatctttcatttatttttccttttctttttatcggtcgtatttgcattaaaaaaaaagtttttatttcattcattaaaaaatatagggttgctccccgagccctcgggggacaaaatgtcgggggccggggacctcggggagtgacacgtcgggggtcgggtcggggaataggtcccaaaacgtctcgggtcgggtcggagggctcggggtcggggagcaaccctaaaaaaatacattccataaatatttaaatttgtttttttatttgttttatgccgtagggcaaggttgaaataatttgaattgtgccaaagggtgggtgccgtttcaccttattgaagcattaggttaatgaaggaaggataaatagacaatttgcacttaaaatgatcaatctgagctccgacaattggaccgggtgccattcggccatttcggacgcactttcgcgccattccaccggggcggacgccgcgtatggcgacagtgagctggacaagaaagttgagaggagattctgcgaaatttttgagactgaattggctgtttttctggttgggacaggtgtggccaaattggcacttttcatggctaaattcccactttttgccccaggcaccgctgccaatgcgttgtcaatggcttatgtgaatcgcgcgggtggcatcattttcgcgcatcggcatgcccatctgatttgagacgagtgcggcgcgcccgaatattttacgggcggcgccaggt

SEQ ID NO: 20490 - DNA, 1468 bp, Heterodera glycines
  misc_feature (1365)..(1365): n is a, c, g, or t
tttttgattttaaaaataataaatattttctgcatgattctctaataaatcctgtcgattaaaatgaatcaattaatgttttatcccagctgaaacagcatcctattattctgggtcttttaagcattttggaattatttttcctattgactctttatataatgtccggtaacgattgctatttctcttaagccgtaccccctcatgtgaaaatcccagacaacatcatatatctgaggagcaattggactattttattttttgagttttaaaaataattaaatattttctgcatgattctctaataaaatcctgtcgattaaaatgaatcaattaatgttttatgccagctgaaacagcatcctattattctgggtcttttaagcatttttgaattatttttactattgactctttatataaatgtccggtaacgattgctatttctcttaagccgtaccccctcatgtgaaaatcccagacaacatcatatatctgaggagcaattggactattttattttttgagttttaaaaataattaaatattttctgcatgattctctaataaaatcctgtcgattaaaatgaatgaattaatgttttatgcctgctgaaacagcatcctattattctgggtcttttaagcatttttgaattatttttactattgactctttatataaatgtccggtaacgattgctatttctcttaagccgtaccccctcatgtgaaaatcccagacaacatcatatatctgaggagcaattggactattttattttttgagttttaaaaataattaaatattttctgcatgattctctaataaaatcctgtcgattaaaatgaatcaattaatgttttatgccagctgaaacagcatcctattattctgggtcttttaagcatttttgaattatttttactattgactctttatataaatgtccggtaacgattgctatttctcttaagccgtaccccctcatgtggaaatcctagacaacatcatatatctgaggagcaattggactattttattttttgagttttaaaaataattaaatattttctgcgtgattctctaataaaatcctgtcgattaaatgaatgaattaatgttttatgcctgctgaaacagcatcctattattctgggtcttttaagcatttttgaattatttttactattgactctttatataaatgtccggtaacgattgctatttcttttaagccgtaccccctcatgtggaaatcctagacaacatcatatatctgaggagcaattggactattttattttttgagtttaaaaataattaaatattttctgcgtgattctctactaaaatcctgtcgnactaaatgaatgaattaatgttttatgcctgctgcaacagcatcctattattctgggtctttaagcatttttgaattatttttactattgactctttatataa

SEQ ID NO: 20491 - DNA, 2770 bp, Heterodera glycines
ccccctcaccgcgcaccacacgtcagagacgcagacacacccacccaataggcacggacccccacagctcatcctctctgcgctcagcggagaaaatcaatcgatatttaaagtaggcaccctctgtagtcaagtgccggaatctttggttcggaatgtaaaaaatttccgggattcgagcctataataaaacccttaatttggtgccaccgccgctgatgcgggagtggcagaagaaaagtttgagacttcctttaaaggtcgaaaattggttaatgatttattagtgtttctctgagccaaaaataaatgtttttataacgcgcattttagacttgttctgattaaatttttaaatttaattacctatattaaatatcggttttgggcttcggtttcaagcagagttgagttgtaccaataccggtaccggcgtgtaattagtacataattacctgtttttctagtaccgaagaatgggaatacgagctagaacagggctcccatccgtccttgaatggcaaggacgtccttgaaattgggccctctttcttgaaaataaaaaatgtccttggatgccaaggacgtccttgaaaatgaacatttagaaaagttttaaaaaaattcaaagaaatttgagaaatctttgtaattttcaacgatattttgattatattatggcattatgtcaatttttttgctcatagttgagaattattatttattattattattaatatggtattaggaatctttcttgaataaaatgtaatttttttctcatgattgagaattttttgaaattttattgcataaagtcacttttttcttaaaaaattagcccaaaatcgcaaattttggtcatttttggacaaaaacctgtaaacaaatcgcattaaaaattacaaatttttcccgcggcgttgccggggaggaatcaagaggggaaattaattttttgccaataaaagagttgacaaattaactgttgcttttaaattttttttattgcaaaataaaggcaatatccacacttaataaatttttatcatttaggtagcatttgacaaatttaatgtttttaataaatattttccatttttgcaaattttcaaaaaatttatttttccttcatcgcttgcggcaatgcaaactgctttttctcgacgtcatgaatcttaaatggtaaaattgattaaaattgtataaaaatataatacagagcaaaaaattgaaaatgcaaaattaatcaaatcttattaattttcctaaaaaataattattatttaaaaattatttctcctcactttttacttagagaaattatttagaaattaaaattacatataaaaataaataaaagtgtggatattttaattggcaatattctcggcaagcgcggagggcatatcattcatccgccgtttggttgcccaccctatcgattgtccttggcggggggggggggggaaatttgcatgaaattcaaccaaaggacaaaacgaagaaatcaaaagaaaaattggtggaaaatattcaaaagattcacttttcgaagaatgtgaataaatgcaattttaaattgtcttcaaggcatcaatcatattgagatcatcacccgatcaaaatgtcaatgtttgtcgatcattcgatcagtcggcccatcgaaagcccgcgacgggcggcagaggcggcaactcgcgcatggcgaaccgcgcctcccactgctgctgctgctcttcgcttggatccctttgctggaacagaaagcactaaacagctcaaataattaattaaaaataccgtgacgagagtcggtggagaggtcccacgggtgtactgtaacttggagtggaattgttggcccgggggcgaatcggcgcggcccaatcggaggagatgaagcagtgcaggaattaacgagctgaatagcacaaagatggcagcacattcgacgaaaaaagaatagccgcggtgtttctgaagcgaacaaatgaaaatggcattggcacagacaaaaaatgccaaaattagaaacggaagagaaaatcaaaaggcggggggggggagaaagtcataacagaataattgaaaaaacacctcgtaaattccgctgacgctgacgtggaagaaacgatattcgacctgagaagcgggggcatttagttgactaatttattggcacttattccgaccatttgggaaagaaaggcgaaagtgacagtggcggcgcaatgtgccaaaactgtggaagaaaaagcgaattggcatggccaaaacaccgccgattcattgacccaccagcaacggccatcaaagcgacgaaggaaaaggcggagagacgacgagagggccaatggaaggacagacagagagagaaaagtgccaagaaaacggccaactgagcacccaaatagacgaacaacaaatgccgttgccaagctgagaagggaaatgaataaccatggcattcattgggacaaaggacaaaagggcaccggggacgaatttgggagggtaaaaagaaacagaacccgggaagaaagacttttattcaggccgatgaatacggtattaccgtagaagggcggggcacgcatgttcagaagctcggccgacgtgtaaaagtcgaagtcggagttggtgaacacataggcacaagtgtacatgccattcggcctgtaattaaggcaattttcgttaacattaatcgttttttgtccgccttcaatgaccctctcccctctctctctctccctctcccctctct

SEQ ID NO: 20492 - DNA, 1179 bp, Heterodera glycines
ctctcgtgtttttggggactctcgcctctcgccaaactctcgctctcgtctttttggggactctcgcctctcgccaaactctcgctctcgtctttttggggactctcgcctctcgccaaactctcgctctcgtcttttctgagacaagtcacacccctggtatatacccgagttgggcccgttgttgcccgtggcgggcgaagtctggtgttggtgttgggccatcggcgacgagtgcagcacggagccggaggaggaggacgagccgggaccgccggtgtgatgatggtgaagcattgtactggtagcggaagccggtcccgactgagggcccgccgaggagcagccgccgatggtgccaagcgcacttccgccggagggtacagccgggggcggcattgccaccgtgtccggcaccgtggccaacgacgtgccctggggcggctgttgctgctgtcgataggcggactcgtggaaggcgcgacgctcaaacagatggtcgttgtgcaggaagaagcggcacaacttggcgtagcagcactcgacaaagctaaaatgggaaaaacagatttatttttagaattttgatttttaaaacacggacattcgcaagcgctgcagactgggctgcatgtcgtcaccaaactcgggctcgaactgcatgaacatggcgtgcaccgagtgcggaaatgtgggaattgcgacggtggctgccggcgttgagccgctgctgagcgaattgctctcctcgcgacccacacggaaaatgccgtcccgtggcgcctcccggatgccaatgggcacgtggatgccgagtcggcaacgccgttcatacatgctaaagataacaaaaaaaattagccaaattttgtgatggaagagcggcccattggactgacttgctcagctcctccatgtacactttgcacttggaggcgatcacgttcacgtccggcacaaccgtcaaatagagcacgtccttgcactggtcggccggcatcaattccaatcggtcccaatcgcgcagcaccttcagcagaaattgtacatgactcggttttcatggcaaaaattatgtcgattcgtttcccccgacctgtgccgagacaagaatcggctcacgctccgcgtggctcacaccatcacgtgcgggatcgctccgtccgtccgttgttcgct

SEQ ID NO: 20493 - DNA, 1253 bp, Heterodera glycines
  misc_feature (137)..(137): n is a, c, g, or t
ccccccttttttggccctcccctttgcaataaaattttatgggaaatggcaaaaaatttaggctttcgatgagaaaaaagaatagtgtttattgcggagcaggtggtttgctgccacgcttaattaatatcagcttnaaaagcatgtatttcaaaaaagtatttctagagccaagattttttgttagaaaaatcttgcttttgaatttttttttaaaattttcttgggagggaatagtgtcccccttcccaacggtcgtaatcgaagcagtgttaaaatttgcacatttaaatagacccattttcatgggcaacatgaatgctttttctcacctttttggcgaccgatgcctccgcaattgcgccaagcgcaagacgacgactgctccgcaccatggcggccatgtcctggctgatgctcaaatgcatcagcaaatccacaaactgacggtcggttgggttggcggggttaaagcggccgaacagtgggcgaaaagcgcgatgactgaagttggtttgctgctgctgaagcgacggcaaaatgaaaccgccggcctcggcgatgtcatccgcaaaaagaccggagccacggccacacaaatagcgatgacggacggcactttaaaagagcgacattggcacaatttccatttaatcatttaagtgtcgaatcaaaaatccggcgccggacccataaatcctacaaaattttaaatagactctaaaccaataaaatttgccagcccttttttggcgaaaatttcaaaaaaggtgccgttttgggccacctgaagccgcagttgcatttttgcagctccgccgtcggcataattcggaagccgctccattgcttgggcagaagcgccgccgctcctccgcccgagcccatcatcatctgttggcgctgccgacgctgcagatggtcacagcgcaggagcagcgcccgcggcgcgccaatgtaaatgccctactcggcagaacggatgttggagttgcagcagcacagcgtacacgagttgatctcgatgtcgtagtgcaggtcattgacggtgtcttggatgatcagtgtgagccgtgtcgagctgcgagcgccgaccgtcccaaccaggagatgagggcaatggcaatgagaagggcaggccgtttaaagacgacctcgtacatattttgaggatgaaggatttttcgagaaattatcagcgacagttatcttagcaaagggattttttaaaattttctcgggggggggggggg

SEQ ID NO: 20494 - DNA, 3041 bp, Heterodera glycines
aaaattacgccagtcgaattgccaagacggaacagtcaaggctctatttcagttttcccgatcataaaaaagatggtaaaatattttagatgatgtgccccctttaaaagcaacttaataagtggttttttgagtttcaggttcaagaaatttctaacattcatttcgacccacttccaatgaaatcatttaaactaaaaacagaaccaaagtgttgtttgctttggctgcttgtgaaaaatatttctaacaggggaattcaaggattcggtttggagggaatgtcaccccggcacgaaatttttatttttgacgcatttttgagaaaacagacacttgaaaaaaccgagatttgaaaatattagattaggtgacatcatgtgacaaatctgagtagcgtcctcgaaaatcacataatgcacaccaaaataataaatgggtaacctattctggatgatggacaaatttcgaatagcgaatcggaaccctttttaaagttactaatttttcaatttaatgcataatttggctaaagcatagcaataatgtaagaaaataaagcagaataaaatagccaagaaaattcgatatcgggcaaaaactatttttttatggtcgtgtaaattgcaataaagccaaaactaaaaaactaagaaaataccgatttgccgttgtaaacgcgcaatgacttttggaaattgacgatggattgcgcgttgcaaatggaaagtggacgagtttcactcgtgtcagagttgcaagaagtccttgaacaactgctctctttggaagatggggacacatttttagcagtcatctttcacttttgggagtgacagttataatttaaagtgctggcttaaacaaaatgaagataaataatgggttgtacatattcatgttcgtttttaattaatagtgcgaggaattcaggggcatacacggccaagatttggaattgaaacatccatgaatggccatttcgtaaatttgactaaattttgcccaataaatgtgagtttaaaaatttttagctcaaaaaccgccaaaataagcactaaaaatggaaaatagtctcaaacccttaaaattagggattgaagagaaatttttgagaaattttcatttcttagggatggggtaaacccaactcatccaaacccaactcatccatgcccaactcatccatatacccaactcatccatagcacgatacgagtcgtcgccgtggcatttaatgccacgactaagaccgtacaaccaaaaaatgccacgaccgagaccgcataatcaaaaatgtccacggtcaagaccggcataatcaaaaatgtccacggtcaagaccacataagcagaaaatgccatgccacgaccacataagcagaaaatgccatgccacgacgatgactcatggatataaaaatattccctgcggttcctttgtcccgaaccaactaaattataccgaactcacccgctctgttttcatcggttggccgcccacggtgcccttggaaagtgtgtgcgcaaccataaaaatggtcagaatcgtgtagacaattgagaaaaggcaatgcattttattggaaattgactgtaaaaaaaggaaaataaaaaaaatattagtcaaaataaatttgtaaaaattgctcaaataccaaaagtcaaaatcgaatcagaaaactttggtttcgaaatttaatcaaaatccgtttttgattccaaaaacaatcataaaagtgttaaaatttgatcaatttcggacaaaatccattaacaaattacactcaaattttcaaaaaaattttcccggaggtacgcaaaaaaagtacaaatgctgtgaaatgagtaaaatgagcagcggaaacaaaaagttttgaaaaaattcattccgccgaaaaacacaaaaattttgaataaaaattaccatttttggtatttgtatagtttttacacttgagaaatttatatttttttgtttgttttaggctccctaaataattcgggatttttgggtaaatatgatttttattattttttttcttcgaattctttcgttttcgtgattgaatgaccaagatttgattatttcgtccttttttgaccctagaatttatgatcaacgtttaataaatttgagatatgctttaaaaaattaggttacaaagaagagggacggaggtgccgccgattagcggcgcagggaaattttttttttgaaaaacacctacaatttttgttgataaaattttttcgtaatttgcctaataaaaagaaatgtgctcttcacaaatactgctgctgttcccccaccagtgtttttgcttttattagcatttttcgcttaaatccatcccctcccccctcccccgtcatctgtcagcaattgtgagaccaatacccactaaagcatttattgtaataattccaaatcatcgcatttacccttcgcatttggcttattgggaggggctgggggagatgagaataaaaaatgaaaatgatgatgattatgagaagaggaggatgacggaaggggggggggaaacaaaaatcgtttcaattttccattaatttaactcataaatcctaaaaattgtcaattttgcgaacgaacatttgaaattaattcaaaaaacaattttataagaaagaattcaaaagaatattttaaaaagttccgattgatgcaaatcgcgatcaatttggttcattgattttacataattattttttaataaaattgtcatatttcatgggtttatgccaaaccctttaaaaaatggcaaatttcgcagattccaagaaatttatttgttaaatattcattccaattcattgaatttccccttaccatttggcttacaaattagtgggggggggggggagagaagtgaataaaaattaaaatgatgagcgatgtgtaaaataagtggaggatgacggatgggggaggggggaggtggacaaaaatcctttgaattttcgcgtaatataactcctaaatacaaaaaatgtataaataatggagaatattttat

SEQ ID NO: 20495 - DNA, 1026 bp, Heterodera glycines
cggcttctccttcgactgttccctgttggatttgtttcacttcggctctctcccccacccgcaatatttgttgaacattcgaatccccgccaaccgaactttgtgccttctcagcaacaacaaaggccccaattgcgccttccccgggcccctccacgagcttcgcctcattgtttatccctttttatttctaattttttctcttttacccaaaggaaattcaccaaaatggcggattcactttggtttggctgtggcttaaaagtgccctttcgcccgtccttttgtccgtcctcttttggttcttccgccgcgtccgtgcccttccccgacagcccgtcctcctcgaaaagaccattttcgtcctcggctgttccctgctccttttggatggttcatttgtccgcttccttttccacttcggcacttttcctcatttttagtgccaatcgaatggctttcgttgcgcatggatttccctgctcttttgctctttggtgatctccgtcagggctttttctacgccgttctcttctcattttggctcatttttgcgggagagcatctcatcgacgacagatcgagaaatgatttggtcggctgacccaccgaatgccaaatgcttttttttcagcgcaactattggcgcaatttgtcccttgtggttctttcctgtgccgttctgttgggcttcgatctctccgaacggggccgtcagttgtccaaccctttccattccgtttggtcttcagaagggtctccccggttggccctcgtctccatcgttcttggcattggctcagctatcatttacacggttcggccattccgtcgttgtacattttggcattattcattgctcatttgtgtgcggttaagttgtttttgctctacaaagtgtgcatgggttggctgacaattcgtcagaagagagaggccgaattgcgtcggcacaatccgcggaggcgcctccgcgtggaggcggtgctgttccgtttccgctttctgatgctattgacgctgctc

SEQ ID NO: 20496 - DNA, 1396 bp, Heterodera glycines
ttgatagttccgggttaggaatttccggctcaaagtcggactctcagatttccaaaggctccaaggttgttagaattccaaatccctctcccgcctcccccccgccgtttcgcccatttatttctttcctaattttgtgctcaaatgactccttcatcctcttttttaatccgccatttgttgctcaaatcccctttgcttgtcctttgttttgtggtcccttcgtccttttccgatccgtgtccctttttcggcgattaccaatgccccgagggctttcactgtgcatttgacaaatgccaagatgagcaggggattgagccaccgggcgattgtgccaaagtcagttatgcgcctcaattaaaacgcgaacgcatcggatagatcagatgtggcaaggaatcggagtgtcggcaaggcaaatgcgttctttatgtggggcgaccgtgcggaaggaatgttttggtggcggagggattggcccgtgcggtggtatccgattgtgggccccaaggcaaatgcattggcgggcgatgtgccattgacagtaagcgaaagaagcgaacgatggcacaattggaaattgaaaggatgtgcggacacagtctgtgaggagatgagcgagctttgccgggatgggatgtgcatgcaattgtcctccatgttctgcttctcgcccttcgattgcggccctccgtcacttttcgagtgccatcaaaacaaatgccaacggcgtcgcgacacaattgttccagttttttcaccatcggcacaaaaatgtgaccccggagaaactctcagcggtgataaatgtgtgactcaggaaggtaatcagcaacagctggtcctcttttattcccactgcttaggatgtgctcaattggtttgctcatccggccaaagctgtttcaatggcttttgcgtcccgacaagcaattccaattgcgctaattccggtgaatgtgccgaaatgaatatttgtcgcgaaggacgctgtgtggcggacatttgcaaagcaaatggtggcagatgtctgccggagaatgcctgctctccggtgagtgtgcccgagggcgagtgccgtcccttccagggcattccgtgttcgctctctgccgctgccgaggactgtcccccgccatacttttgcataggcggaatttgttcaaaagatggtgagtggcagtgacatggcaacaaatacaatgactccccgccaaagagtgctttcgcaaagtgtgccaaatcggagaacgatgcgacggcggaatttgcattcgcgtggagggcaacggatgcagagacgcgatcagagagtgcggggagcacttcgattgtgtggccggctattgtaaggacagaatcagcgcgtacaaagaggcgacgaacaaaacga

SEQ ID NO: 20497 - DNA, 2037 bp, Heterodera glycines
gaaccctttttccgatttatcattctcaacagttcgccattcattccaaaaaccgcccccaattcgcatttgccgggaattaagcgatgtttcaccgatttctgttgtggtcgtggggtttcgttgacaatgtttccatttatactaatggggggatcaataggagattatgtgaaatgcctgcagcagaaagaggtcaattgtttgaaaactcatttaaattcttttaatgcgcgtgtgtggtaatttgttgagtgaaatgagagaagaaagtgaaggggcgggcgacaaaagtgcgcggaatttatggaatgaaaatgcagtaaaagtgcggtttgcaatatttacttataatatgatggattaatcgaattaattgcgattcaatcgaagggagtcgatgaacatataaaggaagattgatcattgtcatggataggggtggaagtgagtgagaagaatataaaaatgaatgggaagggatggaagttaaataggggggggggaagaaaatgttcagaagggatgagaagggaatgaaattgttgttggacagagagtggacaaataaatgcgcaaggaattcgggggaaagagaagggatgagggaaatggcgaagcgacggaagggagggacagcagcagaagaaagagggacgaaccgaccaaaagacagcgcaaagcaggaggagaaggaggaggaggagaagaaggaggtcacgacggaggggaagaacatttaggggattgatcgaatgcgcccgaaaaatgtttcccttccgttggtgcggcacgcgtcagccaattaaagcccattgcgagacggaagcgtggttgaaaaaatggcataaatcaaggcatttttgaaagaaaaaactcaatataacacaacgcaaagacaattttgcagtaaataagaacacattaaaagccgaccgattttccgaagttaattaaaaagcaattaaatttaaaaaatttaaattcaaaaacgtttttaaaaattggcgttttgctttgttctgctttgcgtttcgatttagataatttgactaggctaacaaaagaatgacaaaatgaaaatgggtcaacaatttatcccagcaacttcttcaatggctttcttcgcacgaaacagggaaataatgtaataatatgctttttttggttaattaactagtattcttttccacatacatataaggtatgtttattatgttttagtggatcttcaaatttatcggcgaaattcgacataattgacagacgtattgcaagtttagagcagagttggcgtaatgccatgcccatctcatcaaattctgcaactgccggcacctcggccatgtcttttgattatgcagagaaccgattgtgtgtaatttttactcattcatcaatgataaatgcaattacttttaaataatggtttagatggtgcccccaattttggatttaaaacataaataattcaacgctagttaaaaacagcttttgaaatcattaaaagccaaagggctgtattcgtaattgatgcattttgagaccaaaatgactaaaaaaactttttgatccttgaaaatggtttttcagaactttattaacttagttatcaataaatatattttttcgttcgctgtgtgtcaatgcttgggggaatgtctaggtcgttgagatcgagccatttttcaactttatttcaaattcggaaaattgctcagagactttacgcgctcattgacatcattaagaattgtcatcaccaatctacggtcacttgatgtctattgtatacttttgattccagcatcaatgtaaatcaatgaagacactaattgttacaggggaattcccgttagtcaatgttagtgctatggctgtaattacctgcccgagaaatttttttaggtttggtttttttttttgggttttaaccgaaacccttcgaccgatcctctcgttcggcctcttattagtataaaaaaattgcatagagtaccaggaatgatcgccttcatcacgaggtcaggccttgct

SEQ ID NO: 20498 - DNA, 1882 bp, Heterodera glycines
  misc_feature (1748)..(1748): n is a, c, g, or t
ctctagagtcactccataatgttttatcatcaaaagttcaaaaaaaaatttttttttttctaaaaagctcttattgaaaagaaaactggtcaaaatgctattttgagtttctcatgcgataaatattcgcaaaaaacatactgaaaagaatattaaacccggtcctgtttattattatttttaaaagaaattttcatattttattttgggactcaaaatttaccccatttttcgtatgttctttgtgaagcagttctttatttttatttaaatttacttcctccaacactcaaattgggaaaaagataggtccttttatgttcaagtgataaaatgaaaaatgaagatgaaaaattccgacttgtaacaccgtaaacccaaaaaaaaaaataaggggaacataaatattccgcggtggttccaaagtgatgcctttgaaaaaaaataaataaaatatccgtaaaaaaattctaatcaatttttcttacaaaatgtattaaaattaaaaaaaaattccggcggcgcctatcggcaccacttttctttttgaaattttcctcaaaaatagcaaaaattagtcctattttttggcgaaaggcggctacaaatttctttttttttttttgctcaccgctgctcaaatttttaaattaaattttggcccaaacagcaaaaaaaagcttttcggttgcaaattcaaattgttctcgctttgttttttaaaaaatttcaaaagacaccacatcggaacgagcgcctacaattcccataaaaattgcgttaaaaatgcccttagatcggttggttgccttcttatccataaatgtgcatccgtttctttcctctgtctctaattccacaaatcccaccacacaactgagcacgagtcaaaatatgtaagttcagggcgtccgtagctgtactcgcggctgctgctgctgctgctggtgccgaagcagcaacaacagtcaccactgctgctactggaattgttgaaaatgaaaatgtctcctccaccccgtcgcccgccgttgtcagctgcagccaaaatgcacgagcaaatggcgattagtgcggcaatgatcagacaaatgagaatgatgatcagcagaatcaggctgatgcattggagccatgcgctccaatccacgcggcttctggaacagccggaagtttctgatcctcctctgaatccgcgcttacgccgacgccgtcccttttttgcatctgatgggttaaaaagcaaaaaatttaagcaatgttcagaatacagcatatgccattaaaagaaaaatgaatgaatttcctctactaattaccaccaaaactgctaattaaaatttatttttatgcactatcacagtaggtgtaagtccctcgccttagccattttaaaacaaataactaggactatgcttaggttttctaagaatcgatttttcaaaaatcaaaaatcctggtcatgatttggcggacaatcgaaaactttttactcatgaaaatcttgaaatttgtttgaatataattttgcaatcgaatttagcatctattaggattacaacctatttttcggttttagcacctaaaatcctagccctgtaaattaccgtcatcattttgaggaaacaaccgtgcgtagactgtcttgtataatttagcattttcttcaagccatttttgatatttttccttgtcattgttgctttcttggtgctgctcctgctgatccccgttcttcttccgtttgnggggtgagatgttcaatgattttcttggcatttgacacaatgccaattttgtgaaaactgatcagtgcccaatagccgtgcattgcgagacgccattggacatctcttccttgggtgtaaatgccaatcttttt

SEQ ID NO: 20499 - DNA, 961 bp, Heterodera glycines
  misc_feature (67)..(67): n is a, c, g, or t
tcagaagtgctcttagctcttgctcaatcttccgaattgctttcgccgcttctcgggtggctttccncctttatgatttgctcaaacttttttcgagtttgtcgattctcatccaatcattttcgttaatttttctctcaatttgtccatcttttcttttaaacttttgagaaacatttccaccaattttttgccccactcatttttttccgtttctccaaattttgcgcattctttcgctaagttttcgtattgtcgggtcattagcaaattgctttccttcatcaaatccatcaactcaagtttcactttcatttcaataatttctgtttggctttgatttttgcgtccttttccatttttcttccagaattttttggcttcttcaattttgtcatccaattcctttttcaaaatttgcaatttattcatttcttttctggcattatgctcctcttggatttcgggaattgtaaattttttctcaaaaaacattaaatttgcataatcttgtgctgtcatatttatggcaaagttactcagcgtttcaatgacaattttggcattggcaatgtcttccaactttttgatcactttgtcatccatcgtttcttttccttcattttcctaaaaattattttttaaattaaaaaaaatattttttcaaaattaccctcccaattgtttcagttatttcatgcttaattatatcaatttgtgtgttcaaatctttcaattcctttgttgataatcccatacaaagcaacactaaataaaaaaagaattataattgtttattttttacttttaacaatattaatagaatatgataataatgaatgaatttaccagtatatgagataaaaaaataatataaaattatcatcgcgtattttctaaaatgaatgcatttcatttatgttatctatctgtattattaaggggtttttaaggaaatttt

SEQ ID NO: 20500 - DNA, 1318 bp, Heterodera glycines
atttctttctattaatcaagtacatcttcgtcagccgagaatattagtcatttacatttgtttttttattattttattgtgtaaatatttatatttaaatcacggcaattttaactattgaaaattgaatgatagtcatatgtttgtggaactttcaaagcatttaatttttttggaaaaaattttatattttatttttgatgaaacaaaatatcctttttaatatttaaatttgaatataagttttataactttccaatattattatttattgggttgtatttttccaaagtttgttgaaagtacattattttgtacccaaaaagcaaataacattataaaaatgatggactagactcatttataacaagaaaaaatttggcgcaacttaaaaagtgtgctaagatatttaactcttcattgaatattatttttaattaatttaattctttacaaaatatttggcttttcaaaaataatcattacttttaaaaatacatgttaatgaatttttgaattttacagttatttatttagcataagctaataataaataatgaaaataaatcactttatttccctattttaattttatttatttatttataaattgaattatttaaaaaaatttattttgtttaaaacttaataaatctaatataaaatatatattccgctacaatgttgaagattacaattaacttgagttttgttaattaatttagaagtatataataaaatataaataaattataagcaaaaataataagtagcttaaagcattatcagaagtcaaaatatagaaagccgccattctagagatgattttttctttaatcataaagaaaaatttagatgtatatttgataatcctccccatcaaaatttaataaagattgtatattttgaagccttaaaacaggataaacaccaaaatattcgataattaaaacttaaaatataatgaacaatctaaattaaaaagttatattattttatttactcaaatagttgtatttttttatccaaattgttttatatttccactaattttaagcattttacgcaatttcaaaaacaaccctcatgttgcaccttacttaaaattctttttttttaaatttattagtaataatttgcaaatacaaataacttttcaatgtcttatcatgaacataaaatgtacccaaaatggattaatattaagaaggttggaatacaaaatctcattcaactgcatgcagagccgaataataaatattcaaaaggattgaagaagactcgaaaataaataagcaaaagaagaccgatacaaata

SEQ ID NO: 20501 - DNA, 2149 bp, Heterodera glycines
tatattttgatagagaacaattaaaaatattttattgaatatcaataaatattaattgggtttaatttgagctaagttaggaatttttatgtgttacccatttttgttttcaaaccgattggcgggtataagaaacgcgcatgggtggtggaatttaagaaagcgccagaacgcaaattaagtcttataaagaaaaatcttctcacttttaacacaataacttaaagtgaaaatatccaaaaaaataaagcattaataaaatcaagaaacattcaagaaccactcaataaataatggaagctatggatctagtataatgttttttacaatattcttatatttaattcattttttaaaaagcattaataaaaaaaacatcttataccagaaataaatcgattctaatatattatccactatatgcctaaaggcaacattttaccgtataagaattttcaaagcattcaaatacttattgtctcacccgccactgctcaccgtagctcctctcaaaagaaacaaaataaataaaaattatttaagaccaataaaaaacataaaataaaaatttggaaaattaaggttcaatgaatgtcaatatacattaaataattttaacacaggaacgaattgtatagggcaacaaacgaataattttgtttaaagaaaaagaaaagagtgagtgcgattgaatattaaattcatagaataatatttaattgctaattgataaaaaattttaaatataaaattttaactgtttttttgaacaccaaaaacttttaatcaaattaaaaaatctttaatttcgagcattctaaataaatggatcaatgaaaacgaactacgcgctgaaatgacatgtgaaaaaaaaagttaatgaaaattcttttttatattttctctacattatttcaattgaaatttaattaataaaaaatatttcaacttaaaatttattgttttttctttttttaaacagcaagatagattgttttgaattgttttgtatacgaaatatttaaaaaaatattaaaaattattgattagatatatattgaaatactttgaataatcattgttttggatcattagtgaggataaactgaagaaaagtaaaggagaatgagggaatcaagtaaataaataaataaaaaacatgagagttcaaatgaaaagtaatataacaaataaaccaattagaaaacagaataaattgaaatcaacactgcatcaacatattagagtctataatataagaaattattacaaatagtttattaataaatccatttttaaaatttaaatacgttaaatataattatttaaccgcattaccacattagaagacgaatattatttagtaattagtggttaattttcaattcaaaaaaatttctgataattgttgtccatgtataattcggttcctacggtatggtgtaaaaaatatttcattacgattattatcatttttgtctttgatagattcttctggcggatttattttagctaatgatacaatattttcgaataaatcatcaatttctgtacgaaattttctcagctgcttcctgtatttataacaggttgccatgctgtgttttgaagagttctcattttcctgacatttttttatatttttatattttaaacaattctcattatcacgaagaatttttgaaatatttttatattcatttaaaatttgtagatatagtagcctaatattttgcgctatctctaatattttttcatatagttgatgtattcctggagcactaaatgcgatgatcatatatattttcgcatagaaagaaatattattacaatatgacactaaacgatctgcctccataataatttttctttcttttttccaccttgcgacaatttcattattgataaattgtatttctttgtcgatggttgtcattttctgatttaatttttatttttttggtactcaaattctcttttattcgtgaagcccaataaaatcccacactacaaattgaattctgttttccaactccaaaattttggtgtgaaaccggcgagattctaaatgtagttttctcgcttcactcaatcccttaagtaccttttcctctagtttggtgacctgatcgaaatctttggaacgatc

SEQ ID NO: 20502 - DNA, 1255 bp, Heterodera glycines
  misc_feature (9)..(9): n is a, c, g, or t
actaaattntgatcaaaaataaagaaagttatgaattttctaaatttcactggattttccggggctcaaattttgacgatttttcaaaaaatttttaccaccttccaaaaaatctgaaacgcaaaataaagcgtatatacgtattcagcaccaaaaattaggccataaaaatgcattttggttaattttggagcaaaaaaaattttcatgaaatgcaaaaccatggggtcccccctttggttttgagtttcaaaatcacaattaattttataactttttttaaattcaagataaaaacatgagataaagcacattatattgggcattaaattctctacaaaaaagctcttagacaattttttgataaaatcaactcccgacgagttatgggcccgggactgaaattgaggcctagcaaccaaatttttctatttccaaaaaaattttgaaaaatttttctgaaaatgccaccaatcgatagagcatgaaaaacgattgcttgaaagtggtcttggttttcccgagaaaaatctgcaaaaaataataaaattcaaaaacggaaaattttcgagggggcctagctcgaaaatttctgaaaattttcaaaatccgaaaacatggatggatgcagctcgtcgagctgcacaaaaaagtaattatcaccatcccgctcagatcaaaacacagcgagttattcgcgaaattcaaaaaatgccaaaattggttttcaaaattcgccgaagtgtacaggccaggcctttgatgctagggcctcgcccaagaagaaaaaaatttcccaaacattccaacttagggccctctcagcagacatttttggctccggcttccctgaaaaaagttttggcccaaaaactgcatgcatttttccccaaaaagccatttcagcgccgctggcgctcagttggcctccggaccggaatgccattatttttcctggatgcgcctcaaaaagttgcttaagcaatgtcaacatttcaggtccccccgattagccgttcccgagattttagttttagcaatgaaactcgatgttgctttagttatatataaactagggtgcccagttggctatggtgtgcatgcgtggcttggtaatatatggcccttatttgttattttaaaacatacaaaacattaattccattagtgtgatgttttaaagcgctacccaatgggggggaaacgcggttccgccgcgtcgataaaaagtgatgtaatttagcaattcatcgca

SEQ ID NO: 20503 - DNA, 1559 bp, Heterodera glycines
acgagttggcatagcacgagtagttatgtatgattttccattttaatcgtttagatagtttgactttttcataactagggatggtaaaaatatggatataaaatcgcgaaatatggacataaaatggtaaaaatctcaaaatatggacataaaatggcaaaaatatggacataaatttttctaaattgaggggtaaattttcaaaaaaacccgaccaaaaaaccgaaattttccattttttgcttatctttcacataaattaaccaatttttaagaaaatttaaatttaatcaatttttttgacaaaattttgctaaaaaatgtctttttcggaaaatgttccggtctttggggttaaaacggccaatttagctgatgggggccgttctaataggggtttttttgggaaaatgccaaaatatggacataaatcgcaaaatatggaaaatatggatatagaaatccatcttaaaagcttcaaaccaagctaaaaacatgtttttcgtgcgtttcaggcctcccacattccaggaaaaaaatatggatttccatataattaccatccctaatcataacgtttgccaattttcaaaatttgaaaagggcggatttaacctttacaaatgaaaaattatccgtcaaattgatttatttgattgatttgttggtggagggtagggtaaaacgcccggcaaatggtcatcattttgcaaaatattctcctgattgatgggtcctcttatgttgcgttccctttttcttcctcttccaatcggtcattttatgccaaaatgtttccgccccttccgtttttggcaatgatttttcgcctcccattgttttgaacaaatttatggcaaaaaagattgaaaatcttggttttttgaattcttctggccataacttttttgaaccttaacaagatttttcgaaatttttcaggctaatagagaatacttagggctttcgaatgataccaataatgttagatttggttgactaagaaaaaagttatagtccaaaaactgggctggcgcgaaacgagggtgtcccgccaaataagtcgttttgtccccatttttttaatttttaaaaaagaaaaattacattcctaaggcttcaaaaagtccggaatagtgacgaatagtgacataattttcagccaaaaattgagcaaaaaataatttttatcaactagttgcagttgaaaatgagtaggacagagattttgaagggcaaaaaacccaaaattagtaccgaaaaaataattttttaaattaaaattcttgccaggaaaatgaaaattttttcatttcttaggagtgtattttcaaaaattttcgaccgtttcttaggggtgtatttttttgaaaattttgaggtcgattcttagggatgtattttccgtttttattgcatttttgttgagaaattttcccaaaaaatgtcgaaatagtgacgaaacgccaaaatagtgatttttaactattttagtgacgaaacgccaaaatagtgatttctagtgacgaaaaatgacgtccaaatgaaaaaattttaac

SEQ ID NO: 20504 - DNA, 1256 bp, Heterodera glycines
  misc_feature (35)..(35): n is a, c, g, or t
  misc_feature (69)..(70): n is a, c, g, or t
ttttttagtttaattaaatgatattttgcgcttantggtgagaatctcaaaaaatgtgccaaatttgtnnggattaggttaaattaataacaaaattaatggtcgtcggtgaaaggataaattaatttaaatatttaaaaatttgaaaattcgaaaagtcatacaaaataaaaagtaaaatttttaaatgattttttcacaaattttaattaaattatatgctgagcgcttattactgatttgtgagagtcttcaaaatgttgccatatttattgaattaattaaatgaaaaacaaatttatggtcgtcgatgaaagggtgaattcatttaaattttttaaaattttaaaattcatacaaaataaaaataaaatttttttttaacaatcgatgagaaaaacgattatttggggagggggcgaatggttgttgaaagaagaatggatcgattcactttaaccattcattataaacagacaatacggaggaatgtgaagggaaatgtggcggcggcggcagtttgtcaaaggctcaaaagtgaaaacaattattttcgacacgttttaatcagggatgtgatcaaaaaattttcaaaataagaacatcaaggccaaaaaataagattttagtgtcaaaaataagaacattttgcaaaattgcttcaaatcgttatttttacaatttattcaatcaaaaatgtattaaatattatatttttcacctcccatgatcatttttaacaattttggcgaggaaatgagcaaatcgtacatttcagtgcaagtgagatcataattcgatttgatttgggccacttttcacggtttcaactttcaataaattgcgcacatcagtcaactgagctgaacaaagagagaagacgcgctccacgcatgcattggacacgggaattgaaagaattttgttgacgagcaacacaagattgggtaattccgcctcgaaaaccttcatccacttctgttctgcgttcatttcgccaaatttctcgtcagaaatactttcaagtatttcattcagcgccgtaatttcgtcaaaaagctcattgtcgttcacttccggagcaataatctgttcagccaaactcatcacttcggcgcgattgactttcttttccttgagagaaatccattttaaattcgtgggaaaacgtttcacacacgaaccatttatcgacatagttaagtgtattgatttcaaaaaattctgaaaaatggggaaaattttgaaaatttccc

SEQ ID NO: 20505 - DNA, 1177 bp, Heterodera glycines
ttaaggaatcaagccaccacaggttaatgtatccaaattggagcagccattacaagacacagatttgacattgaatgttgaaccaatttggtaagcgcataccagggatgttgcgaatcgaaaaataaaatgcgaaatatacgaacacgaaacgcgaaatttttttctaaaaattattcataatgaaaatcgtaaattttgagattgtggtgcaaaaagaaaaaaaccctaaatttaaaagaattgttatttatgaaatccattaaataccttttaatgttcatctggtgtggtcccgctgatttcctttttaaatattctttgtgcagctcatgatggtggtgttgcaaatacataagtaatggcgtggttggtaattggggcgggtgagccttcttataatctcaagacttgcattatgcaacgcgagcagacagtttgaaaaaaatcccaaattagtgacatattataataaaacctaacaaaaaaaaagtaaaaattaaaaaagtcctaaaattcattcattatttcgaaatttgtccggtattcaattttaataattttagtgtgtatttaaatttgtgactgaattattaacaaaaacataattataagtaaatatgtgaatcttttactttctctcggtttgaaaattatttttctctcattgtcacaccacatccatttttaacagtgcttaaaatttcgtgtttcgtgctaaaatacgaaatccgaacacgaaacgtcctaaaaacacgaaaatacgaaaaatacgaacacgaaacacgaaacaatcaacatccctggcgcatacggtcgtgcctttccgtgccaaacagccccgtgtgtttgggcttgtgccacggaccagcgcttggattgtgcaaccttaattcatataattaaggatataattcgagagtctcggtttaagacacaggtctattccctatatgggtgggcccctcatgccaaattaccgtcagtcgttgcacagtcatccggacattgagtggtcagtcggaccaaaatgttcccgttgagtaccccggacggctgatagcacacattggccgcgtcgcaacgcacggattcgcgcattgtgcgttttgctgaacatcaaacgctgccgctccaagcggcaacggttccgcgttagtgccgcccagtgcaagcg

SEQ ID NO: 20506 - DNA, 1437 bp, Heterodera glycines
  misc_feature (32)..(32): n is a, c, g, or t
gcacagcagcggacaaccccagcaaagcattntgctgaagcaattaatggaggaaaataaacaaacaattttggtacagcctaattaatagttatttgatataaccattaaggggagagttgcaatttgaaaatggaattggtattttgcattttaaaaacggatggcgctggttcagttcagtgtcgtgttcttcgctccgccgctgctcctttctttgctccttcccgcctccaatcagtcatttctttctgttcttttcacaggctcaattttgagaacagtgcgttgagatggcgggggtgggggaggagaacagaaggagaagtagaaagaagtaggaaggtgtttcttccatttatagggggggggggggggaagagtatgggtctctctctctctttgccgaagcgtcaaacacttggaggtcagcgtcagaggaaagtcgcggggggggggggggggaagtacagggcgccagacagttatatcccttcttaatgacttatttctcaaccatttaggaccatctagatgggatgggccccggattgcaggtttttttagttcgggaaaaatttccgctgcggcgcctgtcgacatcgccggatgaaaaagtttgtaatgcccaaaaaaagcaaatgtcccaaatattgcgtacatttgcttccctcggtgcaccgatgcctggtcaatttcgtggtcaaacgatgtcaacacatccgccaactcgcccttaatcattttgcaataattaatgaccattctgtatttttccgaacctttttgccgaactcctcccactcagttacgattacctgcaaaaaagttaaataaaaatttgaattttacgaattttttgttaaactaaaatttacagtcaccaaagaataaaaaaatttgggttctagtcggttttacgcgtcccatggcattttacgcgtcccatggcattttacgcgtcccatggcattttacgcgtcccatggcattttacgcgtcccatggcattttacgcgtcccatggcattttacgcgtcccatggcattttacgcgtcccatggcagggatgtcattccgaggctcaaaaattttcggaaaccggaattaagtgctatccctggtctatggtattttagccgtcctaataactatgatgaaacctatttttttgtccggtattcagtaattttttaactaaaatttcgttgttaaacataaagtataataacaactcatacacaggcaactcgaacaatggcttagactaggcctaagcttttggcttaaacctaggcttaggctttttcatattagtaactttctgttgacatcattaagaaaaattataaaaagaagattctagcttatttttaagttttctatttcaattttattgtcctttattttttattatgggacgcgtaaaaccgact

SEQ ID NO: 20507 - DNA, 1856 bp, Heterodera glycines
  misc_feature (36)..(36): n is a, c, g, or t
  misc_feature (1676)..(1676): n is a, c, g, or t
  misc_feature (1797)..(1797): n is a, c, g, or t
tataaaaatagtttgtatactgtacacaacaatttntggtttataactttattttgaagggcgataaaattatatttgtgaagataaaaaattgtgtgcacaagacaaaaagaataatgaaaagtacaaaaatgaaatgattaaaaaatatttttaaacggaatgccaaaatcgccaaaacaaaattaaatatgaaaattttttaccagttcgcaaattttgggaccaggtcgtttcggcgccgacgtttcggcgccaagccagaaattaaaaaataagaaaaaacacacgaaaagaaaatctaataagaattgaaaaattttgagttttcggctttttgttagaattcgggtccgggattcgaaactggccaaaatgaatgtcagattgatcagcgaccctgaaaaccccccaaaacattttccacgacttttcagaactaaattttctactcgtgtatttttttatttttggcttggcgccgaaacgaccctggcgccgaaatgtcggcgccgaaacgatacggaccccaaattttataccaaaagatgttgccaaaattaatgattgttaacaaattttggagagagaaaatacatatgtcaatgagtcagcgctcggcccaaagaaaatattccattgggtgaaacccaattttccaacgattaaaggttcagagccaacatttgccagttgagtacttagtattttaaatttttgttggaaattattttggtactgaaatatttttcctcctgttttacaaaacaaagtgaaattaaaccggtccgtactgttgtttgcgccttttgaaggccgacacgctggtgtgatgttaagtgctagtaaatccatcgtttgggctgtatgttgacaaaattgggcaatttccttgttgccgtcttcgatacgatcaacaatcgtgtcgaacaattcaaacgcgtcctcaggaaattgttttctattaatatattgaaattttttattttaaaaaagaaaattgtaaatttaggctagattataaaaagcatcaattgagcagaaataatatgacaggcaatcataaagggtctttaaagaaaatgtttaccaaaaatatcaataaaacaatttttatttaattacccatttccgttgttttcgaatttcttccgccaattttatcagtttagacgtcattattgtatgttttgattgttggcatttggatgcaatttcagggaattgaattattatgtaaatagaataatataatgtttataaattaatgaatcaatcatttacacacaaaagcgtgacgccgaaaaataaaaaataatatgaaataaaacaaataattgctcacatttggagctgagatggcaaagaaattaacaattttaaatcagatctttcaagaagcttggcgaactgattagaacttagtaaagtcgtctctttaggtaaaagtctatagagacgagaggttcgaataaagaacgaattgtgtctatcattggttgagcaataagctgttcttatggtgaattcgtttttgtacagggttttgggaaaagaaagggattcgttattttgtaaatgtgttttaatacctaaaattatttcatggtaaagttttaagagagaattttgtgctctatctgataggcttacttattttttaccgaaaatgtccnctaaacccgaaggtttttttcgaaaattttccagtatttaagacattttttccgtaaaattttatttttatcaaattgtttatgcaaagtttgcatttaaataaatagaggactatttaantttcgtgtgccgagaaaagtctgaaaaagacaatgaaaatgagtaataaaatagaacat

SEQ ID NO: 20508 - DNA, 2886 bp, Heterodera glycines
cccaaattccagagggtcaaaaaattgccaaaaaataaaaaatttttaaaaaattccaaaaattcctaaactgaaaacgaacatcagattcgtgctcagcaccttaaaaatacccagaaaaaaatttttcacccccattttcgtccgaaaaaaaatttccgaaaatttctagggggcctggctcgaaaatttttgaaattttcacgacctatcctacaccattcgatagagcttcaaaagctctacaattttgccctaaggcgttttttcgataaaaccaacccctaacgagttatggacccgggactcaaatgtcccgctcaggccaaaaattttttctatttgcgggaaaaaatcgaaattttttcaaaaatatcaccaatcgatagagctcgaaaaacggttgcttgaaagtggtctccgtttttctgggaaaattcgttaaaaaatcctaaaattcaaaaacccgaaaaccgatttttaggcctagctcgaaaaattttgaaaattttcgaaattttaaaatttggaaaaatccagctcattgaactctacaatagtctgctggcaccccctggcttagttcaaaccccaatgagttattcgccctggactgaactggacaaagttggtactgaatttctcctattttctgcagcccttcctactataggtagaggcctggaattttttttgacttttagacaacacttcaacttaggttcctaccagcggaaagtttttgattcgggatttagaaaaaaagttatgggccgtcaaacgcacgaaaaaatgagaaatcagtccctggtactcagttgacccttggaccggaaaacctatatttttcccggatgcgcctcaaaaagttgtaagacccttccactactttcagggcgctcccggccttcggccgggagattttgtttttgcagacgaaactccttgtcaatataacatatatagtaacaaaaaaacattatttttatcgcggaaacattcattttatgtcactattcgtaaccattttgaattttagaaattagaaacaaaaaattcaataaatcgaaaaatacctaagacttgtatttctacaaaattaaaaaaatgattcctagagtcagaaatgttcaatttttaataaatttctattgcaaaattctagaattgtcttttgacaaactaatcctcaccctttgtcactaatcaaccacttttctttttctcttcctcttctccttctccctttttctcttcctcttctccttcttcctttttctcttcctcttctccttcttcctttttctcttcctcttctccttcttcctttttctcttcctcttctccttctccctttttctcttcctcttctccttcttcctttttctcttcatctgctccttcttcctttttctcttcctcttttccttcttccatttcatcatgtgcaccccttaattattttttaaacaaataaatcaaaaacatttggtctttttgttaatttttaatctgttcttaaacctgcaaaattaaaaaaaaaattgaccaaaataactcgaaaaactcaagttaatcaaatttcacaactttttagttttaactttcttttgcccagccaaatttccgaatgaaatttcgaaggatttctaaaaagtaagagctaatgaaagacacccaaggaaatttggtttgattaggattttatcgaaaaaaattgaaaaggaattgtgatcccttttcacgagtaaaaaatttgtcaaaaatttttctcataattttcttaaaaaatgtaactcacgcaccagtcagacaactcgctttcatctggccttaaattgaaatgtttttttaaaaatattttaatattttctttatagatgtgtgacttaccaattaagaaagtagtcagtgatgaaatcgcttaatattgggattcattattataaaacatatacactaatataatatttattctatttattctttatttataatatatataactagcgggtgcgtgaaccgtcggatctgggctgggaaaaagcgcttcgcgctttgggagcttcgctacctagactgtgaagcgattcaaattgattgaattggttggagagattttttgaatttttaaaaaattattagaggttattagtccacattgaggctcaagacgggcgcttcgcgcccgttttttaaatttgttgaactcatacgagagcttcgcgcaaagtgattttggaattcggaaccaaaggggggtggccaggatttttgagtgaaaaaattttttcgacaaaaatctcccaaaaacatgtctttaggggttatttgggccgctgatcacgaatacgtgatcagattttacttttgacatcgtttagacctcagaatccctgtgtgattggggattctgagtatcattttgaggggagcaaatgaataaaataaacgcttaaaaaacaaaaattaatagtaattaatttatttaactggcaaaactgcgcacctcttctctattttatctcacaaagaattaaaattttcatcggttcgataaaaatatataaaaatttataacgatcaaatgtttgggtatgtgaaattgtcaagttaaaaaatttaataaaattggttttggaaaaaaataaaaaaacaaagcaagttctaagaagaagatgatggaaacaaaacttactaataattcaaaaaataatttgcgataatagtctcaattatcatttaaatttaatattgcttatttatgtgtttatttttatttgcaagttgtgaacggtcaattataggatcaaaaaattacattgataatattcctgctctgaaaaagattaacaaaatagatagatttaatgaaggtggtgatga

SEQ ID NO: 20509 - DNA, 1636 bp, Heterodera glycines
  misc_feature (5)..(5): n is a, c, g, or t
ttttncggacgaaaatggggggtgaaaattttttttctggggtattttgaggtgctgagcacgaatatgacctttgtttttcgtttcagattttttggaattttttaaaaatttttgaaaattcgtcaattttttggccttcgggattttgggttaattttcgaaaattcataacaaatcgaagggtggatcaattttcatgcaattatattgtaaaaatagagaaaaatcaggagaattttatgggatttatttgggatttctatcttaaaaagaaaaaaagatattccagaatttctgaaaattttcgatttttcagaaaaaaattcataacccccttctgaaaagaaatttttgaaaattaaaatactacaaaaatccgcaatttttttctttaaaatataaatcttattttacatttttatcactttcttacgaattgttacaaaaataaaaccgattttggtattcgggaccaaaggggtgagcataggatttttgagttgaaaaattttttcaccaaaaatcttcaaaaaatatgtctttaggggttatttgggcccctgatcacgaatacgtaatcagattttacttttgacatggttaagacctcagaatccctgtgtgattggggattctgaggcacccttatgaggaggggagaggcaggttcggacccggacggtgtacattatttttctatgcatttttgggttattttcactgtttttaattaatttgaagattcgttttaaattatttaaatttatttttttttaaattaattttttgttttattattaataacaaaataattttaattaaatttaatttttcttttgatgaatagaattatttttaagcaaaattagatttaaaaatttggatgcataataattcatttcaaaataaagtaaaataaattattccgtttattaattaaaaaataaacttttacattttttattatttagttttttttaaatttttaaataaacctaattctataaaattatgatattatttttgtacatctcataacaagttaacttttgtacctcttctatttactgttgtacctcttctaatcactgttgtacctcttctaatcactgttgtacctcttttaatcactgttgtacctctttttatcacagttgtaactcttctaatcactgttgtacctcttctaatcactgttgtacctcttctaatcactgttgtacctcttttaatcactattgtacctcttttatcacttttgtacctcttctaatcactgttgtacctcttctaatcacttttgtacctcttctaatcacttttgtacctcttctaatcactgttgtacctcttctaatcactcttctaatcgctgttgtacctcttctatttactgttgtgcctcttctaatcactgttgtacctcttctaatcactgttgtacctctttttatcactttgtatcttttatcacttttgtacctctttaaatcacatttgcacctcttcatcaaatttgtacctcttctaatctctgttgtacctcttctaatcacttttgtacctcttctaatcacagttgtacctcttctaatcacttttatacctcttttatcaaatttgtacctcttct

SEQ ID NO: 20510 - DNA, 2734 bp, Heterodera glycines
gctttaataatggcattaattggcacttaaatcattggaccaagcaactaaaaaatctctgtctctgttcttaggtctggaaatttctaggcatttttgggtttccctcttgtgcttaattcccggttacgcattggcatagaagccatgaaggtataagcataatagccatacatttcatagtagcttatataggaaacatgatggttgatagaagccataaaggtataagcataaaagaattgcagccatacatttatagtagcctagaacccatggtggctcgtctaggagccatacggtatgtttacgcgttggcatagaagctatgatggtatgcatgcataaaaactcactgttcaatggcatcaatttgcgctgctcacccagcatcataatgcagccgtcgggcggtgttgtcggagtgccgccaaatgccatcattgtgcccccgggcgatgccatgcccgtgccgttggtgttggccgccgacaatggcatcgccgcagccgggccgcccaacgcgttcacaatgttgttgaacagtgtgtgggaacgctgtgcgggggaacagaaatttaaaaaaaaaccgaaaaatgccgaaaataaattaaaattatttaaaaaaattgttagatcgagaaaatcaactgggaaggataaaaagacagaaaataaatcggtaatatattgcaatttaaagctaaaggaatgtcaaattgtataaaaaattaaaaaactcaaaaaaataatttaataatttactaaaaaatgcgattaaatttttgaattgaaaaaaatcagttaaaaaactatcgcaaaaaatttatatataaaaatatttaaattaaaaaagaataatttaataaaaataaattagcaaatatatgtaaactaaatgcattttcacccgatgctgcggttcctccgcttcgtgcacaaagtccgggtccaaattgccactgatcgcccgcttcaattcgggcccaatttcgtgcagtgtcctcagaccggcctaaaaatgttgtctaatagatttgcatggactgattcatgggcagactttgtgtttttaaataaataaataaataattccaatttggtgtgccgtgccgaatcctgcttttcattttcggtgcctcaaaataaaaccaaaatatttttggccaagatttaaggttgtgggatccatcttggaaatcattgctcctgtttttatactttgctggacaaaatccatcatatgccaatggtaggactcgatttgcggtactcaaattgccccttttttcgtttttggcaccaaatgatcggccggccaaatcacctgcagtgccatcgcgtgagtgttcggtgccgccattcccttggcctccaattctttgcgctttttgaagcgtcggaaatagtcttggatcagaaaggtggcgtagaatttgcccacggtcacttcgtcgtctcctgtaaaagaaaatgaattaattggggaaaaaagtaagtttaatagaaagaaaaatttaattttgattccaaaattatttattcaaataataatttagttttaatttaaatcaataaatataaagtgaatttttaaatatgtcctaaaaagtaaagttaataaattttaaaaagataaattttatactttgtttaaaaattaattattcaaattaaattttgtgtttaatttaagttaattaaaccaatgaattagcaatttcaaaaatgtctgataaatataaatatttaattaattattatattttccctgctaattagccaatattatgtgttttattaataaagtattcaactacctaataaataaataaataaaaaataaataatttattataaattaattaattaatgttaattatatgtgccattaattaattaattgccgccccccccccccccactcacttcccgccggtggcaccacttcgtccagcattttaatcggcgttcgcttccaaatgcgacggattgccgcccgcagctgctcattggcctcgtcgatgttcccatcggtgtaaattttcagatttgtccgtaccaactgcaaatgctttttttaaattagaatttaaatttcattttatttaatttattttttgtaggaattaattttgtcggaggattttttgcataaattttaccccttccccaaaaagggtttggacatgtcaatttttgagatccatttcagaaaatttaaaaactcgaagaagcgagtcaatttcattttacattccaatttttaaataaatttccataggattttttgcgtggtgagtcgaagtgcaaaaagtccgaatgagtggtgatcggaaggggcgggtcatttcagtaccgaataatgattttaattaattaataatataactatttaatctattaattagatctgctggccataattataatttctatttactatttaatatttcccaatcaaatcacatttttgtgagagaaatacagtgccccaaaaaagtcttaactcaaacctgaaaaactatcttatagttcatttaaaaacttgaaataattcatgctcgcacaacttttggtgctgatcaaaaaagtctcctatatcaacttgatcagatcactccttcctagtgaccggggcacctaaaatacactgaaaatcggggaaattttcgaaatccctagggggttgggaaattttttctagagaaaatgggcaagctcactggaaaga

SEQ ID NO: 20511 - DNA, 1808 bp, Heterodera glycines
tctattattgaaaaagttataagctaaaaaaaattcataatatcaagggtaaaatatagtgtgtaccttttactgtttgtatttgttcttttggcgttctgtatttattattattttattaatttgctttaaaaaattgaaatttatacacaaacacaaggaggaattgaacttgagaccccccttttggtgactaactcacagaccactaagacgaaaaatccagcatatttgtacttggagcccaaaattgggccgctgtgttaaaaatgggttttagaccgtgggttcaaatctgcgtgcctgcacaattttttattcttaatcaggcggtctcaaaaaccacgggagaaaatagtgtaagaaaagtgacattttgtaaaaaaaaataatttatttttaattgtattttttcaaaaacagatttatttaatgtcgcatttggattttttatttacatcactgtgctctgtttggttggtcgaagagattaaatcgccgtgaaggattttgttcactgaagagtgtttgtttgttccattcagcccatccccattttacacatttaatacacacaaacacaaatttgtctgaattattattttgcaaaaaaaaattgtgcaacaaatgatttttatttacattatttttttaaaaaaggataaaaaacaaatagaaaaaataaaaatgaatttgaaaattcaatgggaaacctaataaaaaaaaacgatggaaaaaaaatccaaaaaatatttcacaaaatgtcaccaaattaatcattgttctctatgtgttcactcattattttcatttgattgtattttttcataaaaaaaaattattttttaaattataaagtaaaaatccggaaaatgcaatttgcccagctgtttcttttgctttgcttttgaaacatataaaaaagaaaataggtgagtgattgtgagccgagaaatgttttttattgtgttattgtgagtaatgttttgaacagctgtttttgaggtaaatttcacggtaaattaattcattggacggaccaactgaccaccctttaaatggctagcaataatccaatttcttggttagcagtttagaatgggtgatggatgggtgcagcgaggatatgaattacgcgtacgcaaaacgcattttgaaaatgaaacaaacagacaccaaattcgacgcggagacgcgcaacacaaaatgatgcggaaggaatacacacaaaatttggacccaaaattttagcgaaatgggatcccgctgaattggtctcaaaaaattccgcaatttccaaaaaaaaatgcagtattgcggggactgggatatccagcaaaatgccgtctcgcaccgggctcggtaaattggaagttgcattcgaacgcaaaatttttaaaccctcttggcagtttactttaaaaaaatcgcaaatttggattcccacctgatttttggccactgaaccgtccaccgggtccgtgtactcgtagctgtccgccttggccacctcaaacgtgcgcccgttccgctcaaatttcatgcccacaaatccggccaacaatggctgcaaataattgatcatcaacgacgcaccgctggactccacattctcatagtcgtagctaaattataaaaaaaaatgattttccattttttttcatggcgacgacgaaaggggtgcactacgtacgcctggataaagtcaggatcgaatttatgttgtaaatgaaaaaaaaccaaaaagatccaatttttgaggccgcgttacctctttgggcttttgcttttcaaacttagaaattttt

SEQ ID NO: 20512 - DNA, 1253 bp, Heterodera glycines
  misc_feature (1192)..(1192): n is a, c, g, or t
agaggaaacagtaatttgtagaatagtaagcgaatccgggataaggtgaggattagttatttattcacgagtaaaatgatttaagatatggtgaggattatgagacagaaatgtggccatcagtgcgttggattgctttttcttatttcaagcgattttatttgcgagaatcggcgatggaatattatcctaaaaatgtggtaatagaacctttttacctaatttatctcatcttaccttctcaattaatctttagatgatggcctgttattatttggcagctaaagttgatgagtttaatgtttccattgacaattttgtagacaatttaaggtaaaacattatcatttttattaattttttccgttttttatggaattattttcagaaacggcaccagacaatacaacacggagaccatcttaacactcgaaccggatgtgatgcttaaacttgtaagaattgaaaaataaaattgtttctttttaagactctttaattgttccgttagaattacaatttgaccgtccacacgccctaccgccctttcgaaggccatctgattgaaatgaagactaaaattggcagacaattgtcagaaattgagttcgacttggaatcaatcagaccaatgtcaagcgaatttctgaaggtctttctttcctcgcggaatgatttttcgcaaaatgaaatcacttttcagaactctttgctgagtgatgcgatgtttctttactccccttcacaaattgccttggcagcggtgaaattcggcatggataaagcattgggaggtgctttttctctatccatggattggtttcgaaacaaatagttaaattggcagaagtccgttcctccactttaatggtcgactttctcgccgctttgctcgacgtggacatcggcgacactggcggaagaggcacagcagacattttgcagttggagaaactgcaagttcggcttgaccaaatctgcaaattggttctacaacaatttgcccagggcgtaagtgccgaagaaagcgcatcccttcaagtcagtttgacagagaatatcaaatgtattttagtgaaataaatttagacaaagtttctggcctatacgcaaaaagaaagtgaattaatgcccttgctcatccaattggagaaggccaatcttgagactgtcggaggaactaacgcagcgngatttgattctgatgaagatttttattttgaaatatttataataatgataataaacggggt

SEQ ID NO: 20513 - DNA, 1518 bp, Heterodera glycines
cagatttggtccatcaagtgctggaaaatggatggtgcctttttaacgccaaatgggagacgttggcactgaaataagccgcggtgggtgtttattgtgcaaagatgtttcgatttttcatccaattccatttggaggtaggcgtctctcaggtcgaggtttgagaaaaatgcggctccacatatatgacgtcgggtctcggaagaggatggcgattcagttcgatcgaatcgttcaatccggtcgaaaagtcgatgcacacccgggtctttccatttttttttttgacggccaaaatcggggcggcccaatggctgaattctaccggtttgattgcgccaatctgcaagaggcggtccagttcggtgtcgacagcttcgattgcaccatgggggactggtcgtgctttacagaagatgggtcgggcgtccggttttagaatcaggtgcgctttgattgcgcaatggccaagtccgttcttaaaaacttcctcaaaatctttttgcaacacagcggtgagcgaggattcatccgtaatgccaatcgccgggtttgttgccttgacgacattggcgttgattgatgcgtttggctttcctttgatgctctttgggaacaaaatttctcttgggatgagctcgaattcctcaatccacggaaggccaaacaaatcatgctttaagtcactgctgacgtaagcgatcagtgttttggatggccgatcgaaacaactgacggtgcaatgaaattttccttcggttgaaaatgcggtgtcattgcagttgcgggtttcgatgtccgttggagagagtttgggttgacccaatttgatccacgttttgaagctgatgactgttgcttgggctccactgtctccattcatcttcaaatttatgccattgatcgtgaccgggatcttccaccatcggccttgggttgtgccaatcaccatacaatgtgacttgaccacgaccgtgtgaaatgatcggttctgagatttgtgtgccgtgttcgacgagcgctgacggcagacaatcgcaatgtggccttgccggttgcatttgttgcaaaatgcgttggcaaatttgcagtccgatcgccagtgatcgttgcttccgcatgatgcgcatggatgcgatggatggcctcggtttgctttgtcgtccgatttttgcttaggcgaaggcgcatgatgtgacgatttgggtgccggttcatgatgtggccatttgggtgccggttttgccttgtgtttgcctttgatggtctctcgccattgctgaggtcgcaattggatggcgctggttgagaccggttgagtaagcagagaaagggcactttccttgacgatttgaatcgccttcaattcctcttccaccttttggagagtgatgtctgtgccggtcttttctgcgtcctccagcattttgagacacttttgcctcaggtcgtggtgctcgtcgttgagtgcaatgaccaggattatgcactttagctgttctttggtcggactcaaat

SEQ ID NO: 20514 - DNA, 1172 bp, Heterodera glycines
acttaatataaattaaatcattgactaatttactttgttcttttattatttaaaaatcaatatttccattttttctataaatcttttttttaaagtgggattgaaacttttcataaatatttacaaaaaatcaaattaaactggccaatgatttgtcaattttttaagatttttgcactttttgtgaatcaacctagccccttcatgccacgaacacataaagcgcctttctgttgactatttaaaaaaaaatccaaattgatgtcactggaattttcgcaattttattttcaatttccaaataaataaatagaaatcactgtgtaaaaaataatttttttttttttttgaataatttttccttttgaaaatggcataagaatcgcatttaaacttcaataatcagaagccatcgtccttctcgacttccaaattttcgaattccatcgtttgcttctccgcattgtactcatatttgccggtttgtccactgaactgtcccactctgtgctcccccaaatcgacgtgcacgcggcgaagctcagcgacattgtgctgaacatttaacactcattaagagtgaaagttgaacaattacatttatcaaattgctttttcgtccaattaatggaattatggatgaccctttgtcgtgaatcacacttcgaaattgttcggatttgattctttgtgatgacaatttgacaggcaataattagggatgtgcgagaaatgatttttaccgagaatcgagaaccgagaccgggaaatgaccccgggaaacgaccgagaccccaaaaaaccctagaaatttctcgactcgggatcgggaaccgagaaatctaaaattttttagccgttttttaccaaaaattactatttttgccattttggtcaccatttttcaaaaatatggtaaaatgggggtccggcgatgccgttaggcgctgccggaaaatctttaaaaattttaatgcaatttgttaattgtaagaatatagcttaaaatttcaaaaaatttgctgaaaatttttacttttttttggtttcgggggcgggggggggctttagcccactccctggctacgcccttgatcaagtgagcatttcacaataaaaatggatttaatttacgaatttatcaaattgtaattatcaattacttcataaat

SEQ ID NO: 20515 - DNA, 859 bp, Heterodera glycines
tgatgttagaaaattattatcagcattaatgttcataaagaataattaactacaaaaaatacaatatgccattttacgcctatttaacactttacgaaggttttttcccaaaaaataaccatataaaaaaattttatttacatattttcgtacatattttgggtttttatacatatttcttacatatttggggattttttttacatatttatgtacatattttgaccaatttttgtacatatttttgacatccctataaatcattaatgaaaacttctcaaatacaaaataaaatttttatttgaaaaataacggaccgggtcagtttagtctggccgtaatagtctggtcgttatagtctggccgtaatagtctggccgttatagtctggccgttatagtctggccgttatagtctggccgttatagtcagagggtcggtttagtctggccgtaatagtctggccgttatagtctggccgttatagtctggccgttatagtctggccgttatagtctggccgttatagtctggccgttatagtctggccgttatagtctggccgtaatagtctggccgttatagtctggccgttatagtctggccgttatagtctggccgtaatagtctggccgtaatagtctggtcgttatagtctggccgtaatagtctggccgttatagtctggccgttatagtctggccgttatagtctggccgttatagtcagagggtcggtttagtctggccgtaatagtctggccgttatagtctggccgttatagtctggccgttatagtctggccgttatagtctggccgctatagtctggccgttttagtctggccgttatagtctgg

SEQ ID NO: 20516 - DNA, 1028 bp, Heterodera glycines
tagtctgcccgtcttagtcggaccgttatagtctggccgttatagtcagagggtcggtttagtctggccgttatagtctggccgttatagtctggccgttatagtctgaccgttatagtctggccgttatagtctggccgttatagtctggccgttatagtctggccgttatagtctgtccgttatagtctggccgttatagtctggccgttatagtctgtccgttatagtctggccgttttagtctggccgttatagtctggccgttatagtcagagggtcggtttagtctggccgttttagtctggccgttatagtcagagggtcggtttagtctggccattatagtctggccgttatagtctggccgttatagtcagagggtcggtttagtctggccgttatagtctggccgttatagtctggccgttatagtctggccgttatagtctggccgttatagtcagagggtcggtttagtctggccgtaatagtctggccgttatagtctggccgttatagtctggccgttatagtctggccgttatagtcagagggtcggtttagtctggccattatagtctggccgttatagtctggccgttatagtcagagggtcggtttagtctggccgttttagtctggccgttatagtctggccgttatagtcagagggtcggtttagtctggccgttttagtctggccgttatagtctggccgttatagtcagagggtcggtttagtctggccgttatagtcagagggtcggtatagtctggcaagctgttttcgcctataactcttacaaatattattttttgtcaattataaacaaggaaaaacttaaaatatctatgtttagctacaaatacaaatggaacaccccaatcataaaataaaaacaaagcaaaacaaaaagaagctggaacatgagggtgcactttatgtttttcaccaattcagtgacgatggacttcgtaaatattgacgatgcgagtttttcgggcctaatcacaaatgcataggt

SEQ ID NO: 20517 - DNA, 2111 bp, Heterodera glycines
  misc_feature (2090)..(2090): n is a, c, g, or t
  misc_feature (2104)..(2104): n is a, c, g, or t
actaaactaggtaattaaaatctgcatgtttaagaacctttattatttgtaaattcagcgaatgaaccgaaaaacggtcttggttgaagtgatggttttgaattctgagtgagaaaaacaattatttggtaatattatcgatggcactatgggtcaagctagagcccggaaatgcggatcctgttgcaggattggaattcaaaattttttgcaggaccggatccggccggattaatcctgcaaatcctgcattaaaaatttgctggatcctgcgcaggattgcggatttttggaaattttgaaaaaatttcaattaaatttaaaaaattttcaaaacgataaataagtgttccgatacatttttagacaaaaactggtgaaaattaatatgaaaaattggcatcaggaatagaatgaacaagcgcgtcctcatacctaatccatatgtatattataaaaacaaagtttctgtatatttggcattctgtcttagaaattttaaaaaaaaatcaataaaatcccgcataatcctgcacaaaaattcaaatttgcggatcctgttgcaggattggaattcaaaaatgtttgcaggaccggatccggccggattaatcctgcaaatcctgttttttccaaaaaatgcaggattgcggactgggatcctgcaaaatcctgcgcaggatccggtcctgcgccgggctctaggtcaagcccagtgttagacaaaattgctcgtaacgccaaatagcgtaattggcgtaaattattgcgcgctaattcaaatttacaatgatcactgatatttttgattgtttattttgatcagccttaactttcttcatttccaactaaactgaacaaaattggtatctaaaaaaagttttgaaaaggtgaatctttttctaagcgaatgctaagcaaattaactcgtttcaaaccatcaaatttttcgaaaatgttaaaatgaaaaaagtgaggtgaaaatgtggtcaaaaatctgggtatttgtcgttttctttgttgttcttaacgcctcggtcgtgcagtgcattcaacatcgtcgtgtgcttcaccagtttctcaacgatcttctcttgtgggccgagatgagagtagcggccaacctaaaattaaaaattcaatgataaagaaaaattgaaacaccaaattgttgcacattctgtgcatgtgttccatttcctgttcgctgatcagaccccaccaaagatgagagcgcgcaaaagggacgacatgggcactgagaaggtgaagcttcgtacggacggggtaacgcgaggcgtcaattgtccggagttgctgccagtggcagtagaacattttggtccaatgttcaagcgaattgagatcctctgggtgaagaattttggcccttgacagacgataaatgtttcgcagatcattcatagcatcgattagcaagaatttcaatggtccgggtggaattggggcggtgaatgaagcgaaattttggtggttaaggattttgtatatgtcaccgcctgtcaaaagttggcctcaataacccccacctcatccccatcattctacccgtgaattgttttgtccgagggtgccgtcgcacgccgacatcagacagtcgtttccgaacaacgtccccctttccacgagcgtccgcttccgaacaaatggcgtcaattattcgctggccattgcttgaaaattcagaatcattttttaattcgcattcttgaccatgcaaaagatggaagctcggcggtacaacatccatcaaagcaatgttgacgagtggagggccgtgtacgaattttggggtgggggaggcgacgggcgggcatcaacaattttgtccgacaattggtcccgccgagttcgccaattcctgaagacagccctcgaccatggctcacacgtcggtacagacaagtgcgcgagtctgttcctcgcccacccactctaaatttcccccctccgtcagctccctcttcagacgcttcattgcccacgtcggcgcccaaacgtcatgtccctggccggcgaacgaccgcttcaacgcttcacgggctttgaaggagatgcctgcgtccaantgtgatgagcagantcgttca

SEQ ID NO: 20518 - DNA, 2557 bp, Heterodera glycines
aaaaagtaaattttcaaaaaagcaaaaatggaatttattttttattttaccaatgtgacaaggtctgtgccaatgtacaacttgttggaggcacgcattgaacagcatcggagcaacaaactgaagaataacaaacaaataattattaaattaattaccaattaatttgtaaaaggtaataacaaacaaataattattaaattaattaccaattaatttgtaaaaggtaataacaaacaaataattattaaattaattaccaattaatttgtaaaaggtaataacaaacaaataattattaaattaattaccaattaatttgtaaaaggtaaaaattttatgccttttatcttttatgtttttttttctttatttttttaatattaaacattataacatcagattaccacaaattaacttttacttttatcaacaaaatgaatttcgaaaataaatattttttaaagtacatatttttaaaattgaaaacattttgagaaaaacccaaattttttccaaaattcttcgacctctccaaatagcacaaatcttaaaaacaagaaacacttgcaacacttttcatttaaatattttttattttattttgcctttgcccattctgtgcccatttcattccgctgaacacttccgacggcgctttgcacgtgctcaagtcctaattaatgaattaaattttaattaaaaattaaattctaaattttgatattaaaaatttgcaagtttcacttccgcgcatgtcgaagcggtggaaccgcacggcaacgggccgcactcggcctcaatggcgccgtcctcgtacaccgtcaatttgttgaccaccttcaaatattttttgggaattaaacatttattttggattttcaaaattgaattttgccaattttcacttcacctgatctttcgcgcactttttgcctttcactgcgttttgaagttggcccaaagtgaaagggacggcgcaaagcgcaaaaattgcgacaattagtgaaaattggaaaggcatttattatttatttgtttctcaattcaataaagcaaaatgtaaaataatttaatgtgataaaaacaaaaaatattagtaaaatattataaaaatgccgtaacaaaaagggcacgcaaatgtggatgtgctaggatttatattattatctcatttaatttaatttgcagatagcatcttctccgctcatttttcggattaaagtgacgtcacatataaacacctaaaaatgcctaatttttgggttcgatacctaaaaaccaatttagtactgttagcgcctgtttttacttaattatttgcgtgattttcgaatttcttaagaaaatgagcactcctatttttgagaggttttcaagattttaaattgcagttcaaaatgacgattattttgaacaattttctgccaaaaataaacatttctagaggatttgtgaggagagaatttcggttccaattttggaaatccggaaatggagacaaataaatttaggagcattagagtgatcacttcactgatcctggagaatgtggaggcttttttcaatttcgtggattttatttttttttggcatttatgatttacaaacttcaatttttgaaagattttcatttgtttaaaatcagtattatttaattatttttaaagttttaattaaattcttaaaataaaataaatgccccaaacaatttaaaaaattaaaaaataataattttgattaactttaagaaatgtccatcaaatttggacctatggttttttctttaatctatcaatattttttatctaaatttggacattaaactttgatttaattgatttgaatttttctaaagaatttttttatttttaatccgttagatttaattgattttttcgattaaccaaattttcaatgaaatccataaaattaatgtataataataattaaataaatgaatgagcatttaaatgtcactttaattataaaataataaaaaaaacaataaattatgcattaaacaaaattataattcgccaaaaattccgcagaaacacagtgcaaaaacgtgagatccgaaaattgttttcggttgtccgatccgtccgtcgtcaattgtcaccaattttggcgttgtgtgcacacaaattccttccttccgccgtcggtcggtggtcgtcgacgaaattttgggtcaccgaaacggcggcggactttgcgccatcgccggcccaccgatcggacggaccgatcggacggacggacggcgcgcgaattgcccccactgatcggacggaccgatcggacggacggacggcgcgcgaattgcccccactgatcggacggaccgatcggacggacggcgcggactgtcaccggcgggcgggtaaaagaatgaatgaatcgtatttaaacagcagcacgcgcacacccaaaacggggtcacatttgcttctccccccccccccccgttgatcacgtaaatttttgaaaattcgacgaaaatgattaaaaggtgacatgaagttggcaccaggacctgcagcatcagctg

SEQ ID NO: 20519 - DNA, 1298 bp, Heterodera glycines
cgttgttcatacgatttgacaatctgaaaaagtgatcgagaattaaacttttcccaagaaagatcaaattagagcgatctatcaactcaaaagtcgaggcccaagactctcgcaaatcactaattgacggaagcaattgctttttgatttattgcccctcaaaccgaaatttcaaggcattttcattaataaatgttcagcttaatacccaaaaattctcacaaagtacaaggaatgtagaagtgatagatttggtatttttaatttttggggatattaaattttagtttaaaaattaattaacatttttaattggtcgatgtccttaactgacctgttgaaattttaactcaatattttgtagaattttctgctgtcttttggcgagaaagtgatcaaaaatggaggaagaaactcggagaatggaccaacggaaatcgaaacgaaaagcattggccaattcggaaagaagctcagggggaagttgaattttgggaggaaagcgcatggcttaagcaattaaaaataattagttaattagagggaagttgaattttcgggggaaagcgcatggcttaaagcaattaatcgaaagcgaaggtccgttttgaaaatgccggttttgccctcatcagttggcaaaatgtactttttgttttatttaggttaaattaatggggaattaaatattcaaataggctttatgttgataatttgctttattactgatgtggattgagagtgagttttgcgctttcctcacttttcttattggtgctcattagaagagggcaatggaacacaaaaacggcaaaaatcaatgaataacaaatacaaatgtgcctaaatggcgttggttctcacagtcagaaaatggcacaaaatggaaaaataaaaacaaaattttaataaaaggatcgccgaggctccaaaatttttcggaagtcggaattccgaccccaaatacgttggaaaccggaagaattttatgaagttttctaaatattttaataggctaaattttaaaattcttaaccaagtataggtgagttcaaaaatgtttttggtatatttctgtttttgcacgataaaattattcaattcatcaaaatcttttttaatgtcattttacactgttgccctaggtgttctctattccgaaaatttttggcaaacgaagtttttttaaattttgcatgctaatagagaacacctagggctatcgaatgctacgaaattcattcaattcgaacaactatgaaaaaagttatgctccaaaaaccgcgcgggcgcccagt

SEQ ID NO: 20520 - DNA, 900 bp, Heterodera glycines
tgaaaagaagtgatgtaacgccttctgctgaaaagacactgtactactgtatttaatagtttttaattaataaaatttggaatttcggatattcaatgacgatttgatggagcatttaaatgctaaattcttcatggaaaaatttagggcaaataggcaataaatgtttatgttattacaaacgctgccattaaaaattgcggcggagcgctatcagttattgcggacctggctgattatacaaatacgacttagatatcacaaataagctccagtgatgtaacgccttctgctgaaaagaattgaactactgtatttaatagctttaatgaataaactttggaattattcggaaattcaaggacgacttgatggagcatttaaatgctaaattcttcatggaaaaatttagggcaaataggcaataaatgtttatgttattacaaacgctgccattaaaaattgcggcggagcgctatcagttattgctgacctggctgattatacaaatacgacttggatatcacaaataagctccagtgatgtaccgcggtctgttgaaaagaattgaactactgtatttgatagctttatgaataaaatttggaattattcggaaattcaaggacgacttgatggagcatttaaatgctaaattcttcatggaaaaatttagggcaaataggcaataaatgtttatgttattacaaacgctgccattaaaaattgcggcggagcgctatcagttattgctgacctggctgattatacaaatacgacttggatatcacaaataagctccaatgatgtaacgacttctgctgaaaagaattgaaatactgtatttaatagctttaatgaaataaactttggaattattcggaaatttaaggacgactt

SEQ ID NO: 20521 - DNA, 909 bp, Heterodera glycines
agcgctatcagttattgctgacctggctgattatacaaataggacttagatatcacaaataagctccagtgatgtaccgtcgtctgctgaaaagaagtgatgtaacgccttctgttgaaaagaattgaactactgtatttaatagtttataatgaataaaatttggaatttcggatattcaaggacgacttgatggagcatttaaatgctaaattcttcatggaaaaatttagggcaaataggcaataaatgtttatgttattacaaacgctgccattaaaaattgcggcggagcgctatcagttattgcggacctggctgattatacaaatacgacttagatatcacaaataagctccagtgatgtaccgtcgtctgctgaaaagaagtgatgtaacgccttctgctgaaaagaattgaactactgtatttaatagtttttaatgaataaaatttggaatttcggatattcaaagacgacttgatggagcatttaaatgctaaattcttcatggaaaaatttagggcaaataggcaataaatgtttatgttattacaaacgctgccattaaaaattgcggcggagcgctatcagttattgcggacctggctgattatacaaatacgacttagatatcacaaataagctccagtgatgtaacgccttctgctgaaaagaattgaactactgtatttaatagctttaatgaataaactttggaattattcggaaattcaaggacgacttgatggagcatttaaatgctaaattcttcatggaaaaatttagggcaaataggcaataaatgtttgttttattacaaacgctgccattaaaaattgcggtggaacgctatcagttattgcagacctggctgattatacaaataggacttagatatcacaaat

SEQ ID NO: 20522 - DNA, 1290 bp, Heterodera glycines
ttcatctctgagactcaattctcaggctttccatcactggaactcaaatctctggcattccagacactgggactcaacccaccagcatttcaatctctgggactcaattctgcggcattctaaacattgggactcagcccaccaactttcaatgacattccaatcactgaaaatcaggccaccagcattccaatactgggactcaattctccggcattccaatcgctgggactcaacccaccagcatttcaatctctgggactcaaatctctggcattccaaacactgggacttaacccaccaactttcaatggcattccaatctctgggactcaacccaccagcatttcaatctctgggactcaacacaccagcatttcaatctctgggactcaaatctgcggcattctaaacactgggactcagcccaacaactttcaatgacattccaatcactgggactcaacccaccagcagcatttcaatctctgagactcaacccaccagcatttcaatctctgggactcaacacaccagcatttcaatctctgggactcaaatctccggcattccagacactgggactcaacccaccagcatttcaatgtcattccaatctctgggactcaacccaccagcatttcaagctctgagactcaattctcaggctttccaatcgctgggactcaacccaccaacatttcaatctctgggactcaaatctccggcattccaaacactgggactcaacccaccaactttcattggcattccaatctctgggactcaacccaccagcatttcaatctctgggactcaacccaccagcatttcaatctcggtgactcaaatctccggcattccagacactgggactcaacccaccagcatttcaatctctgggactcaattctcaggctttccaatcactggaactcaaatctctggcattccagacactgggactcaacccaccagcatttcaagctctgagactcaattctcaggctttccaatcgctgggactcaacccaccaacatttcaatctctgggactcaaatctccggcattccaaacactgggactcaacccaccaactttcattggcattccaatctctgggactcaacccaccagcatttcaatctctgggactcaacccaccagcatttcaatctcggtgactcaaatctccggcattccagacactgggactcaacccaccagcatttcaatctctgggactcaattctcaggcttttcaatcactggaactcaaatctctggca

SEQ ID NO: 20523 - DNA, 1013 bp, Heterodera glycines
tttacgctttgctaaaaaattttattcaaaaaagtataactaatatttgtacatagttctagatttttttttttacatattttatatacatattttgagacttctcatataaaaaatttgtagccctattaataaataattaaactacagatatggaagcgagccactggcactccgccgccagcagtaatgctattaaatgagacaggaacaaacattgagccagatttgcccaggtcgtacaaatccaatcaaaattttatttcttttttcctcaatttagtgcctttctgtatattgaggaaggctcaggattaagtgagttttttaatgtcaatgtaaatcaacttttaattcaagattttaatgaaaaagtttttggagtttagaattaattgctttttactaaacaatttaattctttttttaatctattaaaattataattcattctattgtaattaaaatacagtttcgcgcaataatttgctggatgcagacacaaagccaaacgaatttcgaatgctaatttccgatccaattcattgcatgggaccttcgagcattgacctgaaatttaggcaagaaaaaaaattgaataaacaattcaataattaaatattgtttagaatatggtcaacaaaaggcataaaagtaatgttaaaacatttaaataaaaaataaaataaaaatgataaaaaaaagggacggactggtaaaacttttaataatggccgtgtttcttttttgaaaatttactcttttttgggtttacgcaatcttttttaattcaattattactatctatttttggttaatagaagactgtcaatttattttttaattttttcaatattagacaagttttgcccaaaataaagggcgtaggcagaggggggggggggggggtccttataattcattaaataatggaccgtatctcctcgatcatactcccccccccctctaatgtaaaccacccctctaatataacccccaccttcttgttgata

SEQ ID NO: 20524 - DNA, 1576 bp, Heterodera glycines
cccccccccccccccccttcacaattttggaaaaaaaaaataaaataatagggagcctcagaccttttgaaaattttttataaaaactgatgccaagctaatgtgataaaacaggttaattcttttcctttcagtatccctgcaaagtttggggcgcttctgataagtttcatgaaaaaaaagttaagcctaaactttttgtcctgtttaaaaaggaattaaaaatttttaaaaatttattcagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaccaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaatttttaaaatttaataa

SEQ ID NO: 20525 - DNA, 2236 bp, Heterodera glycines
  misc_feature (69)..(69): n is a, c, g, or t
  misc_feature (129)..(129): n is a, c, g, or t
gccaattagtgctaatgagttttaattgtggcgtgaatgttaagattcaacttttcttttcagcgaatntatttaattgagtctataataattgagttcaattgcgacaaattcacaaattaaatgctntaatttaaaaatgttaccctttttggcagtttttttttcatatttgctatattttagcaccaaaatttggcaattgataaacattggtcactaatttcagcatcctcaagtgaaggccaaaggatcgacgttggacttgtccgatttgacctccgacccgttgttggcattccaacgaaagtggggcgccaaataattggcataataatgattaatttaaatttatttattttttacaattttaaacacttttttattttcattttcacaggttttacctccctttggtccttctgttctgctttctgttgcccgtggtaggtgtattcaaccaattttttcaaaacgatattattggggttttgaaaatggtcaaaacgtgtccccacgactcaatctcttggccaaaaaccaaatctagcaattttgatttgtgtgtttaaaattagaattatttataacggtaaatcttaattttttcacccacaatactcaattttcattccttttcagtttattcccgttttgttatggcatgaatcggcaagtgtggcattttacaccgcctcactgttccgctacacattcacattgcactcaacttggctgatcaacagtgtggcgcacatgtgagtgatgaaggccaatcaatgggctgatcaatagcagctacacactgatgaaactaatgatatagtcattttgatcagaggcatttgactgggtttctcgagaatttgtgccctgtgccatgagtttggtcagtcaaaaatgtgatttttaattccgttcagaacccgggagtaattttttctggctcagaaccgatcattaggtcaaataccctttgtactgctgataaatagagggatttttggattaagaaaatgtatatttattgattagtcgcgagaatttttttctttgctcttactgatcattagttggaaaatgtctacttcctctgatcattagctcactgatcatcgggggtttaagttccattctgatcaattgggatttctttcagtgttggctaccgcccctacgacgtttcgatcagttccaccgagtccgtgtggaccaccgttttggcgggcggagaaggcggccacaattaccaccacacattcccacaagactatcggacaagcgaaatgcgaacactgctcaacttcaccaaggcaccaaacaacagaaaattggcactatttacctttgccattcattttaggcattcatcgatttgtttgagaaaatcggatgggcctacgatttgcgaacggtcggcgaaaaatcagtcgaaagacaaaaggccaaacaattgggaaaaattcgaagggagctgaaggacgagtgaaaggagcctaatgagttgattttgaactctattttgtaaattatttttgtttctctaattaaaaaagagaatttcgccacaaaaaaagccgacattttaattaactctaaattttttgtacgaaaaatcgaaatcatttaagtttttttaaaaatccattaaaaggctttcgtctccctttttttcttttcattatcgttttttgaaattattaaactttcttttcccaccacttaaattgaatgtttaatctccgccaatggtcacaattgaaaagcgataaaagaaaatccttcggaacttttctttttttattaataattatttcaatgacaaatttccttttaaatatattttaaattatttaattatttatttttcttttcgatgtttttcctcccaattttattctctctgatttatttctcattttctgcggctgaaccaaaaaaattacgcaaattcgcagcaaaagaagtcaaatttggcgacgaaaacgttgacaaatttcattccggaaaatgctcatttttctgcttttttgttccacttgagacacaggtggacagacagagaaagggacgagagagtgtgatgaggagagaaatagagaaagagcgagagagaggaggggaagagagagagagaaatagagaaagaggggaagagagagagagaaatagagagagaggggaaaagagagagagagggtgtgggtgaggagattagagagaatgaacgagggag

SEQ ID NO: 20526 - DNA, 2410 bp, Heterodera glycines
cattaaatcgatcggtcaaataagttcattttttaaacaaaacccatcacagccccttgctcgtccatgaaatcgttcacactttttggcactaaaaataatttatttatttattaaatttgaattatgcccaaaattatgaactaaatgaaaggggggggggaggaaaagtgataaaagaaaatcctgaaaatttaagaaattttattcatttctttatacaaattggatgtttttatctgtcgaatggcgatgttttaaatttagtgtgagcaaaaggaaattacaatatgcatccgtggtaccgtaccggtatcgtacgtttcgattgcctggttgagcaacagcacagtgacggtagcattttctttggtcactttgcccatgattgtgatcgaatcgtggcttctgatcagcctctcaggcggcacttccatcacatagggaacggccaacgaacggttttcaaagttggggaaaacgcctttggttctgtccacggcgaatttgctgagcgttccttcttcgtaatcgccttcgacctgttgagaaagaagaaaaattttatgttcaaattgaaaaaaatgaaaatgcaactggtacaagaccagggttacccttgaaaatttcccgaaataagagcatcgctggtcaaaaataagattttagggtcaaaaataaggacattttttaaaacacgcttccaaaactttgaatcgcttttttattcaacaaaatcaagcattactcaccgccaactattttctgagcatttcggcttagaaatgagaaatttatacatttccgaaaatcaattataagattttaacaattttgtcgacgcatttttccgaaaaatttttgggtatgggtgagggaagagagttcggcggtgccgataggcgccgccgagggaaattttttaaaaatttaatgcaatttgttaacaagttctgtccaaaaaatgaccaaaatttgcgatcttgggctaatttttaagaaaaataggagttttggggggccggcggtgccgataggcgccgctgggggaaaattttaagaatttttaatgaattttgttaggaattagccaaatttttcagaaatttcctcttttaaatgaaaataagacactaccccaaatcagaacatttcttagaaatatgaacagatacacccctgctctaataggcgccgacagaaaaatttttgtaatttttaatgcgatttctcaacgattttgttcaaaaaatgacaaaattacgattttgagctaatttttttaagagaataagaaaccgccgagagaaaaatttgaatatttaactgaatcttgttaagattttgcatattaattcgcttcaaaaaacatttctttcaaaaattatcattaaaaatctaaatttctccctgaatccaaaaaataagatgaaaataaggacaaagagcttaaataaggacaaatcttacaaataaggacaaagggtaaccctggtttagaccggactgggacagttttgtctggccgatttagtctgagacaagtttagagcatcataactttttctttgttgaccaaatccaacaaattggcatatttgaaagctcttaacaagctcttttggctttccaaaaaacacaaagatataccgacaaataaaaaagttataagtaaaaatatgcaaaaatctgacttttgtgcagtattcatgttgcaacttttttataggtttttcaatcgcttagaaatagcttatcattagctctaaacaggtagggcttccgaatgatgccaaatttataaaatttggccagctgatgaaaaaagttatgattctttaaacttggctcagacgaaaccggccagactaaagtgtcccccacccgtttagacggcttgcttaaggcctaacaaacggatttacatggataataaatcctttatacaaatgcacttgttgactgcaaaaaaagacgtaaaattggaattttcgtatcggtacgattttttgatcgtacatggaaatgctgctgtaagcatacttttttcccattttccgcccatagataagatgacaaaagatatttgtacaaaaaattcagaataaaaaatggtgaattttatattattctttttaaattggtatttaaatattgaccatgcaattcaattcattgacaccgatttattttggatcgcccacactaagtttttttttcggaaaacttcttaaataaatccattctttttagtccgcttaaaattcattctctatgaacacataaatcgacattttatgagcaatggttgagaattagtccgtcgattttgacatgattcaccccttttcaataacataagcagcagaagcgagagaacagagaagcttggcaaagtgagcccaaaatt

SEQ ID NO: 20527 - DNA, 2678 bp, Heterodera glycines
  misc_feature (1034)..(1035): n is a, c, g, or t
  misc_feature (1076)..(1076): n is a, c, g, or t
cggacctgagctcagattttggaaatcattgattttcgtttatgatttttcatcaactacatatattttttgattttttatattatttaaaaagtttaccaataaatttggggttaaaaataatctgagctctgattatgcattaaacttcagaaatcaaaggcgctagattttttgcatcactttatactatacatagcaaaagatcggtctgaataagtgaaacaaaagaagcaattgtaatttatagtacagcagtcaattcgaatccgaataaaatgtcgataaatataatactttttggaattttgacaaaacatgggcatattttctaatcaaatgagtaataaattaaaaaagcggaataaaaattgttttgataatggcactttcccatgtcattttcagagcgccaattatattttttatctaattcctagtcaagttattcttaagagtgcccataataatggaggcggccgttgcggaggagggagtgttagcggtgctgggggaggcgccgggtgtgaacaatcgcatcagttcattcatacggttgctcaacgcgttttgttcctccaaaaattgacgcgtttcctccggcagcacacgacgcacacaaatgctttaaaaacaagaaaataactatgaagttcgacattggaaaataaacatgggctgtatttttttgacaaaatccagccgaaaattaaattttaaattggtatctttaccccggtttcaatggctcccgattaagacgagtttgacgaatttcgacaaatgcgcgccgaacaatggaagcgtattcgcaccgagccatcagttgttcaaattttaaattttggtcaggatggatgtccatgaagttgtacaagtcctcgacagcctgaaatcaaattttccgttttttgtttgctatttttatttaaatttttcacataaaaattcattttcattcaccccatggaaaatgtcgccagaaattcggctgaatattgacgacagttcatcatcaccgcccattttggtgnnattattctgattttgggcagctccgcctgcgccaccgtccntgccgtttctcttccatcgcttttcggcccaccgttcggatacatcgccgcacataactcaccaattgggaactttcgggaaacggatacagatagttgagcatctaacaaaaagcaaaaatccatttagaaaggctgcaataagtatatgcacacccctacaaaaaaattaaaaatttttagtcgaaaataataggaaaaaataaattaaaaatccctttttaaaccaaaagttaataaaattcttaataaaatttacagtgtttttcactaaaagtgacaaacgtaccgcatatttttggttgatgaccaaacgctgcaaaaaaatacacaacaatttggacgtgtccttcactgtgtcggaaatttggttggtttgtccatcggcaacataaaaacgcgaataatactcgtggattgggtgcagcacagtcagaatgtcaacctaaaaagaaaacttttgtttacaaaaaaaaactatttaataaactttttcaatcctggtcggctcaacaattgcgtcagtgaatttggtgagacatttgcggaccaacgatgacaattgaccgccaggatcagaggcctggtatttcatgaccaatttcatcagcgccacaaaacacacattcggatttgtgaattcgcacagtcgaatcacaataatgttgagagaacggaatacctataaaaaatgattgaaacattaaaaaaaagccaaatcaattttaaaaaatcacctgtttgttaagtattttaagacgctgatcgctgaccaacgaaagaagtgaatcaatgaatgaacgcaaagtatccgtacttatccgttgcataatggtcatttcgttagtcagctaaaagggattgaattagtggcattgttatgaaatccgtttcatggcatttcactaacagtgctaagaaagttgcaaatggaacgcataaattcactaagctcctgctctttttggtccccttccttcactccgtccaattgttcaagatgttggcttcgaatgtgaaagatttgcgtgaccatctaaaaaaaataaaataaaattcccacttttcgaaaaaatgaaagaccgtcttaagaatgagttcggttctgtcaataatatactgccgtgttgtctggtcgttcatcagatgaagtaactgaaagggcgcagtcaaatttgtaaaatcccaaaaaaattttttttttttttttgaaattttacctgggctaacgcctcctcggcaatgttaagctgaagacaggaaatgttgtgcacagttcggtcaatgtgttccgcactttccagcgacgaaattgaagacactgactcactacgacgcgaaaaagtgctggttgggcgcacaactggtttctgaaaaaatcggaaaacattcaaccaattctcatggggaacgggtcacaaattcttggtattataaaaattggttagttattgcatttttttgacaattttagtaatatccattttaatgcgtaaagagtgggctatggttttctcatttcttttttattagatggcttcctctcattattctgaatcaaatcatacctccaaaaaatttgatttttttttaaaattttgg

SEQ ID NO: 20528 - DNA, 1264 bp, Heterodera glycines
tcgcccacttttggagggggccctttgaaatgttttgtcccaactgcagcggttgcgtggggtttgttcatttccctttctcgtctgttgtttccggcccaacaatgtattgtcatcatagtcgttttggaaaaatttttgggtccaattggaattttccagcaacattttgcgattgaagtgtcatcgtggtgttcaagttggatgagtacgaaacggctgaggaaagtccaccactgccaacaaaatgtgaccggcgcggggcacgcggattgccctcatcggtgttgtcattgagcattgaattgttggggaggacagcaaccgaacgacgacggctaaaaaataaagagcaaaaatgaaaattgtacgatttttcatttacccgctagcagaccgagccctttttgtcgcatttggatcgtccgcagttgagttgattgtttggttgagccgcgaagtggacgcatctctcttttttgccgagtcagcaacaggacgtgaagagggattcgcattggcaaagagctcaacacgatcctaaaacgaatttgaaaataataataattaaaaattgagggaaataggtaatacatttggtccatttggagagtctgtcaaagccttgtcacggttttcggcaatctaaaagtaaaataaaacaaaaattaattgaaaaaagtttatgaaaagaccttggccattttgttcgcatctttggccaattcaggcgaaatgaaacagcccaaggccttttccccaatgcatttcataatggcacccaaagcagcaaaagaggagtccctcacttcagagtcggcatcagagccatgctaaaaatgccaaaaaataggggtaaaacatgacaaaatgttgactttgctaagaatggccaccaaatccttcagcaaacccttgggaatgtctttggccgggagagaacggaacacgcggtagatgaacaaatccgtctgtgatttctgactcggattctgtttggaggtcatagcctcgagcaaggccttgcttaggtggtcgaaactctaaaaatattatttttattttttttaaatcatccatttcaatcgggttttttttatctatttttacggtatatgctgcgatgacatcgatgcattcgaccagcgcatctctgagcaactgtttcttttccttgaacttgtcgaaaatcaccgggacaaccaacaaaacgtgaggcgtgaatttggcacgcaatcccttggcaaaaaacatcacgcatttg

SEQ ID NO: 20529 - DNA, 1621 bp, Heterodera glycines
tggcttggttggtggccatggcatggccagagggacttttggaggaggacgaagaggaggtggacaacgcggtgggccatctcccggggaacaaatgctgctgggaatggtggtgatggaaatgcagggacggcttgaagttagcgttgttgttcaacagcattccaaggggcggaagaccgaacggactgaatggaaaacactgtaaaagccttccccgccccaaaaagtgctacttgtttcgctgcaactcctcacggaacagtgccaactgctgcaactgcttcgcaacccggggaatgatttcggcacggaattgtccgcccgatggcatcgaatagccgggcacaagcgactggacaaattgacggaagccgacccggtccagcagaaactcagtctggtccaccaacatcattgcggcgatctgtccgggaaatcattgaccgatcagtcgcccctccctttcccacttgatcactgatccgttcgctttgctgctgttccatcacttttgctcgtccccccgccaatgtttctgcgccggagaacgacggcggaggcattgcgggcgaagcagcggaagccgtcgttcttcgcccgttgacaccgctctttttgccccccgtcttcggcgtcgtctgctgacagtcgccacccaccgttgtgggtgatggcaccgcaccatgagggcaaaactcgtcgccaattgcgccctttgaatgataatacgtttatttatacaaaatgattggggactcctttgtgtcggtggcattggcttactgtacccttaatcgagatccaatcgtatcgttggcatttgcctacagtatcctctgccaccgtatgtatccccccatgttccatttattttcagtgttcctctgtaactcaccaccatcgctttccttcgtttggtcgccatgctaagcagcggtgcactcatcggcgacgttggcacttccgctgcgtcgcaactgtccgccattggcacatcgtctgccccccgcttgcccaccacgaccattgtcagggtcagtgactccgccctcctttttcgaccgctccattgaagtgggccgactcgttttgaaattctcaatctgaacaaaatgtaaatcttaaaatgacaatggcattttggtagtaaaaaaaggaaagggcatttccatgtttttgacctgctccaaaagttggcgttgttgtgccgtcgaattgggtgaagtcgaactgtcaaagaaagggacgattatcagaagcatttgattggtcgcttctcaccgcgtctctccgctgatcagtgcctcgacggaatgttttgatgaaacggcgccgccattcgtcgccggcggcggactttgaagtgcggtgaacgaactctccaaagccgcttggatggcctaaaatgggaaaaatgctaaattttgtacaatttcagaaagtccgtcgcacatcaatggacgcctccgagtgggggtcaatgccaatttgaagttgaagaagcactttctgacgttcgacggcatctgcgataagaaacgacgtgaaaggtaaaggcaaaaagaatgctaaccgtttttcagatttttcaatatcgcgcctgttgaagctgttgaaa

SEQ ID NO: 20530 - DNA, 903 bp, Heterodera glycines
gacgcgttggcgtcgctgctgcgtttggttgtgttgctgcgtgttcggcttcgtctcgccctcctcctcttcggtattattcgccaattggtgaagctgctcaaatccgtccaattcatttttgagaaaaaaggcatcgttctgacggacaaagaaaacattcattttaaaagctaaaaacggaaaaaatgagatgagaaatttagaggaattaatttgcgctcgaaaagcatcattaatattttttcaactccgacggtgccatggaaatgtccgacggagaaaatttttggaatttatgcgatttaaagtgatgattttttcttttctaaataaactcgaaaaatcctcattgacgcctcaaaaaaccataaaatgatgaaaaaacttattcaatataatttgaatgtttgcatatgcgcaaagaataaataaagctgagaattgctaacaggcgccgccgcttccattaaaatgtattggtattttttcgaaacttagctgacccttgaaacttagaaaaactgaaaacttgggattttgcgaattctaagagaatttggattgtgaaatgtcattttaattttggcattgtgtcggtcccttccgttcgcttccacctggtgctgcttcagttcgtcctcatccgtctccattttgttgtccgtctgcgcttgtggcggaggagagccctcgccgcctttcctctccgttcgtgccaattcatcctcctccgtctcccgctttatcgccgccatccgccgttgctgctgctgttgtgccatccctgccacgagcaatgcttggagtgccgaaggcgccattaagtcgccggaaaaggcattgttcagcaacggattggtggcacggagaagctgttggaggacggcgacttcagaagag

SEQ ID NO: 20531 - DNA, 1334 bp, Heterodera glycines
atgaaatccatttcacccagcggccttggggttcgtttttttttttccgggagtaagcaattttggaaatgttttgcattaaggggaattatccccatgggcgtcggggtcacacagaaagtaggatttgcatttacagcccacccaaacccgaaaacatataaatgccaatttttatttcgaataaaaaaaatttcaaaaattaaaaatgaatttcaaatgcgatcgctagggataaattataggcaagaaaagtggcataaatatgtaaatggaagtccaaatcagacgaatttttattatttcccacttagtcatttccggaggacaagaaacaacagcatgaaaggggacaaaacacaagacaaatgctgccgaattttgccatcaacgccgatcatttttgttatttttttccgaccgttggcctattacgcgaaactttgctgccgaattttgtcgtctcccccctcccccagcagtccattgcatttgcttttggtttggttgatgtgtcctttttcaacatacataaataaaataaattcaagaaaatcccctcctcctccgcgccgctcaatcccttcgtcaaatgtggacgccgacgacgccgacggagtgaaaagattccccccccccctcaaaatatatgcacaatgtgtgcttttactgtgctgtccgtcgtttgttgtgtgatgtgtagggttggcaaaaatatgcacataaaatcgcaaaatatgcgcataaaatatgcaccataaatcgtgaaatatgcacataaaaagtgaaaaatatgcacataaaattttccaattgagggtgtaatttctcaaaatttcttcaaatttgttaaacataaagtaaaatcttcaaaaatggctaaatgtggtattaaaaatcattttaggagaaaaaaacacgatacagcttaaaatttactcattttagcgaaaaatcaacctgaaaagcaaaattttgcttatttttgacataaattaaccattttttgagaaaatttatttattcaatatttttcgtgaaaattttgctaaaaaattatttttttggaaaattttccgggttttgaggtcaaaaaggccaatttgtctgttgggggccgatctattagaggttttttggaaaaacgccaaaatatgcacataaaatatgcacgaaatgccaaaatatgcacaaatatgcaaatatgcacataaatcgcgaaatatgcacaaatatgcaaaatatgcatatggaaagtcatcctagaaaattttgaccaaaaaaaaaagttgaaaaaattttcaaaatgtccctcttctaatagcgccgaattt

SEQ ID NO: 20532 - DNA, 839 bp, Heterodera glycines
cgtaaaaatttaaaaagttaattcaacaacgaaggggggaaaggttgaaaatttatgaaattttgaacaattttcttaatattaattaattaaaaattccgaaaaacttttggtcggcacctatcggcaccacggtcccccaaaactccaatttttttttttgcaaaaaattgtcccaaaattgcaaaaattattattttttaggataaatctgttagggcatcgccgggaaaaattgatatttgaatacaataaatacattgtcagatttgtccaaaaatgaccaatttttgcaattttttgagccagtttttttaagaaaattaaggattttaaggatccggcggtgccgataggcgccgccgtgaaaatttttgaaattttggctatatatttagcagattttgaataaaaattattaattttgccaaaaaaaactcaattcataccagtgcatttttactcacgtttttttagtatcaaaatatgaacattttacaacattttttcaaacatttgggaccaaaagatcaaaaaaattttgcgtcagactttaaaatttcttgataaaatagttacattatgcaataaaattttaaaattataaatatatttaagaaatcggaataatttttgtcgctacctcaaaattataaattctcataaataagagcaatgtaaacctggtttaaaggccagcttctaacgaaatcagatcattaaagtgaaaaaggaagatttacgagaatctaaaaagaaaaattggttttttgggttaaaataaaatttggtcattcccccgatcggggtccccgacccccgacaattgagctcctccc

SEQ ID NO: 20533 - DNA, 1268 bp, Heterodera glycines
  misc_feature (137)..(137): n is a, c, g, or t
aattcgtcagttggacaacggcggctttttcatcgcccgtcgcgtcactttcggcactttgcaggaattagtccaacattacagcgaggaggccggtccgcaagggcacgattcattttggtcgaaaattcgcattntaagacggactttgtgtgactttgacaaagccggcgatgaaagtggaggtctgtaattcttctgggagttccaatttcgcactttgtttagacgccaatgaccagcactttcacccacgacgaccaatgggaaatcgaccggcgaagtctccgattggtgcgccaagtgggcgcaggacaattcggcgaggtccgatcataaaaccaattcgtaaatgaagcaacatcaaaggtgtgggaggcgcggtggaaccattcgatgcccgtggcagtcaaaaaggtgccaaaggcaatcgaatgccaccaatgcgctccctcttccattttaagctgaagcccggctccaccgcttgtgtcgcggattttcttgcagaggcaatgcccagcaaattcttttatatcagcaaaaggtcgcttttaggctcaactgatgaaacgtctgcgacacccaaaactgcttcagctttacgcggtgtgcactcgggaagagccatttttaatagtgacggaattaatgcagggtaagcaattaggggggggggggggtagaccggctcatagaccggtccaattcccaatggtatccaaatccaaagccacaaacatcgcttaatccaaaatcccatgacaatccctggggaggagaagcagagaagggagcatcgttcgcattcagagaatctgctgcactttctgcacggccatggccgagtgtgtaacgtcgcgcaggttgaagaagcgaaggacgcccttttcacttttctttttcagttggtcgacgtcgccgtgcaaatcgcctctggcatgcgttatttggaggtgccaaagcgaaagtgtttaaatttccaaaaattcgcaggagaaaaatttcattcaccgtgacctcgctgcgcgaaacattctcatctctcacccttcggtggtcaaaattgcggacttcggacttgctcggcttatccgcgagaacgaatacgaagcgcgagtgagcgcccgttttccgattaaagtcggcgccctttccctcactttttactttggacattcagtggacggcgcctgaggcggctaattacaacaaattcactgttaaatctgacgtttggtccttcggcattctgctcaccgaattgg

SEQ ID NO: 20534 - DNA, 2270 bp, Heterodera glycines
  misc_feature (174)..(174): n is a, c, g, or t
  misc_feature (262)..(262): n is a, c, g, or t
  misc_feature (336)..(336): n is a, c, g, or t
  misc_feature (344)..(345): n is a, c, g, or t
  misc_feature (350)..(350): n is a, c, g, or t
  misc_feature (361)..(361): n is a, c, g, or t
  misc_feature (370)..(370): n is a, c, g, or t
  misc_feature (372)..(372): n is a, c, g, or t
  misc_feature (382)..(383): n is a, c, g, or t
  misc_feature (391)..(392): n is a, c, g, or t
  misc_feature (394)..(394): n is a, c, g, or t
  misc_feature (396)..(396): n is a, c, g, or t
  misc_feature (432)..(432): n is a, c, g, or t
  misc_feature (480)..(480): n is a, c, g, or t
cttttttttttttcttttttttttttttttttttttttttttattattttttaaaaaaaaaaaaaaaaaaaaaaaaaaaaaaagggcatataaaaaaaaaaaaaaaaaaaaaaaaacccttttttttttttttttttcccaaccgggaaaaaaggaaattattaaaaaataaancccaaaatttttttcaataacttttttgttttttgtaccttttgcgggcgctttttttttgaaaattttaggaaatttctttggcccntggtacaaaatccgaaaacccacccaccccctgcccactatgggtcaggttacgggagggggggggggtgtgcnaacgagtnngagtngggaaatgtcnaacgttcgncntatttatcannttaatcanncnanccaaaaatctgggcaaacttataaaaaaaaatttcnaatatttctggcggcatttcagcgtttccaaaaaaatttatgtcaganaatgactttttcaggggcgaaatgaccaaaaatgtccgactcgcaaccctaacaaatgatttaaccattcgtgccaattccttttcatttcctcctttctttgctttcacattgcaaattgcttcaaatgccttcgctccgccgtcggcgtcgaaatggtcaaaaaatgccttttttgacttttgggattaaacgggcgatcatttgcaaccgaagtgcgactgacccatcccttcgaaggatggccgtgtgattcgaacttcggggggagcgatggcggcggtgggaaagggaggcaaatggggcacaggggccaaagggtggtgggcctgatgagccatcggactgaaaaggcaagtgaaaatgagaggggggggggcaatcacctgacggaaatggtcacccgactgattggcttcgcagtgcccccgccgttcgactgaaagggctgcatcgaagtggaccgagtcatgaaggggctaagagaaacttagaaacggggaaaacaatggcaccttccgggaggggtcgtaaatggggatgaaagtgccgcaggcgatttggcacggacaccggcgatacaatcccccaggtgattctgcaagagatcacagaccaaaagggactccgccacctgtgaaaacgtaaagttgaccggacgcagaagacccacagacaaaaggccaactaataaaagactaacagacaaaagaccaactgataaaagaccgacagacaaaagtaacatttttatttatatttttaatgtattaatttgaattttatccatgtgcggaaaatgttttttgacaagcaaatcattataagttaaccgctatggactaagttgaaaatgggaaatttgccaaagttaaataaatgtttggcagcttttatcgcttcacaaaagggcggtattaaattggagttttgtaatgtaattttcatgaagatggattgtggccagaagccaaattatataatcgcgcaaagcaaataattgaataataagctctctatttcagtttacacgaccacgaaaaaagacacgaccatgtaatattttggtaaattcatgcaccataactttttctagaagcacccaaattaaacattcttgataccatttgatagccctaagtgtcctctatttttttgtaaaatttcaaaaaatttcgttgagtttcaatcaagttgtggtcaattaatttttgaaatttataagccacaattttttgaaacataaccatattttttgaaattttaaaggcaaatagagggcacttagggctatcaaataataccaagaatatgtaatttggatgcttctacaaaaagttatggcactgatcaaaaattgatcattttatagtgatcaattctcaactaagttatctttttatgtaaaagtcgtagtcccattattcaaaaggcaaatcagtagagaattttgtgctcttcccagtgggcttgcccattttctctataaaatatttcacaacacactacgtatcttatattttcacgagtttatacagtatattaagttgccttggattttttataatgaatagatatcgcaataacaaaatatgatattattcataaactctacatacaaaaaaattatcttttatctttctttttcagtatgtcaatactcgattataaagcaatatacatacatatattctaaaaaaaaatgaacgtgagcgagtaaacgaaagatttactctttttttactgctataaaagtatacaattattggatattgactctttataataaa

SEQ ID NO: 20535 - DNA, 1544 bp, Heterodera glycines
  misc_feature (1410)..(1410): n is a, c, g, or t
  misc_feature (1417)..(1417): n is a, c, g, or t
aaagctcaggtcccggtcccggtcccggtagggcaaccgggaaccgggaaaaacaagcactggtaagaatggggggtctgagtgaaaaattagtgaagaaaattggagtcaaagggaaaaataaaaaataataattaatatattctttaaaagtaaaactcctaagtgtgcaaatggcctagtggctagtctccttgactttccttgcttctttcccctggttcaatccctctacagaaattagattattttcaatttttttttgtatactcgtgggttttcctatcaagaaaatatcattcctcatatattttaattgatatatatattttattatttttttaaatgaaaatccatacaaattgagcctaataatcccaaaaaagaagccatttttgttgaaaatctgttaacaaatctcactcaaattttcaaaattttccccggcggcgcctatcggcaccgccggaccccccttctttcccaaaagttttctggaaaaagcgcgccgaaaaaaatggtgtgataagtaaatctaaatttcaaataatattcgaccatttagtccaaaaaatgatttttgaaataattgaagaaaatttgtttgaaaattttcattaatttaatttgctttattttgggttttattaaataaaaaaccaaataattttgtattattttcacttgaaataaattaaaatttgaatttttttttaaatttttaaaatttttttgaatttttaaaatttcccggttggtcccggttcccggtttttcttgcggtcccggtcccgaagaaaaatcgaggtcccggtcccggcttctcaggtcccggcaagtcccggtcccggttttgcccaaaattcccggtcccgtggcactctactttgaaaaaaataattgcgtataaaattgtcattttccaatttcaacagataagtagcataccattggatagcattttttatgggctttccaatgataccatatttgcatttgtgacataaacatttatttgatttattttaccatattcacaatttgatcaaaattagagtgccacgggaccgggaccgggaccgggccgggaattcccggtcatccgaggtcccggtcccggttcccggtcccgggttttgaaaagctcaggtcccggtcccggtcccggtagggcaaccgggaaccgggaaaaacaagcactggtaagaatggggggtctgagtgaaaaattagtgaagaaaattggagtcaaagggaaaaataaaaaataataattaatatattctttaaaagtaaaactcctaagtgtgcaaatggcctagtggctagtctccttgactttccttgcttctttcccctggttcaatccctctacagaaattagattattttcaatttttttttgtatanctcgtgngttttcctatcaagaaaatatcattcctcatatattttaattgatatatatattttattatttttttaaatgaaatccatacaaattgagcctaataatcccaaaaagaaggccattttttgtgaaa

SEQ ID NO: 20536 - DNA, 3495 bp, Heterodera glycines
  misc_feature (11)..(12): n is a, c, g, or t
  misc_feature (34)..(34): n is a, c, g, or t
gtgtgaacacnncgcgctgcaagcggagtgccanttgcaacaccttttttcaccgatatccgacgcagcgagtcgcggctgagcatgggactgagcccggatcagtattgtctgaacgtgcgcgacattgacgaggtgtggaaaataaaactgagatggcattggcatcctcgaatgcaaatggacatttttggatattcattggatgtgtcctaggcgtcaaaagggggtgggtacggtagatgggtacaaataccgtaactgatcgaaataacggcaattatttttttaacatacgcattacatagatagaaaagggtctatatttatatactgtaaattcattatgcaccaaaaaaggtaattaattttctgatccccgcccccttttttcacagtgcgctctcggccttcacaactgttccacctatgccacgtgcaccaatttgccggatggtcggtttttggtctaaaaaatgcatttttatttttttgcaatttcattttgcaggttacacatgccaatgcccggccgggtgggaagacggcaatcccgaactgccggtgggtggggatggctaattaattgaatattgggctgtgcgagtttttccaaaatgggggaagggttcaagtgtttttcaaaatccaacaaaatctcggcaaatctcgactgttatatatatatatatatatattccttttaaagggtcgcatttgtgccagtaaattgtgcgctcagtgcagtgaacacggcgtaagtgatcaatgggtgctttgtcagacttttctctgatgcttttcctcgtttcgatttgttattttgactgatcaatcacagtactgattgggttaattgttccaatgccccgctacttcagtcttgcatccccgacccagccaacagcaccaacgtggtctgccaatgctttgacggatacgccggcacattctgcgaaatcgcgccctccgcgttgccgctggtgttggccatcattctggcactgcttttcctcctcctcgccctgtggtcagtttggtcaatcacccaaaagggaggaaatgccgggcctttccttggattgtcaccaaaactattcaaaatgatcggaaaaaatgtctaatctgtctaacgaactcacgaacttaatttcgattaaactcttaaattttccaatctccaagatttaaaatcccccctttcaattttttatctttccatcacaacactcatttgagtcaacaatttttttttactaatttgctaattagtaaatcagtttaatcaattgcgctgatttgtgagatatcttttgactaccaattgaccgctttttcccttccgttcgccccttttccgtcccaacttttgtctgtctctcctttgacgtcattcaaaacacatctgctgcagtgtctcggcattatttatttgtttacgtaaatcccggcaaaaaaaagcatttctcgtctctccaatcccctaaataatgcaaatccccgtccgattggtctcccccccccactccaactgggactcttcccctgggaatgaattcccaaaacggcaaaagtgtgccatcacatccaatttggccttgcctcttcgcttttcgtgctatgtccgaccgcctccacctgggtcgacagatttttttcaatacattttttatttatttttctccttttaggggaaaagggtagaggtgcgctattagagtccgaatccgagcctgaaccgtatacggatttttacggacccgtagtccgtatttttcggccgatacgggtttttacaggctatgggttttacgggttttatcccgtaagtccgtaccccgtgtgggtgcaccccaaatctacagccgacgaaatctcgacgcagaaatttccaaaaacaggacagtcagatctaaaatgaaagtgccgggggaaggaacggacggacaaatgagctaaacaaataaaggaacgcacgcgacgtgcttttcatggacaagccacgggggaagcacaaagccaatggcaattccgagctagaggtgacaattgttgtcaatcaaatgccaaaaacatttgcctgattcccaaaaacaccggcagcacaagcggtggaaaccttaaaatcccaaataaaacccaagtgggaaaaggacaatggaaggacttgttcaggtccaaaccaaaccgccgcaagcctcgggggaattccaagaataacactggggaagaacgacgatctgaattaaaagggcaattagcgatgggttgggatgaacttcgatttaactgtttgggcaataaatgtaagccaaaatcgatcgaaaagggaggtaattagtggcaatgacatcttggtagtgcccggggctgtggagagcattttcaaccaggcgccgaaactattgccgaaggcaccgatcagaatggacttccgaaggccaaatttctcaagaaaccaacttaacaaaaaatattctttagctgtccttcgttcaaacggaccttccggggaacatcagcaccatgtaagtgagcatgtaaaccatcgaagtccaatcgacggcggaataagaaacaccgtaataggcggagataatgtgggcgatgatactgcagcggttggagaaagggttgtaggacaaaacgcatgtgcgattgttggttgggtctcacctgtattcgatccattgcatggcatttgaggctgaaagcatgacgaacctgtcacccccacacgtcagtttcagtccagcggcggcggcggtgccaaagcgagcacttccgtgaacatcaatcgaagcggcgatgtcgtcggaggcgaacgacgacgcgtagatgagcgggagcgagacgaaagtgtcgcggagtttgccaactcgcgcggcgctggcgcatggggtggcacgtcgacggcaacaaacgctggtggtggcactcaactggacgacctccatcatccccagcaccaccaacgacggcacggcggacgaaacggtgcgaacggaggcgaaaggcataaccgcgcatttgccatggtcggagaggtgggaggggaagggacctggggagaggggcaaattgcgattgggtgactgatcagtttttgacgcaggaggagcgatcattgggcggcgaattgtcggcggatgacttgagcatctacgacaagaacaccatggtgggtgtagcgggtggtgaacttttcattcattccacccctcccaagccatttctcctcgtatttaaaattttatttaaaaaacaatttgggaaaattttgagcttggcgttatttgttgaaagaatcattaactgaccggggattcccggctttcagttttaatctcaaaaaaacttttttctgtattactccaatacaaaagtccgagacagttcctgaattaacccgttttcattatttaaattatcgataattggctggccaagagggaacagtcactactgatcagttatcatatcataaaattatca

SEQ ID NO: 20537 - DNA, 2668 bp, Heterodera glycines
  misc_feature (53)..(53): n is a, c, g, or t
  misc_feature (68)..(69): n is a, c, g, or t
  misc_feature (78)..(78): n is a, c, g, or t
  misc_feature (83)..(83): n is a, c, g, or t
  misc_feature (91)..(91): n is a, c, g, or t
  misc_feature (143)..(143): n is a, c, g, or t
  misc_feature (154)..(154): n is a, c, g, or t
aaaacttcaatcaagaatgatgtcaaaacatcaaagttttagggcatttgagnccaaaatcagataanngggattttntaagnaatttgcntaaaaatgatcaaatacgggttacggttcggtaccctcgaaatcaaatcatnttatccaaatnttgtgggataattctttctttttctctcagaatatgatgcacatgttcaaaaacatggccaacgaccgtaccggtctgctgatggtggaggactgcgtggacgtactgtcggaggcggtcagtgaaaaataattaatcggataaataattaccaaattaatgaacgatgggtataaatgaccctaatattgaatgaatgagtttgggaagcctttattgaaaaactgtggggcgggcaggctttgaaccgcgtaaaaatgtttatcagtttaattaccggcactgtgtcaattgtcgctcaattaatccattatcttcctctcggagaagcttcttctctatctcatgtccatttaagcccgacaatgtctcttcggccataattttgctcggccaacgccatggactgctcaatgatttgaccattccgataattaaaaaggccggcggaacggaacaaaacagagggtttagcaaagttggaaacatttgaatgttttaatttcagttttcctccgctgctccaaggagcgactggctttggcactttcaaacaaagagccgacgatttggcatttcatgcttaagacggggtcaagaaggagaagcagcgacgaaactgttaacataaaaaataattccaaataatttgcattttttaatttataaaaatttatttatttgtgacaattaaataaacattaattcttcgatttgcttttgtcaatctttcaaaagtgataataaattattacgcgcagagttctttttccgtttctcatcggtgcaacggacgaatgttggcctttacgtttttctcctcaccttcttcggccgaatacggcggaatttgaatgggcggaagttggccagacgggtccaacatttctgaatgaggctaagtggccggtggtgaattgggcagcccaaaatgggctaattatgtccgatcggtgtttaccttgagggttgaagttgccctttgatgcgccgtaattgccgcccgacgcacctccgcccatattcgaaccataacctgtttgtattttcttagttaatttgggtaaggataggctttgctgcacctcctccgcctccaaatccgcccatgccgccgtccatccctccgccttccattggcattccgccgcccccgcccattcccatgccgccgcccccaccgcccatggcgataccgcccccgccgcccattccaccaccttcaaatgcacaccagccggacgacgaattgccttaaaattaaaatcggacgaacggattgaaccgatataaagcctttgccacttaccgtatcccattccgccgcccccagtcatgtctccgcctcccatcattccgccacctccgctcatcattccgccgcccattccgctcatatctccgccgccgccgcccatactcatcgacccgcccatatcaccgccacctccgcccatcattccaccaccgcccatcgctgaaagtcaatcaaatgccaaactcaaactgtgctaattaccgccgtcgggcattccgccgccgctttccatcccaccgccgccccattggcacagtactgacttggcaaggaccaaaaggacggacagatggacactggtgagagaagaggagcacatcggaagggaagtcaatctgagtgaaacggaggtactaatggagcgaatgaatgaaagaataatcggagacggagggacgaccaattacataaatagcagaactgtccattcattcatttctcaactcaatttgaaagtgttggaccgatcggacagaaaaaaacccggaaacagagcaaacaaagaaacatttgcgagacatatttagggatgaaagaaaatggggcgggggaattggtcggactgatcggagacgaaaatgggggaggggaaatcgcaaatgggacacatttggactgaaatgaaaaaataaagtaaattgagcaacggaagaggggaaaattgggaatgagaagcgggtgggagggatggtcaacactcacaaatcagcacactcatccaataatatattgaaaaacccagctccattttatattttcaacatttgagcaaatctgaggaatcggttgattggtaaaagagaatttcaatcagaagcctaaatatgtaagaaaatttggcgctacaaaaagtgattctttttgaaaaaaattttcaaatacttttccatcaattttagtttttatgtttttttttattcttttttaaaagatggttaaaatgttttagatattctttcattgatttcactaatctccgattcggcttccaactgtagatgaagtaaatatgaggtgaattttcgaaaaaagatgcgttgcaagcaaaatgtgagaaattaattattttttattaatatatttttaagtggcactctcgtaattgtaaataaatatttgaaaattttttcaaaaagttcaaaaagaaccactttaaagaacgcataatttttatgatttgcataatatttaagatt

SEQ ID NO: 20538 - DNA, 2759 bp, Heterodera glycines
cgtgatcgtatcgttcgaaaggcgcagtgacaaatgtccgaggaacgacgccggtggtgagcatcgtcagaacacaaatcaaaaatctaaacaaaaggctcggtgtacaagccacccgagagaaagtggcataaatattcgtgccgattcagcgacgtttcgacccattcgacgacgcgctgctgtgcggcttggcaagcccggtcaaacagcccaattgtgagttgttcgtccacatttcgcaaggcgttaaccgatccaatttcggtggtgggaccgggcgaatttgccgacaaggcattatttgtcgtaacaaatcgaagtgtttcgctggagagaagcggcctcctgcgcagtttttcctcagcgcttaaccaaatgccaatccgtcggttttcctccgtccgtttcttcagaatttgctgtagctccctccgagcagcttgaaaaatatcgggcgtcctttgctcttcccgaacaatttttagcaaaataggagacgattttgccgaaatatcagacggatattttcgtttccttgaattgttgacaaactaaaatcgtaaaataaataataaaagttctcctgtaatttaaacaaactcgttgatctccgccgttgcaaataattcgattgttgtcgtgattttgctctttctcttcctctttttgctgccgtttaatttcaattctaaaaaaacggcccccgtcttcgtctccgataaatctgacgagtccgtcgatggtcggtggctcgcccatcgccgcaaaatttgaggctgacagacatccggcactgcttgtcgttgggtcgcaaagttgttcaaagaaatgccacggtttcgaggaagaaagtttgttgagtgtaagaaaagttgtggcttcggaagcattcattggctgtgccctatcggaggaaatgagtcgcggaaattggcaactgatggaagggatgacaagcggagaaaccacaggccgaggctcaaaaaggttcgggtggttgcagcacttgcgcagctggatgataatgccaagcacggaaagcatgttgccggacttgaggttgtccattgtcctgcaaaaaataacgaaccgttttctgatttaaaaacatttggttgtttttatttcccttacgttcgccttgacagaaattcgttgtataaaaagcgctgtctttttgacaatggacagggaatgatcttctccgtcttggtcggcaattgcttttccacttccgacttcagtcgcctcagaatgaacgggcgaagtatctgatgtttatgaggcgattaattctcgattatttgaaaagcgaactttgtgcaagcattggaccaacgcctggtccacttcggacgtcccttcgaccatgtcagtgatgggcgagtgaaaccattctttgaagtcgtcgtgtgaagcgaacacatgcggcatcagaaaatggagcaacgcccaaagttccatcaacgaattctgcaagggagttcctaaaggaaaaatggacgggaaaagggggaaaatatacggccattgagaggggggggggggggagggatctccaaaacaaacccaggataattacgaaatataagaaaaattcttctaaatcaaaaaaagattggtaaaatttcttatttggtagatttttttaaatccttttaactttgttacggcagtttttgggctgaaaatacttaaaaacgaccatttttggcatattcaaaaaaattgtctcgtgtctcgagagaagtcctggtctttttatggttcgagttttgggtaacattcggtttcactatgccttacccgtcagcagtaaccttcgacgcgactgaattctgagcagcgtttgccagcgctgacttttgaaatttttgatgttctgcgcctcgtccaaaatcaaatattgccaggccttctttttgaacgcgcgaatgtcttgggtagccaatttataagaagtgatgcaaacgtggaaagcattgcttttggaccagccctaaaaacaaataaaatgggcaaattaaaaaggcaccgccgcacctttcgtttctcggctctttcctttgctgtaccgaaatatgtcagcactttcaatgcggggcaccactttttcagctccatttcccaattcaaaatgacagaggttggcacgatgatcagatgaggaccccaaacggcacggtcacaagccaaatgggcgagcagagcaatggtctgaaatgggtgagaggaaacaacgaaatggcgaataagaaaaagtagataatggatcgagaagtaatatttacttgaattgtcttcccaaggcccatttcgtccgccaaaattccgttcagatttttctcgtacagagtgactagccaatcgagtccgacgagctgatactcgcggaggtcgcctcgaatcagaaagggaacttcagtttttacctaaattggaattcgctttaatttggaatttaaacttttcccgacttccgtggtctcgagtgtgttgcccttcggctgaaattccaacgcggccactgcgatgttgtccaactgtttgcgccgaacttcgctgttgtccgagcggagtccagcatagtccacgttgttcaggtcgggcttctcctcgcccgtccgttgcgcttctgtccgatcatccgagctttccaagtgactgctaacagtcatttcgcattcgtccgccacagattgtgaaggaggcggtattttatagcccaagactccaataccactaggcaactgaat

SEQ ID NO: 20539 - DNA, 1331 bp, Heterodera glycines
  misc_feature (1111)..(1111): n is a, c, g, or t
  misc_feature (1261)..(1261): n is a, c, g, or t
  misc_feature (1303)..(1303): n is a, c, g, or t
aatctctaatgacctctaatcatcgtaaaaaatagtcccaagatgcgggaaaatcaacggtttttgaacgggttaactcacgaacaaaaagtcttgggaaattgtcacggcgctcaattcaaaaaccagttttttcgcacgtcgggagtgtttttattagggttaagccctgagccttcggggggcaaaatgtcgggggccgtggaccatcgggtgggcacatgtcgggggtcgggtcggggggagctcaattgtcgcgggccggggaccccgatcgggtagtgatcaataaaaaattttaaagaaaaaaccaatttttatttttaaatgctcgtaaatcttcctttttttctttaatcatctgattcaaattcgtacgttggcgccagtaaaagtgcgtccaagttggcctttataacatacagtcatggtcatatgttatctacacccccatcttattttatttttgtcgtcatactataagtttcggttaaacccttccaataagacccgaattcgaacaaaaagtcgaataaaatggccgacaaaactactattaatcttattcttcaacgacttgaagcgattgaacgtaaagtcaacaacaacaacaatgccgttccagcgcagttgaatgaacaactgcaaagcattgttgaccgtttgtgtgacatcgagcggaaaactgacaccgcaaacaacacaactgcaacgcgacggactcagaggacaaagagcggaagcgcagtcttgtactgatctaccttccagaatcaaccaaggaaaagccgatagaacgggccaaagaagacgccgacatggtgtccgacgttttggacgctttggatgtagaagtgtgcccacagatggtctaccggatggggcgccggaatgatgacaagcggaggggccctcgcctggtcaaagttgtgcttccggcgagcacctttcaacgcttcgctttggcacaatggggacgacgccgaaatgtactccgcgcaaaaaacgaggagtgggatcggctgcttgttcgaccgtcgttgacaaaagaggaacaaaaggcggaacatgaggcgcgtgtcaagaaaagggaggagtacgaacaaaaacngggatggagtgacaattcacggacaaaaaaacaattgaggtcacaaaattttgtcaattttttatatttcaaattcagaagtttagtaaataagttagatgatttaaaaaattgacttatagaaaacaaatataaaattattgctatctncgagacttggttgagcaataagttagataattcgcttatagntccaaattttttcctacacaattgtacg

SEQ ID NO: 20540 - DNA, 1069 bp, Heterodera glycines
aaaaatttttagaaaaacctttttttatttttcccttgatggttttgagccttcaaacaaattagttatcccaccgacaagggggggaaatttttttgattcttttattttcaaaataatccacaattaatatcaaaatgtgctgttggccctccctttaacaattagtgatcataacagtatttcgtgtgaaattaagctaaaaacttataagaaaattctaaaaaaggtttcgattttcgtagagctaattatttagcgattaactcagttctttcttcgattaactggaattttttcttttcagattgcactgagattgactcaatgtttcataaaattaatcaatttttgttgtttttaattagagaatatgtcccattagtccaaagcaattttgagcccaaattgcctgaacacattcagaaattaattaattatcgaaaattactttggaaagacattaaaaaagaaagaataagggaaaaatatattggaatttctaagaaaattattcaaaggttgcttttaccgataaggataaatctgacgccttggctaaacaattcttctcagttttcactagtcaaaacattgaacccgaacccactggttccaaaaatctctggaaaaaagtatggatttttttactataacacatgctgaaatttatttttcattatgtaaacttaaggataaaaacaatacttctattgacggtataccaagaattcttttgaaaaactgcaaagaaactttaatagccccattatttcaccttttctgtttttcattaatgtgtggcaaaattcctacaatatggaaaaaatcgattgtttgtccaatcccaaaaattccgaatcctgctaatcccattgattttcgtccaatttctttgctctgtacaatgtcaaaaattttagaagaaaatatagctcgaaaaataagagattttgttgaaacctaataatattttacctaaatgtcagcatgggttccgtaaaaatcgatcagttaccactcaactattagaagtagttgatgattttagcaaagctttagaagaaaa

SEQ ID NO: 20541 - DNA, 1552 bp, Heterodera glycines
tttaatacgctaaaaatgtgcattaatagtttgtgttattttatataaattatgaaataatcatttttaaaagaattaaatgataatttctcgagatgtcaattaattaaagtataaagtaataagaacctataaaaatcaaattaattttaacaatcattttcgctttcgcgacaattttactaattaattaaatgcccaatcaattaacaataaaacaatattttttgtttcttttatttgtaatttgtttattcgttctttcgcatttcatctgatcatttggataatgtgcttgctgattgccaccatttgctcgtaattttgttccaccattttcctgctgatcatttttagtgccgttttattgtccattttggcaatgaatggaattgtgcggaaagtgaatcgaagtcggtctgtcgccgcgctgaaatcgtccgactttttgccgcttatctgtcgcttcgccaaacaaagttcaacaaattcggacacctgcaaatgctccaattaattgcataattggccaattaaatatttctcgcctgaaggtatttctccgcccattggcgcccgctcgggcgatcacttccaaatatttggtccatcaatttgaaaagtttgcgcccattgggccgacggagtgctctgaactcggcacattcggcgaagaatttctccggagattttgccaattttcttccgtttggcccttttacaaagacgagatcaaacagtggcacgttctgacaaaagacattaattagagtcacaaatgccggtttcattgtgccattcactcacaattcgtccttggcccacgcaatttttgtgccttttccaatcgccgccacagcgccaacaaaatttgtgtgaaaaggtgctaggtcgatccctaattaaatttaattatacaaatcggtgtcaatgaatttaattatacgataattttataaattaaaaaagaacatataaaattcaaatttttgttcaaaattttttgcacaaatatcttttgtcatctatgggaggaaaatgaaaaaaaggtaaacaaaaattaacagcattcattgacaccgattttataaattcatttccgatcacatccctttcctccaacttttctcggtgacatcctttctgatgatatgcaccgggtggacaaatgccgttgatccgttcattgtccggttggcattggagaatgctgttgccgcaagggagaagaccgttcaggtcgtcgtccaatggcacaaagtccgccaaattcgctttgatcgtgccgacttcgccggtttgatgctttcccttcacaacgctacgccgatttacgcgcttaataaaaaatgaaattaatatatgtccaatcgatcggcaaaaattaattaattcttctttccgtaattaatttgcctttttcctgctttggctcttgttccgatttcggttttattggccgtgtcttttcccacatggattactaccgtttcatttagtcactttctttattttcccatcaattagttcgtacttttgtttcggccattgg

SEQ ID NO: 20542 - DNA, 1641 bp, Heterodera glycines
  misc_feature (17)..(17): n is a, c, g, or t
tcaaaaagaaaaatatncgatgaagggaagcaaagcgccaagactttttgaattactatttcctctgatgtccattatcccatcccccgattcttcaagtgtatccgagtatataaagccgaccaaatccctttccagtcatatccttcatccctttcattccatttgtttgataaattttgttttttcagttcatttctgttaaattttctgtgcttaccaattcaaaaatgtcggacaatccgaaagaagcggagaaagaaatggaaaaagcaatgtaaataattaatctaaatttgattttctaaggtcattttgcttttcccttttcagcttcatctctgccgactgttggttgggagtgttcgatttgcttccgccatctcaacttggcctcggaattgcgatgatcagtcaccgatttgactatttcgttgatgaacatttcaaaactcgcaaatggaaattgagaccaattgtaattcgaagcaaaatcggagagaatggcgcaaaggaaatggaaattgtcaattccgatggaaaagaattgccaatccctcaaaatccgttgccgaacaaagtcatcggattcagatgcattaggaccttgtataaatttaaatttttaatgatttgtgtcaatcatactttcttatgattttcagcttcatcgaccaaaatgtgctcacttttctcggccattttcatcgttttttcgccaattgtgcaacagaattggacattaccactgaaaatgttcgcattttggagtttattgtgcacaacatttggccaatgttcaaggacaccatttatctgttgattttgaacatcgtcgcttttcgtcaaatgcaccaattggccccgtcaatgctcaacgactgtccatcccttcgcactttcaatttgtctgacggcatttctcttggatttccgcctgatgacagtgccaatgcgtcggatggccaaacggttgccaaatggctgttcacgccacgtcacgacaatttgaagaagaagttcatatgcgttatggattcaacgatggaacaatggttggcaaccgtggaacaaatcaaagcggtgattatttgattattccaaattaattcgtatttcccctattttttgtcttctttttaggcattttcaaatgcttcgtctcctgtttatttcggcatttctgtttactttacgccgtcctcttcacttttttcttccgttgtgccatttaaactgaccaacgaattgactggagagaaattggaactggccaaagaagcggaagaagaagaagatttaattagttttcggcttaaccgttgtccaattgtgcccgaagataagaaacagcagaaaatggttaaggaattggacttgttgctatggaaccgaattgaaatttatatcgaagacgacggagtcggcgatgggtgattaataagattaacaatttaaaatccaaatgtttatttttgttttcttttcagtcttctcggcggtttcccggggctgagtggtgatcactgatcagaaccagcagaaatgaatgagtgattggttattgatgcgattatgtgacccaaatgttagactgctatttaagtgttgtatttgattttttctcataaattcgtaaaa

SEQ ID NO: 20543 - DNA, 1374 bp, Heterodera glycines
taaaatagaaatcaattaattatttatttatttaaatgaaaataaaatgaaattatataattattctctatgcttttagcattttttcgcagaatcagtcgggttttaagattttctttgattgtattcatcatcacaccagtgagagatgtcaaagaccgaccccggtcgcggcattttgaccgggctaatacgggcttaaatttcgcaagcgaatctgcccaaaatgggaaaaatataaataattatatggtggagatgtcattagttcaaaatttaccgatagaaacattcggatttgtggaaagttatccaatgtcaagagtttaacatttctgattctatttccggcgcctataggcatcgtcagattcaaaattcgcctaaaatatccaaaagttgatcccaaatcagcatttttttggtgaaaatctctcaaagtggatacaaaacttaaaaaattttcctgccggccctaaaaaattggctcaaaattgcaaaatttgttcatttttggacaaaatctattaacaaatcatacaaaaaattaaattttcctcggcggcgcctatcacacagccggaccctctagttctccaaattttttttctgaaaaaagcgcgcagtaaaaaagtattttgtaaaacaaaaaaagtcttcacatgggcttgacttaatcccaacccgggccgcccgtttaagcggggtttttttgaccgggcggccagggcccggccaattgtcgaagcccgagcccgggcccggtcccggcattttcaaaattccgttctctaataaggacaccatcgaaataaggacaaggcggcccactcgaacgaatacaaatctcaaagtcttgagaacaaagagcagaaaatagctacaaaacaaaaaggatttaaaataaatgtctattttttgatgatacgcatagctacattgaaattttacgaaatatactttcatgaaccacccaaaaaaatgggaagcgtagaagaattttcccacaaaattgtccaaatttgctgtaacaaattgaagacatgtgacttttttgtgcacttaataaaaacatgaaaaaattgacgtcagtacaatatttatgcctaaaaaataaatttgcaccatcgtgaacagagcactcgtccgaggtgatttcgaaaaaaaggaaaaacatccattacattgaagatgaaaatatttcggttttaattttattttgcattttaaaattcaaaaaacaaattataattgaagaagaaaagcacaccaaggatgaaaaagaacaaattgatcagcttatttagcaaatatttctttctcagagagttgtcaaatcgaaatttgaatttggacccaaattcgcgtcaatat

SEQ ID NO: 20544 - DNA, 2319 bp, Heterodera glycines
tccattcccatttgatcagttcgccggtcatgtgcactcctaaaaaatttatttgttttaattgaaattattaaataaataattataaaactgaattttatgaaatgaaaagcattaaattagtcaactctatgaatagggtttgaattacaaaaaatcctgttttacccaaattttaattgttggtcctaataatctttaaaatgtatgtaaatatccgtcgattcccaactgatcagttcgccgatcaagtggatatctaccgggacgatcccagggaggatgtgcacgaattgtggcgcaaattcacggaaagcatcgattggatccatcggctgaactgtggacgaaaattgctccaattcattcagctgctgcaccgattgttgccaaagtacacggagatgaaccgattgaaagcggaagatcaaagggagcaattggaggaggaaatgttttgggcggcggaagaggaagaaactgtgccaacaccggcggaaggggcggcgcggggagacgatgagggaaacagtgccaaaaacagaggtaaaaattgggaaaagatttcaaaaaaattattattgtttaaattttcaaattatgctccataacaaaattataaactcaagaaaaaatttttttgccacttcaataatatctcacgaaaaaaattttccagccccctaggaattttttctgaaaatttcccgatttcaaacctgtagcaaattttgttctctttctttttgtcttcaaagttttgagtttacctatattttgttacgccaaatttgggaccattttcggaaaaaaattcataaaaatttttttcttttagctcttagtatttataggggaaggtatgcttgaaatttcagctgaattagtccacgggaaattgctgaagtggcaaaaaaaaaattcttgagtttataattttgttacagagcataatcttaaaaattttacgtaaagttttattttagttttgagagccttcgccacattggaactcgagacaatttacaagaaaatcaaagagaaaatgttggcacagtttgagggctggtggaagcgcgtgccggaacagaaggagccgctgtacgagttcttcaaacagctcgaggacatctcaacgcgttacgtcatggcaattgttgacgcatttttcgacggcatttccattgagagttttcggcaggaatattcactgggcgtcaaaggtggggctgtgagcggaatgatcagaattggatttgacactttggcactaatccaaacttcgaaatttgtttattttaacgaacattgggaaaaatgccaacttaatctatcagttttaattagagaccggacaactggggtcggaggatcccgagtcttgatcccgaccgaatcccgaacaatcccgacgattttgaaagaacgatcgggacgaatcccaaatttaatcccgctggattccgaaaaaatccagcggtatcccaatcccgtccggtctctagttttaatttaaaaatgcgacccataccaattaaaaatgggttcatgattttaaaagcatttgcctatattacaaattcgaagttcgtttcatcatcattagggctcggaattatatgcaccaaaaattgcaaaatatgcacataaaaagtgaaaaatatgcacataaaaagtgaaaaatatgcacataaaaagtgaaaaatatgcacataaatttctccaaattgagggtataatttcttaaaatttcttcaaattcgctaaatgtaaggtaaaactttcaaaagtggtcaaatatggtattaaaaatcatttagatgaaaaaaacattataaagctaagattgacgaatttttagctaaaaatcaacccaaaaagcgaaattttcgctttttttaaatttttgacataaatttacaaatttttaagaaaaatttaatgtttgcaatttttttttttagaaaatttggctaaaaaatgatttttcggaaaattttccaggctttagaggtaaaaaaggctaatttagttgatgggggccgttctaatagaggttttttgaaaaaattctcaaatatgcacataaaatatgcatgaaatgccaaaatatccacataaatcgtgaaatatgcacaaatatgcaaaatatgcatatggaaagtcgtcctagaagctttaaaccgagctaaaaacatgttttttcgtacgtttcaggcctcccacagttcaggaaaaaaaaatatgcatgtgcatataattccaagccctaatcatcattaagccggctgcacatttggaatttatttccatctgtaa

SEQ ID NO: 20545 - DNA, 2629 bp, Heterodera glycines
cgtccggaaactgagctgctgtaccaaaaaagatttgtatgtgtggcgaagtggtttgtgagaaggtcaccaaaggggtgggtcccaggttcgattcccagtgcatgctattgatgtatttcgatgattttaatgaataaataaaaggaaaagtgaccaaaatgattttaaaattgtttacaaattttttaacatttttatttatacgtgtaatgaaaataaaccatcaatcctcgatcagtcaacgacatcgatgtcggcgtcttgatcactttcttcgttcgttctgtcttccgctgcttgctcccgtcgttcctcctccctcttaattagttggataagattttaaagccccttccatcaactcaccagcttcaattcgtcgagtctgccggtgtccatcaaccaattcgagacgaaatgatgctccagctgttgtcgcatttgttcagcgtccggcatcgtcttccaaagctgctcaagtcgccgccacacggcatgcaacgcttcatctcttgaaaaattagcaccttccaaatttaatcccaaagtacaccaaaaggagacaaaaaattagagaaaaacagatattgtttttctctggcactctctatttattggtacacatctcgttttttcggatggtgtgtatacctatgtaaaatttaaccaagtgttacccattccctcctcctcctccccattcacttttttcccgctatttgctttcaaaaaacgacatccaattggccaagacaattaagtgttgttgtcgcaagaagcgacgagatgaccaaaacggacgggaggtctgctaccgccaaaggaggaagccattcatgggaaggttttctagtgttcggagtggacgatggaaagccccgggaactgtcacgggaggaggaggactatttcggagggggtgcgctcgatcacccggtggcatttccccgccgggagaagagagggaaaagaaacaagtggtcgaacgggagcacttcccgtcgcaattgagggacagagcgagaggcgtcaagaaaatgatcggaatttgccttttcttcccaattttctctatttttcacctttttcctcccaattttctcaatattctgctatcgtaattttattcaatttgtcgtatttcaattttgcccctttttctcctctttttcacatctgcgtctgctcttccccctttgcctcgccgctttgccatttattttttgaattcacctttgtcttcattttggccgacacttcccctccggccttctccgattcttttccgatttttccccattttttctctttgttttgttaattcaaactttggaccattcacatttttccattcacaatgtttacgcattttgctatgccagggagccatcctctccccggcctttgactctccccttttttcttatcgcatcgtttattttgctcatttgtccaatttgcatttatctgggcctaaccccggggaaaaatatttaccaatcacccattcccctcccccctttttcatcactaatttgtccgtcacatcattcattcgttcacttttcttcctcactccactctagggagaaaaagttgttcttttgccttaatctctcaccacaccactcaatcgcggcattcacttttaatccccatttttgccgtttgtcacatttgccccccccctctctcacgaggtttaattacccaagtttgagcgctccgttaataaactatttttctgtcatttggttcatcaatttgggcgggggtcaaaagggagccgactcccgattcgcaactcacttcttctccggcccctttgcctgggcatttcggagcgattcagcaagtcaaacgggactccaactctcaggagtgcccactcgaaccccacctctctccttttccaatcacccccagtgattggacagcgaatcggacagcgagagggaaaacgggagtgaaactcccgagcgcaacgatcggacagaagttggcacgccggaagtgctgacaggagtgctcggacttaggcagttgaacctgggagcaccggcttctcccccaaattgagtcggtggtgccgttatttaaacaacagcccacttcttctttgcctcccacccttctctccattccacccccttgggaagggaccgaacggcagcgaagagagagagagagagagaaaagagaccgaattttgaggagtggattggagcagaaggaagggagaaactcccggccaaatcggcagagagtttttgccacaaacaaagttggtgccgttagcagggggcttctgcacatcaaggaacagcagcacaagcggtcgccgagaaccagcaacgagttgtggtcgccgaggaccaacaagcacatcgatttgtgctaacggcgaacaaagttggtgccgctaacagggggcacctcccactgcacctccatcacccataggtacaaaagctttagagcaacgactgagaaacgacccgaggactagtggaatattaaaacaaaaatttaatgaacaatcgggatcgggcgttaaaagtaaacaacgaaaatttataattaaaaaatggaaaagttactgaacaaattgtataatgacccaaat

SEQ ID NO: 20546 - DNA, 1388 bp, Heterodera glycines
gtccgaaaattattataaattactcattttctgaaaaatttttcaaaaaaagtttttagaattctttttataaaaaattttctagattttcaagaaaaatttctaaatttgagtttctagtttaaaaataccaaagattttttttttgcaaattttttaaaaggtttcggctacgaaatttgtccaattccaatcagttcaagccgtttttttttacaaaactaaaattaattttcccgactcatttacgactgaactgactcaacaaattggggggcaggaaattgtacaaaaaagcgatgcaagcggagattttccacaacacgcccaacctggacgtgttggaagcggcggtggaggaccttttgctgctcgagtcaacggcgccagcagttgcttctacctccccctcggcctcggctgtcccgggcgacgatggtactgaaatggccacgcactgtgtgaagggctgtgcgcttgccaatggccgcttgatcattgcgccgactgttgtgatcaccaccggcacatttttgaacgcggaactcgtgtggggcgcgcaacgaaagcccggcggtcggatgggcgaggcgaccagctcgggactggccgggtgagtcctcaaatcggctagggctacggcatgccgtccgtgttatgcctaacttaatcagcaacagcatgaagcgggttggaatcatggcatttttttgtgtgtggattaggaattttccagtccaatataaaagccctagttctatcgaatgatctaaagttatcaaattcagccaactgtgaaggaatttagaatcaaaaaaccggactggcgcccagttgtccttttcaaatttggattatttaccctatgccgttcgttgtgcattaattaattcatccatttaactctcatttttaattgatttatataaatttgatcaaatccccattttttttttctagcacatttcgtcgcgttggatttcgcaccggtgtgtttgaagctattttatacaaacattttgtctaattttgttcccactcccctcggggaccggtaaattggacaccaagcggaaaaatggacaccaaaggaaaattggacaccaaatttctttttaaaaaataaccccaggaattagcttaaaaataaaatttgagtatggtaaatggattaatgaattaaggcacttagatgggggatgattggtcaatgtgccaaaaaatgcacgaaaatagtaaccctatgtaaacgaaaacctttttctttatgaatgttatgattgctttcttctgcttatgttagaaataataataacattatttatttccgttttattaagcttataaaaaacaggtatgtgcaaacaaaaataaaatcttatggccaa

SEQ ID NO: 20547 - DNA, 1646 bp, Heterodera glycines
tgtgaaactagaaaattagaattggtggagaatagaaaagttcacctggctcccaaaaaaaaaattgttgaaattttcttataaaaattttctatgcttttctttggaacatttctttcagctcctttcctatgtcggctacacggatgaacgtctcgtcaaaattgtgtgcgaaaatgtggacgaaagccattcgctgatcagtgcactgaacgaaggcatcaaagggccccgctattgtccgtcgttggaggcgaaatgtctccgatttgggcacttgaaacaccgcgtgcgtatgtggtggcattcttcgtctctgatcagtgatcaagaactggcccaattttttgtttttcaattgaaatttcgactcccgacgggtttataggcacaaaattccgatttttaaaaattcggacgggttttttatgaattttttttttttgattcatggtgtttttcggtcggaatttcaatttccaactgatttttaggcattaaattatgactttttaattcgagattggtgccatctgtctcaaaggatgccactcttgtttttatgattattattaaaactttttgttagatttttttggagcccgagggattcgacagcgaattgatttacccgcaaggctgcgcattggggtgagaatgaatggcggaagggggagcaagcagcgcattctctcccctctccacggaaaattttagatttttttaaactaaaaaattcagtttttaaaaaaaactttttcttggcggggaggaaggtgacgaagaaaaaaaaacaatttttatttttattgaaaactataaattttaaaaaattcaaattcttaaatcattgacccgcattcagtttcaccatggatgtgcagcagaaaataatgcgctccatcgacggcttggaacgggttgaagtcgttcaaccgggtaaaaaataaaaaaataaagcattttgacaaaaaaaaatatcataaaatccaaggatattccgttcgctacgactttgtgcacccgcaacagttgtggccgagcctggagacgagaaaagttgtcggactgtttttggccggccaaatcaacggcacgacgggtgagagtgatcaccactgatcacatgagtttccgatcagataggtttggtctcctgaactgaggctcgcaaccaaaaagaaatcaggatggcaaatccgaaagcctttttggcaccttttgcagtttagagtaaaaaaattcgtataaaaggtggagagaaagaagaaaaaaactacaatcattaaatgattaaagggttttttatgggttttttattacaaaataaatgagtttttgaagtaaaaaacagtcttcttaaaatgcaaaaaatgtcggggccgggccgttttcgcgtgagtgcctatttaagactgaaattggcggatagtgccgaatatccatttcgacttatttcgaatcccgaacccgaattcaaataattttcttaacttttttttttgttttttctttcttgcggcttgtaccttctataataatttgtcagtttgttcgaatgtgcatcaaacggaaaaaataaataaaattttataaaaattcaaaaatttaacaaaaaaataacaaatttcgggaacagtctaagg

SEQ ID NO: 20548 - DNA, 1922 bp, Heterodera glycines
cttatcacaccacttttttcggcgcgctttttccagaacttttggggaaaaaggtggtccggcggtgccgataggcgccgccgggggaaattttgaaaatttgagtgagatttgttaacagatttcaacaaaaatggcttctttttgggattattaggctcaatttgtacggattttcatttaaaaaatgataaaatatataccaattaaaaatatgaggcaccaccatgaccagtgagtgagaccgagggtaccccctttttggcagaaaaatgtttgaaaaaattgcttaaaagacagcgttttccacaaatttttcaatataacggcggaaaaattaattaaaatcaataaaattttgtttgtattggaattttaaattttttttcccaccaattttcagtcgtatcgcctctttgggttggcgcattgccgcatgttacagcaatgctcggctggacattggccatccatttcatttcgaaatatacccaaaattaaaaaataatttttttttatcattttcccttttttgcaccctttttaattggcaaatattggaaaacaattattatttttcttaaaatttcttttaaattaaaattttaatttaaaaaaatcctggcgaagccaatccgtgatacgtatccctgcatgccatcataaatttgtctgcaaattttcaaaagtgactattttggcgcaatataagttccatgaaaacaaaaaaaaatcgtcgcctgggggtggggtacccccaccaagccgaaattctgggactgtccctacccaatggagcagctcgttccccctccccctgcccgaaaaaattttcagcaagtctttcaaaaaaaatttccagaaaaatcgtttaaaattagaaaaaaaaatttctctgcttaaaaattccttgattagatttttgtaaaattctgttattttcttctctgttgcagctgatcttctgatcaaaaatggtgcgaatttgaatcatagctgtacaaacggcaacactgcgttgtgcgcaacgaagttggggctgaaagacatcgtcaagcgactgttggaggcgggggcagtcgctgaccaagcgaaggaaaagggtaaataccgtaataaatatttcaaatactctttattagtgccaccaccctctaataaagcccccacaaatagcatggggttgaaaatcgggtacattatcatttatctcccgcgacaaataatttatcaaaaaaaaacatttttagaaatgtttatacccatatcttgcgattttctatcccgtatatttgtaattccatttgctattaataagtttttgtttatccatccaattcaaattgcccttagtttaggcgtcgatgtgcaagaagtgtcctcgagttccgccgggcccaccagtgataagtgaaagaagaagaagtgatcatttgaggaaggaaatgaaatgattattttaggcaatgctttatccgctaattgtttgctctttgagctttatccttttgttttggctatttattgtttgcttttttaggttgatttttgcttccgaatatgcttggatacataaatattttctgcttataaatttatataaatttctgtttttgattagtcaaatcttttttaacatccggattcgtgctctgcaccttaaaatagtcctagaaaattttttccaagattttcaaaaaaaaacgggaccagtaaactccatgattgccgttattgccacccaaaaagttataaagcattgaacatgctatgggctttgttgtacaagcctttgctcggctccattaatccttaacacaccgagtcaaaaacgagacatgtgtcaataaagagagagtgcagagaaactttttttatctaacttttctctccttttggcatactatctaatattttcatta

SEQ ID NO: 20549 - DNA, 1041 bp, Heterodera glycines
cgtaagcgtaatttttgtaacccagagtctctacggtcgggacattaaaacggcaagagctaacgcccattatctgattttaatgcgtaacccttcaggacaattacaagtgaggacactggggtcacaactgttcccaaaaagactgaattatttcatggatgcatatcacgatgcgaccaataatcaatttagctatctcatgattaacatgcacccaaattctgatgaggaattcagattatgtagcaaaatttttccagatgagactctggaaatttatttaccaattgaatagtatataagaatatgaatttaaattaaattaaaaatgtataaatttagctccgaagtgaaggagaatacagcattcctaaagaagcttgcctccaccagatcagaacaaaagaagaacgaattaatcgaaaacgctacagctgaccaaattttggcaatcgttgaaatttgtgcaaatatattgagttttagttttaaactaacgaacaaacaaaaaagaaggttggcacaatacgccgatttttatagagaaattgccaaatctcgttcagagaaaacggcaagaaaaaggatacaacaggggagtggtatagccctgggagctgtcttgatacctgtcctgagtgttttagcccaacatttattagaaaaaataacatcatgaaatttgcaaagaaaatgttaatgattcccgaggcggaatatttggctctacggagtgcgatgaatagtggtgattatctccaaaatgaaaaagcgagtttagacgcaaaaatttctcagaatttacaaaaccccggcataagcgaggacctcaaggcgaagagacacgattggctctataaagaaaggcgtacggtaaaggggatacttgaaaatagaccacagaaggtagtgattgagaatcatgtacccggtccaaatgttgcaccatatctaggcctcaacacccaatccaaaccacaggagaccgatgaaccccggaaaataattattcctaggaaaagacttgaagagcaaact

SEQ ID NO: 20550 - DNA, 1665 bp, Heterodera glycines
gtcgtattctcgcgcgactgccacttgagccgaaaatgggaaaaatgattgtgcttggtgctgcgctgggagtgggcgatttgatgctcacttctggtgaataaaaattcaattgaacatttcattttatcacccttcagcttctgccaccagtttcaacacacctttcgttccgcgtgagcgcatgcacacgaaactgtcgcatatgcaccgttctttctccggaaatcggccttccgatcacattggccttctcaatgttaaccaacaatttgcccaagagtacgaaatggatttaacacaagctgagaatttttgtcgccgatattcgcttagttttccgttgctcagtatgtccaatgaggcaaaaaggtaattttggacctttcacagttgaaattagtgatgtctacagtttcattttttagacaactttacgacgttatggtacacatttctggtttccctgaaaagactttccaagtatttccaatcgatgttcatggcgatgactccaatttggacattttcctttctttgatggtcttttttctttcgacaattaaaatcaatcctttttttagattgccgcatattacccaaatgtctgctatataaagtttgcatatataatttcctaaattttaattgtttgattttaatgtttcacttttgtttagagacaaacgtcgcgtgttcactttggaacagacgacagccattctcaggtcagctgaccaaatgcgactttgtcccatttggatgttttttaattttttgttttttctttcattcagtaatatgtcgagttgcgtcccattcaacagaaatgaaacgttcgatttcccttcacctctctttgtgtttgcagaaaaggtctgtttgggctgttgttgtaaattttgttgttcccttccctttttaaatattttgctgatggtgcttattacacccccaaaatgatgccactgtcttccgcattttggtatctcaataaatttcattgaaattggcgcacttgtacaatgtctctccgatcgaatgcaaattctcattctgaaatcctccaaaccgcgggtgttttgatacgcccacttgctaccccatatcagatttctgtagcacacacattattaatacagatatttcacttctcttgatagctccaatacaataacaataaaaccacggaggaccaggactttctcatgaaagatttagaagtgagcctatttgtcagtccgtcttcttaaaccaggggtgtcatcagaaatttaaaaaatcagaacgaccgtgtcacagatttaatttcatgaacccaaaaattgatttaaaaagcttttataaaacctaagtcttgttaagcttggcttgcagatggcactcctgacctaaactgctctttataacctctgacccgaaacgactcattgtcagccccgggtttatttgggactttcgtttttgaccgatcgctcttgcttattagttttcccccccgttcttctcgctttttaggtttcgacctctaacgaaaactctgaaattccccgtcacaatttgtgctcccttctcgcctccatgtcccttcaccatttccagcttcgtacctcctgcatctcatgcaaacaggcgtcaatggtctctccgttgcaattgctcctt

SEQ ID NO: 20551 - DNA, 1075 bp, Heterodera glycines
cagatcagggagtcttatatggggccaagtttttctgatcggatcaagattatgccacccttttctcagaagcatgccattgaattcagatcagggagtcttatatggggccaagtttttctgatcggatcaagattatgccacccttttctcagaagcatgccattgaattcagatcagggagtcttatatggggccaagtttttctgatcggatcaagattatgccaaccttttctcagaagcatgccattgaattccagatcagggagtcttatatggggccaagtttttctgatcggatcaagattatgccacccttttctcagaagcatgccattgaattcagatcagggagtcttatatggggccaagtttttctgatcggatcaagattatgccacccttttctcagaagcatgccattgaattccagatcagggagtcttatatggggccaagtttttctgatcggatcaagattatgccacccttttctcagaagcatgccattgaattcagatcagggagtcttatatggggccaagtttttctgatcggatcaagattatgccacccttttctcagaggcatgccattgaattccagatcagggagtcttatatggggccaagtttttctgatcggatcaagattatgccacccttttctcagaagcatgccattgaattcagatcagggagtcttatatggggccaagtttttctgatcggatcaagattatgccacccttttctcagaagcatgccattgaattcagatcagggagtcttatatggggccaagtttttctgatcggatcaagattatgccacccttttctcagaagcatgccattgaattcagatcagggagtcttatatggggccaagtttttctgatcggatcaagattatgccacccttttctcagaggcatgccattgaattcagatcagggagtcttatatggggccaagtttttctgatcggatcaagattatgccacccttttctcaaaagcatgccattgaattcaaaacagggagtcttatatgggggccaggttttctgatc

SEQ ID NO: 20552 - DNA, 1442 bp, Heterodera glycines
cagagactagctaacacagtcagcataggcttggacttccgtaccccattattatttttataatgggtttgttaaatgcaaaacaattcacaaaagttgttttaactccattcagagatgagatagaaaaaaaacaaaaataagtttgaagagccctcgaagagctgcaccggatgcgagtgccgccgttgctgtacgctcaacggttgctgtgcaaagacggaaaattgcttatcagaaaaaacgaaataaaatcaggaatactcacgcccgtagacaaaccgttggatatatggggacaaacctatattggactaccatacccaattaattatttttgggatgcgaattgttttgtgcgaaactgttatgaaaaaagggttcgaaaaactgggaaaaccccactcagagactagctaacaaaatcagcataggcttggacttccgtaccaattattatttttataatgggtttgttaaatgcaaaacaattcacaaaagttgttttaactccattcagagatgagatagaaaaaaaacaaaaataagtttgaagagcccttgaagagctgcaccggatgcgagtgccgccgttgctgtacgctcaacggttgctgtgcaaagacggaaaattgcttatcagaaaaaacgaaataaaatcaggaatactcacgcccgtagacaaaccgttggatatatggggacaaacctatattggactaccatacccaattaattatttttgggatgcgaattgttttgtgcgaaactgttatgaaaaaagggttcgaaaaactgggaaaaccccactcagagactagctaacaaaatcagcataggcttggacttccgtaccaattattatttttataatgggtttgttaaatgcaaaacaattcacaaaagttgttttaactccattcagagatgagatagaaaaaaaacaaaaataagtttgaagagccctcgaagagctgcaccggatgcgagtgccgccgttgctgtacgctcaacggttgctgtgcaaagacggaaaattgcttatcagaaaaaacgaaataaaatcaggaatactcacgcccgtagacaaaccgttggatatatggggacaaacctatattggactaccatacccaattaattatttttgggatgcgaattgttttgtgcgaaactgttatgaaaaaagggtacgaaaaactgggaaaaccccactcagagactagctaacaaaatcagcataggcttggacttccgtaccaattattatttttataatgggtttgttaaatgcaaaacaattcacaaaagttgttataactccattcagagatgagatagaaaaaaaacaaaatatgtttgaagagcccttcgagagctgcaccggatgcgagtgcccgcgttgctgtacgctcaacggttgctgtgcaaagacggaaaat

SEQ ID NO: 20553 - DNA, 3359 bp, Heterodera glycines
  misc_feature (1744)..(1744): n is a, c, g, or t
gctcttggctttataacaaatatataatttaacatcattagcatataattttattttcactcctgatggcaaagcatcaggaagatcgttaatataaatcaaaaataataaagggcccaggacagagccctgggggacgccagaggtaacttttttacttaggataaagaatccccaattttaactcgaaaagtcctattactcaaaaagccctttatccacattaaaagtttgccctttataccaattttttccaatttgtataaaagtaaattatggggcactgagtcaaatgctttttgaaaatcaatataaatacagtcaacattttttccatttataattgcctcgtatcaatcttccacaactgttattagttgacttgtcgtagacctattaaataaaattacaaatttaatttaaaaaataaaatatgcgcaattgtattacaattttggatcatcaccagtccagttcataatttacattcaatgggcaacgaaaggtgcacaaattttgggagacgaacaacagtaaaattgggcttagagaagagcactagtgcaaatgggtggattaacgacacaaaaatggttgtattaaatgcgcttaggctggataagccccacactaccggtactaattatattttctgtgtttttttctaaagctgagggtaaatttctcatttaaaatttaagctaaaaatctcgaatatggttaaagatggtatgaaaaattatttcaggtgaaaattttaaaaaagttgctaaatttattaattttgagaaaattgtgacttgtatttgggcacaaatcgggcgccggacttttcgacagcaaaggacttttcgacagaaatattataaattttaggaggggacttttcgacagaaaaagtaattaactttcaaattaaggggcgtaaaatcgtaaaattttttccaaaacaacaaaatgaagccaaaccagtattgaaataaataatttataaaatctaaaatcctttacctagaaaataaatttaaaaaaattggacatgaatttttaagaaaattgtttcattcttcctaggagtgtattttgaaaatttaaggaccggttcttaaaggtgttttttctaaaaaaaattttcccaggtaaaaaacgtatctctagtaattctaatttagcaatccatatttgtatgttaatttaaaagaaatttagtaaaattgacaagcaatataatttattttaataagaattatttgtttttatatttactgtcgaaaagtccgggagcccacaaatcaggggtgagacgcggccgtaatccgcgcttttaatttgaatcctcgaaccgcgaccgcgggattttttgggacaaaattataaagaaaatttgaagcgattgtcttttttgaatattcaaattttaaataaattttttgaaaagttggattatttttctcaaaaaattcgtttaaaaattctcttttttcctcgacggagctgaatacctttaatttttctttaaaaaattgtatctaaatcaaaaaataaggtgattttttaaaaatcttttaccaatttgcaatcaaattttttaaaatttttcgtgcggcccatatcggcacattataaggaaattttaaaaaattaaaaaaaagttaatgtgaaaaagttggaaaatttttgagtttttaaatacgcgatccacgatgcgcggtaatttttttgcgcaatccgagaccgcgggatnattctgtccgtgccccacccctggcccaaatccgaaaatgcaaatgcctttgttactgattagagttccatgggttatatgaaaacgtcatatccttatctgagccttttgatccgcaattgttctactgtaattgatttcttcttcctgctatactgtcgtcgtcatacggtacctcgcacgaaattattttggagtgttgccacttggtttgtgttcgagtttcttttgaatatggctggaaataccttatggtatgcttgccgatattccgtactaaacaaaggtgggaacatttccatatatcccagagctgccaaatgcccttgtttttatgatttcccttatttaggagagtagccgaatcttagagattcgacaaatcctgttcccaagactatctttgttttcgatgttgaaatatatttttgtaaactttatcaatttttaaaacatcttatatttttttatttgcctcaaaacagcataatttgatttaagtttttcatttcaaatgtccaattaatatattccaccgcccaactacttaaataggaaaaatatcaaataataatgataatttgaatgcttttaggcttatcaactttgaaaaatttgctaaaaattgcccgttttttggttttggcgatggactaaattataaacatttgttcaacaccttgtaaagtacaaaatgggtccgtttgatgcagcggcaatgttcaaaaagagtgcaaaaatttggtgtccaaaccaagcagtgatcggcgaaagtgacggtttgatcagaatgacataaatcgaacagattaaatagccgccaacattaatggcgacaatgcaaaaaagtgcacgaaatgtgcggcgattgatcgaatcagcggacggtaagcctaaagatgaattcagttgttataggcttctcgggattattcgggactatcgaattaatatgcatataaaaatccactaattagtttgaatataattgtgcgcataaaaagtatttttattcaacacaactcataattttaaaattttatgtgtttcactgctcaatgaaagcgtggaccaatgactaacataaaagattctaaaaagaagattaattaaatgacctataaaaaactaatttttgtttaaaacactacgaggtttcataaaggcaatttaatcccgtgggatcccgccccgcaaaaaaaaaaaaaattgagttccaatcccgcagcggggtacacaaatttgatttttgtaggggtcccacgggattagcattgcattttttgaaaaatttacaagacagaatgccaaaaattttctgaaaaatttacagaaaatttaattaatttataaactcatttttgggctccctatcatttcgtcactgatcgtttcgtcactgttcagttcgtcactgatcatttcgtcactgcgaaaatttttaaaaaattgtttggcacattgtcaaaactgaaaatttttttaaatttaacaaataaaatctgttttacatatgtatataaaagaaatgcatgcagcacaaaaattgcaattttggcaaagtttaataaaaatctttaaaattctgacttcaaaaagtagtgccgcgaagacg

SEQ ID NO: 20554 - DNA, 2871 bp, Heterodera glycines
agaagagcgaaaacaaactttttttttaagagagagaaaagaggaaaattgtacggttttgtgtatgagaaactgttgaaagaaagcaattagtcatcacacgctttgatcagtaaaatgaggaactgattagtattttcgaaaatgggattctttagagaaataaatgttaaaatatgctcggacagcgattcaaagctcaaaagaagagaacattgaatagatctgcaaagagaattattacattgtttcatatatcaatgaaatatctttaattaattttaagaatagcgtgcagaaacaccatcattgatatcattgatattttaacataaataaaaggtatttgtaagctattgatacgcgataagacaattaccaaaaaagttatacatgaaaattgcaaaagtcgaaatttttgaagttttttcttaataagttttttctaagcttgaaaatctttttgttttttatacagctaatagagctttttttaagagctttcgaatgataccaagattgttggatttggatgcaaaagaaaaaagctataatggaaaaacgagctggcgcccaaacgtgagcgctcaaacgcagtgaacccatttttttatggtaaattttttgaaaaaactccaaatagttccgaaatagttttttaaaagtcacaagacaaaattgttcttaaaaagtttagcaaaaaataaatgaaagcctaaaaatcccatccctgtttataaacaaagaatcgagattgatagatttgcttacaacaaacatttacttaattgataaagcagtaattaagttagcttaaaatctttgtatttaagaaatttacttttttccatttgaaggaaaaagcctgcaaacaccagaagaagtccttatccgatggattggtgagtttcaattagaaaatgaaaaaattattataaaaaataataatgaaaaaaacatttttttattcaaaacatttgctttccacctttaggagaagcccgaaaatggtcagatggagaagagtgttggagtgaactcctctgatggtgaatttaaatttatttaaataatcaatccttaaaattttggaattagtcatttaaagtttaaagcttgaaaattatcctgggatataaaatcacgaaatatggccataaaaaatggccaaaatatggccataaatatagaaaagaacaaaaattgatacaataaatatgcctataaactcctaataaagctaaaagcttttttcatgcctttacaattgaaaaaatgggaggattttcaaataattttgaatttacacaattagttattcattttaaaattaaaaataaatgtttaaattcgttttcagtgccgccaaatgccaccaccactgcgcttactgccattccgatcccctgaagcgaaggagaatgaagaaaaggacaaggacaaacaaatccaagtcaccaaagccataatcaaatccaaattccgccataatcaaatccaaatccgccaatcatttatatcttaatttaattattatttttactaattattttattcataatttatttaatgtttttgcttcatttgggtttattcaattttattttcattcaatttattcatttatcaatttatccaaaattcgaccgggattatacttatttcattgtaatatgaattatatttttaaataaattggcatttaaatttcattaaatggaattatttattttttgaaatggcgccactttttatacattccttctgtgtgagtttatttgacgagaaacattgaaaatcctcgtgcttttttttggctccaaagcatatgcgtcaatggcacttcgtacaaaaggcaactcgttttacaaaacaaagcctaagattaagcttaagcctcggcctagcctaaagctttggcctaagcctaacctaagcaattgtacgacttgccaaacgcaaatttggacaaaatttgtgccgttgctgcccaataacgcaccaccgctctcaagaatttagcaatcagggacaaaccctgcacatgttctttatgtcattattcttctcaatgttgttggccatcattaagaatttgtgattttaaaaattatttatttcaatactgatttggcttgatttttttgcttttttaacatattccatccgatgaatttggttggtttgaattagagttgtacgagaccttggaactcggtctggactcagttcccgatttttcaaatctcggttattaaaatctcttacgattaactttggtgtcacgctggaccccatcgttataaaaactttcataaaatttaacctaagaaatcttaaaataatttactatttttgctaattgtcttaacaaaatttcaataaaatatttatttttaagcctgccaagaaatcccattaattggcaatttgatgcaaacttgaacatattttgttaaaatgatgctaaaaagaaattaacaaattcaaatattaaagttagattgattaaaagatatttacttaaattttaaacgccattgaaaattgattaaaattttcaaaaaatctctttaatttttcatttcgcggatggggagaggattcccccccccctctggttacggccttgctgtggcataattttctttttttttttgcattgttaaaataataatgaaaaataatttatttcattcaaaatatttactctccacctctagcggaagcccgaaaatggtcggatggagaagaacactgaagagaattcctttgatggtgaatttatttaataattagcgtatttaaaaaacgtaaatctaaattaagctttttaaagattgaaaattattttttggtggacttctagag

SEQ ID NO: 20555 - DNA, 1406 bp, Heterodera glycines
ccaaattttgcagggaaactgctgagacccttcaaatgcttataattttcttagatttttttgcctggaggaacacagttcttcacacttaccacaccagcattatttttttaattatttttttcattttatcacccaacgttctagactgatcagaagctcaccaaattttgcagggaaactgctgagaaccctacaaatgcttataaattttcttagaattttttgcctggaggaacacagttcttcacacttaccacaccagcattatttttttttaattattttttgcatttgatcacccaacgttctagactgatcagaagctcaccaaattttgcagggaaactgctgagaacccttcaaatgcttataaattttcttagaattttttgcctggaggaacacagttcttcacacttaccacacaagcttaaaatttttggcctgtttaaaaaggaattaaaaatttttttaaatttattcatctccctttttgatagaaaaagcatcagagtgctaaaattaagttgtaaataaaatttggtgcgctttagagcactttctgaaaaaaatatttatgaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacatttatggggagcaaaactccaacgcagaattaaagtacagactatagggaagctattcccgaaggattcggtctccccataaatctggacgcatcggttcagggggactgccccg

SEQ ID NO: 20556 - DNA, 1629 bp, Heterodera glycines
caagcttactcctctcgtattccgaccatgaacgcgatgaccatcaatgtgtcgttgctttgtttatcagtgacaatttgaagaactgaattttttttaattaaaagttttttttaaaacaatttaaattaaatatttataaaatatagaaaatattaattaaaaatgagaaatttagaacaacagaaaattgaaaaacctttagttgaaataaaaataaaaataaaaacaatgtcatattaagtaaatttcaaagagaggtaaaacaaagatttgattttcagcaagaacttttttgtaaacagaaaattcgctcaatttcgcaaacatttcatgaccttaaaaaacactgtgtgattactgtagttggacaattaccggtaaaattctctaacacactgttcatcagcgacggctcctgcaactttttcagctcagaaatgaagcgtacctgaaataattgagcagggataattagcaaaaatcgcatggctaaacccgaatcacagtatattaattgcaaataattatttttaaattgggtttaataaattattagagaccggatttttatacactaaaccagggttaccctttgtccttatttgtaagatttgtccttattttgagggttcaaatcttacaaattttaaatgttcttatttgtaagatttgtccttattttgagggttcaaatcttacaaattttaaatgttcttatttgtaagatttgtccttatttaagcactttgtccttattttagtctttttttggattcagagagcaaaattattgaattttgaatatattttttaacaaaattcatgaaaaatcccaaaagaaattttcccgtcggcgactatcggcgccgcagtgccacaaaattcccataagatttcaaaagttgacctaaaatttgccaagcaaaaattagggtctttttatgaaaatttgattttcaaaagttttttgtttttagatggagaaaaaaaattctaggtctttttttactcaaagttgttaggttttttggtaaatgtttttcttaaatgatcaaattagttaataggtattttgtaactcaccatgtattcgcacattggtgacttttccagccgaaaatgccaaactccggagcatttggcttcttcctcttcgtcaatgggtgagtaaatctgaaaatttgtgaacaaatttaaaataatattctatatttgtttaattgtttcccacctcaaccttttccaccacttcattaccgaaactgcacactttggtggacactgaaatttgctcaatttattaaataatacttttttgtacatagaagggaaaaaggaattctaaaattaaatgctattttttaagtttaaaataaaaatataataaatattttaaaaaacaaaaaaggttctaaaccggctttaaatattaaaataattgttgttgcaaaagttttttccaaaaaatctttaaaaaataaataaaaataaaacctatttaagaaagaaatctgttttgttttttaattcattttttttgttatttgattaattttttcgtttctacttgaaagagaaaaaaaactcctcaaatgtttttttttcgaataatcccccattgggaaa

SEQ ID NO: 20557 - DNA, 1462 bp, Heterodera glycines
attatttggtctcctgaagtcaattccccattagaatagggggatttttcatattttctttaaagtattttatttgaaatttaattaataagaaagtttgtctaactttaaaaaatattttttaaatagccataagcccacaaattaatcattttttggacaaaatttgttaacaaatttcactaaaaatttcaaaattttccccggcggcgcctatcggcaccgcttgaccccctccctgtaccacaaaggattttgtaaaggcgctcacaaaaagaagagattttaaccaaaaaaagattttgtaaataagttgaaaacatagaaaaattctctacgaatattttggaattttaaaaataatagacaattttaatgaaaattattgtacatatataaaaaatcagaaatggcctcaacaagcaaatcttttggtatttttaaaggatttttcttattacacatacaaaatttaaagtgcaaaccgaatcgacatttgacgaagaattcaaaaaatattgttcgggcgatttgattgggcaggaattggaccctttggattggtggaaaattaacgaaggattttgaacaaatcaattccgaaaattctattttattaaattttttgttatttttgtccatttaattttaaaaaatactcaatcatttacacagagaaattttttaaaccgtttaaattataatattttcacttgaaaaataattaaagtaaaaaatttttaaaaaatcaaaatttttcattaaaaaaattttttcccgtttcccggcgggattcccgttaaaattgacgggatttttacgggaacgggaaaaagccgggaatcccgttcccgtttcccgtcccgctctttatcgattcccgtttcccgttccccgttcccggaaatttttttttaccggactctactttttaagcatgatgaatttttcgtataattcacatattttttacaccagaaaaaaacaaaaataaattttaaacttattttcatcgtgacaacaattctgcagcaaatttctgaatttaaaataaataaattaatatttaaattttgttctttgaaaatttttccgctttgcggaaatacgagactttgcgggaacgcgaagaaaaatttcccgtttggcggggacgaaaaaagcattttttaatcggaaactctgttggtgaatgaggaagtccaaagataagccataaaatatttaattaacaaatactatttaaataaattaacacgtatttataaaaaaatttttatcatacgaggaatatttatttgaaataaaatataaaaatgttatttgattttcttaaaaaatatcaatcagtctcagtttctccttcttcaatgccattggaaaattgcgggacacctaaaaaaacatttcataaatttgaatataaaaataatggctgaatcattgatagtgaagacagacc

SEQ ID NO: 20558 - DNA, 1973 bp, Heterodera glycines
  misc_feature (1959)..(1959): n is a, c, g, or t
tgttttctattaaatttggtgcataaatgtatagctgctttacacctcccgtcaaatccggcatataagtcgcctcttccgcgtgaaatagccttgtattcttaaaaccgagcacataggctaggtgttttgacaaatctatatgggagacagcagcggaaagatagacaataaatttttgatcaatgctgtcatattgaaattgaacatcctcattggctagtctttctcttttttgtggtcctttctcagcttcagatacttgtctattttcaatatctttacgtttaatatgctcaccgagtgcctcattaagcctattcactatcccgctaaaacccttttccgatttatcattatatccctcgagagttgatgtatatttggtctttgcctgtctggcgattccctttgcgacgtcggctgatttctttgcttttttcaagtcattcttttccacatgctccaatgttatgtttttggctttatctacttcttcttgaaaagacttaagttcatttcgggatgtttgaatttcggttcccatttcaaccattttgtcaaaccaaatttttatatcaggctcttctaaaatgtgaggatttgtttctcgtagtgtgtttagttgggtttggatggaattcgagatattgttgatctgattaaaatgtctttctacatctctcccggcgcgttctgcggcgctctttgcgacatcaatttttgaatctttggtatcttcagccttggcttctctccttccacgttgttttttgattttgtaatgatggctgaatgcctcgttaattttatttcccaggcccccggcggttttaaaattcatgtccggtaaataaacttgagtcgggacactgctgtcgttttcccatactttaataaactcttgaccgtttataccgagtaaggtgaatgagtaggggtaaataattgatgagagagctactgaccaaatttgtgcccaattccaaaatctcggggagtcgtactgtgaattttgatgtactgttccctggtcccggtgtgttcgagggtagcacaatgtaaaagtcatccatctattttcactaattccaggttataaaatattccttttattaaatttccttccaaatcttcgatcctgtatgaatcgggtgtcgtcgaattggcaacaacaattttaaacaattcttcggtaaagtttgggaggtatccctttgaaaattttcccttttccttggtaatacgaacgatatcaccgattttaaattttttcttttttaaaattttaaattccctagccttatataatttttcccagagcgcacgggcattttcaaaattaattgaagacggtttggctcccaatgttctattcacactgttgttaatgtttgttattattttgtctattacgtcgacccatcgaagagtgtctttctttgtaaaatatctgtacaagcgctcctttattgtccgatttgccctttcaacgactccggcgtgcagatcaggactatacattacatttttgatgatgaatttttcctcaaaatattttttcatttttcctgcttggaattcaagccccctgtcactatatattttcatcgggataattttagacttttcgaacacccgatcaaaagcctcgatcatgtcctcactcttctttgacttggccggtgcactgaagatcattcgactcagcacgtcgatgcagaccaataaatatttataaccgtcgttatgctttttcaactggtcaaatatgcacaaatcgcactgccaatcggtatggaagccacttggtatcgtctttagtctcgggaatcttttcctgatgggcttgtgaatcgtgtatgttttctgcttttctaggaatttatgaacgtcatcggtcgtaattttcgggtcaatcttcctgagaaggtttaaaattttttgaattcccagcanaaacttgccggaga

SEQ ID NO: 20559 - DNA, 2066 bp, Heterodera glycines
ggggggggggagagggagaaacgcttccatttggggaccggaatcgcaataaatttaaggcagaagtttgtttcctgaaatttttctttttttctttggaattttcttttaaaatttttcttaattttttttttttttgaaaattttctaatggtggggatgagggattaactgtagggacttgtcctggtagtgaatattttttaatattgttgccttagagaagccaatgaaaattcaaaatagtgaaggacagcagagaccgagaaattgagctttttcaaaaatttccaaaaaactttcttgaaaaaagtggaataaaaaaaattagatttctttgaagaatgttgcacctaaaaatgggaccgcttgctatcttttctaggccctaatatcactgtgaaacccatgttgtgatttttttttgggggggggggggggcgagggcgagtgtgaagccggcggggtaccgaatcggctagggtggacggtacccgatccggcggggcagcatccaaacccggtcatttatcctccttaatccgtccctttcccaatgtaatttagtaatttttcagctatttttttgaaaaaataaattttctgctaacagtcaaaattttcattttaggaatcagaacgccaaaactttgcaaaacttaaaatttattggggattttcccttgtaaaaatgcaagagccgatctcgagttagaaaagaaactttcaaaaaacaaaagagaattcgatagaaaagaccaaaaaattcacttaagcaaaatttcaataaaattggtcaataggaaaaatttttttccaagggcaaacatttcaataattttaatacttttttagcaaagtccacaatttaaggccaaaccaaataaaatttacaatattctccagaattttcccttcaaaatgagcataaaatggttttatttgctctagtattcaccaagttataagctaagaaaatttcataaaattgtgatgttgtacctaaacaacgctttttgaatatgattttttattgccacgaaaacttttattaatgaaaaaataattctgccttcttctttaaaagaagaaattgaaattaacacacaacatagggaggacttgaacctgggaccccctttttggtgactaactcacagaccactaagacggaaaatccaacttaattgtacttggagcccaaaattgaatcgccgtgtagatggtatccatccgatttcgtcactcgtcatttaattaataaaaagtgaaattgcaaaatcaaaaattatgtgaatttttagacaaaaaatttttaatttggaatttaacaaaatggaataaacaaaatgaaaattttcttcacaaccttcgtagagtgtgctggctgctctcaaaaattaagtaaatacaagaaaaagtcaaataatcaggtcaattagtgtgccattaattccttattgcaaaataaggacaccaagccaaaagcaaggacttttcaagggctgtcgttcatcaaaaaatgccaatttttgaaatttctaaaacaatttttccgaataattcacgagatgtgtgtggcaaatggcaacactgatcagataacaaaaggggagatcaatggtaaattaaatggtaattgcaatgacaaattagggagtaattaaaatataaaaataggactagaaaaaattaacaaatttgtggtaatattgaaaaaaacaaaacatgaaaaatggcaaaaaattgtcgtccatctccatttgcagaagaagggcatttcaataacgagtcgaaatgctgtggtattacggtatcctactgtaaatcaaaaacagtaccaattcaatacagtaattatggaacaaaaaaatgaaaataaaatatgacatttatgtacaacatgagatcgtcagattctccatcatcagctttgtatactaataatacataatgaagattttgagaatgaatgattggtgagaagtttttcttggaaattccctaaataaatttgttgaagtttcaaaaatgttcccaaaaaatcacaaaaatggcattttgcg

SEQ ID NO: 20560 - DNA, 2120 bp, Heterodera glycines
  misc_feature (2089)..(2089): n is a, c, g, or t
tctttaatgactgttccacgtgagatggaacacttctcgttccgactagtggggcgagtgtcacttcgatggccaattccgcgacgttaagcctttccctcgtttcatcaattttttcaaattcaaccgacaaatttagctaaaaattctcactgattattattttggattttaattatttgccaccttctcattaaagttgttgggaaatgtttctttgataattttttcaaacttctcagcaagcggttccctggtcatgccaagccaaatgagcagcacttccatgaggtttttcacgccgagtcgcttaattccgtggtgagtcgaagtgacaaaaatatcagtgagagactttcagaggggtggcgtcatttcagtacggaataaattaatttaattaattaataatataattattttaatctattaattatttttctgaccataattataatttcaatatattatttaatatttcccaaacaagttacagttttacgagagaaatacagtgccccaaaaaagtcttgactcaaacctgaaaaactatcttatagttcatttaaaaacttgaaataattcatgcttgcacaacttttggtgctgatcaaaaaagtctcttataccaacttgatcagatcactcctttgtagtgaccgggcaccccaaaatacactgaaaatcgggaaacttcgaaatccctagggggttgggaaattttttctaaagaaaatgggcaagccaactggaaagagcacaaaattttctaccgaattggttttgggatggttgttctacgatttgcacatagaaagttatacttggttgaataattgatcaccataaaaatgatcaatttttgatcaacgccataactttttccagaagcatccaaattaagcatacttggtatcatttgatagcccgaagtgtcttctatttgcctttaaaattttaaaaatttggttgttggttcaaaaaagttgtggcttgtaaatttcataaattgatttggtaaacctttgtgaccacaactttttttaaactcaacgaaattttttgaaattttacaggaaaatagagaacacttagggctaccaaaagataccaaaaatgtataattttgatggttttagaaaaagttatgatgcatgaaatttatcaagaaattacttggtcgtgtatttttgtggccgtataaactgaaatagagaacaaatatatttattattattagcttattattcaattttaaattatattattaattaattaaattaatttcttccgtactgaaatgacgccacccctctgaaagtctctcactgatatttttgtcacttcgtctccttgacccgcttaattcattcaaaaaattggaaaaagttgagttcttctgtctcattctccctctctctcccctttctctctctctttccctttttctctctctctctttctttccctttctctccctccctccctctctctttctttcctttctctcgctgcttctcactctttttgtctccctttttcctcccccctctttctctcactcttttcccactctatatatctctctctctctctctctgtttcatttctctctctaactccctcctccttctctcttcctccccctctctctctctctcctcatttattattacttacatttgaccgtgttttgccataaaagggtgtttccaacagtccggccaattttcggtaaagcctcgtgaagaaaaagcatgccattgcatagttttctgattgtttctgttcttcaaattgaactttgctttctatttggtcatgttgttgttcaccagcagcatgagaaatgttgtcggtgctgaaaaatgaaattttagggaaaatcattggaatctcagaaagtttcagaatttgggtcatttgataaggcctcttgagaaaagttgaaatatttttcttggaagagaataattttaaaatagaaatgtattacaaatcaattaattcatttgtttttttaaatatttgcccatttttgtgtttatttggcgaaactacccattaattaattaattgattagctcanttaattaatccaattcaccaacagaacaacg

SEQ ID NO: 20561 - DNA, 1814 bp, Heterodera glycines
  misc_feature (1753)..(1753): n is a, c, g, or t
ccctcgcttcaggatcgtttttccgatgaaagtgacatattttttgcgcgcgtttcacgttttttgaaggacgaaggggctgaagaaaatgacattttggaaaatttggaggatgaagtgaattcgactcgcatttcgccaccagccaagcgcgcttgttcaattgttgagataatgcagaacatagccagttgtaccaaaaaaggtggtaccaaaattgcaattttgataaaaaaaaaaatttagctacatcatctcaaaataagggcatgtcggaagaaattctctcatacaaagaggaaatttgtgtttcaatgaatgctgatcccttgcagtggtggaatagcaatgaaagaaaatttcctaaactttcaaacattgcgcgtcgttatttgtcatcaccatgtacaagcatttcaagtgaacagctttttagtgtggcaagagacgtatatgactaccgtcggtcaagcatttccccagagacggctgaaatgttgatctttttgcataattctattcctgatgtcaatttttcatattaattttcaccagtttttgtctaaaaatatatcggaacacttatttatcgttttggaaattttttaaatttaattgaaattttttcaaaatttccaaaaatccgcaatcctgcgcaggatccggcaaattttaaatgcaggatttgcaggattgcaggatttgcaggattaatccggccggatccggtcctgtaaaaaattttggattccaatcctgcaacaggatccgcaaatttgaaatttccgggctctagttttattaaccattaaaagaaaaagttttctgttttggtttgtttgtgcacgcccggaattaggcaaatagaatttgtggcacctgtaaagaacaggaatcgacaaaaaatctttttcggtcacaaatgtaagggttttcggtgtcgctgatcacgaatcaggcattcattttgaccaatttctgcataaaatctacctattttgcgcaataaattaattttagtaaaagcgaattcccgactttgtttgaatttaggtccagggcttcggaattggccgaaatgaatgccggattcgtgctaccgaaacctatatattgaaatgttttttgattgctaattgaaaaaaatttacggggcctgaactgtacaagagataattcccgttttaagacgaaaaaaatatataaaaaacatttgtccttccctcacattctccgtttaaaatatggataattgattgtctctttgttaaactttggtttattaacggatcaaagaatccacaaaaatatccagcagaggtgattccgatcaaaacaaataattaggtgatcatcgcttttgctcctcttcctcctccgtttcaaattcgatcatcacttgctcaatgccaatgcatgcgcggcgcctgcggcgtccgttgtttaaactgcgcagaaatttgaccactcgccgtccgaacagttgcgcatcatcctcctctcctgtcgatgtcgatgatgatgaagcagcgagcccaaaatccgaagcggacggctaaaaccaaatggatttatatcttataaaaaatatcgaacaaataaaacaatggggagggtctttcaattttcaataaaaagccaaacataacataagattagaaaacacttaaaaagtgcacatccttaaatgaaattgctttttaatgcattgtaaaaaatttggaataaaataaaaaaaggaaaagccgttagncggggttaaaaaaatttcggtgagaacttttaatgtatgctttatatatagatgtactata

SEQ ID NO: 20562 - DNA, 1965 bp, Heterodera glycines
  misc_feature (1013)..(1013): n is a, c, g, or t
  misc_feature (1037)..(1038): n is a, c, g, or t
  misc_feature (1051)..(1051): n is a, c, g, or t
  misc_feature (1059)..(1060): n is a, c, g, or t
  misc_feature (1063)..(1063): n is a, c, g, or t
  misc_feature (1089)..(1089): n is a, c, g, or t
  misc_feature (1098)..(1099): n is a, c, g, or t
  misc_feature (1122)..(1128): n is a, c, g, or t
  misc_feature (1165)..(1166): n is a, c, g, or t
  misc_feature (1183)..(1184): n is a, c, g, or t
ccaatgtggcccaaattttaggcccccagccacagccccttgcttctcccagttttaagtcttggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccccttgcttctcccagttttaagtcttggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatgccaaaacaaaacgaaatcgttttaaaatattcctttctggacttgacttggtttcttgatatcgaagctgttttctacgctatttctaaaacggttataccaaaccccagatttttgaatccggttttcagaaaaatgccttgtggtgaaaacatatttcacatttcactccataactttgtgagttcggcacggatcgagaccgggataagaccattggaaagagcagctcgagctctacagaggtatgaaaanaatatatctgatgcattccataanntttttccgtgagnttttcttnnttnttggccgccccccctttttcctcagntctatacgnnttttcgttgtttgtaaatttttnnnnnnnttttatacaatctttatattttttttttccccccctnntaaaaagaaaaaatccnnggcaaaaaattttcaaattttccattttgtttccaatttccaaaattttttgggatttttaatggcaaaaaaaaacaaaaccgtttaaaaaaatccctttgggaaatatattgggttttttaaaaaaaaaatgtttttcccccttttttaaagagggtttttccccccccccctttttttttccccttttttaaaaaaatatttttgggggaaaaaatattttttttttctcctctcttttttgtggggtggcgcgcgcggacgcggggggaaaatattttggaaaaaagcccgccgctccctctaaaagaggagggagagaagaaaaaaaatattttttttgtgtttttttttataaaaaaataatatttttcttgcgggggcgtagtttttttcccgccccccccgcgcccccccctctctctcccttctgttgtgttgttggggttgtataaaaaaaacaaaaaaaaaaaaaaaaaatattcttttttttttttttttcacaaaaaaaaaaaaaaaggaaaaaaaaaatatttttcttttcttttttttttttattttattttttaaaaaaaaaaaaaaaaaaaaaaaaatttttttttttgtttttgggggggttgggttttgtttttttcccccccccccccacccccctcggtagggggggggggggggggtttttttttttttttttggggggggggggggggggggagaaaaaaaaaaaaaaaaaaaaaaaaaaaaaaacaacccccccccccccccccccccgccccccccc

SEQ ID NO: 20563 - DNA, 1534 bp, Heterodera glycines
aggcagatttcatttaataaacctaatttgatttgagctccttattcttgaaatcaaatgatcaaaaactatagaggaggtaaatgtccaaaaaaggcactcgctccgctgcctttcgtccgaccgctcatttgtccgtgtgccattccgtttttgccactctgtccgcccgctcatttgtccgtcccattccgttttcgccgctctgtccgctgcattttgacttgtgctgtgccaatatttaactgttcttccacttccgggcgagcattggacaaccattgccttagaatttttaaaacttatctgtttatttcccaaatttagtcaaaaattcaatttattagtgaagtcttgattaaattccggctaatttcacgattttcagcgattttaaaagtctaaaaaactggaaaacgttgaaaaactgttacgaaatggagaataaaattctttgcgaatatttgtttaattccaacattctttaaatttgaagtgcaagctattttaatgaaatttgctaaaaaaaatcaaaaatttaaattgtttttctttgttttgtttttccatcttttcattccaactttttcttatctgctggcaatttgattagtttttgtgcctcccaattttcctttgactctaaatcgatcgatgttcgttaaattgtttctcatcgaattttgttttgcgaaaattaaagtgtttggatctgagattggtctactctctgtgtttggttgaattgcgtccctgtcttgagtcaaataaaagcacaattacacaaataatgatcgtaattggcataattaaaaagtgacactttatgacattttcatttttccaatgtgttcattccccaaaaattcgggctaatgtaaacaattttttgttttgtttattttcactctcttaaaattgttaatgaccatccggctgtaataattgcttaaattgttgccgtaatggacaacgcttgagtttgtgtttattatggccactcacataaacgtgataattacctaattaagatatcaccaatttgtacattgacgagggcttttgttaatttatttcttaaaaaggaaaatttaatttcaattgaaatttaatttttccatcattttcttttaggaatacgcgacaatcaaaatgcaatggccgagaaaatgtcgggaattgatgcaaaattggaacaaattgaaaatggttaaaataattaatgttcatttttcatttattttaaatttgaaaatgctggaaaatatttttaatttatatttttctttagcattggccgagaaagtatcggaaaaaaattgtgcaaaaaatttttcacgagcaaaattatcattaaaatcaattttttgcaaaaacttacttccctacgtacgggagtaacttttcataatttgtcgaaccaaaattgttaaattcgataatcggatacgaaaaatataatatttaatacacatttttatcatataaattgtaaaaataactgattagaagcattttgcaattgtcctgattt

SEQ ID NO: 20564 - DNA, 1982 bp, Heterodera glycines
  misc_feature (69)..(69): n is a, c, g, or t
  misc_feature (110)..(110): n is a, c, g, or t
  misc_feature (1306)..(1306): n is a, c, g, or t
  misc_feature (1317)..(1317): n is a, c, g, or t
tttaaataaatgtaaaataacccagttttacaaatgttaagattttgactcaaaaactgttattgagcntaagttctatttgtcgaaatatttttcaatggcacgacttnttcacagttagcaaaaaataatttaattaaatcggctggaaaactattggttatagaaagtgatttcgatcacttattactcaaattcatagctaaattttggtacattaaaataaaatatgtttttttaaatcattaaaaaatgaatgagtcaagcatattgaccatatttatttataatttatttattttaacttaaaaattttagtatgaatattaagtattttgaccaattttagtaatcaatttttaaaagaatttgttttttaatctttaacaattttgccataccgtactttagctggctgcccatttgcctgtgcctttttgctattaattaattaattaattaattaattaaaggtaaacatatccaagggatctgcccttccttcactttctcggacattttcagcagaacaaactttagtctttttttctctccgttggtcatttggtctttgtgtcccactgcttaatagtctttttttctctccgttggtcatttggtctttgtgtcccactgcttaatgagtcatccattaatagcgtttgatctttgtcccactgcttaatgagtcatccatcaatggtcgaccgttgtaattagctaattaattaaggaacagaacattgcgacccaatgtttacaattttttgtttattttcactcccaaacatttttctgagcatccgaatgcaataaacacaatatttcgttgcataaattgtgctgaaacttctctatgatattcacaaatgcatttagcatcaattagctaattcatttatttatatcaaattttatttatttatttttaattaaatttaatttattgcaaaaaaatagttgtaatattttaaaatatacggccttttcttggcgaatttagctatttgttgtttaagtaacaattttaaaaagtttgccctattttttaattgccaaattcgacatggccactttaaatgtggcccatctcatcactttaattggcgttggggtacaaaattataaattaaaatttattattaattttttctaatatttatttttgttttagtcaattgcttcatccgttgttgctgatgagcaacaaaatcaaaacaaaactcaaaatggaggaggaggcttaaagcatttgttgggatcggatggtaaaaattatattttttatttgaaatttatttaaatntaattaaatanaatattttaagggttaatttttgcttttagttttcactgagcttcgggccaaacaaaatgcgatggccgagaaaatgtcgggaattgagacaaaattggaaaaacaaattcaaaatggtaacaattttattctaattaattcattttcgactttcgttgattaaaatttaaaaaatgaaaatgaaataatttattttataaatttaaattaaaaaacaaatgaaatgaaaatttcttatttgattgttaaataatttattaactattgtaagagataaataaattaacattaaattgccgaagcagcattttctcatttaattttcacattcattttaatgccttttcatttcatttaattgcttctccgttagccaataagcgatcgatctgactcctccccttcccatttatgtgtctatttaatgtgcgattttcccatttctcgtcacttaatccggactaataattattattattctgtattattatttatttattttacatttatttccctgggataaagccattattttaatggacttggagttggggagggaagtgggattgatcaccccaggaccccctcataaaaatggttggatttctaagggttgggagtcccaaggcctaattcagcgcgttccactggcatgtgtgttact

SEQ ID NO: 20565 - DNA, 2841 bp, Heterodera glycines
  misc_feature (2813)..(2813): n is a, c, g, or t
ttggttttttttgcatctcacacccctctttttgctcttctacgttttaaatctcgggaatgaagaggcaaaaattgcctaattttttagccgagctttgaaaattctagggggaatgttaagcaggtggtgccgaacgattgaataaatttgtttcctataaagactaatatttaataaaagataatcctttaagggttttaatagaaacacaagcattgagttggaagaaaagcataaactaagcccaaaaaagaaaattgttaaaaaccacattgaattcagcatgacagcaatcaataaatcaatcaatcaatttcggtcaatcaatcaatgtgtattgaaattacagttttttgcttaatcgtcttcgtcttctctttcttttttgatagtattcactgaaattttcacaaaaactacaaaaacttgggtcgaattttcttctatttttattttgaatttaatatttataaaaaagcctatttttaatgcatcaaaatttttttgaaactacataacctctaaaatttattttttttaaaacaataggaaaaatcaattttttaaaaccccaaaacaatatttgcaaaactgagccggaaattaagccggccgattcaaaacaacacctccccccgcaccaatacaaaactttttttattatatttgtgtgggacactgaaaattttcgtaactttattattatacaaatcggacgactaattctgtgaaatccgtcctgtaaattttgatacataaaacccggttagtgtcaattattatttattatcaaaagatcaaacaaacatcttaccagttttcggtccacacttcgctttttcgtttgttcgctgctcttcatctttgatcgggaatttttcggtccctacgaaaagaaattacaggaaaatcataagcccatgcgattttttgtctggattctggatcataccagaaaaaaatgcttgtttccatcttcgaactgtttcccgattaataccgaataatttggaaatttcaatatctttcatattgtgtacattcttaaatatttgataattttctctgaattcttcttttaatgcgtcgtaatgttgttttccttaattcttgtttatttgaatttatttaaaattttgcgcacttttaaagaaatttttcgaaaataaaagaaaaaggcaatagatttaagttaaaaaatatcccatttaaattaccatttttctttcgttttgcttttttttcaattttttccccttcaatattttcttcattttctttttcttgtttgattagtatttcacttgaattttctttcaatttcattcttccatcatttattaaatctgtcattaatttcattgttccttaaaaaaattttaataattacgaaattaaatagtttttcgctactttttctatttactggactagcattcggacgatcatcatcaaaagcgggcgtttctctatcattttctaaaattatcttaattattatccataatttattggggtgctaaaattttgtcgattaagaatttgatttttgcgatacagaattggtgaatcagggaatttagtgaaaaagtgaaaatctgtatattaaaaatggcaaaaaattattaaattgataaaagaaatttttaaaaaacaataaaatattacatttaaaaaattgggttttagaagaaaattaaaatgaaatttctcaaaattttgttcaaaatgtgcttttttataaaagtgagctttttaaattctgataggtttgaataacaaataattttttaaacataacaaaaaagaccaaaagcaaataaattatgttagcactagggatgcgatttttaggcaaatgcctaaaatttatgcacttaatacgcacagataagcacgaaaaaagccctttccgcatggtttggggtgtctacgatgaattttataatgcctaactttgcctatttcggggtttttgtgcctaaagtgcctattttagggtttttgaaaaaatccttaacaaaaatgcaataaaaacaaaaaaatacacccctaagaaatgacccaaaaaatttttcagaaaatacaccctaagaattgtaaaatttttcaaaaaaattatccctaaatttaatatttttttcttaataaaaattttttggtttaaaaatttgttcatattcgaaaaaaaactttaaaacattaataatttcatttacaattgaaatatttaaagtttaaacgtgttttgttacctaaaaagcgttaataaaaaattttatttgcctatttttgtgcctattcgggcttttttgtgcctatttaatgcctatttcgcgattttttgtgcctaaaaatcgcatccctagttagagcaccgtgggaaaatgaatttaatatgttttgagaaattcaatcccacgtcttaattcaaaatcatgcaattgaaactaaaaatattgaatatatttatactcattttcgaattcatttttaggaattatacttgataggttaatctggtgattaacagcagcggaagccttcccatggacagccccaaaatcgaactgttcaaaagtatctatcggagaagatctgtcttccaaattgacaagtgagagaggttcaatgatgttgctaatctcttcagaaactgctcaaaaaatgtggtgaaaggaaattgaataaatttgtatttattttaaactttgttgattgactggtttaaatttggtatgtatttgttagatttggtctgtatttggttttcacaaatttgaattaatatgcatcaaggaggtgccganaaggcgcattcaagagattaaaatttaa

SEQ ID NO: 20566 - DNA, 2493 bp, Heterodera glycines
caatccctctacagaaatcatattattttcaatttttttttgtatactcgtgggtttcctataaagaaaatatgattcctcatagttttttttaaattgatacatatttatcattttttaaatgaaaatcctaccaattgagcttaataatcgcaaaaaccaacctttgtttgttgaaaatctgttaacaaattgcacccaaatttttaaaatttcccccggcggcgcctatcggcaccgccggaccccttctttcccaaaagttttttgaaaaagcgctccgaaaaaaagtgatgtgaaaatcaaatctgaatttctattaatattcgatgatttagtccaaaaatgattaattgtttgaaataattgaagaaaattcctttcattttctctctaccacacactctttaatcttctgtgccctatactcttttcctttcattttctctatgccacacactctttcttttcgttttctctctgcttacattcttttcctttcattttctctctgcttacattcttttcctttcattttctctatgccatacattcttttcttttcgttttctctctaccacacactctttcaattcattttctttcttctaagtttttttatttctctcttcgaaacacacactcttttcttttcatttctctcaatcacactttttcctttcattttctctctaccacacgctcttttcttttcattttatctcaatcacacacttattttctaccagacattcttcccttgcattttctctctaccacacactcttttctttccatttctctctgtcaaccactctttcccttctctgtctgatttgcagttgctgcttggccaacattcagccaatcagcgattgaattcgttgcgtgcgtttcttccaactcacaaaggaaggtccccaggtgtccgtgggatttccgaatgaaactttgtgggtgaatagagcacctatgggttcttaagaaaaatggtttcaatttctgccaaataagtacgggtgccgagttatgccgtgccaaactttttttatcccataaattgaataatcatttgcaccactttgttctgtctccttgtgaaattagtggattttaaaatcatttgacaattgattgattaaaaaaacgacaaaaaaaaagaatcaactttaacattaagtaactttactaagtttataaaatcgcaaatttcgtaaaaaatatccattacaaaatgtggtcgacattcttggtatcattcgatagccctaacatttctctacaagctcatctaaatttcaaaaaatttggtcaagtttgagcaaagttatggccaaaagtacccaagcaatcaagttttcacacatttttaggcataactttttttaaactcaataaaattttttgaaattttgcagactaatagaggacacgtagggctatcgaataatagcaagctttattaattttgttggttctgagaatgttttgatcagaattttttatgatcaaaataagcaatccgtaattgagcccagccctggcgctagcgctttcttagcaattccaaagagggcgctagcgctctcagcaaattcaatttggaaaatacattcaaatataatcgaatcaaatttaatttattttaataaatgaatagaaaaaaatatggttttttaaacaagagtttgtgaattgttttcaataaataagccattgtaaaggtaaatgcaaatctttgtaaatatatttaaaaatttttatttcaaatttattgccgcctgctaggctaatcaattttcaatgaataaattaaaattcaaacattttatttacgctaaatttggaaaatcgccaaaataaagaaccaatgatcgttacttaatcacaaagataaatttctaatttttttctttgactagggcatacatcaataataatgataaatttttctcttctctatggatgcttttcatttctccatcagtgccctcaaaacaaatttcttttagatgtcgtctgtcactgagccgctcaaaaagttgaaaatgtagtcgatctctaagttttcacgttcaacaagcaattccccacccaagatgacaaaagtgattggaaacaacggggcgaccaaatcagcgttttctgttttttaatttatgattttacattttttaatatattttttgtaaaatttacctttattttttaaattatccatcattgaatcgattagcactgccatggaagcaccacttgccgtgccaattgctccagatacaagtgcttttgctgctcgaaaacttttcaatgaatttaaaattcgagcggtagccccaatggcggcgacaggaccagcacttgctcgagcaaattgtgtcgagagcaacaaaaaaaattaaaatacttggcatggtgtttttaaaaagcgacgaaatttctaaaaatatttaccaaattaaaatagttttggttttatttatagtgaacgat

SEQ ID NO: 20567 - DNA, 1629 bp, Heterodera glycines
ctccaccaccgggcaactgatagagaacaaaaaatattagcgctctcaatttgcattcgccaaattaatgggttcattacgttcccgctcaccccccccccccaccgtaaaaattttaatttcttcaaatctagaatttttaaacggggggggggcaaattaatgtcctttttacaaaccaagcttcattgtactataatataaagaaaaatgccaacggtatttaaattgcaaattttatacctttccaacttggtttggttacgaactttgtcaatcaacacacttactaatgctggtgttgttcgcgtgggtccagcggattgtcactggaaaacaccgatgcgcaaagatgtcgtccacagaggggacagtgaaagttcggctgcggtttgttcatctccacgtgatttgtcgcttgtctaaaccccaaaataatcatttcatgtcgttgaattccatttttgggttttgtcaagcagttcaaactctttcaacttactttgatattggaagccatccaaaaatggccaaagccaagaaaaatcggctctgcacgccaaatttgtcggccaacgcttcgtcgagtacattgtccgccaacggaagttcgggctggccactgtccaccagttggtgataacgcgcagtgatgtcataggttgcggaagtgttcagccccgggctaatgcgccatgggcaaatgacggtgtgcgcttcgaccaatttgcgttgaatgtgtctaaatttgtacgacaacagtatgtgtgcgctcctttgatttgttcgtggtttttgatgatgatcccgaattgaattttcatttaaaccaactcccaattctgccgagatttcagtttccataaaattcagtcgccactgaccgaatgcaatggttcagcacgcgattggacacttcgtcgccgggcaatttgatgtataacactttgccacagtcgtcgcattgcaaaaactcctcccccacatttttccatccatgacgtgcgcacacaacaggcgaaatttccttcggcttcgcaattcgactggccaccttttgatttggtcaatgtttacaacattctcaaacagtaattccaaatatttcacatcaaaggttgccaatcttcgtctgtaatttgcccaactcttctcgtcattcaatgccaattcagcagacgagctaaatttttagaaataaataaatcactaaacagggctaattgtaggccaaacatttaaaagtacctgccaacattcacgcctccatcatttccgttgactgcgtcgtttctagccaaaaaatcggaaattgagcgatggagcgtttttaccaaagtgttgcattcaatatcggaatcggcttttcgttttgtcattttttggacaaaatacccaactgaatacgtacaatacataaaaacgttcaagattagaaaaaagcaaagaaaaaaagttaaagatgaaaaaatcccggaaacgacataggtatgtaatttaaattgtgcctttacgaatttaatagtttcaaaaaaattttccagaagcattcaagtttttgtaagaagtacctacctatcttacaattagtatcattcgatagctctctaatctgtaagacctgcaggc

SEQ ID NO: 20568 - DNA, 914 bp, Heterodera glycines
aagtgtgcaaatggcctagtggctagtctccttgactttccttgcttctttcccctggttcaatccctctacagaaattagattattttcaattttttttgtatactcgtgggtttcctataaagaaaatatgattcctcatagttttttttaaattgatacatattttatcatttttaaatgaaaatcctaccaattgagcttaataatcccaaaaaccaaccttttttttgttgaaaatctgttaacaaattacacccaaatttttaaaatttcccccggcggcgcctatcggcaccgccggaccccttctttcccaaaagttttttgaaaaagcgctccgaaaaaaagtgatgtgaaaatcaaatctgaatttctattaatattcgatgatttagtccaaaaaatgatttttgaaataattgaagaaaatttgtttgaaaattttcattaatttaatttgctttattttgggttttattaaataaaaaaccaaataattttgtattattttcacttgaaataaattaaaatttgaatttttttttaaatttttaaaatttttttgaatttttaaaatttcccggttggtcccggttcccggtttttcttgcggtcccggtcccggtcccggcttctcaggtcccggcaagtcccggtcccggttttggcaaaaattcccggtcccgtggcactctactaaaatccattggacgcataaagtgcaccactagagccgagttgggagccctgataatgacattacctttcacttttaagacaacaattctgggctcttgtatgattggtccccataaatttttcgaaaaaattataattaataaagagtcgggtagaacaccttttcttatgttttcggggtcgctgatcacgaatccggcatccatttcgac

SEQ ID NO: 20569 - DNA, 2139 bp, Heterodera glycines
agttacccctactcatggtcaccattggcacattggatgtgcagtggattgacattcacttcaccgaccgcagagcgaccgatgaggacagacagcgggtgatccgagtaccggtacctaaggcatcgcatagcagggttgaacagctcagagactttttggcggtaacattgcgaaaccgtagcggagcaaaactgttgccaacacccagtgaggtggaagctaacaggaaccgaacaaagcttcttgattctccaccaccactgaaaagagagaaaagagatgtgtcatcaacgccaatgtttgacgcgagtggaaaacgcctccaggactctcctcctttgtataatataaatgaagacgaacgacttgaggagtcaccgcctccttttgaagaaacaaaaatttcggcggcaccaccaccgcctgtcacaagccccgttaagccaacaacaacggtcaaaacgcccgctgctccagctgcagcaccttccgcaactgcaaaaccagcaacgcagtctacagtaacaaaacaggcaccccaatcgccaaaaccaacagcaaagcctactaccgccacccctgttaagtcaacaaccgcccctccgccaactgtaaagacaacaacagcccctccgccaactgtaaaggcaacaacagcccctccgccaactgtaaagacaacaactgaggtaaagagcccatctgttaagccgacaatttcggctcctccagctcagctaaagtcgcatgcaaagacaactgcgccagccaaggcgccacctccagcttcggtttccgctgaattggctcctcgcgctcctctggcagactctccaccgcgttttgatgaagaagaaaataaaacagacaaattaaccgccgcaaaaccttcaactaagacgacaattacggcgcctccggcgcaactaaaaagctcggcaacgcctcatcaacaaaaacagcaagtgcccgtaaaaccatcagctcccatttcggttcccgcaaaaccgtcaggctctccaccgcgttttgaagaaacgagacaaaaacagcagcagccaccacccccaccaacatcagctgctttaacactagcagatttgccagaaaacaccctcagcgttcaaatagaccctctctcatatgtgcccaattccgtctcaattcaatatcttgagaacatggaacgattcaagctggtgttcaatgaggcgatcgtcagtcatgtgtccttctcaccgcagttgggctatgtgcttggctttgaaaaccctcaacatgtcgtgtcaaatgaactgtcaaaatatcctgtggatttgcgcggaggcatctcaagctttgctgtctactcgaaagggttgaccgaaaacatgatcattggcaattcactgagttcgctgcttcgtgttgtgtctatcagcggtgccatcccttgggagtacaacgagaagatttacgactcgccaatatttgcccgtgtgttaccacgggagatcaatgagattgagattgaactgcgcacaatggacaaaggccgtctcgtgccgttcgcctatgggacaacgatggtcgtactgatatttaagaaagtgataaacttctgatttcatcattcattttgtttttatttgacactaataaatggttcatattgtgtttgatccaagcattgcgcagtatgacgagtacgtgcagtacggtagcggcttagagaaggaggaattcgactacttccggggcaccagcccttttcagaggggctacggtgttcagcgaggggcaggcgttggagacgtgtttcgggggctttggcgctttttcctgccaattctgcgtcgtgttggaactacggtagggtcggaggcgctgagcactggacaacgcgtgctggagcgagtcgggcatgagggggtgccgctcaaggaggcgttggtcagtgagggaaagcgcggaattgacactgtgctggagaaaggcggcctgcccaaacagtttggaaacggacgaacgggtataaaaagaaagagagcacgtgtgcctggtcatcaaacaataattggacgaccagttgcaaagacagcaagaaaacgagttcgctcagacgcaatttggactttactaaataaatggcatttc

SEQ ID NO: 20570 - DNA, 1528 bp, Heterodera glycines
gaggaaacgtagggctagtgaatgctagcaggctctctttattttgttcgttctaagaatgttttggtcagaatttttgatcatcaaaattattttatgccaaatgaaaagatttacgttataaattgttatgattttttggtttcttgatatcattcgctagccctacgtttcctcgattagcctgcaaaatttcaaaaaatttcgttcaatttcaaaaaagttatgaccaaaaatgtctgaaaaactggttctttgactacttttagccataactttgctcaaacttgaccaaattttttaaaattaaagtgagctaatagagaacccataggctatcgaatgtttccaagaatgtttaatttggttgactttgacaaaagttatgagtagttttttaaaaatttgtactggaattgaaaattaaaattcttttgctgaacgcgcttagtgaatttgcgcgcatttttgttttaaattttaaatttcttttggtatgtagcttcgatttacttttcttacgatgattttgggctcagagctccaatttttcaaattttcatttgaattttaatttttaaaccattctaaaaagtcccatttgtgaggaaaaaatacagtattctaaaaatgtggaattactggaatcaattctaaaatgaaaataaaattgagaattatgaaaataatttatgttatattatcctttttcttcccttttacccgcctcattcacagttaattaagataataattttaattgttaaatttcttctgagtgcaattttttacataaaatgacatcgttggttgaattgtatcttcccagcaaaatgatcactttcgtcactttgtcctgggtttcttttattatgtcctttgaattgtatcttcccagcaaaatgatcactttcgtcactttgtcctgggtttcttttattatgtcctttgaattgtatcttcccagcaaaatgatcactttcgtcactttgtcttggtcttcttttattatgtcctttgaattgtatcttcccagcaaaatgatcaatttcgtcactttatcctgggtttcttttattatgtcctttaaattgtatcttcccagcaaaatgatcacgttcgtcactttgtcctggatttcttttattatatcctttgaattgtatcttcccagcaaaatgatcactttcgtcactttgtcctggtcttcttttattatatcctttgaattgtatcttcccagcaaaatgatcactttcgtcactttgtcctggtcttcttttattatgtcctttgaattgcatcttcccagcaaaatgatcactttcgtcactttgtcctggtcttcttttattatatcctttgaattgtatcttcccagcaaaatgatcactttcgtcactttgtcctggtcttcttttattatatcctttgaattgtatcttcccagcaaaatgatcactttcgtcactttgtcctgagcttcttttattatgtcctttgaattgtatcttcccagcaaaatgat

SEQ ID NO: 20571 - DNA, 1851 bp, Heterodera glycines
ctaccttattttttctgtgggtctttaccgtattttcgattgccattattttacgaattcgattgtttagtaatttaaaattgttttgctgccaaatgcttgacaaaatattgctgcattcacaaatatttttgaataattcttatccaatgcttaaattgaatttgagttaagccaaatgctaccgtaatgcaagaagccgaacagaaagcggacggtccagcgcaatttccggccgctgctccgaagccggtaacatttgacaataatggaatatggtctttacaataaaattcaaaaaaaaaaattttattttaaaaaattattttaattttgacaaatcacattagcatggaggcgtcaccacggaaaaggaagccgcagacttcgacgacacaaagagcgccggacaaatctcagaccggtaattaattaattaggggtcatatccaagggcgtatctagggggggggaaggcggagtttaaacggagatggagcagataagcccattcctggaaggcgttcgcatcattcgattacccgctgtcattcattaatttttttctctctcaattaatgcataatgggattaccaaataattttttttagcaaaataaaacaaaatcttattacgaactgaacgacttcgaatgtcttcatcagggggctcgtcaaatgagttcccctttggtacatcccaagccttcgggcaggaaacaaaaatgtttgagtggaaaggatgatgagtcctcgatttcggctattgataggaaactttggcaaggaaagaccacgataaaaatctctgatttagaaaaagctcaaaatgatatggggaaattagaagatggagtgaacagagcttttcgctacatgaatcgttccttgaaccaaaaagtcaattgggtgaaagatgtcgtgtccaatacaaatgccaattttgagacactgaaagtccaatacgagaccttaaccgaaagagtcgagatgttggaacaagacagtgatgggacgaattcaggtgggactgttagtatttctaatctgaatagagcgtcgcgtgtgccgtttgtgacgccaatgggcaatgcacagcccaaccaagttgtaccgaacccagtgccaattcatcaattatcaagcgaagacgaagatgacgggccgactctttttggcctgaacatgctctcgaacggacccacagtggggtcaggtttggaaatgttttgtgaggagtctgtttttgcatttgacgattgggctgaacgtttcaaggattacctgtccgtgtcaggcaaggcttacacagaacaagaaaaagtcacaagactcaaattagctctgagggacactcctcgggcactgtttaaggagttattgccagcacaaatggacactcttgactcagcattgagtgaacttcgacagaaattggactcccctcagcgtcgggaaattgcgaaacgaactttatcgctgtgcaaacaaagggaggatgagacagtggcgcaatttctcagacgcctgacgcctttggtggatgcgacaaattcgacattgaccggtgaaattcgaaaagagaaaatttgcgaagaatttttggatagattgaagccaaacattagctttcttatccgtctggtgggtctgtcacgagcaaaagacttggacttggtaagagcacaagctgaggagttggaggctttactattgatgaacaagggcgatgaagcatcacgcctttatcaggcagtcaatgcgctgaacaatcagtcatcccagtcccagtggtctacagaagcaaaccagaataatgatcgtgctggacagtggtcgtcaagcaacaat

SEQ ID NO: 20572 - DNA, 976 bp, Heterodera glycines
  misc_feature (492)..(492): n is a, c, g, or t
  misc_feature (497)..(497): n is a, c, g, or t
  misc_feature (523)..(523): n is a, c, g, or t
  misc_feature (525)..(525): n is a, c, g, or t
gaagcggttagctctcgagtcaaagcaccagaattcaaggcaatatgagaaaagtgtcactttagcacacgtgaatgaccaacactgggccacaaccatacaagggaagggcattaaaatggactcggataagcaacatcctgtgatcgagcaacttatcgcatcgaacatcgaatcaaattcataatgttctcggttttatgacataatatagaaaatctatacatacataactcaggatttttcttcagttattccagaagttataagtgcaaaagttgattccaaaattggagaatacgtgaaccaatcaatagaagaattaaagttaccccccccctcttgtcccccgtccccgcccaatctccccgcaattgtccccctccctttgctcccccttttcccctcgcgccaattccgacgcggtccgtgaactccttttcattccattggcggattatctcgcctaatctccacgccgcttaaaaattncttgnctccctcccatgcgtccattcatttncncaaattcctttctcattgcccattatcattcttacattttgttttctctttcattttctgcattgattgctcaatatttataaatgaggtgattaaattcaaatcgacacaaataactgaaatgactgatgagtgatggatgaatcggttgcaatcggagattattggcgagggcggggggggggggggcttgaaattccgattggtcgtcgctctcgggggtttctcttttctcttccgtgtcaattccccgtttcccgttaccatcgattgtctctcgggagtatcggctgtatccccccctctcccctttttgtcttcggctcccctttttgctccattcttcgtcaccactttccgctctcgccctttctgttctctgctcaatcccgagatcagagggtgattatccactccaccgtctctctttgctaacctaaacaattacccc

SEQ ID NO: 20573 - DNA, 429 bp, Heterodera glycines
atttaaatcgttcgccgattgtcaacggttggccggaatgcagggcggaacacaaacattggcagagtattggcaggagacgcaggggtccgttggggaggagggcattttggcattcgttggactaattaacagaaggacggtgccaaagcaggacaattgggaacacttctacgcccaaatcggtaggtgcgatttgtacaagagcacgaacggaaatgggaaaggagagagggggagggggaaaagcagaaaagacaatgggaaaggagagagggggagggggaaaagcagaaaagagaatgggaaaggagagagggggagggggaaaagcagaaaagacaatgggaaaggagagagggagcgggggaacagcagaaaagacaatgggaaaggagagagggggagggggaaaagcagaaaagagaa

SEQ ID NO: 20574 - DNA, 2754 bp, Heterodera glycines
  misc_feature (2724)..(2724): n is a, c, g, or t
  misc_feature (2733)..(2733): n is a, c, g, or t
agtggtcaaacaccgatcggattttatgtaccaccaaaacaggaaaaggagaagaaacaatctttttcctcttcggtaagctgttaccgtatattctctaattatggccctgtctccattaatcccgctgtctccaattatcctccctttctgaggaggttgaaaaataatccgccctatttatcccccggaggataaatggaatttttattttcaaaaatttttttttttatttttcgcgttttttactgaaaattccattaaaaatgcaataaaatcgggagaatacacccctaagaaatgacccgaaaaattttagaaatacacccttaagaattgagaaattttctcaaaaattggtcgccaaaatctaatttttttttcttgataaaattttccttattccaaaaaattataaaatgtttatttaataatcatttaaatgaccaaaactaaatttcttttggttaagtttttctccctaaaaatccttaataaaaaaaaattataaatgtatatttcatgcacctttttgtgatttttgtgccttttaatgctattttttcaattttttctgcctattatagtgcctttttcccgatttttgctgacttttttccgttctctagtcataagtgaaacttgattgcatattcgggatctacgacctaaaataaccctaaaacatatttttggatgattttggtgaaataaatttccactcgaaaaatattgcccccccccccttggtcccgaatcgtaaaatgagttttatttttaaaactttcttcaaaaagagataaaaatataaaataaatcttataatgcaaaaaattgtggattttttaaatattttatgaaaatttcctttcagaacggagttctgaattttttctgaaaaagctaaatccagaatttttggttttcatctacaagttagaaaaaccaaataattatataaaattctcccgatttttcaaatttttaagctttattccactaaattgttcaacactgaagtgagttgtgaatttcgcctaaatttccctggctaaaaattttcaaaattaaaaaaaaaattccaaattttctgaaacgtaaaataaagttcattttcgtatttcaatatttcggggtttagtcaatgttttataaatattttggcatttttcgaatttttcatataatatgcagaaattcttcaataaaaaacaattttatttggagtgatgacattttttgtttcaaaaaattttccattaaataattctatcgaagaataatctccccgtctccatttatgttcccgtatctaattatcccccccccccccccccctttctgaagaggttgaaaaaaaattcccccgggccataattagagaatatacggtaagtaggaaaaagcaaaatttgggatttctatttttacttatttcgtttgtcgcattttccgtccactttttgcaattttgaggatttttaaggaatttttcataaatgcccgaaataaaatgcaaaatatcgtaattttcatacatattttcattttttacaacttttgagattttgaaaatttagaaaaatatcatataaaactcatttttttgaaaatttacccttcccccaaaaaatcaagacttttttcttaaaagaaatatcaataaatcaatttcaaaatacctataaaacaaacttcatcgtatgttaccgtaactagtactagttttcaagaaattgtgactcacggatgcattttccacttacgcatttcttccctcgtggtttatttaattaattatattaattaatgtatttgtttatcagcaatcggaatttgagcatcagccaacaatgtcaagacgaaatcggaccaaatctaaacacatggaggaacaacctcaaccaacggccgataaatatgatttttcgctgtacaacaatccgtcatcctccagtgttcgttttaggcactgaataatggctttactcagaaattggggctgttacgaaagctttttgagtcatattttataatattaaaggaaattaatagaccagtagaggtgtcgaagaggaaatattttgcaaaatttgttcagaaatttgcttaatcaatctaaaactttttaaaacgtagcggaaatctcgggattggggggtaattactcaaaaatcatcaaatggaaaattttggtaaaaaatgatgcattactttgcccaagtgtaacaaaatttaaaaaatgatatctatcatacaatagccacaatggttcactattcctgatcaaaatttcaaaaatttttggtcactttctcaaaactttccagaaaaacgaaattttttgaaattttacaaggtgattgagaatatttagggctatagagtgatgtcaagaataaaactttggttcttgagcaaagttataagcaaaaattcttattttgattggttttttttttgaattacgcccattttgatgggtttgagtaacgtcataactccgaaatctcccttctccaatttttcgtggcttaaaccacttaaaaagtattttcagcacctcgggactattttttgtaatgattagaggtcattagggtttggttggaactcgttttgggcggttttttaacgggcccaattctaaagtttttccaattttgttaagaaagaaatccacttttggacctgaattttaaaccgtagggattctcttatttngttgcgttngtgcctcctattattttagga

SEQ ID NO: 20575 - DNA, 2350 bp, Heterodera glycines
ggtgcttgtattactcggttcccgtttgccctaccgggactgataaatcgaatttccaaatccgggaccgggacctcggaggaccgggaattcccgcttcgggtcccggttcccggttcccaacccctctttctttggaaaacaaacaaaaataacatttaaattacaaattcttttgtgaaataattattttagttttttgaaaaattatgaaaatgtattttcggtttgcagtgatacccgggcccagtttaaaaacttggaccccaagccaagcccgacttttcttggcccggcaatatacggaatttattcaatgcctattggaattttagaaaaaaataaaataaagttattaataaaaatggaaaaaaattttctataaatatgtttaatctgtgaatgcgaaatttattggtcggcttaattaccagcagcagatggagtcggattaaaatgaatacacaatgcaataatttaatcactttttcgctggagtgatcagcaacagcagttgatcattgagcaaaaatggggaggattaattgtccatcggcggagtgtacaaatatgaaaacggcaacggataaaattatacatgaattattgtacactaatgagatggtaaatgccatttttacattgtggcattccctcccaaaatgccatttgtcatttgtatgcaaatcgatggctgctcatttttcctctgctgctgctggttactcacttttatgaactccttgtaaatgaggagaccctaattgccttaaattacccaataaaattttctagtttgagaagcattcccaaattaattttaggaaaagctaaactataaaaatacataaaaaacaaaagttggattcatttctctgtcctattcaaaacgaagaagtgaaagagagcgagagagatagagaacgcagagacaggcaacgcaaggaaaggcgagagaacgcagagagtgttgccacaggagagaaaaagcgagaacagagaagcaaagacaaaagtgtgcacgttagaagtggaagcagaaaagcgagacagttctacgcaaaacccctcgggcgaggacgaaaagcggccgaatcattgtgaaaggacgaacgcaacgcaaggcatagagaaaataaaaaggagagagagagagagagaaggtgagagatagagatagagagtgaagaggaaaaggcagacaacgcagaagagataaagcaaacggaaaggagagaagaaacggccattccttctgctgctgctactgttactggcgagacgaaacgggccaaaccaagttcaaagtgccaatgtgacgacggcggtttttgttcaatgctaatcagctattgctcactaattaccccaaataacaaaactatgcttctcccaacaatggcccccaaatgccttccgctcgaacttttgttcgaaatcgtgccttttatccctgccgaaaaagccgtcccgaatgcgctctcttcctgttggctgctgcacaaacttttgctgccacgtgtcatcaaatggcaagaggtatgccgtgccatttttgggccaaggaattgggcttgaaatgcacttttgtaacgtcggccacccaatttactcattctctgggccttttatgttttttaagaccccatcccggaaaaaacaccgaaaaaatttcaaaaaatcacgaagtctacgaatatattaatatcaaattaaactattcaagtatctggggtcaaaaacgattataaaataagatttaggcaaaaaataataataatacagtttttaggtatttattttttaatttttgacacaatacagtcaggtgcataagtttaacaccactagccttttcgagaaatttggctttataaaaagttaaatggttggtgatgaccaaaatgttttgacattttttgtagcatttttaatgggctttcgaataataccaatcattaagcaaatatcggttcaaacccgaattacagttgactttgtgtaccataccccattttcagtggtacatatgtttaacaccactttttgaatctcaaatttgagagcacagaaaaatctgaaataattcatgcaaacataactttttatgctgatcaaaatcaatttcggagtctacaaaaagtactgtatttcttaagaaaacagtgtttacagtagaaatgaccatcatcaaaaataaagtggccatacctaagtgggtataagacgtagactaaacattaaaaagcaaagcggtagtaaattttgggctctttccaataggcctaatcaaaattttcaaaaaaaatttcccaaccccctaggaaagtttcgaaagttttcccgattt

SEQ ID NO: 20576 - DNA, 1713 bp, Heterodera glycines
  misc_feature (71)..(71): n is a, c, g, or t
atgtgtgtgtttatttgtgtgtgtgtatgtgtgcgtataatgatggtatgcgagcgcgttttttctttctntactttttctttttgtttttgtctttcttttctttctttttcttcacttccggctcaccgttgacgaagcgccggtctcggttcgcggcgcatcagtgcccgcagagggcaatgcaaaattcgctgcccgtccgtcgccgccactcccgcggctttgttcatcctgctgctcctcgccgtcatcatcgtcgtcgctttgcatgaccaggcgatgctgttcgcttcctgctaaaagcggggggtggggagtgatcatatgatctttttttttgcggggtggggaccgctttccacgtaccatttgcacgcacgccggctcgttgctgctgatcactttgacgaggtgccgccatcacactgctgccgccaccgccaaacacgccgtttccgccctgctgacttatcggcccgctgcctccgcttggaatggaaatggcattgttgctgtcatttgcttcaacaattattggcgtgtttgttgacggcggattgaacacttaaaaatggggaaaaattaatattttttaaaatcaaaaatgtttttttcaaaaaaaaatggggagaaattattatttttaaaattaaaatgctttttccacctgaagtggccaccgccgaagagctctgtccaacaatgcggtgccgcgactccgcattgtagagcagggtgaagggaaagctgcccttcgcattgtgaccttgggcgcgcactttgagccgtgtgaattccactatttgtccggcacaaatgttgctcatgcgcggcacacactcctgccagccgtgcatcgccatttcgtgctccaaatcgttgtggtcgaagatgatgcgcacgtcgtagccgctgatgtcggtttgggttgtgaacgggccggccaagacgacaaggcccacgacgcggctgaaaagcgggaaaatggaatgctgaaaaatgaaattaaaaaaacacttacttcatcaccatatctggttgccactccaagtaaatccaccacaggtttgagaaaccattctcaccaattgccggcacaacagacgcaaattcgggctgaatgtgtttgttgaccatcttctgcagctgccgggcatgcacaagtgcaaccgcttcacgcacactgggcggaagcgcctttaaaagaaaaatttttaatttcaaaaatttttttttgcccctccccctccacattgacacaaaagtgtaaaaaaaatgccacctcaaccacccgaatttgattagacgctctaccccctgggtcactccacgaaaaacttacactattcaaactccacattggcacacttgcgccagaaacagcaccattcggatgctgcacaatgccgacggcaccattcggatgctgcacaatgccgccaccaccattcgggtgctgtccaatgccgccgttgtccactgaattcgagacctgtgttttaaaaaaacatgaaaaagcataaaattaaaaattccccctaaccccagcacacttacagtcaatgtcaatggctgttgggtgggtagagcaacggcaccgcgcatgtgttccaactgcaaagcaccggaaggatcggcaccagtgctgccgccatgattgttcacattagaaggccttaaattgatttaaagtttaaacccccatcatta

SEQ ID NO: 20577 - DNA, 1882 bp, Heterodera glycines
gcaatggctggcaaactccactatgaagaacaacgtacctgcctgtcagagcatcataaaaagcagtgaatgtcggacagagttaagcagcgtgaccgaagaaaactgcatttttattcctattcatctgaaaccaaatatgatggagccaagaaaaataaccatctttttggggcataaatcaattcatttattgaaaacaatggcataaaagttataaaagccaattgaagagcaaaatttttatcggttcatgtaaaatagcacaaatcgtcaaaatattttttttaattgaaagaacgacattatacaatgagagccctgcacacaacacaaccatgattacctccctctagccattcttcaatacatgcattgtgaaatgcatggccgcatcctagcacacgcacatcgccaaacataggttgcagacagattaggcatctttgaccgaaccagtcgtttcggtaacgccgctgaagattggaggggcatggggtgtaaaatgatctaatttttagctctccgtttaacgaaccaaatcgcgcccgctctgccgtctcgcagatgcaccgaacaaacgtcccacgttgtgcgcattctgacggatgagcaaatggagagccttcgtgtccatcactttgtccccaaaaagtgccggtagcatggcactcagccattgcgcagtgactttggccagtgactcggacaaccatttgcatttttccccctctctgtcctcagaatcggtaatccgtcggagcttccccttctggaagttacacattatgtatcgagagtatccaaaataatttctgcaacaaatgcggacccaagcagaaaagaagcaatgtgaaaaaattgtcctatgaataatagcgtaccgattgtcgagcacaaaaagcagtgtatgtcggacagcattgagaagcgtgaccgaagaaaactatgcatttttattcctattcatctgaaactaaatatgttgagaaaccatcttatgggggataatatgaaagatacatttaattcgttgaaaacaatggaataaaagttggtactctttcggtttgtatcagggttgttccgggtcgagaaaaaggccgggtatcgggtttcgggtcaattgacaaatttttaatttgtttaaaaatcaaatggcactgcaatatttgcagcgaattgcgccatttataggacgatggaaataaaaccaaatggaatcaggcttttcagccatctgctttgcttaaattcaagaaattcatacaaaatatctttagaaaaaggataataatgaacaaatacaaatacaaaattttcgattccattgaacacaatcgtttcaaaaaaaattctcaatttccttatccacctaattttcacccagacccctttcttaccagtgcttatttcgacccgaaacccgacccaaaatcatcgggtcgggtttcgggtcgagaaaaaggccgggtttcgggtatcgggtttcgggtaacccggaacaaccctggttggcgttttgttttttacgccaattattttttggcaatttttttcgttttttaccgtccatgcgtgccttaagagtgtttgacgttctttaacaacccacaaaacatcatccttctctgtttgatatgtacacagacattttacgaaatccaacgaacattctttccttacgtcaattctgcacaaagacatgaaatattattaagaaagagcgatgatgaaagtggaaaagagggaattgagaataaaatatgtagaacgaagggagagagaagagagaaggcgaacgatgggggagagacacgaaagggagggaagcgtacggaagggggagggacatagaaagagggacgggaagggtgaaaga

SEQ ID NO: 20578 - DNA, 3067 bp, Heterodera glycines
  misc_feature (3057)..(3057): n is a, c, g, or t
tttcatttcataataatcattcattttgctcattttttgttcttcggtgaatcgaattggacctaagaatataataaaatttaatattaataattaaattgaaaattaatttaaaatttacttttgctcatttcaatgccaaattcctttttccattttcttaatgtttctttgctaatgcccaactctttcgcaaattgcttctgtcttccattttttggcattcttttaatttcatcaatttggtcaataaattccctctttttctttttataataataaattccaaattcttttttccattcgtaaatttttggtcgattaattcccaattttttcgcaattttttgctcaattttattccaaatttttgccgaatattttccctttttcttaattccttctctaattgcgtgaaatttgtgaataatttcgattttttgttgaacatccaattgatctgtctgatcagttaattcattttgatcattttgatgaaaatttgtattttgatcagtctcattttcattttcatctcctccaattattatttcattttgccattcttcgccaaatatttcagcaaaagttggtcgacattttttacacagattaactgacaatgttttgtcagttgaattgtttatgattaagaacacaaatataaaaaggagaaaaagcatcactaaaaaaatataataaataattaattaataatttttgaatattttttattaaatatatttgtattaaaataaatttaattacatcagaaaaaatttttttgtggagaagcattgacaaaaaatgcgatcaatagtaaataagattaaataactgaaagttatgaatttcatcataatttcacatgaaacaaataaaatagcgaataaaattaaattatactaaaaaatttagaaaaaagtcagcagttgaacagcaatacacaaataagaaaaacgaaaaatttaagaattattttctttttcccatatttttaaagtggtaattccaattttcaataatccggcaatttttttgtcatttaaagaaggatttacttattcatttcataataatcattcattttgctccttttttcatcatgataaatcgaattggacctatgaataataaaatttgaaataaaaaaggtacttttcgagttatcagggcctattttctatttaggtttttattaagagctaaaaaagtaaaaaattttgaaaaatcatatttctgcctattttggcgttttgaccaaaattattaagaaaaatgcaataaaaaagaaaaatacaccactaagaagctcaaaaatttctgaaaattcttaaaaattcgtttccaaagttttttattttattttttgacaggaatttttgattttaaaaattatttttctaaatatttattaggcctaatttttttttagcttatttgatagatttgccattttacacccccctaaatttggggtttttagtgcctattttggcggtttttaaagccaaaaaatttaagcactattcataacaatgtcacggtttgcataatgaaaaatttacgattttttttcttttttccaaattttaaaagcagtggttccaatttgagaagaattgccaaaaatgcgatcaattagtgaaattgatcttcattagatctttcaaaaaaaaataaaatactaaataagattaaatattgaaagccatatatttcattcaaaaaaattataatttaataattgaatttatgcgaaattagaaaatttattgaataaaaaatctctcttcagatttagttatatcattcaagatatatcgcaattttcatgaattttttacgcagttatgattagagttgtacgggaccgggaaattttgccaaaaccgggaccgggacctgccgggaccgggacctcggtttttgttcgggaccgggaccgggaccaaccgggaaattttaaaaattcaaaaaatttaaaaaaattaaaatttttagtttatttcaagtgaaaatattaaataattaattttttgtttggttttttattttataaaacccaaaagttaaagcaaaattaatatattaaatatatttaataaatattttaaaccaaaattttcaattatttcaaacaataattattttttgactcaaatgatcgaatattattagaaattcagatttgcttttcacatcacttttttcggcgcgctttttcaaaaaaatttttggagaccaggaggtccggcggtgccgataggcgccgccgggggaaattttgaaaatttgagtgtaatttgttaacagattttcaacaaaaaaggcaggtttttgggattagtagactcaatttggaaacggattttctttaaaaaaatgataaaatgtgtgtcgattaaaaaaaaactatgagaaatcataaattgtcgatagaaacccatgagtatacaaaaagaaaatccaaaatattttaatttctgtaaagagattgaaccatggaaagaaagtagaaactcaaggagactagccactaggccatttgcacaatcattgttacttttaaagaatatattaattaatttttaaatttttttcctttctaattttcatcagtaatatttcacttagacccccattcttaccagtgcttgtttttcccgattcctggttgccctaccggaaccgggaccgggaaatagatttttaaaatccaggaccgggaccaggacctcgtaggaccgggaattcccgccccggtcccggtcccgtacatctctggttatgatccaattaaatctgacagtaaacagagaattgttaaaatcttggcgtaaaatgcttactccaataaatttgtttaaaaattatacattacattaatcttgagaattttgttcaattttatattccccgcatttttcaaaaatttcctctttaagtgttcccattcaaaaaggatccctcaaaatttaatggaaaaaagttattattataataacataattcaaataaaaattgaataaacattagtaaaagcaaatgaaatgnaaagtataat

SEQ ID NO: 20579 - DNA, 1644 bp, Heterodera glycines
  misc_feature (368)..(368): n is a, c, g, or t
  misc_feature (486)..(486): n is a, c, g, or t
tctagagtcccataggaattcttgcgtcattggccgactgaatgccttttgcattgccaatgggaattcttgcgtcattggccaagggagtgtttggtgggtgattattgtccatgcgcttttgccttctgtttttgatggtctttgtatgttgtaagaatagaacaattgttgcttaaattattaaacaattttcaatacccatattcatagccctaataattaattaattaatgacctttgattgattgctcaaattccatcaattccttgcttgagagtttcacaaactttttccaagtttctttattttcttcattaagaaatgaaagttcccccatttttccgtcaactagcttattgtcgancatttagttttgtattttcattgttgagaccatttccttaacattttcactacttctccatgctttctccattttttcattgtcacagattttttctgcatttttgatgattttttgnggtttgctttcaaattcccttaaaacaaatggaaataaaaattttgaagctttaatttgaaaattttaacaattttccccgtttccctggccaaaaaccccctttccaaagcccttacttcttgaaccattttgggggatttaaaaaaaaaattttgtaaaaaaaaaaaaaaaaaaaaaaatttcaaatttagggcttattttgggggtaaaaaaatttcaaaaaaaaccggggggggaaaaaaccccccccgcctttccccctttttttttttatattttttttttttttaaaaaccccctcttttctcccacaaaaaaaaaaagaaatttttttttttttattttttttaaaccccccaaaaaatttttttttctcttttttttttttgggggtccccccccccctcgtggggggggggggttttttttttttattaaaccaaacaaacaaaaaaaaaaataaatatatttttgtttttttttttttttgttgtgggggggggaaaacaaaaaacaaccctctcttcctaaaaaaaatatagttgggtttttgtttttttattttttttatttttttttttttatttataaagaaaaaagaggggggggtggggggaaaaaagaaaaaagaaaaaaaaaaaaaaaaataattttttttttttttttttttttttttctttttttttttttttttttttttttttttttttttttttttttttttttttaaaagcgggttctttttctcctcgtcttctactccttttttctttctttttttttcttttttttttttttttttctttttttttctctcccccccccccccccccccccccccccccccccccccccccccccccccccacaaaaaaaaaaaaaaaaaaaaaaaaaaaaaaaaaaaaaaaaaaaaaatttttttttttttttttttttttttttttttttgtgttggggggggggtggggggaagaaaagaaaaaaaaaaaaaaaaaaaaaaaaaaaaaaaaaaaattttttttttttttttttttttttttttttttttttttttttttttaaaaaacaaaaaaaagggagagagggggggggggggggaagggggggggggggggggggcgccggtttttttttatttttttttttgttttttttt

SEQ ID NO: 20580 - DNA, 1013 bp, Heterodera glycines
tttttaatcacctggtggaaaatgcaaatttaatgcgctccctgccgccccaagcgaaggataaaaacaatggctttattattatccgatcaaagggagcagtacagttttgtacagaaaatcagccgacttttttgaaaatattttttatttatttattattttaatcgatggccaaccaaaatgaatgagcggaatttcttttttttggggggggggcgggatacacgggccataaaacggtgatggacgggggcagtcttcgcgtaaatgctttattaatgcaattacaacatgtcataccaactgatcgctcttcaaccaattttcaaatggtttaatcggagacggaagtcattcattcattcattagttaattaggtattaattatgcccactaattaattggctcgtccattcattaattcatcttctttatgtcaccagtttttcgtttgtttgttcgcctgcattttgtcaattatcaccaaattattttgtggggtgaggggaaaatgcagggcaaaggcacgctgtcgatcattgcttttaatagcaggtggggaaaagcccatcgaaaaagggatgggaaatgccggtggaagttggcaaaaaatcaaaagattggcataaaaaataatgaaacgcgtgccaatccccaaaacttcaacaaattcgccccgctttgcgggtcttcgaagatttgtcgaatttataccatttcggcgcaatttggtagccaaatgaatgatgtcacggcaactgatgtctgtccaacatcagcagacagttcgtccatcatctgccagtgttttgctgcttccgctcacaccgattggccttccttcgcttcttcctaatgttgtgccctcccctctcatcccctctcttccctccttctctctctccctccctcttcctccctctccctccctcttcttctctcccctctcatcccctccttctctctctccctccctcttcctccctctccctccctcttcttctctccc

SEQ ID NO: 20581 - DNA, 995 bp, Heterodera glycines
ttcatgtccaatttgcgcttttcgttcggcttcgtgcacgagaacggcacgcgaccaaagcagcttagctcaggattggattagattacacgacgcggctattaacactcattcactcagggggtgggggtgttagccgcttaatggcccgttttatgccaattaacattgtcctcatataaaacaacaaacgcagacagatggccaaaggatgattgcaatgagcacacgaacgaaaggacaaaaacatattgcacacgttaaaaaggcagaattttggccaaccctgagggtgggcacataaaatggcatttctttgtcggcattattttattatatccccttttaaattcttttgtttttgaatttgaaaatgcccttccaatcggtgtccaatttctcgattgaccttcttctgtcagcccattcggcaactttacccaccacaactatcagcagcatttctccgtctctcccctttgatttcgttgccgtccatccgccgtcggctttttctccgctaaatttggcaaaaaatggcaattttttgttctctatggcatttgctccgtttcaattttggtggcgtccctccatttccgcgtccgaccttccctcaacaccatcatcaagttcaagcagcacagcaagcatcgtcagaagaagaaagtcagcggcaactgttcctcctcctccaccttctcctcttccttcgttttcgtcagttgtcgcgccgtcgtccgcccattcgtcggccgtgcttaaatttggtcatgaaaaacttttgccgaaacatcaggataaggtacaactttgccagcattggcatgccgcaagcaaattgccgaactttatttgaaatttcatcccaattggcattttccctctccgccaagggactgggtcgttcggcgccgtcgttttggcgtcagcccaagtttttggactataacttttttcgttgtcaaccaaatctaacaatcttgatatcattc

SEQ ID NO: 20582 - DNA, 1890 bp, Heterodera glycines
ccattacggtggagagggtgaagattatggcaatgatttcacaagcttccgccgcctgtcgactcgaacgaaaaaggtgatcactgatcatgatcagggaagaagagatttgagaccgttggcaaaaacgatcaaaatgggcgttagtcaacaaactattaaatggaataggtattttgacaaaaaattattcataacttttgccaaaatgaaccaaattttaaaagtttggtactttcgatagccctaagggttttctactacacaatttcaagcaaaaaaaaaattgttaaaatttcaaaaaagtcatgacctgagaaattcaaaaaaaatcaggtttttctaaatatttttgatcatagcttcattgaaacttaacgaaactttttaaattttgcaggataatagaaaagatttagatctatcgaatgatagcagtaaaatttggttgtttttgagtaaaattatagcaaaacgaaatttccatatgagatttcgtaccaatttccgtgctgacaatgagtcgaaccaaaaaaatatcaatgcgactaacctaaaagaagtatcaatgatagtaatatgtatttaaatttaattattatcgtaaaatttaaactcaataattttttcccaaacttttttgaaacttaattaaatttttgatatttaacagaataattgagaaatttttgttctatttaatcacataaagggggaggtatggatggcttaattgaagtttgatcaatttttatgcatttaaacgacaaatttgcctttttggatgtccataaaaatatgacacatttaatagggtctaaattttattagaaaaattaaatttaaatattattttatcgatgataattttggcgctatatggaaagtgaccagttttgaaaattttttcaaaaggggggacccttttgttttgcaaaatttttttgtgatagtcataaaaatttattcatcttaggtttttggggtccccgatcacgaatctttcaattattttgatcaattccgatttcctaatctaaatttgaacaaaaaatcataatttgaaaaattcaaaatttcgatttttattcgagttcggcttagggattagaaattagtcaaaatacatgccagattcgtgattagcgacctttaaaaacccggataacaaattatcatggttttttatcttaaaaaaattttgcaaaacaaaagggtccccccttttgaaaaaattttcaaaatatgtcacttttcatatagcgccgaaatttttagctaaaatatatttaacttcattaaggccaatatttttccactcgtaaagtgagcattatacataatgaagataattaaactctaattaagtattcaatcaatttttagtcggtaattaaaattttttattttatttttttaattatcaattcagcgattaatggtcgaatggatttacaaattttagtagaaagaggggaaatcaagtacttgatgaacaatcgtagacaaaacttatgattaatccgaattcaaatgtgatcgctgcatttctaacttgaatgaatgcaaagaaaattttttaatttccatcgggaccaaaattctccagcattaccccactttcaatatgtttccatgtatttaagctggaaatgctaattaaaaaattttgagtttttgttcaaattcgcgtcttggattcggaattagtagatgccggattcgtgatcagcagatcacctaaatcctcggaaacatttttcaagaaaaaaaaaacttaaaattggcactagtaattgaagaatctatacgaaagtaattttatgttattttgtacactcacaattcggcatgttcccttgatagccttaagcaatatcgaaatttgac

SEQ ID NO: 20583 - DNA, 1017 bp, Heterodera glycines
  misc_feature (12)..(12): n is a, c, g, or t
aatgcacacccntttgacacgtaaaatattccaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaattaccagctatttgaaatgcagtgggcaagcacagcgagtcgcttaatgcacacctttgacacg

SEQ ID NO: 20584 - DNA, 1811 bp, Heterodera glycines
catcctgtagtggtaaaaaattttcagtaaaaaaaactgttatctgaatattacaagcaaaattaagaccattccaaagaggaaggaacaaaaatttttgcctaaattttatattatattgttgaattgtttgaaatgcatctgttgtctgccgttttgaaatttttcaacttttcgcgaaaagatttcccagaaaatgcatgggacaaataaaaattaaacttctattatgatcaatttaaatttcctatcagtttcgggtttgctttaaacacgctggccgatgaaaaaatggagttttatggatgtcaaattttgggacttttcttcgacgtggccatcagcgggttgtttcgtgacaaaaacaaaccagtttgatgttattcgaatgagctagacgcgctctacattttcaaatgtatcaacaaagggtctaccgccactccctggcgagatatggcctgtcaaagcagaacggggccaataaatttgaatttttgttaatcttcggcagttgcctttatttcgagcctactctacttgtgcatcttttcccaatatggcactgcttccgaattattgaactgtttcacgactgattgttgagataatttttttttccgattcctttatctccaagcatgagccttataagtgattgttcatatccttctcttgaaaaaaattgtcagtaaaaaaaacacgttttctgaatattaacaacaaaaatttttagacactttctaaagaggaaggaaaaaaatttttcatttgcctaatatttatttatactgttgaactgttggaaatgcagctgatgccgtcggaaaagctccgattttttggggaagtttttttctttcagtttcaccactgattgttgaggcaatttttttcgccaatttcttttgtctacaaacattatttattgcgtttcatcctgtagtgtgtaaaaaattttcagtaaaaaaaacttgttatctgaatatttacaagcaaaatttaagaccatttccaaagaggaaggaacaaaaatttttgcctaaatttatattatattgttgaattgtttgaaatgcatctgttgtctgccgttttgaaatttttcacttttcgcgaaagatttcccaaaaatgcatgggacaaataaaaaatttttctttagactacaatttttttatcctgtagaactgtaggaaaggcaggtgatgccgtcggaaaagctccgagttcttggggaagtttttatttatcagtttcaccctttcgtttgtggaggcaatttttttcgtcattctctcttgtagtacaaacactatctattatgtttcatcctgtagtgtgtaaaaaattttcagtaaaggcaacttctaatcggaatatatgcaatcaaactcaaaagtcatgtaaaaagtggaaagaaggcatgaaaaggcacgaaaatcccgaaaaaggcatgaaaaaaggcattttaaattttttattaaggcttttaagggagcaaaacgcgtaaatagtgcgcagaaaaaaaggcatatgcctcaaaagacggtctctatttataagtaataaaacaaataatatgccaaacaaattgtaaattgtgccgctttgagtgaatgttaaaacaaagtgttaattaaatataatttgactgatgaatcattcgctgattgtcccttccgtcggttggtcaactgtttaggtttatgtctttgtatgggctgggctcggcggagaagggcaaacgatggttgggctctctaggggggctttgctgcttctgccccaattgactccggccattttct

SEQ ID NO: 20585 - DNA, 2005 bp, Heterodera glycines
gtcttcatagagtaaaaattcaaagaaaatttaaaatgatcggactaatgctcttgaattcctcataaaagagcttttttaaaaattgcgaatcgtataaaaatgcgacaaaatcacaaaatcgtagaaaattcaaatatgcgaattaatcgctgatcagcagcactcatatacaatataatacaaattcgatgaattgttgatcagcactctagttcaatagaatacaatacacactctgctgatcattggcacactttctgctgattgtcgctgaataaaaacagtttctctccgtctcgtgtgatcaaatgcatataatttgatcagactgttggagcagaatcactatgggatggattacaaaaacgtcgattgattgttggggcgggcgggtcagggaaagtccgtttcccccgcggggtgtggtcggcgatggatgggaatgggacgacgatttgtgtgtgtgcgtgtcgttgcactacaaaacgccaattgacggatggggggaaatcaattgctctaattgtgcgattgtttataggggggggggggcacccgcacagcccaaggccgacggtcgagatcagataagatcgagattggagttggagattcgagatttgctcgctgagaccttgggatatgaggtgggggcgggaaaggaatgtttgacagactaacggcggaaggaggcaattggattggataaagcgcgggagagggagggggggggggaggcaacagaagggagatgacccttccgatcaaatttttcaacaaaatttgatcggaaagtgtataaaaaaaaaaatgctacgaattctatgctcattcatatttggggggacaagtacttacattcttacaaaagaaggttaaaattccgcacaaatatcattagaacaatggacgaacgcaattgaaaatatccttgaattttgaaaaaccatggagctccccctagggtaagataaaaaaaaaaaaattctgaaatttaaaaattactaaaaaatcaatatttaattaaaaaaataaatagtaattattataaagcattaaccattttcacccatataaatccattgactcttttccaatcttttccccttttttatccgcgccactcaataaaaaagccccgagggtatccacctgctttgcttctcccccaattatttaatgatttttgtctgtctgacggcgatttgattttgctgttgtttgttgttgttttggcgttgtgtttgttgttgctgttttgcaaaatctgatcgggcggaagaggaagcacacaaattggtggttgtcaatcatccgcggcgattggtggcgatttgtggggcgttttgcccctatcgccgcccccgcccacggcgatcggtcgtcgctgacggcggcgtcggtggtcacgcgggcggggggcatttgtcggattttgccccagcggaaatagcctatgtttggcgaggattatccctcccccggccgcgccggagggagcaccaccgctgactaactgacaacgtgaatgtgcgcagcgggcgcgcacggcctgcgcccgcccgtaatcaatcaaaaccgccgccaaccaaaccaaacgctgcagcacagtggcagcggcggcgggtgatgtccgctctgccgccctttgtgaggcacgcagcgcggtgcatgcacacaaatgatgtgtgtttgtgtgtgtatgtgtttcagtacggcgcatgcatccggcgtgcatgtacatgtgaaaccggaagcgcacactgagaaaggagggcagtgcacgcaagttgattatatttagagaaaaagagaagtaacggaaagtgtagaaaaaactaattggggttattaattgttggtccggaaagggacacgccataaatgcatccggaaaagggagcaagtgtttatagagtgcatgcccggaaagaaaaacggaacggacatgggacacacggatttgttgaagtgagtaatttaaaaatgaaaaaagaaaaaa

SEQ ID NO: 20586 - DNA, 943 bp, Heterodera glycines
  misc_feature (934)..(934): n is a, c, g, or t
taaaatgaagaaaaagaaaatttacgatttttaaaagaagatttactggttttttcgttatttaaaattttcaaaatttttacaaaaatattactatttttttttataattttacttttcataaaaagattattgactttctttttgggtttctcttagtgcagagaggggccattttagtgacgagcttttacgagctttttcataaatgtggacatatcacatgaaaaagcgcgaggcaaagagaataatcatcattgtgaattaaacataggaaataatttcatttgtaaaaaaagaaaaaaccatttgctatgctttaataaaataaataatttttattttatgtaaaatatttttaaatacataaaaattattacttatgcggtaatatttttaattaaattatttgtttttttaaaatgaacagggcccggttaaagaaaataattagctctgttattttttttttataaattctgatgtttttttaatttatgtcatggcatattttagcttttcaaatttagaaaaatcagtcaaaaattttgacaaaatctggcatccagaaaaatgtccaacaaattgaatctgccgttagcattttgcacattatttgtccatattttgctggatgtgccgtcgtcaagcgatgggatgattgccaacaccgttagaaaccctgcgtttagcaaattcgtcactcagataacccataaatcgactcaaacggctcaactggcacaaagagtggtagcccagaaagcaaccggcggaacaatccgaagaaacgtagccaatacccaaacgaaaaatgttggcaaaatgccaaaaacggcgacgcaagaaacgacaaacggtaaagaaaaaaatataatacaaaactttgtgtatgaggaacaattaattttaagaaaaaatctttataaattanatagttctt

SEQ ID NO: 20587 - DNA, 985 bp, Heterodera glycines
caaaacaatcataaaaatatttttttaaatattaataaataatctgttaaaaaaggcttttctggatggataaagattccatccatctgggaatacaggtcgggtgggaaaatgagaaatattttttattctgtccattaatattgccaggaaaaatgttatcaatttttccctacagtatgccgaaattgcgcacacacgcgacgagtggtcacaggcgacgctgaatcccattgattaccccggaaaatgtagggttcagtttgccccggacaatggaggagttcaaggaaggactgatcaacgccgcactggacattctgccggattttgcgtttgccgtgcccgtttctctgttcgttgccaatccgccggctgcaattctatgggccggatggttggcggttggagagtgagcaaaaaattgataaatattaaaaaatggaaaaataaataaaattttataaaaattccatggacactatctaaacagagagccttgattaatttaatcgaaaatttctttgaattatttttgcttaaaagaccgagttccaatgatattgccaaaaatatgatggaataggatggaaaataaattgtcttgagcgcagaaattttaggtattttgccaagaaaagttggagtttggatgtcagtcgtccgcttcgcgccctcaggacgggcgcttcgcgcccgttttttaattttgttgagaatattctgccgcttcgcgcccgtcttttaattttgttgagtacattcggccgcttcgcggcctcaggacgggcgcttcgcgcccgtttctaaatttgttgggctattaaggccgattcgcggcctcagacgggcgcttcgcgcccgttttttagcttgttaggccgcttcgcggcctcagtcgggcgcttcgcgccggtttttcaatttttgttggccttggacgggcgcttcgcgcctgttttttaaattcgttgaactcatgcgg

SEQ ID NO: 20588 - DNA, 2466 bp, Heterodera glycines
aaaaaaattatggatcagtaaaaaaaaatggtaaaattcaaaaatgatacggtactttatgcaatgggcactggactaaaaagcgaacctattggattgaacggggcttccgcgaaatattgcgggtgaggagtcgacgcgcgctgtcttttgccactaattatgtctatgtgcgtagtagagttggactgttgcgcaatttccattgcgcggaaaatgaaaaggctttaaaatgtgaacagaataatgtgtcacacttttatattgggccgtggaccgcccatttaacagacacggatctccgacatccttattcaacgaaaagtgcaatttcgtaaggcggaacaacattatgtcaaattaccatttttaatttcagtacatcccaaaaatgttcgctaagagagatccgttcggaaaattaacattttctttacaacaaaaatgttaaaaagcaatttattacacctagcgccaaacattgtgtgggtgcgaaaaactagagacaatgcccataaatcttcggccaaatattttgccaaattatggcccaacaaaaattatgtaaaatattcccgttaaatgttgcgaaacaggataaaattttttataaaatactgacaaattgtttgaaaagcaaatttcgaaatatttaaccggactgctttgcataatttttgctgagatataatttagcaaaatatttggccgaagatttatggtcattgttcagatttttttagtacacatacaaaactgtttggctcaaaattagccgattacatttacattttttctttcaatagagaaagaacaatggcaattaatcttttattcagaaaaacccaatatttcgaaacgggaatgtaccggtggaaccaaaaaaaatttccgaaatgatcattaattatgtaaatgggcgggatcagcattctttttgctgtcagagcgcgcggtataaaggcagaagttttcgcaaatttttcacttatttaatagttataactctgccgaaagttccttctgacccatgtccaacagggattagctaaatgaaaccctctcacaattatttattttcaaaattgtgaacagtgtttcacttaacaaaaccctccttgtcaaaattatattttaaataatgttatagttggaaaaattaataaataatattttttctaaattaaatgttcaattttctatctacgaggtagaagccatgcacaaatttgtaaatgtgtcaaaaccactacctcatagaaagctaatcgaatacatagaagaaaatacataaataatttctcggaagaaaagtattaacaaaaaattttttttttttggataataaaattgggacatgagcggaggcatacttttggatggaatcgaagaatgagaatgaaaatttgcacttttcgctggctccttcctcccaaccgattgcgccaccccttttggcaattaatcttgtggtcaccgaattctgtggatttgtgagtgacgcgagcataacaaaaaaagaagtaaatagaataacaaaagtaaaaataaaagtgaaaggaattaaatttaattatattgaattaatttaattgtctctcgttttcaacccacgtttgaagcaatattttgattttacaaaaaatttaaacgctttttatgacagtacactgctaattggatcaaaatgggtttttctttaactgttggatcaaaatgggtttttctttaactgatcatagataaattagaggttatagttttctaaaatttgtacttttttgagattaaatttgaatgtggccttttttatagaagactcatgcttgttttggttgtgcttgcttattattttgtataattttcggttttgcttaaaataactaaaatggtttttctttaactgatcataaataattggttctaaaatttgtactttattgaggggaatatgaaatgaccttttttatgacagactcatgcttgttctgtttgttcttgcttatgtttttgttaaatttttattttcgtttaaaataaccaaaaaggtaattcttaaaccaatgattaataaaagcgcctatttttattgaaaatcttttaacaaataatttcaaaattcttcctagcggtacagcgacaattctcaccgactgatttataaaaaaatcatcaaaaaggagtcctattggattaatctgtaaaatagtttaatcgaaaatgctcaaaaagctaaggttaattgaaattgatgcaaatttttgaacaccccctctacccattaaaatacgctaatttaatcgcatttaaatacagtaattctttttcacgccaattaattgcgtagttttaaaaattattcggtgtgaccactaagataaacataaaaaaccttaggggtatattaattaatttattttatagaaaatgctttaattaaaggttctgcctcaaaatgcaaaggat

SEQ ID NO: 20589 - DNA, 1159 bp, Heterodera glycines
  misc_feature (1096)..(1096): n is a, c, g, or t
acagcattgactgcaaaggtggaagatcaggaagatgatgtaaacgctacgacggcttcaaacagtacagaagaaacagcagtgactgcaaaggtggaagagcagaaagatgatgcaaatgcaacgaaggctacagcattgactgcaaaggtggaagaacaggaagatgatgtaaacgcaacgacggcttcaaacagtacagaagaaacagcagtgactgcaaagatggaagagcagaaagatgatgcaaatgcaacgacggcttcaagcagtacagaagaaacagcagttactgcaaaggtggaagaacaggaagatgatgcaaacgcaacgacggcatcaagcagtacagaagaaacggcagttactgcaaaggtggaagaacaggaagatgatgcaaacgcaacgacggcttcaagcagtacagaagaaacagcagtgactgcaaaggtggaagagcagaaagatgatgcaaatgcaacgacggcttcaagcagtacagaagaaacagcagttactgcaaaggtggaagaacaggaagatgatgtaaacgcaacgacggcttcaagcagtacagaagaaacagcagttactgcaaaggtggaagaacaggaagatgatgcaaacgcaacgacggcttcaagcagtacagaagaaacagcagtgactgcaaaggtggaagagcagaaagatgatgcaaatgcaacgaaggctacagcattgactgcaaaggtggaagaacaggaagatgatgtaaacgcaacgacggcttcaaacagtacagaagaaacagcagtgactgcaaagatggaagaacaggaagatgatgtaaacgcaacgacggcttcaagcagtacagaagaaacagcagtgactgcaaaggtggaagaacaggaagatgatgcaaacgcaacgacggcatcaagcagtacagaagaaacagcagttactgtaaaggtggaacagcaggaggacgatgtaaatgcaacgacggcttcaagcagtacagaagaaacagcagtgactgcaaaggtggaactgcaggaagatgatgcaaacgcaacgacggcatcaagcagtacagaagaaacagcangtactgtaaaggtggaacagcaggaggacgatgcaaacgcaacggcggcatcaagcagtacag

SEQ ID NO: 20590 - DNA, 1048 bp, Heterodera glycines
cagaagaaacagcaggtgactgcaaaggtggaactgcaggaagatgatgcaaacgcaacgacggcatcaagcagtacagaagaaacagcagttactgtaaaggtggaacagcaggaggacgatgcaaacgcaacggcggcatcaagcagtacagaagaaacagcagttactgtaaaggtggaactgcaggaagatgatgcgaacgcaacgacggcttcaagcagtacagaagaaacagcagtgactgcaaagattgaacatcaggaggacgatgcaaacgcaacggcggcatcaagcagtacagaagaaacagcagttactgtaaaggtggaactgcaggaagatgatgcaaacgcaacgacggcatcaagcagtacagaagaaacagcagttactgcaaaggtggaacagcatgaggacgatgcaaacgcaacgagggcttcaaacagtacagaagaaacagcagtgactgcaaaggtggaactgcaggaagatgatgcaaacgcaacgacggcatcaagcagtacagaagaaacagctgttactgcaaagatggaagaacaggaagatgatgtaaacgcaacgacggcttcaagcagtacagaagaaacagcagttactgcaaaggtggaagaacaggaagatgatgcaaacgcaacgacggcttcaagcagtacagaagaaacagcagtgactgtaaagttggaacagcaggaagatgatgcaaacgcaactacggcttcaagcagtacagaagaaacagcagtgacagcaaagatggaagaacaggaagatgatgcaaatgcaacgacggcttcaagcagtacagaagaaacagcagttactgtaaaggtggaacagcaggaggacgatgtaaatgcaacgacggcttcaagcagtacagaagaaacagcagtgactgcaaagattgaacatcaggaggacgatgcaaacgcaacggcggcatcaagcagtacagaagaaacagcagttactgtaaaggtggaactgcaggaagatgatgcaaacgcaacgacggcatcaagca

SEQ ID NO: 20591 - DNA, 2552 bp, Heterodera glycines
  misc_feature (4)..(4): n is a, c, g, or t
  misc_feature (20)..(20): n is a, c, g, or t
  misc_feature (31)..(32): n is a, c, g, or t
  misc_feature (64)..(64): n is a, c, g, or t
  misc_feature (2505)..(2505): n is a, c, g, or t
aaangaaggaggaagaaganagcgagagggnnggaagggaagcagcggccgggaggggaccaanagggaagaaaggctgaaacgtaatgctgctggaagagatccggaagtaccaaaaagtgccaaatttttgtggaaaattatacaaaaattgatatttggtgcgtttttaaatgaatcaaacgcgtgcatcactcagttccccatgcttttttcatttgttgcattaaatgtgcatgcgtatcaaaaatttattaattttttgtcagccgccccaaaatgtaaaattgcgcttttcctaataatttttttttggcagttttattgagttaggcaacaatataatgcttaaacataacgttcagcattttgtttttaaaaaatgagataggacattttggattaataagggatgtattagcatatttttgaaaagaaaattagaccatctccggaataatttcacttttcgtatgtattggggacattttgtgccaatgaagcaccaccacaatccaccattttctggcagtaaaatgagcatttgtgagccatccgccgcccttccggctctgctcgcaaaaactcagtcattgcccagagagggacatttatggccttaaaacggcccccatcctgatggcggcggtgtgtgccgtgttgtgtcctatgccaaaagctccaaaatgcgcatcaaatttcattgtgaaaattcgaaattcgcgtcccccagcagaggagaaaatgccgtggaaaggaggcgcttattagagggccccgggaaaaaacacaaaatgaagcaaaagtgcagcggccgtaaaccatgtgtaaatgctctatgaaaatgggcacaaaacgttagagagagagaaaaagaatataaaaaataaaaataaggaaattgtataaatttttcgtgtcttaaatatgcatataaatttttggctcaattaaaaacggaaataaatgaaaattttaattgctcaataattaagcaaatgaatgccaaaagaatgtggaatttgcacaaatatcttgccgaaggagataatgaaataaaattgtgatggataaaacattctcgtcaatccttcatgttggatggatggattggattggaccaggatttgcggagaaagaaaaggggtgggaatgttcttcatccccacccatccacggggggcatggtccacgggaatcaatgcccgctgagcatgaccccgcccccatctcagaagcaaaaccaccaaaagcagttgttgatcagcagctctctcattttcgcatactatttaactttcctcatcctctgatctgaggattgatcagtgtgaggggatggataactttgcaaaaacaatgaattttcccgatgcaacaggcgttgtgctgtgcgattatgggggtaataccctcctccgacataatgttccccacaaaggcaccgttcaataaacaaaacaaaaaaaaaacgcggggccaatgggccaaggatcgataatgaacaggcgcaatggaaattaggcggattatgcgttcgatttttgggctcgagacttacgatagcacaaaaagatttattgaccaatcgatattaggatggtaagtaataatattacataaaaaataagtaggaaaaacggtgaaaaaaaatcagaataaaacaaaaaaatcggtattttaattaattaaattacagtgttatatattaattatgcaaaaaaacaagtaaaaagggtaaaaatcggattaaaaaaatattataatattgaaattataaacattaaaacaaactaaactcatagtatacataaaaaaaacatcaaacacgccacaaaaacaacaattatattacaaatatacatgtatatataaaatccaaaaattgctatatatatacataatcttatacatataaaatggaaaaatattatattatttaattaattaaagaatatgtttgttttttatattttttcctatataaaattgcttgaaaaaattgcaaaaattcaatggttttatgcacccaccgtttgtcatcaagctagccttttgtaaattttcgcgcatcttcatatggtcatggttgagctcgttgaactagaaaaataaaaaaataaaatttgattatcgaaatatatattctttaatattaattaaattaaaaaagaatgagataaaaaaaattgataatcctctcattcctttaaacattaattagaaaacaaacctgaccatgaaatggttatgctccaaatcctgggagagtttgacctgaaaatgaagttgaattatatatatatatattattattattaagtgaatttaaaagcattttactttttgcttaatttagcaaaaccctttccttgtacaggtatggaattattagagcccagaaaagggccgggcttgtcagagttttcccgacattatgatcctgaatgcttcaacgtaaatttgatacaaaaaaaaagaatttttaaatcctgaaatccggtntcagtgagtcccccaaatccagaaaagacgtccccccaccccgattc

SEQ ID NO: 20592 - DNA, 1203 bp, Heterodera glycines
ttttatttttcagtcataaacaatattgcaataatttaagttcgttttatttttcattcacaacacggccgagagaaattttgatacatcaaagacaacctaaaatacaccgcggtgagagccctagcgaaggctggactataaaattgcacaacaaatatacatactgttcgagttatgttttatacgagtcagatatgagtttttcctatggcaaggttgtgaaattcctcccaaaaactttcttacggaaaataagcagcaaattttaataaaaataaatacttttcaattcatgcaatgaatttcctgaatctataaattgatccactagaaaagtgttagtagaaaataaaaaataatcggagcccatattttcgtcataaattgagtcccgaaagataaatagcatggcaaaaattgaaaatatttgtcgatttattgcctattttccatccacgcttgggatgaggaaatatataaaaagataaactttgtataagtatttattatcatggaagtcgtcagaataatagcaaaagacttcgtataaacaatattgcaataatttaagttcgttttatttttcagtcaacaacacggccgagagaaattttgatacatcaaagacaacctaaaatacaccgcggtgagagccctagcgaaggctggactataaaattgcacaacaaatatacctactgttcgagttatgttttatacgagtcagatatgagtttttcctatggcaaggttgtgaaattcctcccaaaaactttcttacggaaaataagcagcaaattttaataaaaataaatacttttcaattcatgcaatgaatttcctgaatctataaattgatccactagaaaagtgttagtagaaaataaaaaataatcggagcccatattttcgtcataaattgagtcccgaaagataaatagcatggcaaaaattgaaaatatttgtcgatttattgcctattttccatccacgcttgggatgaggaaatatataaaaagataaactttgtataagtgtttattatcatggaagtcgtcagaataatagcaaaagacttcgtataaacaatattgcaataatttaagttcgttttatttttcagtcacaacacggccgagagaaattttgatacatcaaagacacctaaaatacaccgcggtgagagccctagcgaaggct

SEQ ID NO: 20593 - DNA, 1039 bp, Heterodera glycines
accagaattagaacaaaaaatttgaaattttttccaaactcccccctgaaatcaaacaaatcttggtagaaatttgttctttctttatccaattaataagtgaagcattgttttgcagcaaaataaatgattgttaaatgaatttgaagcttttccccagaaaaatgcatttcttgtaaaaaattttaaattttttcgttcgaattctggtccggggttcggaattgggcaaatccgagtcagattcgtaatcagcgcccgcgaaaacccccaaatactcatgttgagaccaatttaaaaaaataaaaataaattatggaccccattctttaggattgccaaaatttgttttcaataaaacaaattaatgcaatttatgatgccgacaagtgaaaggaatcttgagaattcggaagtttttgtaatgtttcttcccaaaaaaaataataataatttcttttaccaaaaattattcataaaatatgactcgtgaaaccaacggaaaaatgtcaaattggaaatgtcttcaaaaaacatttgttgacaaagttttaaattgtaattaataaatatcgtgtgctaaaatgggcaaatttaaattaattaaacaaaaacttctgttacatttttctacatttgcttaaccgtttttaatttaaagataatttaagcgctttccctcaatttatttaggttatttttaaatcattcaaatcgtgatgtgatgcttaaattttgtactcagttttttgcctttttcagcagcttaactccaattttgccattatttgttcatctttttgcttttaaatgtttgctttttgtttttattatcattaataatttattaataattccatttgcatttattttaattaaattaacgtttttctcattgtgcagctccaacactcaaagtaatgtaattatattattatatattctctttttttcacttttttcaatcctccgaatttgcattttcttgtgaattcctaaaataaatcataaaatggatgggatttattcgtcctcattt

SEQ ID NO: 20594 - DNA, 2088 bp, Heterodera glycines
aaaatacacccctaagaatcgaccaaaatttttttttcccccccccgactaagaattggaaaatttaaaaaaaaattcttcctccaaatttttttttggcaaaatttttgatttaaaaatatcaatatttgctaagagaattttataaaggaaatgtagctcattggcaagtgcactagtgaaaaaattttttttttttgctcaatttttggctgaaaattatatcactattcgtcactatttcatactttttgccactattttgtcactattttggcattttactcactattttagttaactatttcgagatttttcgtcactaaaagtcgtatccctaatgattagtcttttcgtgcattatttcttttttattttttgttagttaaaaatatattaaattcgcttcaaattttgcatatagttaaagaaaatttttaaaagcttaagctttttataagctttctatgagttcaaaattatgtgattggttaacaaaaaccttcaaaataattatccagccctttcatcaacaaaacttcctccatcatttatgtgtttctcggtctcatgtcgagaactgcaattagttgatcattttttgatttttgttcttcaccattttattaattatgaagaccaattgtcgttcaattcaataaaagtgtctccttcggtcggtcggtcagctgcagctgatgagcataattagcacagcaaatgggtgataaatgacaaatttaatttggatttcacaattcgctgatttttatttcctcgattaattcattcaatctttttttaatatctaaaaagtcaattcattctctaacagataaaaatgattgctgcaaaacttgctcaatttttgctttccttttccatcactttgttttctttggcatttctcgccagaggctacaattcggacaaatgtccggtcaaaggattcaacggcgaatgttttgagcgaaacggtggcaatgacactgaatatgaaaattggtagaaaaaggattaaaattaaaaaataatcataaaataccagggcattttcttaaatggcctcagtaatcggtcggtcggtccttcccgaaaatgcttttcgtcgtccatttgcgtccgcaggtgttatcagtacgcgtccacgtcgatgaactacgatcagatgaagccgagcctgattctggtggccagctcaacggccgatgtgatcgcagccgtccgctttgcccgttccaaacgcgtcaacgtcgcggtgcgctcgggcggccatcagttcagcggagcatcgtccgcgagcgggaaaaacatacaattggacgtcagccaagcgttcagagtgagtgcaaggaaaacgcagcgcatttaaacattgagctgatcagagcgccaaaggatcaaatgaaaaaaacgacacgacagcgatgctcctccggtggcaaaacataaaatggcacaaatccccttaaaaatggcacagaaccttctctaaaatgtggcaatgatatccctctaaaattatagtaaaatcgtaacttttcgtactgtaggaaattgattgagtctatttgggtgaccaaaacaaattgatagaaacttaactgctcaacagcatttgtgctcgcatcgactgatgtgaaacagagtgtaattagctgctaattactcagaatgtttctgccggcgattttgcggtgttagaaccgaactgtagcaatagtagcgtcgctgtccgtgttggcatcagtttcacactgctcgagttctttttgatgatggcggaaaagggactgttcgtacccggcggtttgtgcaggtaggaaaattggtaagcttcttctgccaacagaacaaagttaatcaatcggttaattatattttgcatgcaatgccaattttttgactaattagcagaattgactatttaagccaaacaatcaactctagtatatcccatttaatgcttatcccttacagtaatgtccatatcggcggacacatccaaaccggagggtacggcgtggcaatccgcgcgttcggactggaagcggaccatgtgcttgcatttgacatcattacggcaga

SEQ ID NO: 20595 - DNA, 2885 bp, Heterodera glycines
  misc_feature (2622)..(2622): n is a, c, g, or t
tttttaatgctcgtgatatttctaggctacacgtggacttatgtccgtgcggtccaaacccaacaaggaatgaacagtttggttaacccgccagttacagatgccgaggcatttcacacacatcttttcctttgaagatgctacccaatatgcaaagcaaatgttttcaaatatcggtgctttaaatcatcatcatgaaaaacttcgttattatttttaatgccattttaatggcataacaccaaatttaaataatttcatattaaaaaagcatttttatttaaagaaaaaagacgaaaatgtcatttgcttaaaaataaatttaatataattccattttaatggcataacaccaaatttaaatgaatttggtaaaaaaaaaaatatttgatttaaaaaaagaagaaaaggttattcgttcaataaaaataaccaaatttaaataaatttgatataaaaaaattttatttaaagaaaaaagaagaaaattattcgataagaataacaaatttaaataaatgatataaaaaatatttttatttaaagaaaaaagaagtaaaggttattctataaaaataaattaaaacgctaacaacatttgtaaattattttattcgtgacataaaaactttttagaagaatgtgtatttaagcattaatttaaacaaattgtaacatatttataatttaaaaattgataaaatgcataggaaaatcgggtttgctttgcacttttttaggaatctcccatttttgcactttttataaatcgcccaatttgcacggttaatcttttttaaattcattaatttgtgccttcgaataaaaaaatgaatatcctactcaaataaacatttataaataaatgattatttaatattttttagtatgatgttttttttattaaatgaggaacttttccaactaaagtgaatattgaataaattatattccgtaaaaatgggttaactcatcaaaaattataaaattaatgaaaatgaaatgaaatggggaaaattttaaaaattttcacgaaaacgccaattcagcgctgtatttatgtcctgaaaacaaagaaatttcagggcatttaagacttaaaattccaatatcccatgcctagaaaggtttttaatgtattaaggccgattaaatgattagtttaattgatgcaaaaaaaaatataaatatctgaaattaagaggctgtaagttgtacagaacaaatttttgacatgtatattgaaaaatcaatttttttatccctaatttgaaatttaattaatttttctgtcgaaaagtcccctcctcaaatttataatatttctgtcgaaatgtcctttaccttcaaaaagtattttaatatttacaattttctttaaagttatatatttgtattaatcaaaataaattttttattaaaagtaaaatttttgaaaaataaattttatccaaaatacataagttaaaaaacgatcaaaattacacatgacatcttaagaaattaaaaaacaaattaaataagttaatttttacattcgtactcaaaaatctatcctgatttccaagtacaatcttggaaaaaagtaaagttaaaattttccaggcacaaaagccgaaatccaagtaagtacttggccggaaccccccccccccccccaccccctatgcctccataaagtttttgtaaaaaaccgcgccgcaaaaaaaaaacgatttaaaaaattaagagattgtcaatttattaaaacaatagaaaataggcatcgaatccttaggaatttgtagttttaacgaaattgttgaatttcttaataaaaatttccagaaattttgggactaacaataagaaaattccaagttaagcgaccacgaaaacccatatattggtgtgttttttctttgaaagtgagaaaaaaaaattgaaaatatttatgagccctaaactgcataagagccaatttcggcgtatggcttctcgatgtttcgcgaaatggaagtcaatttttaaattaaatttctattccttttcaaattatcgccaagtacctaattttggcaccagattttataagtcaagtttattctattagcctgcaaattttcaaaagtttccgttaagttaaacaaatttcaatttggacacacactcaaaccgaaaattaattaatagttttacatttttggaacagtaaaggaatacaacagttggaaaagttaacacgaaaaataataagtgaattaaggatgtttaaatcaaaaaattgcaaattgattattagagatgggatttttatgtgctaaaaatcctgaaatatgtaataaaatatgtgctaaaaaatgcttaaatatgtgctaaaaaccccaaaaatgccaaaatatgtgctaaaatatgtgttaaaaattggaaaaatcaagtgtctttttgcataaaaattcccaaaaatctcattctttatcatttttcgcccatacaacgcaaatcaaatacctttcaagtgtttgaaggtaaaattaatcttttttccaataaattattttataaattgaaagttctccaatgaaaattaagaaatcgattggttactttcggcaaacaaaattttttttttttgaaaatatntaaaaaatgacaaaaaagttgattttaggggtgtatttttcaattttcttgtatttttcttacaaatttttctcagaaatgtcgaaatatgtgcaaaatatgtgccaaaccccgaaatatgtgcgatatgtttttatttgacaaaatgccaaaatatgtgattttatgtttttataagtcgctctaaatcgaaaattgttcggagaaaatgctttttttgggcttctctcgtcataactaagccgcagaaaaaatatgtaaaa

SEQ ID NO: 20596 - DNA, 2227 bp, Heterodera glycines
  misc_feature (98)..(98): n is a, c, g, or t
  misc_feature (129)..(129): n is a, c, g, or t
ttatgaaaaatgtaataaaaataaataaaaaacgcactcaagaatctatttccataacccaaaaatacggcccatgatttggcggatagtcggacttntacgcctgaaaaaatctattgacttacaatnttgtagctctggataaaaaatgagacattattcagttttattgacaagtagtccaggcattttaagttttaacaactattaggtacctatttctcgattttttgcacctgaaaaatcctagacctggttatatgaatgcatgttttaaattttgatattatttgtaaattggagattttgaattgaaatatttatacaatgtaaaatggttatatggaatggtccaatgccgaggatgaacttgttgatcacaagaagacatttccctctcaacagcctttttcgacgcctcatcagaacggacattttgcagcatttcctcagaaagtcttcggtctaaaaattcaaaattgttatttaataacggaaaagtaacaaaaaggaaaagaaaccgataaatcatttgcatttttgccctgtcgcgcgacgacgtcccatcggcaacgggtgcagtcaaatgcacttgctcctcctcagattcgggtctcggaatgggttgaagaattcgagcagtccaacgaggcgatcgctcgaaattgtcagcacaagatcaggcagttaaccaacgagacggaacctaattatgagagaatgaataaaacgcatagcacatagcatgtattagaaatgaaaaatttcgttgttttagagaaatagttcttttaaaaatttttcatataaaaatttcaatagtgaaaaaattttctagcttttttaaagattttttgttgaaaaatttcaaaatatagtttcgagggggataaaacgacgtggggaaaacgatggggccaaatgatcacgtcggaatttggacgtcgtcgagtcgaaaagacaagtcggagattggagaggcaaagttggaaattgtcgtatgccttggccaccaatgaacgcaatctctgatcggttatctgcaaatattatcattttcttaaattgaatgatgccccaaacaattccctgacatgttcgtatgcttttgtggacggctcgtccaaagtgttcagtttcaattgcccaagttcggggattaatgtcgtttttgttgggtcaaaggcaccgccggagcaaacgacaaaaatggcagggtcaattttgacctccaactctagcttcttgcgcacgtcaaccatatgctgaagggctgtcgcagaacggcctaaaaagagcaataaaaaaatttttaaaataaattcaggttttcaactaactgtcatgaaaatggccattttatgcaaaactgctagcaaaaattctcatattttaaataaaattccaacgatttttctcggcgattcacaccgaaccccaataactttttttttcttcttaaaaacgctcaaatgcacaaaaattaaccgttttttgcgatagttttttaaataatactctcaattcaaaattttcccgtcctccggttcccaaaacagttggtgaagacggactgattttggcggtctgaacacgtcgattgttcaccgccggggaatggcacgtaaacaccacctaaaattacagaagcagtattgttttagtttaaaaaaatcaggagcatgtttaggaaaacacgttgttcaaagtcgccctctagcggatttgtttcaaattttagtgacattctatttacaattaaaaaattcatcaaaagcgctattttaggcatttttattcctggttttgttggccataatttaccttcaccgattcggtgctgctcacactgacgccaagcccagtgtcattgcgcaacaaatgggaggaagtgtcgggcaaatcactccgcggggtgctgatttgtttggaagcattttcaaatgcctaaaacagaaaaaaaggaactaaaaaaacacaaagaacatacttcagagagttgggtaagctgttggaggaatgatttggtgatggtgatgtccaatgtttcggtggcctcaacgattatggccaattttgggggtggcaatgcgattttggaatctccgctcgtctctttgtctcactttcgttcaaccgcagaatcatcggattggtgccgggagggtgcgaaatttggacggatttgctctgaaaatgataaaaaagttgagggtgatgatgtcgg

SEQ ID NO: 20597 - DNA, 2099 bp, Heterodera glycines
  misc_feature (46)..(46): n is a, c, g, or t
  misc_feature (79)..(79): n is a, c, g, or t
  misc_feature (1992)..(1992): n is a, c, g, or t
  misc_feature (2003)..(2003): n is a, c, g, or t
  misc_feature (2035)..(2036): n is a, c, g, or t
aaatttaaaaaatatatatttttacctgttttgttagagtgattcnaagttttttggacccggttattttgccgactgnattcatgggattaatcccgcaatcccataattccaaaaattcaggcggattgggatctcgtaaaatctggcgtgatccgttccgcgccgcgcattctatttatacacccattaaatttaaacaattcaattatttgtagaagaaagggcaccgcacttcgttagttttggagccaaagatgagcgtgttggtggaggacgagctggaggaggattttgttggggctgatcaaaaattgcttggagagagaaagttcaaggaatgggagcagagactgtggcagtggggacaagcggaagagcaggcaagcgaatggccaagcccattttgggcccaacattctctaattgggcatctgataattgggcgtcaaaaacctgcttcacggcaccaatcggattagagtcatgagattatagaacacactgaccaaatcccatgaaaattaaaaatctattttaatataaaaattagagatcggtattttggaaaaaacctggacctggatttggattacattttggatctggacctggattttctggacaaaaatccagataacaggacaggttgccgaaaactggcctggacctggatccaggaaaaaaaatccaggcctggatctagagtccagctcggtctctaataaaaaggtattcccagaaattttttaaatgtttaatgagtgtcactttttccttgcacctttctttggccgatcaaaaaagcattttcatcacagcatttcacaatcgcagcattttctttttttttatttgatgggtgtgcatatttatttgcctgtgacatgatgatgatgagcgggggggggggggaaggctccattccatccttttccattcattcattcatccattcacatttcactcatcattttcatttcatcttgcttaatcgatttgcgtttgcccaccgggggggagggagggatcgcccgcttttggcaaataatttggcttccttgccgcacaatgcgcttcatcaccaccaacagtttcagcagcagaaccaccgcttttcccttttttcttgcccaaataacacacaaaatttggtcctcgcccaaaaagaacaacgaattttccgcctccctttctctgcccctttgaattgcatgccattaactctgctaatcgtttaagaaaaaataggaaaatctttattgaatttcaaaatgtgatcaacgacttactcctttgacaccatggattacagtttttatgacaaaaaatggaattgaaaatgaccgagacttttttgggaaatctttcgggatggcacttgtctctgatcagacccattaaagaaggacccgaaaatgagcaaaacacacactaattggactgaagccaatccatgcttttatattttaaataaaacacgatttgctaggaaatgccaacccattttcatttctgctgatttcatcaatcaaaaaagtcatttctgtcccagccaaatttggccaaagattgtttgctcagtgggccttaaaggagcccaagaatgactaaaagccttcccttcttctgctgatcataagacaagactcaaaaaacagcatcatatatataattcatgcaagaatttaattaaactaaaattaacatttttattttatttgaatgtggttcgaagtttattttcctttaattttatttttaatgaaatatcaaggtatgcttttttgatatttataataatgcttagagacaaacctatgacccgaatacaaacaaaaacccattttacaaaattataaattttgactcaaaaaattagtgattacaactgcggatatgaatcagaaaatgatcaaaaaaccgagtgaacgcattgcacaaaaacccaacccatgcatagtattaataattcttaattgtgcataattntatacaaattnaaattttattatttgtatttattaattgctannatatctcgcagcttttcatatattatattttatttttattattcgttttcgtgacttcatacc

SEQ ID NO: 20598 - DNA, 1062 bp, Heterodera glycines
  misc_feature (43)..(43): n is a, c, g, or t
  misc_feature (1046)..(1046): n is a, c, g, or t
gaatttctcaataaaaaatcttataaaattttttttaaaaganaattaaaatgtctttggaaaaatttcggaaaaaacctcataaaattccaaaaaaatcactgagaattttccaaaaaacatttcttcttgaaattttcttacaaaaaataaattctctaagatttttctcttgagaaaattcaattttctcataaaaaattctctaagatttttctcttgagaaaattcaattttcttataaaaaattttctaaaatttttttcttgagaaactctgtttgaaaatttaaaaaaatttctagcggcgtgttttgtcatggcgtgacttcggccggcgtgattttgtcctgttcccttaatttgatattttttttttaaaaatcttattataaaatgcattttggccacttaatttatttgcatcgaaattttaggtcaatcgccaagtttacaggaggagttggaaataatgtcaaatgaagtatgatgtctcattcattatgtattatttaaatattttttggaattaaaaattaattttaatttggaattttatttatttgccaattttcgattttagttggctgctcgcgtttcactcaacgcaattcaatcgccagattatacgcatttgcctgcaaatggcgaacttagcgaatcacctgttcggcgtagcatttccagcagagggaccacttttcaacaggtgaagaagcccactgatcagtataatttatcaatcgcatttattgcgtttaataatttaattttggtaaaatattttcataatttttatttatttttcaatcgcattaaaatgggtttaattttaattattattattatacttaatatatgtacattgttgtttcatttagaactcacaaattcctgatcggatcttcaaagttgtgtttgtcggcgattcggcagttggaaagacatgctttttacaccggcaagtgtttttcaaactcattagaattttaaataggttaattaattaattgatgctttaattttttcagcttttgtcacaaccgnattcaaaccttgttca

SEQ ID NO: 20599 - DNA, 974 bp, Heterodera glycines
ttaaatcttttctagaagaagtagataaagccaaaaacacaacattagagcatgtggaaaagaatgacttgaaagaagcaaagaaatcagccgacgtcgcaaagggaatcgccaaacaggcaaaaaacaaatattcatcaactctcgaggaatataatgataaatcggaaaagggttatatcggaatagtgaataggcttaatgaggctttggctgagcatattaaacgtaaagatattgaaaatagacaagtatctgaagctgagaaaagaccacaaaaaagagagagactagccaatgaggatgttcaatttcaatatgacaattgtctatctttccgctgctgtctgccacatagatttgtcaaaacacctcgcctatgtgcttggttttatgaacacaaggctatttcacgcggaagaggcgaattatatgccagatttgacgggaggcgtaaggcaactatacatttatgcaccaaatttaatagaaaacagaattatcgggaaccagatggctccactcttaagaatagttaacttcgtcaatgacccaggatcgattagtgaagttatatatagcaccgagtactttcatcgtctacagtcgaaacgaatttcagaaattacaattgaaattcacacaccatttggtgaattcgttaaatttcactggggaagttgtattcttacattacattttaagaaaagtatattttaaaaatgacacacgtatttttcgatcccgattacaacaatgtggtaaaggaaaaagggcctgatcactaataagaaccgaaaacgggtattttatcagttaagtttcatctaaaggtataaatagaacaaataacacaaataattaaaaaatgtcaactcttatgaaaatagacaaggcgagtgaggatggtctcgaggggggcctttcgctgttcgatatccccccgacgaacgttgcaattaataaatccagta

SEQ ID NO: 20600 - DNA, 1617 bp, Heterodera glycines
ctggttttgaattgattcgaaacggaacgaccagcatcaaggtgcagtttaatgagcctataaaggacggcgggtatgagatgatagttctgggggaatttgattcgattctatctattaacgctaatcgtgtgctcagtagcgacggaagcatatgatgaattctaacgagattgaaatatttttaaccaaacacccgacaaccagaaaatattttatcggggtttttgcttccgacgggatgccaaaattgaaggacatgcattttctgtactgttttatggcgaataccgaccgggcgggcattataggtgaacattgggtcgcttgtttttaaattcgccgacagaaattgaatattttgattcattgggcgattatcccaatgaagatttaagttcatatcttaacctattcgaacgaattctctttaacgaacgtattgtccaacatcaattctcagatgcgtgtggtcaattttgcatttattttttaacacagcgatgctccggaatcctttattgtgaggtcattgaccgtctatataaggttcgcccgatgtccgatatattattaagaattttgtcagtaatgtttaatttaattgttctcctaacgatagtcggtcaactcagtggagaaagggttactattctttctgatacaaaaacgacaaatatctcactcactatgacaaagagttcggtcaatgaaaggttgttcggcttcgatcggtcgagattatgtacgataactaggaatctgatttcatggtggagtgtatcaatccaaaatataaattcaataggaaagagcggaaccattaatatcaaactttaccgggattttagacaattaaagccccgagcatgtttttattacaacgatcatagttatttaatttttcaaaacgaaaagacaaatgaaacttcggtaacaagagggagtcaagaaatagttgtcaggaattttcccggtggcgaccttagatttgatcatatgatggtcgacttttcgtaatcagagacgatcgaatagacgagattgacattagatcaatcgagaatttatggacacatcataatggcaccgaaattattactagaccgatcggatcaataccgtcttcatttaccgatttcctaataattgagggacaaatttatctgattaataaaaataaaatatacaaagatcgatttgactcaaatgagatacttcccaaatatgtgtcagacgcgaatagtgaattctttaattttgtcatgttcaaagaatttgagaaaattaaagatttttgtcaatttttgatttggtagtggtcataatttgtatatctgttctcagaattttgaaattaaagagaaaaggcaaaaattcatcatatagtggtgaagtaatgtatataaggaattgcaacgaagatgagaatgcctatctgtgttcaaaatgaattctctcgttgaaattttatgcgattttaacgatagtgaacctcacgaattatcagaaattctacgacatcggaagaaagaaaaagtgaaacttttaagaagacacaccctaataacgcccggtgagaggcacaatcagtttatctcagcggatgacatcgca

SEQ ID NO: 20601 - DNA, 3342 bp, Heterodera glycines
gggatttgcgggattaattccgcgggatcccctcccgcaaagaattttgagttcgaatcccgcagctggacccgcaaatttgaaatttccggtctcttagcgatcaataattttcaaaaaaacatttttttgtgttcctttgaccataatttttttttttttgaaagacaacaaatttttgaaattttgaaggctaatagagaacatttagaggtatcaattttcaaatttctaaaaaaaaacccattttaagacaccggatcaacaagtgagagcttcaaagcgtccatttccatttgctctccgtcttcgaccgggttgttcaatttaacaatttcctgtctagtactttccagcggacgtcgagcgtttgggttgtcgagaatacggctcaacagattgttcgagtccaatcgcttcaccaaattaatctgtatttataaaatgaataattatcatccatcccgttaattgttctcaattacttaataaattttcagaaaaacactttttttaatttttaaccaaatagttcaaaagattataagtgcagaattatttgagcatatttttgtttaccaaattttaaatgttaaaaagagaattttgagaggctatcaatttttaaatatggacacaatttttttaaatttttggtaaattttaaacaatgttttattatagtttcaatttactttttacatttagtcagtttctcaacatcttaagtaaaactttaaacaaaattttttcaaatcgaaatttttgattttttgtcatttagcacggaattatggtaatataattctctttactaaaaatcaaagaaaacatataaatgcttgattttgccgacaggcgccgcctaggaaaactcaaaatctaatattttaaggtttttgacggaacaaatctttggtggcctgggatatgatggcacattatcggtctcgagccttgactcgagaaaagtctcgggttttttggtctcggtctcaagtcgcggctttacggtctcgattctcggaaaattttcggtctcatacagcacttctttcttcccatcaattaaactaccgtaaatgcccatgcgcgtttgtcgctgtcccattcaatttccaaacggtgctcattgttttcgctatcccgagggtgcacgtaacgtgtgatgtccaccggaaatgagcattgcttcttttccggttttgaattgatttgctgaattagttaatttgactatttcttaattgggtaattattttttaagcgcgaaaaacatgtgatttttaaaaatctggagcacttttcttaattgtttttattaacgtatcatatttctcttgccgcgcctttcgatggcactaatagcccctccgcccaaatttttggcaacaatttaacatttttgttaattcttatccactaggctaaaaccagcacctataaaattgtatattataaattttatgaaaacatatttgtgcaaaaatgtgccgaagaatgtttgatacagttaaatatttatcattttcaaaacaataatatggtgtcaaataagtttttttgtttttaaaccgtttcaaaaaactttgactaattttttaaaaactagaaaaatattaatattattttaaatttgaagaaaatattagcttttttttacaaagtttcgtaaaactgccaatttttttgctttattagcatgaaaaatctcagaaaattacatttttttctaaatttcttgcattttttgagcattcgtggtcacaacttcatgaaaactgaataaatttctaaaaatttttaggttcttaaagcaaactaagaacaatcgatgatataagattatttaattttgtgtttaagaaaatttattaagattttatttattttacgaaacgcccatgttgtgaatttatacaaaatgacccggacgcggacactgaccggcagcctaacttgatacccgtcaatattcataattgagtgcggcggaaaagcgtcctgttgctcctcagtggtatccaacataaacatgcgcagttggacttcataactgaggggaaaccgaatttaaagagaaaataattcaatttctgaaattaaaaaaaaaatattattttccccataattgaatgaatacacaaagtcacgccattcttttccaaaaaatatttgttaattgaacattttgaaataccgaaaatatatggggcgaaataagttcatccatttaaaatataaaaataaattagtcatttgatattgcaatatttaaaaatctgaaaaactcgcccagtatttatcaagtcttctctgggcacaacaaatatatgtgaaaaatgtccaaagcctgtccaagtgggcactggatacgggggcaatttcgtcattggcacaataaccttaaaattgtaaattaattcattgatagccggatgacttaatccaaaaggtcataatggatgaaatatgccaacgatgaaaatttataataatgttttacattttttgttttactatccctttgcggatttaagaaacgtctacaagacctatcccctaggaatcacaatcatgagctttcgcctcgaaaatatatacatacgtcattaaaaataaattaaatccaattttatttgaaaacaaatgccagaattcatcctaaggccagagattcgatgacaaattaatttaaatccttttttatatgccaatcctcggttaccccagggctcctcaattgcactcacttttatatgttgatagaatggcagctcaacggtacgaagatcgctgacgcgttgatttgcagcggaacgccacggagcaagaacaggcgcattgttattccatttgaattgcggactcggtatattgttggacgatgatgaaacatcgggtttatgggttgatttagagcgcggctttccgccttcactgatggcacaacacaatgccaaaagggtgacgatgatcagaacccccgggcgagaaacggcaaacgcaaagcgcattttgagttagattttaaaataatataagtgtaaaaaggggaataattgctgaatatatctgttgctttttagatgcgaaatcacttggaaagcaatattagaatggaaatattagaaatggagagagaaatgaaatagatagatatattgatttattattgaatgtttatatgaatgtgcatttcttctatagtcgaattaatttgagaattttttttttaatttgagaaatttcattaaattattagtaaaagttcttcctgctgattgtggacttactcttcaataatagaaggaaaacacatttgagtttaaaagatttaaa

SEQ ID NO: 20602 - DNA, 2540 bp, Heterodera glycines
tggcaattggccaatccggaccaagtggaggcggccaagcagttcgtcaaaaaattgaccaacaccaaattctctccggacgattttgcaaatcccggtcgacaaataacacaataaatgcaacggctattcacaactttttctctgtttaagtgcttcaacagcattacaaagctgtcgaaatggtagcgttggatttgccatttgacagcgaacagttcaaaaaagaggcagcggaaaatgacaaattaagttggtcacttttcctatgtttcacttgaaaatgcaactttattcttcccctcgccagttccgtacttcaaaaatccaacttttgagcagagagttgccaaagaattggaagaattcgcagggatttgtgagacaattgcagaaacaaaggagaaagggaagaggaaaagtgcaaaggcagaaaaggaagaggaggagagggcggaggaaaaagaggaggaggaaacgagagggacgaagaagcggaagaagaggggagaaacaaccgatgaaggggagggacagcagaaggggaggaatgggaagggccaaacgcggcggaataaaacgcaacgagggcctgacggatgaggagaaaaggaggatggatgaaaatgcattccttgcctcacaatcagtggattaatatttttaattattgtcacgtatcattttgcgttcgcaacagacattaaaccttttttggtccattaactgtgtaagaaaaaaaaatcacaatcagcaggaaagggtttcgtattcaacctccattaaatttgaaaggagtggttttatttccccgtttgggatggttccaatcaccataaatagaccaaccattttcacgacggagcatttcagaaccgccgatatcaccccaccctcgttcctctccaaccctcggacccctacaaaaaaccttgatcaactgaccacccaccccttttttgaattgccaaaccccgcaatttttgaatcggaattcgtcccatagaaattgagtcaaaatcccacagcgttctacgcaaatttgaaagttccaggcacttaatagttcctttcaaaaacaaaactttctttttggatgcgccatttttaccatgaaagatatgtaacaaaataaaatttgatgccaaatatacaaaacaaaaaaaatgattgtgcagagaagcgatcacaactttttgtcaatccgttctttttcccacatacgcctttggtattgctgagccaaagaattgatcaaggaataaacgaaccaaagaatctgaaaaaaaacatttgaattcctacaaaatgaaggaatttctatttaccattgcagaaacaaaataggacatcactgaaaacagcagaatttaggtgagaaagaaggtggattactcgccttgttggaggagacttgaggcttgttccggaattgggtccccgggccgacggtggagactgatcttttgggcttgaaggaactctttgagcggtgcctgaagaacagtgccaatccgtgggattttgttcaacagcgagaccaaatgctcaacgtgatgttcagaaaaggtgagcacaacgaacaacatctgacagtggaatgttgtattagggcaaaaaaagtggaatgagcaaagcgaaattgtcatttttgggagtgacttatttgaaaaaattgactgatcagtggattaaaacgaaattggtcaccactaccaactcgaccatcgaccaacctgcatgtgcatttttacgagtgcctttccgattaaagtcgcgccgaaaaatgtccaaaaagggatgagaaagtgaccacaagtgatgccagccaagtcgaagaacggattggggatggaagcgaacaacaaaatgccaggaaagcccatccgcgtcacggccctttccatccaaagttttatccgttccatcaaattctgagggtacgaacgtttgagtaccggaaaaatcgcatatttaaatcaaatccccaccatttgattagtcgcatcgcgttcgacaattgcgatgaattctcgatattcctcgctgtccggctcgtgtcccgacagtcgcgccgctctcgccatgaaaaagggcggcaattcgcccagtgcggtgcccgcgccccacatgagtgactccaagcgcacctgcaaatgccaacgaatgtttttacgaacgatttgctttaccttcgcaatgattgtccaaagcgtaaccaacgaagaatgacccatcgcatctgtggaacaagtgacactgaacggaatcagtgaaattagtggagaaaggacaaatggaagggaaactgactcatcgggatatggcggttcgggaaagtccaatgaattgcactcgaaggcggcgagagtcactcgggcgatgtgcggtcccttaaaaacaaagcgaagaatggaggaaacggcgggaaacactgaccaaataaaggagaaaagtgtgaagacccgtgccaagtccaattgaggagagaacgcccaaaccgagccaatagaaacaccaaagaagttcttctcgaaatg

SEQ ID NO: 20603 - DNA, 1699 bp, Heterodera glycines
  misc_feature (1588)..(1588): n is a, c, g, or t
  misc_feature (1626)..(1626): n is a, c, g, or t
tgttgacaaatctaacaatcttggtattattcgaaaggcattcacaagctctattagccttgcaaaaaacaaacaaaaattttagcttctaaaaaagttattaggaaaaaacctcaaaattttcgacttttttgcaatttcatgttataacttttttggtaattgtctaatcgcgaagcaatagcttagaaatatcttctaaccatgttaagctttcgaatgataccaagattgttagatttggtcaacaagaaaaaaaagttataacccaaaaacttgggctggcgccaaaacggcggcgccaaaacgatacagactcctatttagcctatcttataggttcatggctcctccaaaacataaatataaatttcatgctgattacgagcgtgaatttcaaggcataaaaagaagtaaaaagggcgatgaatatgcgaattgtgtgtcgtgcagtgtgggcgtaccatatctgcaagcacgcacaatccttcaagtccgcggactgtgtatcctctgacggactgttcaggacgatgttttctgattaagcggttgcaagaaaatagtgaaaagtctggtgcaagtgaaagtgaattttgatcaaaaatgttcggaaatgtttaaatttcttttttcacgtcctgaattgctcaaaaaaattgctggaggtgagaaatatttcgtaaatgctcattttattgaataaaaggcaaaaacaagccccaaaacaacgttttaaaaaatgtacttaattttgaccctaaaaacttattttttactactgatttacttatttcggaaaattttcgatgcgacctctgatttaagcataaaaaattaaaaagaaatgaaagggaaagagaaattaacaaaaatttgggaattaatcgtgacaaaatttacaaatggaagagggaattgaagaaggaaatattcaaatttttaatcattgtcccattttgtagaaggtacaattatcagattatcaaaggaacagaaaatagaaaaaattaaacaatttgaaaaagtgaaaaaagaatttacaagaacattcaatttgaaacccaatgggaaaattaatgaaaaaatagcggaaaaaatttgcgttaaatttaatacaatttgtgattggaagaaaaaatcaaaattgataacacgtaatttaattaattaaaccttttaaattgtaaaatttaatttaaaacttttctttttaggagaaagaaaagtttactcggatgctgagaaattggaatatgtgaaaagagatgaggagatgaaaagaagaaacccaatgataagtgatagaaaaattgccgaaaaattaagcattccaattgccaacttaatacgatggacgaagaaattgggcaccaaactgaaccgttagcatttcgatcatagtaattagggtttgcggattttcagtgatttattttatttattgtgtctttaattcggtgataatgcatgaaaaaagttttcatcctgaaactcttcattttaatcttcagtgcaacatttcggcatcgggattcatccctcatccaatgacatcaacatcccaataacagcaaatttagcttanatgctcctcgtaaatgagattttggatgtgaattttanaatcataaaaaatcttagaattggtcgatcatatggggtctttgcattatatgtaataaatctgggctttact

SEQ ID NO: 20604 - DNA, 1913 bp, Heterodera glycines
ggcccagtatgggtgctaaggagatggaccggaacccggacccggcctgggagatagcccttgaaaaactgatcaaaaagttgttcttgatcgaatcggtccgggtccggatcagcactttgggtcctccgaaaagtgtcaggtgggcctccggaaaatgccaaatcacttttcgtactttttggaccggttccggaggcccggaaaatcggcaaacaattttcccagactaattttgacccggggaatctaaactcgggctcggaattccggatttggaaagtctgaatccggactccggaacttttccgaatcttccggatttttagctgaggcgaaacttgtatagtgcatatccccccccccccgttttcatcaacccaatacttaagtataaaaaaagttatggttatttaaatccacaaaaccttaagtcggaatttttgtccagaacttttttgaaactcaattaaattttttggaattataatgataggtaaatagtttaaatagaggagttgaaattctaaaaaaaaattttatttaattctttctgaaaaaaagttataaagcattgaacaggctatgttttttgccacagtcatgcgaatataattataaacatttaaaattttcaagccataaaatgcaattgagccaaaattaatttattattcgatagcgctaagatttctctatttaccttaaaattttggaaaaatttcattgagtttcaaaaaagttaaagcctagaaattatgactcaagattttttaaaattttgacaccataactttttttataatttcatataaacattttttaaattaatattctgagagacaacacacttaaaactattgaggatatcaagaattactaatttggttgaaattgggccaagatacgaatttatatgtcttgcattttttatttcctacaacatggcagtatttaagaaacgatccagcacgatttatatgtgctaaaattctgaataagtatgtacttattgtcttcttttgaaattttcaaaaatttctacaactttatttgttttatgataaactgttatgaaacagaggcaaattttcaaaatctttcccgaactcgactacttaaaccctttatttttgtcataaaattggctaaaaattaaaaagtttgatcagctttgacaaaatccgtaacaaatcacattaagattaaaaaatattcctcagagacaccaattaggaccccgaccccccccccccgccctatattccaaaaaatttaaatgcgctgtaaaaaaatgcttaagcaaaaacaaacaaacaaacgtgttcatataatccaaaatcaatccatccatctcaaatcttactaatgatagccccttctcatgtccatgccaccttaaaccacccaaatcccacacccacccatcctaattcctttttctcttaaaaattaataattgcaggctgaaaatgtaatattgtacttttttaattgaataaattataaaataacacaatttttaccaaaaattaattttttgaataaaaaattctagggagtggtaagggcaaaaaagtccaatttaggggcataaataggggcgagaaaagcgtgaaacatgggcgaaaattctgaaaattgacgtaaaggacttatttaacaattttattacaatagaatttaatttcaccattttttgagcaaaaggaaaaaaggaatttttattacaaaaaattcgatttttggcttattttttcatttttaggtcgacattaaagtgaaatttttattgtttttgtccaaaaatcttaatttttttttgtatctttttccaacaaaaacaccaaaataagggcgaaaatagtggcgaaatgaaaaaatgccaaaataggaacacctactattttggg

SEQ ID NO: 20605 - DNA, 1816 bp, Heterodera glycines
gcgcttctcccgatcagcactgtctacctggcggttctcctcatcagctcggttgtcttggcgcttctcccgatcagcccggttgtcttggcgcttctcccgatcagcactgtctacctggcggttctcctcatcagctcggttgtcttggcgcttctcgcgatcagctcggttgtcttggcgcttcttacgatcagctcggttgtcttggcgcttctcccgatcagcccggttgtcttggcgcttctcccgatcagctcggttgtcttggcgcttctcgcgatcagctcggttgtcttggcgcttctcgcgatcagctcggttgtcttggcgcttctcccgatcagcccggttgtcttggcgcttctcccgatcagcccggttgtcttggcgcttctcccgatcagcccggttgtcttggcgcttctcccgatcagctcggttgtcttggcgcttctcccgatcagcactgtctacctggcggttctcctcatcagctcggttgtcttggcgcttctcgcgatcagctcggttgtcttggcgcttctcccgatcagcccggttgtcttggcgcttctcgcgatcagctcggttgtcttggcgcttctcccgatcagcccggttgtcttggcgcttctcccgatcagcactgtctacctggcggttctcctcatcagctcggttgtcttggcgcttcaatcgttcttcatggcgttttgcccggacattgccatctaataagcaatatttatttgtttaatcttgcatttttctcacctgcttcagcgatggcaataaacaatgccacaaacagaatggcgaatattgtcaatttcattctcagcgaatgattcgaccgagcgaaggaattgccaatgtgtttttgttcacttgttaactgtttaaataacagcgcttcgtttttcttggagctcagaaaccaaagtttatctacaaggttgcccatcacaagatttgatgagtccgtcgaccatttgcgctgtccgccttcgcttcgtcagatggacgaattgtccatggggtggaacgcaattaatttgtgattaatgaatttaaattaaaaaattccgcaacatttttattgcccttgtgactttaaagtggggcaggcaattaataaattgggaatatttgaaaaaattatttttggtttagctttctccactaaattgttattgctatttttttggaatttttcgtaaaaacaatataatttcattaatattaatttatttgtttttcttcataaaatgattttctgaatttcttacgatgaaataatcaatgcaaataattgcacattgattactggaaattgatttcttcttttatttataagcatttccaaagccgcccagcttctcatttttatgaattttttcgtttttctttaatttctttcacatttttatggcgctaaattattttttgttcgtcattttaatgattctcataaataacggcaagtttataataaatatttaataaaatagtcttttgctttttcttttaaaatgttttgtgccttttctcatattctactggttgtttaagttctgtaataaaagagaatttttttttttgtttgctgatttaaaaaagtttcaattaaattgagtgataatttgcaaatgccattcgaaagagaaagttttagcatttttagaaagcgttaaaaatcccgtttggttttttcattttttctgttttaaggctgcgcgcaagattttgagttgggccttccccttaaaagatttgctaacgtccaaatttttcattgcaaaattcaaaacca

SEQ ID NO: 20606 - DNA, 963 bp, Heterodera glycines
aaaagtgtgtgaaaagttaggcgtagcactgagaagcatttttaattggaaaaaacaaattggcaagaatgggtgaagtatttggtaattaataaattaattcattaattaattatggaatcaatgaattaaaatttgaagtaaatattattaaattgggggcacaatctaggaaattggtctaattaacaaaagctttttatttttaggaaaaaagcgattttctgaattagagaaacgaaaaatagtgagacattttatggaaatgaaagcgaacaattggacaaaaatggacaataaaacgaggagtgagaaggagaaagaagtcactatgacctttgaagtgagccgaacgacgattgccaaatggaagtgccaattgagaaagagagggggtaagaaagtgccaaaaaagaaatcaaaaactgaaaaagcattcaacagatgatcaatggtcggaagaggaagcaaatgagcacacatcggacgaaggcaccgaaaatttggacggagaagaggatggacagcaaccaatggcacatgaggacaatgccaatgaaaatgatagtgaaaatgccaattacagtgaaaatgataatgaaaatgccaattccagtgaaaatgatagtgaaaatgccaatggccgtaaaaacgatagtgaaaatgccaattacagtgaaaatgatagtgaaaatgacactaaaattggagtcaaagaatctttgggtgagttatttgtacagaacccttattttgtatgttaaaataatattaaatttttaatacgaaaaattaaaaattaggtcaaaactacccaaaaagaagagatgaatgggaaaaaattgtgaaaatatttgatgaattaaaagaaaaattaattcgtaagaaaagtaaactttgtaatcgtttggaaattgaaaataaaattgccaaaaaattggacacacatcgattaataattta

SEQ ID NO: 20607 - DNA, 1768 bp, Heterodera glycines
ccaaatatgcgaaaatggatgtcagaatcgggttttaggaaaatatgaaaaacaagcccaacggctttttctctgaaaaaaaatgtgggtgagattttagttttgatgctcttaaaaaacccaaattattaagtgattgccaaacattatgccaatttataaaattttaagcatgaaatttaacaaattctgacgattttccccaaaagcctcaaaaatcatcaaaatttctcaaaaaaccacaaaaagcctcaaagcctcttttgaaaatatatgcaaaaatggagaaaaaaataaatcaaaaaccgggatgtcggagattccccggcttggccggtcccgatactggtctttccagctctaatctattttcttgaaaatttctaactcccattcctttatggtattataatagtgaatttttttgaaaatcttcatattataaaacaggaaaaagagccaaattataatatgcggacatggaaatgagctcagacaaaccgaaccaaaaagtaagaaaaaatagaaattatgaatttaatattgtatcttatacatattaaatagaataggaaaatttaaaaatggcagagaataaatccattcagtttttattcgtttttttgtcaacgccaataaattaacggcaaaattatgaccccaaaaagagagatgaacaaatgggagaaatttgaatttaaaaaacggcaaaattatgacttaaaaaagaacaaatggaataaaatttataattttaaaaacggcaaaattatgaccccagaaagatcaaatttggatttaaaatgtaccgaaacagcaaatttttataaataattctttttatccatgtttttgtttaatgtagaacttctaaaaacatttaattctcccattttgataattcatctaatctattcggtttttttaggttagtgtgtcctatctgaagcagtaattcattaatttgttaaattaaattgttggacaatgaccgatcagcaacaaccaaagaaaaaaatgtaataattattaaaataatttacctttatttttaaaaataataaaatatttaggcccattgagctttgccaagaagtagtacaaatgtgcgatcataaaggccctaccgcatttgtaaaaattgccaagataaatttccaattttggaaactcgtcaacgaccatttgcggaataaaaaatggcttcttgattatttggagattgatgaaaaacaaatgaatggaaggacggaaatggttatttatgacggaaccggaaaaatattgccaattccgcaaaatccattgcccaacaaaattagcggcttccaaacgatttggatcacgtaaattaaccgattatagtaaatattatttttttttgttaactttctagttacctggatgcaaatgtgatcgcttttctccacctttttcaacatcttttcacttcgtgtgaaattactttgaccattgaaatgaccaatggtcaatttttgttcagtttggcccaaaatatttggccactgatcaaaaacaacgttaaacgcttttcaatgccgaccaactttgaacattttcggcatcacttcccttcaattctcagcagcgaccaatggccatctctccaattcgtttattgtgaagatgttttgcccgatttcccagccgatgatagtgccaacgcgtcggatggacaagttctgaccaattggctgttttcggcacattcttgtgatttgccaccgaaggtggctcagtgtgaatg

SEQ ID NO: 20608 - DNA, 1296 bp, Heterodera glycines
  misc_feature (1249)..(1249): n is a, c, g, or t
  misc_feature (1278)..(1278): n is a, c, g, or t
aaataaattttccctatattttggaaaaagatatataaatatatactttttttggtgatttaggtttttttggtattttcattgaccaatttttttgatgagtttgtggatcagagcagccaaaaaagcctaataaaattgtctaaactaatcgtttgtctttttatttcaaattcgctccctagtaaaaagattcgccttttgctgattcgttgtccaatttcgcgagatgagcacaaatgggccaagtgggaaaaggaagcgattgaatggacattcgatgatcaatggaacaaattaactttttacgaaaaagacgaaatcgatttttgaacccaatcaaatgaatttttattttttattttgtcaactttttgattatttctgtgatgtatttgattctcttctgtgtctttttaaagatttttcggttgataaacttttattaaatgctcgaaaaattcattccagcggaaagaataaaacatttaataaaatgcaattaatttacattgcacatgttaaaattttaaattctaaattcgtcaaatttgactagtatttcacggactaaaaatcttcgaatttattgaacttttcaggaatttcgtattaaacaattcaattggttgtttcgattgaaaatgatgaacaaaaattagtggcacaaaagcggcaaaaggctattgggccggatgttagcattgactgttttgaattactcttctcattggccatttgtttgtgcttgcaaattgtccaaaaggaagtggcgcaaaatatttgccaacatttgcattcacatggaattttatcgacaaaagggcgagaaattttatctttttttaaaattttttgcataatttttcatttgaacttttcgccctcataatagggcaaaagataaaatttatcttcttttataattaaaattgctgctgaataatacgctatttacagcaatttttatttattttcattgaaatttgcccatattttaccatttttgcgcctaaataattcgctccctatctataaggggtcttcggtctcagttgctaaagcttattcataaaaattaaacaattcctttttctaaatttagctatacaaaatcgaatttcttcgaatacaaaatgaatattgcaaatgaaatggttcaaataaatttgccaaattggaatttgccttattttgtgtatttggacaatggaaaagaattttttatctttaaatatatttttattanaggattcgctagattattgtattatttanatgaaaaatttttcaaga

SEQ ID NO: 20609 - DNA, 922 bp, Heterodera glycines
ttgcctaatttagacttttgtcaaccacgaaatcgctgttcgccaggccaccgttcgcgatctgtccttggtcaaaaatgccggcgtggcgctgagctgtcaaacgctgaattttgggggagaacggcacgtgaccttgattgccaattatatcacggatgattggcgcatcacacggcggacattgcggtgaggggagggggggggggcgtggaatggacttgggagtcagggaaagggttttgcactcggaactgaacctccccgcctcgctcccctacggtttgggtgggcgtggacataaagcaaagagttaaaggcggaggcaaatgccatccgatggatagtccaaaaaacttctcgagacggtcgttccattcacaatgtttcagtgtggagaaggcaactgatgtgcattcgttctctcagctgctccgcgatgttcttgtcgaatttcagctgagtgatgccccattgattcttctgacaatggactcttctgagtacggcgaccattcggaaatggtcgagcaaatgccggataatgtcctgacaatgccaaatgccaacatggcactgaatatggtaccaaagggatgtcaacattgtttctaacattttacaagattctggcccaaagtctgaccgagtccgccgactttgcgtccgtattggcactcgtccgcctttgtttccgcctgatcagtgccgtgcgtgagaccgatcgtctcgggcaattttccccgacggattctttgcccacccattgggcagaaatggcggatgtcgacggacaaaagctaaattataccaccgaaatttatttggcactgaaatttgtgaggcaaaacgcagccgcaattttgactttactcgagagggaagggatcggaggtcattcgttaaaaattgaactttgaaa

SEQ ID NO: 20610 - DNA, 1422 bp, Heterodera glycines
  misc_feature (77)..(77): n is a, c, g, or t
  misc_feature (240)..(240): n is a, c, g, or t
tgtgtacgaaaggattcgcgaaatggtcgggctgagtcgaaaggcgaaggcggcagagacggaaacgaaaagtgagngggaaaataagaaaaagagggacaaatgaacacgagaaaagggggaaggggacaaatggacatgtaaaaaggggggagggcgacaaatgggaccgaccgattgattgaccgttcgattctttttaaacttttagcggaacctttcaaaaaacgccggcgattncaggaagtcgaaacagcagcaacgaaaagtgatcagatattcaatgaactttttcattaaaagtgaatcttttgcttaaaagggaaagattttctgcaccgattggaagaatgtgcgatggaagaggaggacgaattggacatttacttgcgcacttcgttcactcaagaacagactcagtcagtggcaaagtgccgatggattaattaccttcccccccccactttagggacattctcgaattttggtcatccatcggcgaagcacaggtaagacagatgaaaggacatcatacacatttaggcataatgactaacttcgctgcttttcagttcccccgattggctcgcttggctcgtttcattttggcttcttccggcgcgccgtgcccaattcccttgcagcagccgtccatctgcaaattgggaccgtatgaaattggcaccaggcttaacttgaggtgttttgtttgtttttttttgccaaaaatctctcccaaaatatatttttaggccagaagtgctgaattcattggcccatgtgccccaccaatcccaacaagttcagcagcagcagcaacaccaacagtcggcctctcccatggagtgaagcgactgaaccgtcaaaccgagcggagaacggcgccaagcataatcccgaagtccctctccgtgtgaatgtccccccccccaatttgccaatgcttcgtcgtttctccgtttgtcctcagtatgtccctattgggacggcacttccccctcccttttgtcagcagtgttttgctgtcctctgctcctttttgcccttttcctctctctcttttcccctttttcttttctcttttgtgcatttctctctttttattctcttctctttttcactattattattattagaattttgcttcttttgcttctttcttccccttctctctcatctcatcaaatggcattttcccctccccaccgttttattgttcgtactgtaagtagtgatttttgtataccttcatctcaccacactaaccgcaagtttaaccctgtgaatccattgaacaacacaaaataccggtgaatttttactcaaattccctcaggattaattatgtaattaatttaaatgtcgaattgcataagccagcctgggttgggcgtatttatgtatactgtatggaaactactg

SEQ ID NO: 20611 - DNA, 2717 bp, Heterodera glycines
aaccggcgaagtcggcacgatcaaagcgaatttggcggactttgtgccgttggacgacgacctgaacggccttctcccttgcggcaccagcattctccaatgccaaccggacaatgaacggatcaacggcatttgtccacccggtgcattgctaatcatcagaaaagatgtcaccgaggaaaagttggaggaaagggaagtgatcggaaatgaatttcaattttaagatatttgatcaatcttcctacatcacttggcccatcttttgctgatcgaaatgctaataacgaaccaagaaattgccgaaataagccaatggaaacgatgaaagcatcgagcagcagcctttgttataaaaacagctgttttttgtccgatttattgtcgagtacgagcagaagagggaatttgcggctgctcgaaagtgagccgtttgctgacgaagcggcaaccgaagcggaaacggagctacttttgttcgcggaattggagcagcaaatggacgaagacggaaacaaacagaaatacccggatgaagaaatgccgtgccattcagcttcatcttcggcattttctgctgacaactgtcacgcccaattgccaattttttgcggtgtttgttttgccgaatgcgccgcctttgattctttcgcattgcgccgctgtgaaccgttcggtgcgacacacactttctgcgacgactgctggcgacagcacattggccaatgtttgagcaacggccgagtgccaatcagctgcatggtctgtggaaaagcaatttattccatttaaattttttgtcatttttacggcttttcgctatggcttttgtgccgtttaggcccctaattgttcatccgtcgtccgcccttcggtcgctttgcttgttgttggacaacccattgcgcagcggtaccgtcaactcatggtcaaacgacgccgtttgtgccgcgacttcgtcgtctgtgcccaatgtgacggcaccgttcggctgcgtttgaattggcaaagtttggcatcgctttcgcgcaaatcgcagccattggcaaagtgtgcgcattgcgaagagatcatttgctgtcggtgcgcacaaaggcagcatttgccgctcagttgcgaagagcgcgaactttacgagctcattctgcgatcacacggtgaataaaaatggaatataaacaaattaagggatttttcgattaaaaaaaatattatttaaattaattccgaattttcaccgtattttcacacgtgctgagtcgatccacaaaaaaactcagtgattgataaaataaaaaaaagtaattataaaatcggtgtcaatgaatttaattataattaaatgtaattataaaatcggtgtcaatgatgctgttaatttttgttttcattttcctcccatagatgacaaaagatatttgtgcaaaaaattttgaacgaaaatggcgaattttatattttctaatttaatttataaaattaatcgtataattaaattcattgacaccgatttgtataattaaatttaattaggggtcgacctagcaccttttcacattccccaggccactccctccaatctctgctcctttcccccggcttaaatcgcatcgcccgcggcgttcgctgcgacaattgcaacaatttggtggagaagaacaccggctgtgaccacattgtttgcgtttgtggctacgaattttgttggcgctgtggcggcgattggaaaaggcacaaaaattgcgtgggccaaggacgaattgtgagtgaatggcacaatgaaacatggcatttttgaatctttatttaatacattttgttagaacgtgccactgtttgatctcgtctttgtaaatgggcaaaacggaagaaaattggcaaaatctccggagaaattcttcgccgaatgtgccgagttcagagcactccgtcagcccaatgggcgcaaatttttcaaactgatggaccaaatatttggaaacgatcgcccgaggggacgccaatgggcggagaaatacattcaggcgagaaatattaattggccaattaggcaattaattagaacattttaaggtgtcagaatttgttgaactttgtttggcgaagcgacagataagcggcaaaaagtcggacgatttcagcgcggcgacagaccgactccgattcactttccgcacaattccattcattgccaaaatggacaataaaatgacactaaagacgatcagcagggatatggtggaacaaaattacgagcaaatggtggcgatcagcaagcacattatccaaatgatcagatgaaatgtgaaggaacggataaacaacttgcatataaaaaattgtttattgttattgttaactgattggatgtttaattaatcaattaaatagtcgcgaaagtgattgttaaaattaataatttttatagattcttaacatttctagttactttatactttaatttttgtgtagtccaatgaatttttgaaagtttgcatactaatagagactgttaagcgctttgaatatgtcaatttttcacattttagcgaattatacataataaaaggaatctgggtgttttaaaaataaatttgattatggatttgcaattctgaacaattcggccattggatttgagaataaatttcgagaaatgttttgcgacccgtcgaataatgccaagactttttccacaagaattaagcaattcaaaa

SEQ ID NO: 20612 - DNA, 1721 bp, Heterodera glycines
ctccagcgccatccattttcagggctagttgattcggcaggtgagttgttacacactccttagcggattccgacttccatggccaccgtcctgctgtctatatcaaccaacaccttttatggggtctaatgagcgggcactttggcaccttaactccacgtttggttcatcccacatcgccagttctgcttaccaaaaatggcccacttggagctcaaacattcaacgcctgggttcagagtcaagcaaccctggcttcatacccatttagagtttgagaataggttaaggacatttcgtccccaagtcctctaatcattcgctttaccgagtataactgcttaacgagctccagctatcctgggggaaacttcggagggaaccagctactagatggttcgattagtctttcgcccctatacccaagtcagacgatcgatttgcacgtcagaatcgcttcggacttccaccagagtttcctctggcttcatcctgctcaggaatagttcaccatctttcgggtctcagcgcatacgctctgtctccgccccatcgcatgcgatcgagacgggactatgttgcgccccaacaccgcagtgccagggatcacacatcagctccgtaagaagccttcactttcattgcgcctttgggttttgaacacccaatgacttgcgcatacgctaaactccttggtccgtgtttcaagacgggtcgaacagatgaccggcttttacaccgagaacgcacaactgagagcccgagctggaccgaactggtgtgctggtacgtgtcgcacgcgaccgccaccgacccccagctcgagtcaacacggacccgaaaccattgcacaattcacccagagtaaacagcactcccccggatccgggtaccagaccccgaaaggctggcctcaagaccgagctcacgcagctactccgagcatctcagcgcactccgcctgcaaatgccccattcgccactgaacagaaggacagcaaaccccagtctggaggctagcaggccaacgtacagcaacaaacgggtgaatgcagaccagatacgccagctctgtccgtttccacctcatcggtttcacgtcctctttaactctctcttcaaagtgctttgcaactttccctcacggtacttgttcgctatcggactcgtggccgtatttagtcttagatgaagtttaccacctgatttgggctgcgatcccaaacaacccgactccaagacacgtaaagatgggtaggcaccgccagttggacaggtcttgcaccttctctggagccccggtcaagggaaacttgaacaagcgggccaacccaagctcacggtctatacgctacacctcgcaaccccagaggagctgcgattcagcgctggactcttcccagttcactcgccgttactacgggaatcctcgttagtttcttttcctccgcttactgatatgcttaagttcagcgggtgttcacgtctgagttcaggtcgaaaaatcaaagcaggaatgccagtaatccaggcactccgccacagcatgcaaagcattggtgcgcttgagttacggtccgtaaaacgcgaattagaaccacaagttcgcgccagcacaccaaaaccccacagccgagctgagcaagtaacgtaagaacacgtacaagtacatgatcccacgaagcaacgcacaagcagtgcattttatggtaacgaccctg

SEQ ID NO: 20613 - DNA, 1740 bp, Heterodera glycines
atattcataaataattattaatatcttaaaaatagtttagaaattaataaaatgaaccaaagaacctgacaaatgaagtatgaaattaaatttaaataattaatttgcataaaagcaaaagcctcgccattatattaaaaaagtatatattatttttttataatattatataaataattttaattttatcccattatacaaaattaattatatttgcaattgaccatttttatattattttttcattcatagaacttcatggcttccagcttcaacttaaatatcaaaattaaatgattcaaattcttaataccttacaaataatacttcgactaaaaataggtttattaactatttgaaactgattatattctatatatttaatataaaagaatttacaaattactgttatgctttatagacaaaaaaaagtatcttcgatacataaattaaatgcttattcttaaatattcttttaaataaattcaaagattaatgaattattttgtattaattttaaattaattatagattataataaaaataaatatcaataatactactatttattggatttttgttttatatttaaaatcaatctgcatgaagcgcttcttgaacagttgcaagagtttagcagaaccgaaaatttggaagaacatttatcatattcaatgttatggcgtcaagaattttctttgcatgatcaataaaataaaataaaaagttaagtataaaatattatatattgtgactaaaaagtgaagtagtaaatgaaactttaatgtaatgaaatgaacaactgatttaggtgcaaaccgttaagtcttattaaaatgtatttattatttgttaaaaattttgaatcaattagtcatatttaggcttcagatgaactcgcgctgaatataattttggatccatatgcggctaagcacaattatgcaacaatattggttaattcatatcacatacattgtcgacaaatcattgactccagaattttctgaaattaaattaaactaataaattacttgaataaatttattaaacttcttatatgcttttaactagaaaatttggcaatgaattatttacaaatttatcgataaaattaagaaaaattttaagcataaaaatataaaactaaatccaaagcaatatacgaaaacatagaaaaggttatattaatataattttgatttgtgatattaaaaaaacatacttctagtttaagtaaatggattcaatacatcaaaaaatttaaaaatgtatattcaaaaaacatttgaagcgtcaaacctaaatgagttggaaaagcgtaacaatgcgatagtaatatcaagaatgaaaaaaattaaaaaatgcacaaacgcagtgaaaattattttataatttaaaagaatacaatataatagggtattattacagaagagtgaattttaaaaaatttgcgtataactaaatttatagcaagacacgcacgtcgatctgaaccgtgcaattggccaaccgctcgcttcagttcttcgaagtttggcacaaattgcttattcaaaaatgcaaaaaaatatagtcgataaattaaataaacaaataaaactttaaaacacaaaatttgaaaaacaatcatttctaaaattgaactgattatagaaaagtagataaatatgtctagagcataagacaaatcactaggaaggggcaaaaagtttttttgtatacaattcatataagcaa

SEQ ID NO: 20614 - DNA, 1377 bp, Heterodera glycines
acaaatccttttccaacaagcgatgaatctcagcgcaagttaaaaccaccacagaatggcaatgtgcacagctcgcaaaacaaagcaatacccgagataaaattgactggatttgtcggatttgattcgctgccttaccaattggtcagaaagtgccaagaaagcgggtacatttaactagcatttttcgctattttatttgtttttgtggccccttgcctctccagattccaattcaaccttttgtgtgtcggtgagacaggaatgggcaagactacacttctcgaatccctcttcaacatgaaaatggagtttgagcaatgcaaccgcgaactaaagacagtcgaactccgcgaaaagactttcggtattcagctttaaagactaacaaacacaacattttttaaagatgtacaggaaggggctgtaaaggtaaaacttcgggtggtggagactgctggctttggcgatcagttggacaaggaaaagaggtaattcataaagtttcgctaattgatatttgatgataaccccctttcccgcctcagtttgtcaaaggacatgaccggccgtaatgaagtctaccgggcgccagcaatctgcgcactgtgtctcattctgaccaacaccttcatgctccaggtggcgggggaggaggtcatctggaaagccattcctcaaaatcgaaaaattttatcatttttggacatacataatctgttaacagacccatccaaatttggcaaaatgattacagatttttaaaacttttttttttgccagggtatcgagtgctacatgaagcgggcgattgtgggcaaaacggctttggtgtcctccgccgctttggtctcatcgcaccatttgatgcgaaaaaatcctgaggttggatttttgagattttttacgccatggaaaagtgtcggaaaagggaaccgtttcgccgcccctagaaaaatgtccgtttcgccgccataattgttttttttttattttcaaaacatttgttatagcggaagttaagctatccggctaagcggaaaaataaattaacaatcttatgcacatgtgtggccgacattctcaccagcttcaaaaataaacagccatacgaagaacccaaccaaattcagcagccgtacccacaatttagcggtttttaaaataataataataaaaaattttgagttttttaaattgtggcggcggaaaggacatttttctatggcggcgaactggccgaggcgaaacagtccgtggcgaaggggtcggagtcgttttcgcgtggggcgaatttttgaactatagctttttttttgtcaaccaaaatacgatagccccaaatatcctttattacccagaaaaattgtgaaaaaa

SEQ ID NO: 20615 - DNA, 1506 bp, Heterodera glycines
ttggggaaaattggtcgggtttttttaggtttgggggtcatatagtgttatttatttactgccgccatttttcgtcaattttttagggcgacacagctggtgattttgtcgctgcgtttcagtcgatgaccgatgcaaacgcggacattctcgacaagctcggaatgattgggaaaggaacgttcagtgtgttgaaatttgctgggccagttggccagatcatacatgctggtctttcagtagggttacaggtttaggtgtgaagaaattcaatgaataacttgtgttgtctttacagcaagactccgaagagttgcgtgcaatccaacaacttcaaagtcaaattgcgcatcaatttgtggcagtggcgcggaagatcgacgattcggtacaacggctacactacgcaacaacgatgaatgattatcagaaagtctgtagaacttttttagtcaataaattcattctctggactaactggtgtgggtcgaaccaactaaatgaactaggcatagggagtattgaataccaaagtatggtgtcagattctgcttctcgggagagcgtggagttcctggttttttgtttggacaatataaaaatagaaaaagtttatctctatttagatggttggattccatatcaatgcactcgagcgcctgatgaacgacatgatccaggcccccagtgcaagagcgctgagacttatcacgactgagtgtgagaatggcccgcacacaccgcgaaaaattttgcgtgtatgtttcgccagtttaatctcagacttggtagactagaactacgattttcacttttcctgagcttttttacattcttttcccgcctgactacatatcattattttttaatgttttggtatatatattttagtggattaatttgattgccgatcaaaattgtaagctccctactgtgaatgaagcaaagacctacgcgagggcactcgaggtcacaacccaaatcaaaaaattggcgcaaagacaaaatcgtatcacaaattcgtctttttatgccatgtggcagtccggtaagatatccaaatattaaaaaacaaacgaaaatctatgcttattatcttaaattatacaattttaaaaaattcatgggatgacagaattgctcgtcaatctgatgaaactaccgtatgcaacggggaacgagcatctcggctacattgaaaacggtgggtttatatcctacccaagacctgacctttatcacttaatttcagcattgttgaaaaagcagatcaatttcgagagtttaaaaacacctcatgaaatttcacagcgcatggtaagctttttcatagaaaatcgtttcgattcctaccacgcggatgtgcatcgcaatgcaagtgctgattatttcgagtaattattgtaaatttctgacgttagacccttccctggaaatggatctgcttggacaaattgccgcaaaatgttaagcctagacttaaaaaccaagcttcaaactttcgtt

SEQ ID NO: 20616 - DNA, 1137 bp, Heterodera glycines
tataattagccctctcaaattttcctcgggcctcagaaaatggctatctcttttcggccaattttgtaccgatcaaagggaaaatggcttaattcaggccccaatgtgcgcctgaatcgctaattagcttggcacttcggaatattacatataaattagccctctcaaattttccttcgggcctcagaaaatggctatctctttttcggccaattttgtaccgatcaaagggaaaatggcttaattcaggccccaatgtgcgcctgaatcgctaattagcttggcactttcgaatattacatataaattagccctctcaaattttccttcgggcctcagaaaatggctatctctttttcggccaattttgtaccgatcaaagggaaaatggcttaattcaggccccaatgtgcgcctgaatcgctaattagcttggcactttcgaatattacatataaattagccctctcaaattttccttcgggcctcagaaaatggctatctctttttcggccaattttgtaccgatcaaagggaaaatggcttaattcaggccccaatgtgcgcctgaatcgctaattagcttggcactttcgaatattacatataaattagccctctcaaattttccttcgggcctcagaaaatggctatctctttttcggccaattttgtaccgatcaaagggaaaatggcttaattcaggccccaatgtgcgcctgaatcgctaattagcttggcactttcgaatattacatataaattagccctctcaaattttccttcgggcctcagaaaatggctatctctttttcggccaattttgtaccgatcaaagggaaaatggcttaattcaggccccaatgtgcgcctgaatcgctaattagcttggcactttcgaatattacatataaattagccctctcaaattttccttcgggcctcagaaaatggctatctctttttcggccaattttgtaccgatcaaagggaaaatggcttaattcaggccccaatgtgcgcctgaatcgctaattagcttggcactttcgaatattacatataaattagccctctcaaattttccttcgggcctcagaaaatggctatctctttttcggccattttgtaccgatc

SEQ ID NO: 20617 - DNA, 2402 bp, Heterodera glycines
aattttacattttaaaattttttcaattttaaccaaggtttgatatgctgtcaagtgttttttggtcttttccatctcatgcatacatttccagattaatttccactgttttttctttttattttttgacaaggaatatgtgtctttttccctgtactgcctgtacaagattaaccttttcttttgctattcagcaaatcataacatttacaatatttgatgggtgatggcattgtttaaaaagaaaggagggcgtttgatttgcttgttttgttaatttctaaaaaaaattctaaggcataaaatattcatattatttttcaggtttctattggttttggataaacttattaatccgaaaaccggccttacaaaaaccttaaattcttaccattttctagttatttaactcaataacaaatgttttccgtgccgatgccgtcttgtctgttaccgtcaccttcttcaacgtctctgactcccgtccaaacacccgttctctcgccaattgtaaatgattcacgtttttcttatcacgtgccgatgccgttctccccattttcaccgcctccgactccaactttttttcaaacagccgttcccgtcacggatgacactttgctccgtctggccaattttgtgcgttccaccaacagtgacactcaacaacaacaacagttagtccgacaacaacaaatggctgggattgagagcaaagacgacggttaagaaaaagcaatattcttcattcatcaatgtttaatttttagacgcccgccgcatttctgcagcgaatattgggacaatggcaagggtggcgatgctcgaattagtcagaggtattttcaaaaatattttaaccatgccaatagaactgtcataagctatcagtttttcataccaattcttccactttatttatatttgccgaattactgactttcagcccaagtacgttcgccaattgtggactttctttgtatggtgctgtctgacttcaaccaatttggtcacttctgttctttcatcgatagtcgtgaatttaaaattcttgtaagtaaaaaacgaattcaattttataatttcaattttgacagaatacaaaagcgtttactgagcttctcaatcttcgctctaaacagaagccggtgagtaccattatagaaaatacgacaaaaaaaaagttattttaaaattgaattattccccttttttgacagaagtcgtatttgcaagtggcgcgtgcccttaagggttacgagggtcgattggtggatggccatgttatgttgcgaaaagtcaaggacaaaaggaaccagtttaagttcttcccggatttgccataatttgagttttacaatttctcattcatagtgacttttgatttttcagtgtatgtgcctttatttttatttaattcgcaaaaagtggcggcatttgattttgtttcatattcaattattaatgttttgatatatataactgtccgtctctttttaagtgcagttatttcacgttttactttgtttatttcattaattggtactatataaacagtaaattggcaattttttctcatttatttgccacaagttttcattaggcatttttcaattgacgatgtagagtgccttgattttatccattaattaatgtttgagattaaccgataacagaagaagtcaatatggatattgcgaaccataaatggggtagggaggaaacggcggcatggcacagagaaatgatggataggtaagaaattgagatttagccaaagataggcaggtagatcgctccattttctgcaattttaatatacggcgaaagaagtgaggagagaaaatccccaaaattcaacattttcagaaaattatggtggggaaatctttcattgctgtgacgaatgttgaaaattttaattaaatcgtacggcatataaaacgcaatggaaatggaagtgaataacacataaatgatgtttttgttatgaagagggggacttgaatgtggtggtgttgctttgttgtgcgcctctagctctggtaatctagctttatgatacctgctgaactcatacagctaaatggccagagcgacagacacaaacatttgtttggagattaaaaaaaattgttgtggtggaagaaatactaatctgcgagatcagcctttatcaatgtcgggatggagaggagtattccgtctgatgacgatttggcagtcagtctctgtcttctcgtaatactaactgcccacgagtgattggaaattgatgaattgacgcgatgaattttatgtattattattattggaattggtttggtgatagcgtcgggtgcggttagatagtgcatacaaataataggaatgattggaagagagaaacatttgataatatt

SEQ ID NO: 20618 - DNA, 1448 bp, Heterodera glycines
aaaaatcgcccatttcccgccactatgccaattttgggcggggacagacctaacgggggagatataaagtataggtattttcaagacaatttagtcctgtactggggagtatccctgcaaaagttggtgaagttcagatagcttttcgaaaaattacttggaattaaattttactaaaattataagcctaaaaaataaggttaattattttaaatattttttcaaaaaatcgcccttataaattgcattggatattttcaagacaatttagtcctgtactggggagtatccctgcaaaaattggtggggttctgatcgcttttccaaaaattacttggaataaatttttactaaaattataagcctaaaaaataaggttaattattttaaatattttttcaaaaaatcgcccttataaattgcattggatattttcaagacaatttagtcctgtactggggagtatccctgcaaaaattggtggggttctgatcgcttttccaaaaattacttggaattaaatttttactaaaattataagcctaaaaaataaggttaattattttgaatattttttcaaaaaatcgcccatttccggcactatgccaattttgggcgggacagacctaacggggagatataaagtatagggaatatcaaatctattcccgaaggattcatcctcccgaaactgtctgactgttcgaaaaaattttttaatttaagcctaaaaaatttgtctgattattttaaatattttttcaaaaaatcgcccttataaattgcattggatattttcaagacaatttagtcctgtactggggagtatccctgcaaaaattggtggggttctgatcgcttttccaaaaattacttggaattaaatttttactaaaattataagcctaaaaaataaggttaattattttaaatattttttcaaaaaatcgcccatttccggcactatgccaattttgggcgggacagacctaacggggagatataaagtatagggaatatcaaatctattcccgaaggattcatcctcccgaaactgtctgactgttcgaaaatttttttaaaattaagcctaaaaaattttctaattattttaaatattttttcaaaaaatcgcccttataaattgcattggatattttcaagacaatttagtcctgtactggggagtatccctgcaaaaattggtggggttctgatcgcttttccaaaaattacttggaattaaatttttactaaaattataaggctaacaaacaaggctaactattttgaatattttttcaaaaaatcgcccttataaattaccattgcaatattttcaagagaattgagtcctgtactgccgagtatccctgccaaaattggtggggctctgatcgcttttcccaaaagtacttggaaataaaatttttactacgattataagc

SEQ ID NO: 20619 - DNA, 1050 bp, Heterodera glycines
ttttcactaataccctaactgtgctaatcgtttccttgattatgggttaaagcagataatgaattctaaataagtctgtacttgttgtgtggtgctccgggcggttatggtaaaaaaataaaacgaagaagtgttttgctatgtcaggcacaaagattttgaagttcactgttgtgttgacttttaggctgggaatggacatgaaaaatggcaaactaatgttcggcgattccttaagaatttgaaaaaaagaaataataaataacaataatttaaattatataactctcttacgtaatttgtttcgattgttttaaatggcatcacttgtggcggactgaacaacaaaaaattgccttcaatcttaaaaatttgcattcaaattacaataaaatcgagagcagcacgaccaatccattattatcgttttattaattttcttaaaatattttttaaaaggaaaactcattaattcctctgttaatttgactctccttccgtttttgaaaacccctgaggttctataagcctttgaagtaaaaatcttttttctcccactattcttcgccaatatttctcactttttttggaaaatattctcaattcattttcgatatctcaagacttttagccctttgtcaactgattttcgaacctcaaatgacgtcatttggtcaaatcgcaatttttcccaccatttttgtgggaaaaattcctcttcgccgtcactgatattactgctcagtaaaaatttgccattcagttttatgccatagctgaagttggtgaatgcaataataaactcaagcagctgactcggtgccgttttgttcaaccgacggtttaaacgaatttcgttctgaaaaatcgataaattgtttaaaaattataattattaattaattagtccaacttctcttaaaaatatcgaagcaccagctgtagaaatgccaaatctcatcatcaaatcctctttcttttctttgccgtttgatttattcgcttaaatgttaaaattggttaatattttctttcgtcaaagattaactg

SEQ ID NO: 20620 - DNA, 1288 bp, Heterodera glycines
  misc_feature (84)..(84): n is a, c, g, or t
ttcttttccgaaccgttgccccgcagagtgaagttgacaaattgcattttttctctcggtatcagctggacgaagatcaaatgnccagccgataaattgccgacgatggaaatgtcctttttgattatttgcttacaattttcgactaatgccgaaccaaatgtcggctcgtccggttccaccagctccgaatcggatggacggacaaactcaaacaaaattgacatgtaaggggaaccaatctaacagatcactttcatttaacacaacactttaaaaaaaacatcctcttaattttaaaacccttttttatactggagactaataagtgtacttaaaatgaaaaactatcatagaagcggcgagatcaaggaaagggtcgcgaattacgttagactaactctgagagggatttgtcaaacgcaaaaagtaagggaactcaatttttgctaaacttccttaagaaattcgctaaaattatacaattttctgcgttcgacatattttttttcttgcgttcgacaacttttgctgaagaagattcgtcgaacacaaaaggaggggttgaaaaattcataaattttgccaaatttttaatatttcatcaaaagtcccaaaatttttcttaaaattggctcataattgcaaaaataggtcattttttggacaaaatcttttaacaaatcggataaaaattacaaaaattgtaagctgacgacgcatatcggcaccgccggaagtgatgtgaaaagcaaaaaataaagaataatcattttgccgctgacccccccccccccttatttgttagtgggggtcatagccgaatgcatgagctcccccccccatgtacacgtacgtattaagtcaatgcctaaaaaatgtagaattcggagatgcgttcaatttttagaaagtattgatcaattaagattattgactgatcattaggtgggcaagctgtcatgcattcattgcccacgctttcatggtacaattgcagtgtcggaccatttcagcttcaaattttgctccgtctcatggtaatatgtccaatcccatcatccaaaatccggcacaatccttcaaacgcgctcctctattcgccagcttcttatgcgggtcatgcttttccttgtccgctgggtcgagctcaatgtgttaccttgcagcgaaaagcattaaaattaatagaaaaatttaatatttaatttcccaaagattacttgtcgcaaaggtgaacagttcttgcgcattgcttaaagtgtatcactaattggcgtatggcgtc

SEQ ID NO: 20621 - DNA, 2340 bp, Heterodera glycines
aaaaaggaaaaaattttctttgttgaaaaagcttattttaaaaaatttattttttcaaccatatgaaagtcaattattgtgattttttgaaaaatcgctcaaagttaatgaggtgattctatttacatgccgcaaatttttgtgaaattaaaaaactcaggcaattgctgtttggccggttaaaatctttaaaattcatcgatttgacgtaaatattttcagagttcctatataaattaattataccttgccatataatagcgaatagtttctcttccccaaatctgagggcagaataggtaataactatatggcagaggtacgcataagtgtcattatagcgatcagaaaaagttaaacatgtaatgaaattaaaaagtattatttttcaatacactgaattattgtgcatgtttaattgtttctgtccttgagttcccattattgatattcacattttttgttgtggttcgctgactggcccctcggggcatgtgtcgcaccaatgcggttcgctgactggcccctcggggcatgtgtcgcaccaatgcggttcgctgactggcccctcagggcacgtgtcgcaccaatacggttcgctgactggccctcggggcacgtgtcgcaccaatacggttcgctgactggcccctcggggcatgtgtcgcaccaatgtggttcgctgactggcccctcggggcatgtgtcgcaccaatgcggttcgctgactggcccctcagggcacgtgtcgcaccaatacggttcgctgactggccctcggggcacgtgtcgcaccaatacggttcgctgactggcccctcggggcatgtgtcgcaccaatgtggttcgctgactggcccctcggggcatgtgtcgcaccaatacggttcgctgactggcttcggggcattgtcgcaccaaagtggttcgctgacattccctcggggcattgtcgcaccaatgttgttcgcagacaggaccttcggggcattgtcgcaccaatgtggttcgctgacaggcccttcggggcattgtcgcaccaaggtggttcgctgatattcccttcgggacattgtcgcgccaatgtggttcgcagacaggcccttcggggcattgtcgcaccaatgaggttcgctgacgtgccttcggggactgtgtcgcagcaacttttgcatctgcattcttattgagatgtgtgagccctgactgatggatttcagcacaggacgactacactccacggcgaagaatgatgacagaataacctttttgcgcaattttaaataaatatttttattttctgtgcatcatatggttattttcctcatactttgtgccacatttgcaacactttctgatttgttgtttcagatgccttctaaacaacaaaatttgagaaagaagatgcaagatgtgtatcggcgacaggcagagcgatctgtcagtcgggataactcacccgtctcagacgggagtgcagatgggaatggagaggcatcggcgtatctccggggcaccagcaccccaagcttaagtgctttgcaaataagcacgccggcttcttccattggaagtaaaaagaggggaagacccttgagagccggagcgaagccaatcttggctacccaagaaagggtgtctctcattgacacacctcgaactgcggtcactcaaagtgaccagggttcgccgtgcaaaaaaaggggaaaggtcgccgagtgtggccaacccatgtttgcaaatgaagctattgctttgacgcctgtttcgactctaagtcgtggagggcgaccagttaagcaactgggagggcatgccggtaaaggaagaggcaaaaccaacgagtctatgagcaaatgctctgaaattgaccaaagtgtggaaaacgctctaagtccggcaccctcgcacattgtgcctgaaaagataaacttcagcacagtgcaaattaatttcgctacatcgcgaaattttgcctgtaaaatttggaaatgggcagcaatcggcctttacgaacgtgatggcgaaacaccgattgccccaagctctggcccaagatacattgagacctgttggaatgatatgacccagtttctcaatgacggctttgctgccacatacttggcatacttggcaaccatatcacaacgaaaagtggtcgttgttgacccaatggtatggagcaatggcctggacagagtcatgccttacaaaaatatgacatttgggtacgaccctaatgttccggcagaagttatacttttgccagtacatttccctggacattggactctcattatccatgatgtgcaatttggcactcattttgccgattctttg

SEQ ID NO: 20622 - DNA, 731 bp, Heterodera glycines
gccatcgaatttcaagtatcgtatttttttaagtatttattacatgggttttggataatgtttgttgggttggtcaaaacattttataatggaaaaagcccaaaagcccctcccggggcttggccagcggttcagcagcaacagaagcagccgaaaattgatggaatatttgggcaatcaaaaaagcaaaaaaaaacagtaaaacgatagcaaaaagtgggagacttttgttgacgggaagcccgggaggatcatgctcagcagaagctaatccaatgtaagaaatgccactcaatcaccggcaatggccaacaacaggattttggccgcccaactgccccatgggccagggagggaaagcgaaacaggagggaaagcatccccccatttcccacgagcgggaagcggttttgcctctcgagactctcgaggtgtacatttgagccatttttaaagcaaaaggcatgacgctgaccatctcggcagcagcagcagtagcagcagcaacaacagaagggaaaagcatagacaaaatgacaaaaagcaaaacgtaaaaagggaccggcggccgtctgctgtgccctgtgggcacacataacaagcggaggaggaggaaaagccatgggccataaggccgggtaggggaggggggggaaagtccaccccaaaaacaacacctgacagactctgactgactgatgggcttttgctgatcccataagatggggggg

SEQ ID NO: 20623 - DNA, 1657 bp, Heterodera glycines
tttaaacagtgttgccagtgagtgcgtttcgcaaacccaccagaatgggaaaattgccataacttttaaacagattcggtattggcaccaattttattctctattatttagtaaataacttttttagatttcataaaatttgcatcaataataattttaaatcacaagtttttggaactgtaccttttttaggttttataattatgtaaattgattgaaagctagttttgcaaaaattatgaacaaaatttactaatttggtggctttatgaatcgcacatcacggggggggggaaatttaaatggtcttaattttaaaaattgtcgcaaatacagcaggtctcgccgcaacggcctatcttctgggccaaaaatatttcattcaaaattttgtcaaattgtgaaatttattttaaaattttaggattgataaaacccggaagttcccaatttaaagtggcactttgaaaatttgtaaaaattaacaaaaaaaaatgcctatgtcaaagatgaatgaaaattgtacgtgtgtgcgtgtccattgacaaaaaaatgccgttggggacaacacatgaccaattggcacacaaaaggtccccccccaggggacagagaatggcatttttgctgcccattcaagcatggcttgatgagagggcctctgctgccccgtgtgagtacggtacccgccttttggcaccaccccaccaccagtgccctatcattgtgccgggaattgttgtgccaatctcggaggcaaaaggctgcaaattgggccggggcggggacgggggacccattggccaaagagttgggcaatgaatggtcccgccaggcatttgtggaatgtgtgagatgggattttggatggatgaatggccttggcatttgccacacgaccctcgagggagggaagggacgaatttgggccaacgaaaaggggggagggaagagaagagagagagggcatctgttggacactgatttatggcatcggaagacaaaatgaattatgattatgatgaagaggaagagaatgtaaatgggagggagcaaacggagcgcaaaacaaaaggagagaatggcaaaaaaaagtgccaacttttaaaaagcatagcgattggaccaattttttttattagcatcattatctgactgaattggcctaccgcggggtcatgtgacagtccacaacacagggatctgatccgacgttacccaggaaagtcgcggttgccgagccgaccaattagttaattagttcattaggcggtgttcattttttgtcccctccagtgaacggtgccttgttgttgttattgttcaactcgctgttctcgatgtgggttcaagcttcttcctgctggaactgatttgaatcagcttacggaaataagagaaagaaatttcgcactgaatgttctccccaaaaatgggcaaattgtaataataatggggggaggacgggagggggcgggtgactgatggacacaaaacaaagaaagaagcggcgcatttcccgaggggaggggggggggcgatgccaggacattagcaaaggtgggaggtggtggtggtgatcagcagccgaacaacattataatgatgatgggcatggagggagatgcacaaaaccatcaccgccacagcccatttg

SEQ ID NO: 20624 - DNA, 866 bp, Heterodera glycines
acctcatgtggaaggctgtagaaaaaagagatagccatttttctgagaatatctattcttagttatggagccattttccaaccgaccatttgtagggctcaaccgtatatagtaatgcgttttcggggaaaacctcatgtggaaggctgtagaaaaaagagatagccatttttctgagaatatctattcttagttatggagccattttccaaccgaccatttgtagggctcaaccgtatataggtaatgcgttttcggggaaaacctcatgttgaaggctgtagaaaaaagagatagccatttttctgagaatatctattcttagttatggagccattttccaaccgaccatttgtagggctcaaccgtatatagtaatgcgttttcggggaaaacctcatgttgaaggctgtagaaaaaagagatagccatttttctgagaatatctattcttagttatggagccattttccaaccgaccatttgtagggctcaaccgtatataggtaatgcgttttcggggaaaacctcatgttgaaggctgtagaaaaaagagatagccatttttctgagaatatctattcttagttatggagccattttccaaccgaccatttgtagggctcaaccgtatatagtaatgcgttttcggggaaaacctcatgttgaaggttgtagaaaaaagagatagccatttttctgagaatatctattcttagttatggagccattttccaaccgaccatttgtagggctcaaccgtatataggtaatgcgttttcggggaaaacctcatgttgaaggctgtagaaaaaaaagatagccatttttctgagaatatctattcttagttatggagccatttt

SEQ ID NO: 20625 - DNA, 921 bp, Heterodera glycines
aaaagagatagccctttttctgaaaatatctttcttaggtatggagccattttccaaccggccatttgtagggctccaccggtatatagtaatgcgttttcggggaaaacctcatgttgaaggctgtagaaaaaagagatagccatttttctgagaatatctatttttagttatggagccattttccaaccgaccatttgtagggctcaaccgtatataggtaatgcgttttcggggaaaacctcatgttgaaggctgtagaaaaaagagatagccatttttctgagaatatctattcttagttatggagccattttccaaccgaccatttgtagggctcaaccgtatataggtaatgcgttttcggggaaaacctcatgttgaaggctgtagaaaaaagagatagccatttttctgagaatatctattcttagttatggagccattttccaaccgaccatttgtagggctcaaccgtatatagtaatgcgttttcggggaaaacctcatgttgaaggctgtagaaaaaagagatagccatttttctgagaatatctattcttagttatggagccattttccaaccgaccatttgtagggctcaaccgtatataggtaatgcgttttcggggaaaacctcatgttgaaggctgtagaaaaaagagatagccatttttctgagaatatctattcttagttatggagccattttccaaccgaccatttgtagggctcaaccgtatatagtaatgcgttttcggggaaaacctcatgttgaaggttgtagaaaaaagagatagccatttttctgagaatatctattcttagttatggagccattttccaaccgaccatttgtagggctcaaccgtatataggtaatgcgttttcggggaaaacctcgtgtgaaggttgtagaaa

SEQ ID NO: 20626 - DNA, 1987 bp, Heterodera glycines
cgctaattataactcagttgcattaaatacttgtaaattgcaatacatggttgcttcactggttccaaggaggaactgtattcaattagcaaaaaataatgaatgaatttgataatcattatgaattcggagaatcaatcaaatattgtcataatttatacgcctgcaaaatgaaaactcaaaaacaattccaaaacaacaaaatttcttgtttccgtctcatcgtcatttctcaacgcgttcattcggcgacaaactttttgatcttgtccaggaaggtcacgtactgagagtgctcgtaatgagtggctaaaaggacattaaaattcgcaaactctgtagtggtacatgtaaatagtgtcatcagcaaactaaccgaagctgacgagctgctgacaaaattcgggagtgaagccgcgctcttcgagatatctgacgaacagcaaatcgtgcaatttctaaaagcacattttaaaaaagttcgtaatgccattttgaatcaccgggtcaatgtatttgccggacgagctgtacacgtcgtcgccaacttcgttcacgggttcgccattcaccgacggtgcgatgaaaaactcttcgacggtgaagtcaactggcggaaaaaatcagggataaaaatattgaataaacaacacccgcaacatgataaacccgacgaaaattcccgattcgaattgaggggaaaggcaagaaacccatccatgccgtaaacgcgagcaattgacttacatccgccgtcctccgtcttcaccatttcaagagcgaagaacatactctggttgttttttgtgatgctaaaaataatgcatttgttttgtaaaaacggaattgaaaaaacacctaatggtgaagtgtggcaacgagacgggcacagactgaaaatgaatggatcatattgaaaatcagagttcgacttatgcctgggtttattatcaattagattttttaagtactaattgtaagtagcttcttttaaacaaattcaaacacccagcccaaaattggactatacaggcaacacttggggattttccaagaaaattcaggtcaaatcaaacatgaaacttagacccaagcaaaacaaaaaaaaaatagaaacctctggctccatttctgcttgtggctcgtcttcgtactcctcgtcctcttcgatgtcgaccgaatgattcacgttcagaatgacttcaatcctgaaaataggaaattggctctaatgcagtttatgagtccaatcaattgacaatcccgggtttttatacaataactttgtttaggttcgagctaaaccgatctttttgatatcattcgaaaacacaaagtctaacgaagctaaaatatataaaaccatatcgttaaggcaattgctaaaaaagatttgattaattaagtaattgctgattattttcgcctgtaactttcttgaaatgttagaattctttagttttatcgtattattacattaattagactttgtgctttcgaatgataccaaaaagataggatttgttcgaacatgaacaaagttattgtgtaaaaacccgggattgtcaatcgattggactcataaaagttaaatcggactcataaaagtcgattggactcataaagtgcattagagccctaatttccttccaaagcaaatgtcttactcttttgcttttccttttccatttgttcttcgtataaccgctctttctcctcttcgtcggagtctttctcatccaccgaacattcctccgattttggtccctctctttccgaggcttcgcttcccttttcctcattttcttccgcttcttcggtgtgtatttcatcctcatttttcgtactttcttcgcctttttccgttcttaggtgttcttcagatggttttaattctaagacggcggccttttgtgtgactttgtctgaatttattgtccataaaacaaaatgccaaattcgctttaatcactgccgaaacatcact

SEQ ID NO: 20627 - DNA, 2416 bp, Heterodera glycines
taaacttttcataccccatttttcgcaccgtgaatgttatttttattgaattctgaaccgttttgagtagattagactagaaaaaattgaaaattttgaaatcatgtttcccactcccttctcccaggggtattattttgtaaagtctttttttcaaaataaacttttcaaaccccatttttcgcaccgtgaatgttatttttattgaattctgaaccggtttgagtagattagactagaaaaaattgaaaattttgaaatcatgtttcccactcccttctcccaggggtattattttgtaaagtctttttttccccaataaacttgtcaaaccccatttttcgcaccgtgaatgttatttttattgaattctgaaccgttttgagtagattagactaaaaaaatatgagtgatcaaactttcactaaaaagttaagcctaaactttttcccaaagttaaaaagcaattaaaattttattcacctccattattgatagaaaaagcatcagagtgcctaaactaacatgtaaataaaatttggtgcgtttcagaaccctttctgaaaaaatatttatgaattaattttgcaaataaataaaaacgaaagactcagattttcgaaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaattttaaaatttaataattttcctgcaccgaaggtactcactcggcctcttcgcggcctcgtggtggggccttcgccccccccccccctcccacgcccttcagagcacgacaaatatttcaacaaaaattttgaaaaattgactagagcaatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgactttctgaaaaaaatatttatgaaacaaaaaaatcgattttttcaagtgtccgtttggggtactcaaacatttatggggagcaaaaatccaacgcagaattaaagtacaggctatagggaagctattccggaaggattcggtctccccataaatctgggcgcatcggttcggggggactgccccgaatacaaaaaaatcgattttttcaagtgtccgtttggggtactcaaacaattatggggagcaaaaatcccccgcagaattaaagtacagggtatagggaagctattccggaaggattcggtctccccataaatctgggcgcatcggttcgggggggctgccccgaaaacaaaaaaaatcgattttttcaagtgtccgtttggggtactcaaacaattatggggagcaaaaatcccccgcagaattaaagtacaggctatagggaagctattccggaaggattcggtctccccataaatttgggcgcatcggttcggggggactgccccgaaaacaaaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaagttttattcatctccctttttgatagaaaaagcatcaagaaggctaaactaacatgtaaataaaatttggtgcgtttca

SEQ ID NO: 20628 - DNA, 1679 bp, Heterodera glycines
attttgtcccggcgaaatttcggccgacgagatttcggcggcgagattttatcccgccccttttttctgtggtctcgctttttaaaacgatggatgtagcgccaaaaaaatttttttcggaaaaattacaacacacactcaaccgggagctcggctctcgagtggatagctcgaaaagtccatagggagcttagctctcgagaatcccgcccccatgtctggagcgcagaaattcaattaggtatttgtaatatgtgtcaaccactaacctgttgcaaagtcggctatgccctggtcagcccactcgggcgccgcgttcgactcatcgtcgccgacacagctgttggcatccgccgccgtcgcctcatcacttccattgctcagtgtcttcagcaagtgattgcctttgtccccaattctgatcgcttcttctctcagatgctgtgctactccgccatactcatccacgccttcttctgctttgtcctgctcaaactggaacatcttggtcgcgtacagctgctcccagacaaatgtcgtgccaaattcctcctcttcatccgcagtttccggccatctttttcgatgttttggttgttgctgcttctgttggtagtgttgctgggtactgcttgacaattccgttactgtcgtccctcctgcacctctttgtgccactgttgctgctgctccatgggtggtggaagcgaacaatcggtcaaaccattccggacgaacgccgccgtgcaaattgaaagcggaggatgatgcagttgcagcttctgctgctggtaatgatgatagagtggtaagaaggggaaatgttgtcggtgcatcggtaccaatgggttttgctgggagttgttggcgaagaatgtccggtgcaatatttaacaacgacgaagccgacgacgatgattgggttgttctggaaaaagctgaccgatggtttaaaagccaaaaatgtaaatgggattgggggcgtgggttcgattcccatccaagaccaaacattttgacaattattttacaataacttgaaagggacctaaacgatttgccattccgaatcatccacttaaattcaagcttaaaaatcaggaatatgccaaatcaatccaaaagcatcccgattccttctgcctattaaaaaccctcatttttgttttccaatcgattttccgaacccaatccaacaaaaaaaaatagaaattaaaatttgcgtaaaactgggcgcggcccacgcactgagtggacgaagacgaaacaccgcgcgaagctgccgaactggtgctgccgttgctgattgttgacgagaatttgtcgttgttgccgtttttgttcgccttccgtgctcgttctgttatcgctgatgctttcattggcactcttgacgttttcggcgtcgtcatctcttcctcctctcccgactgagtgctgttccgctgcttcttctcaatgtcacgctttttctttggcgaactgaaaatcaaaatgttcaaattgttagaccctcgattaattagagatgaacaattggccggtatctaatttgggaaccctaattcgactccaagcaagccgcaatcccgaataatccaatgagtcccccactgctaatcatcccaaaactgttgccttctgagactgtcccccaccttgtgctatttcctgtctga

SEQ ID NO: 20629 - DNA, 929 bp, Heterodera glycines
atagctcactatagcctgtctttattctgcgttggattttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtacccccaaacggacacttgaaaaaatcgatttttttgtttcaaggg

SEQ ID NO: 20630 - DNA, 1900 bp, Heterodera glycines
ctgctgtacttgttgtataacaaagagtacagtaacatcacacccctgtaatctgggtaagtaccgtaccacctataccatacgctttgacaaatgagtgaaaaatcaccttcataaacttcatcacttaatttctggttgtccggttttttgctcgacacttgtataaatagttcttcagtttgaaatttaggtttggctaaatttaattttattaattttccaaataatttttaatgagattaaagagctaaatttattttaattaccggcagtttttctgtatttcaacaattcgttccaatttagcaatttcagtttttgaacatcgacaaaattttctaattcaaatccaaaatttaaatttgaaattttgcccagtgcactaatgacatcaattagcgtaagaattgtgccgctcatttcaaaaattggcttcacagccgaagcaactccattatgcactcggaacaaaaactcataaaccatgtccaaatatgagcgaaattttttgcattccacgttttgctcatactgtaccaatgctgagtcattactgtaattgggttaattgatcattagcaaaggctaatatttgaagctgctaaaagttgtgcccagggcaaaagattggttgctaagattttctgccatcaaattgctataaaaatcacggaattcctaacccaaaaatgaccataatattcgtttatgcccttgttaccgttcaatttcctgcgcgtttttgtcgctgctgctttctggtttgaatttggcaccattttcggcacaatgccaatcccttcgcatcaaatgcaaaatgccaaggtgctttacatatttttgtgtgtaaaatcttttgtttgtttcatctacagtttgcctcagattgtgtcgagttaccgtatcaaaggcatactctaacacatacataaaattggattgccctttcacaaacatgaggaatgcttcatcttcaatctatgtttcaatgaatttatcagccaattttattacttcaattattccaagatttaaattttacagaaataaattatttttccagcgtgaaaaatttgtgttctttggatccgaatttataaaataaaaacatttaaaactatcgaaattgcctcaagtattttttaccttgggttcaatattttcgaaattttatttactttattttttgcacgaaaatagtcacaatctcgagatttttcgtccattttaaatggtcttattttgcaaatttagaattattcttattatattaatttcaccacgctttccacttcgtagattagcaaatgcaaaatgagttcgtcctttttctcgccataatttttgttagcatcggcattttttgatgccgatttcgatgatgatgataatgatgatgatgtttgtgccatatccatgccaaataactgtccattgccagtcagaaatattttctgctccatttcattttgttccatttttgtcgcattttcttttgctttattatacattttcttcatgattttttcaaacttggcacgtgcttctgctaagttcttttcttctaaaatggcaacaaacagttttttctaggacatagtaatgtcggcgctagttaaaaagttgtcctttttgaaaattttttcacttttttttcatgtaattttattttataaatgataattttttaaattcattttagcaaatggttaaagtttcaaggtattctattaatgattccaacaatctgccgttcatcgcttttccaacattggacgatataaatttgagatggcttttttcccaaaactttgaagagattttacaatttttggcacacagcggagttatccaaaataaatgtttatgccataagtaaattttggtgaaaatttac

SEQ ID NO: 20631 - DNA, 2827 bp, Heterodera glycines
atagggagtccaattatatgcacatgcatatttttttcctggactgtgggaggcctgaaacgcacgaaaaacatgtttttagcgtgttttgaagcttctaggatgactttccatatgcatgttttgcatatttgtgcatatttcgcgatttatgtgcatatttgcatattttggcatttttccaaaaaacctctaatagaacggccccccaacagacaaattggcctttttgacctcaaaaaccggaaaattttccaaaaaaataattttttagcaaaattttcacgaaaaatattgaataaataaattttctcaaaaaatggttaatttatgtcaaaaataagcaaaaaaagcaaaatttcgctttttgggttggtttttcgcaaaaaatgagtaaatttttgctttatcatgtttttttcttctaaaatgatttttaataccacatttagccattttttgaagattttacttaatatttaacaaatttgaagaaatttagagacattacacccttaatttggaaaatttatatgcatatttttcactttttatgtgcatattttgccatttttggtgcatattttatgcgcatattttgcgattttatgtgcatatttttggatgccctaataatcattattcccttttcaaaggtcaattccgacaatgtgcatttccttctctctgttgggcatggccgcatcggcactttacattcccgtgttcaagcgatgctcaaatttatcaaagtaaaaatatattttaaaaacaattgtttattattttaattttttaagaaaattgaatggtgatggagaagcaaaagcagaagcatcatctcaaaattcaacccaaatttatgcgtacatttttgccttagtccaatcggcgtcgacattggggtaattatttatttgtaatttaaattttaaataattaagtaattccgattgaaaattggtttttaatttaacagaaaactcactttatttttttaactccattttcaaacattttcagctccttttttggctcaacaattggtggctatggcgccgatgcgtttggattcccatggatttgtgcttttgttgcgttcgcgcattttctcttcataattttggaacaaatccgcaggatattgtccaaatatttataattaatatgattttgtttgtaattgatttgatgaactcagcccattcttttttgattctcatttttttaaataaagattcaattaattggcattaattaaatttatttactcattttctggtattttgtgaaaatataattaattcacaaattttatttaaaaaacacgcgttcatataataataatatcttccgtttttctgttacacaaaaattttgattagattgtaaaaaaataaataattatttattagttaatttgtcgtcaaacggggaaaagtgtaaaaatggtcaaaattccaacccgcaagtcgctgtaatatttaaaaaacggggaagcaattaattcaaatgataaaccaatgaaaaaacaacaacaattgcatttagtagaatagttatttaatttaaaatgaacgaaaatttctcgatgtttacgaaagttatgaaattttattcaaaatttttaatttgatataatttctcgttagttagctaaactatcggttagatgccatcgctattaatatttagaagttttttcacaccaacgaaaaaacgacaacaattgtattttgtgaactatttaattgatttaaaatggaaaaaattcaatatttagaaaagctataaaattataaaatatttttagacttttttattcatttttttggctcgtcagctaaacataatttatcggttagatgtaatctgtattaatttttaggtgccttttcgaatggtttaccaaatgtacttggcatccaagtacgaatccgagccctggctttaaaccctcaataaagtccgaaaatatgtatatattcaatatttgcttaaataaactaaaaatacactaaattactaaaaaatggtttaaagccaaaaaatgcaaaatattatcaaattcgagcttcaacaattgcaaatcaaacacatctcaagattttttggtaattatctcattctgttttcgtattgccactttcggcatacaatttgtgacatgaagtgccatgccatcgtcggatgagggcgtattgtgataaaatacggggaaaagagaattgagtaaaataataatataaaatgaaaatatgtgtcaaaaaaatataacaaaatcaataaatatattctttggcgcttttttaattcatttttacaatttggataaaatttttcaatagaaaaacatttagttaaggatatgtattatatttttcttataatttttccaatttttacacaaatttcttcaaaaaaaggtaaaatatttttaataaaaaaaatgaaccttgcgttattaacctttggaattttcatgaaaattgaaatttcaaatagtggaaaatgaaattcatttataaaacgaaaatacattttagaccaattcattggacaaagtcaatcacttaagtctatcaacaacaatcataatggtaatattttttaattcatgactcttattcttaataatatttagtggatttgtatccgccttctgccccaagcattggtagcaatttttcattaaaaaatatttttaataatttttttttagaaaatatacatggacaggcatcaacatcaaatggcggtaattttttgtttattattattagtacaaaaaaaaaaattccctagcaattgatgatgaaacattaat

SEQ ID NO: 20632 - DNA, 1569 bp, Heterodera glycines
aatttttaagaaaatagaaggatttttagtgccggcaggtcccgataagcgccgtcgggaaatttttttttctttgaaaaatggggagttttggtagcatttatatcagcgaggaatccgctaaatgagtgtaaattctcagatattggaattggcacctcataatccgccgtttcttttcgatcgcttatgttataaattacatataatttttattgtcagcccacattcatctcactcatcaatgggtgtatgtgtttaagcaattgtttataaatcccgaactaatccgaaggccaataaacgagatcaaatggaaaaaatcttttctgttctcagttttactgataaaacgcacaaatacaatcgaatatgtaagtgttttgttaggtgaacgaagttgctgatcaaaatgccacaaaagtcgccaaacaaattaaaaaaaagcaaaactcaagaaatgagattaaaaaagaaaatagaattaaacaaaatgccgaagagaaagtcgaaaacaaagacaaataattattccaagctcttcgaacgatgcattccgaccacccgcgattgcttctcctccttcgaagtgcccatttccgacagattcgtctcactcgtcgcatatccttgaaaatgacgaattaatgaggataaaagttggaatttcctgttttagagccaaattttggatcaaaaacaatgcgcatttcaagagataaaatgccacacttttgagccaacatttcttcaacttcgaaaattcgatgtttttgttattgttccgtaccatcgtccttcggcggtggcgtcggactgtccgtcagtgcaaaagcgacaccgccggcagtataaattggatccgcagaaaaggaagtgccgagaaaggtgccattgtttttccgactagcgccgccaccgcgtgccgcctcgggcgtcgtcaacgaggagtaattcggcggaaaggaagacgagtcagaaattgcctgagaagtaaaagccacattttaaatgggagaatatacagctcgttcccgccaccacccgagaaaacaaaaaattggacatttaattttcgaactttcttaaggcttttttagtatccatgtcgagcaggttatcagggtaatttttaaaaatattgtcctaattggtccaatgcaccttgtgtaagatttttaggggatttgataaaggtaaaagcatttgataagccacaaatatttttaaattgaaaagtgccaaaaagccggaattaaaattataaaaaaagttttttttttaaattatgtatttggaattcagttttattccgctcgcctgccgctcgtcatcgtcgtccgccggcgttgtgttgtggtggctttcctttgaactgtccgtcaccaggtcctccttcagctgttccatctcgcgtagttcgcccgtggctgtaagcaataaaaaaaatgagtttagtttcaatgcaaaacccaaaactaagtcgaccaaattccaggggggggggcgaaggataaaatgcaattttttggaaattttctaacaaatttcttataaagaaactctcaa

SEQ ID NO: 20633 - DNA, 2312 bp, Heterodera glycines
agacgaattttggggacgccgaattttaaaatgggaggaaattagcacttttttgactgaagttgaggccgcgatcaattcgcgacccatcactttcgtctcagatgaagctgatggtctttttccattgcgaccaatcgattttttgtctccaaaagcaaacctcgcttttgatgagccggacatgtcagacgaagtttttcgaccttccccagctgaaaagttagccgcccgatggtgggggacagcaaaatcaattcggcagttttgggaaaaatggtcacaggagtacctgttgttgttgagacaacgtaatcagacgaaacacaaaggacctagaattgtatccaaatctttaccaaaagtggatcaaattgtcctggttgaaaatgaggaatttcctaggaatacctggcctatgggaaaaattacagaagtccagggccccgaaggaaaccctcggagtgccaacattttaatggcaaatggacgggtgttgtcccgtcccgtttcgaaattggtgccattagaagaaccacccgggattgtgtgtgagactctttcgcgccccccgggagatccccaagagggaaatctgatggatgtggtcgagcaaatttcagaatcggtcggtaaagaaaatccaaaagaaaagttccgatgggcaaaagagccaccccgtggcaattttcggtagaaattcaaatgggcagaacgccctcctcgcccaacaatttcggccacaattctgagtactcggctaacgatgctgcttgtgttgtgtttcttcagcggaacagcagttttatcagcacctgtactctccgctgcacttttatccacacaaccaaacgccacaggcattttttcctgtgtttccaagggggtaatgctcgagggactccccgaaaccgaaaaagttgatatttgctgtgacggtatttgcggtcatcgggaatacagaagaccattcttttttccgattccagaggaaaatttattacttgggacctcttgcctagctattttttggatgggacccaatgtttccacttcatactcggcccaatgcgccccagtggacatctgtctgctggtcgattgctatgtatgctgggaaagagtgttcaactttcactgctcccccactttctccgctcttttgatcggttgcattgcccttgttgtaggcattgtatcaaccgttttgtgctgccttctcagttggacaaactgtttcttccgcgcagttaaacgttgttgtcgaacaatttgttgtcgcatgttccgaaatctgaaaggaaggaagcaaaaacggccaatagaaagtgattcagaaagtgattatgaaaaccgtcggcacaaaagattcaataatcggagatttaggcctttgacaaaattgggcatggccctgaccttaatttgttggttccaagggatccccctaggaaatggagtccctaccactataacggccaatactgaagaatgcgaatccaatgaaaatggaacagaatgccgatttaactctgtgactttgttgaatttgctcccagtcggccaatcggtggaccttatgatcaggggtcccgaatccatgctattagggattcttacgttcactttgaaaggcttataccaggaatgtatccctgagtctttgggattcattcgttcttataaaatgggatgactcggactttgtaccaattcagatggtcttgagaatggaaggattacgcctagcaatacaccaccaaatggcaacatgtaagataagaccacagggtttaaaaggttactataaatgccgaatcggcagccgtttttcctatacctgtacggcagttatggttcacctttggctgaaattgtgtgtgaaaatggaataaattgggcaattccgtgctccgctcagcaaacgcagcataatacctctttgtctttcgacacagccaaaattaagacaaattgtaaggtgacgtgccctgggggtgatactttattcgaaatggaaggcactctggcctatattttttcgatcagccgatcctggcgtttgactggagacaaaaccgaaaatcatccaggagggtttagcctacctgaaattggtgatcttttccacgtcttgaaatggatcttcggcggcacccagcttatcatcattttgggagtgcttttcgttggaatttgtgctttttacattttcctcaaatttaacccaattttttggggttatcgaattttggctaggaaaatttggattaccatttctctgctcattaatctgtgatgggctaatgccg

SEQ ID NO: 20634 - DNA, 1431 bp, Heterodera glycines
  misc_feature (61)..(62): n is a, c, g, or t
  misc_feature (71)..(71): n is a, c, g, or t
  misc_feature (76)..(77): n is a, c, g, or t
  misc_feature (1307)..(1307): n is a, c, g, or t
  misc_feature (1345)..(1345): n is a, c, g, or t
cttcttggcttgtttgtattcgtcctccagtttttgccccataatagatgcttcccaaatnncatcgaagncgcgnncggccttttagcggatgttccgtgaaccgctcttcgcacctttttagctcttccaaagactttttcagctgcgggtcggacctgttcatgtgctcgatgggatccaattcgggaatgagttggtcgaagcgttttttcgtttcctacggggaaaatagctagacatcaaaactgatggaatatttcgaatttatgtcactgaaatttgtcatgaaaagtgtagagacatcagccaacaaaaacaaacgatgtcatcagttcaattcatattcacttttgcatacctttacgaagttcagtcccaacggtgggactgacctgtctgaggctgctctttccgaaaaaagacaatgttcaaaaataacaaaataattcaccagaatggtcttggccactgcttggaatgcctccttgctcttcagctcttgaggaatttttagccgaattgtgctcactgcttggatacagtcgaaagcgaagggcagcaccaccaccacgccattctccccgggcggcggaggtttcaccgcacatagattttgcgcgcagttctcactttcgcgcgagacgaacacagccacgtcgaggaaatatagcatttcaggagacaacggattcagtgggttcggctttttggtgtacctcaacagcacgccccagccgaagtccttgtcgaagcatttgagctaaagaatgcatttcgtttagttttagcgttaagcatggtgttcaaaaaagtcactttgagcattcggcctggctgaaagaagcggataacttttgccggcttcagtaccaatgctttgatggcatttctctgctgctcaatttgcttctccaatctgaaaagtccttccaattccgacaaatggtcgacatgcgcacttaggaaaagttgtcttttggtgttaagttctgaagaattcgagaaatcaacaattaagaatggcttttcaactctgcagaaggtccggaaggcgggaataattctgccactgatagaaggaattgccgagcataaactgcggattgatgtccggcactcgcaacagattaagcaccatattgtaagtgagtcggaattgggagttcagtggatcgctcgtgccctaaaaagtgccaaaatgcgtgatttcgaaaacaaccaaaaataaaagtggcacttttattatttgcatggccgtctccgcgctcatctgctggtccaccatcagaatgaccagtcccttnctcgtctttgccccgtctccccgccctccgcttcattntggatgtattcgccacttgttatccatctgaaattgcgatgaaacaaaaaaacggtctttgtaaactattctttacctgttactga

SEQ ID NO: 20635 - DNA, 1645 bp, Heterodera glycines
tcgtgtcccgacatttgcgcctttgtccaaaatcgggttctaaattaagttttttcaatctctgatcgcataaacagctttaaataagcgattaaaagtgattgtaaccgatcatttgatcttcaaagaatttttgaaaaaataataaaattttcaaacaacaattattgatcctaaacaaccaaaagacagggttttcttaattgtaatgctgtttaggctatcagggtttgaaaaaaattcaactttgagtccaattttggacataggcgcaaatatcagggctccgtttccattcggtttagtatttaatgcaaatgtttctgcctgtattaaaatcaatgtctttgatttcggaggcgtacgcctcgcactcctttcggctgaatgaaaagataatgcatggcaacatgtctcgctctcgaatggttctaatgattttcacaacgttgctcttctgcgtcgcgtcgttcgcgccactccgccgtccgtgctgaggccgcacttcgccgcccatcggttggcgctcctccaaacagctcatcgccttggcaaagttgtcctgtttaaactcgccctgaaaatgcacaaaatgtttggctgtaaattttaaacatttttccttgcctttatgttcacaacttcccaaagaccgtccgacccggcagaataaaccaaatgttggaggggaacaggccgatagtccgtgtaaatgatgttgcactgtttgtgctgcaaatagcaaatccattctgaaagtttgaattccaaaaaagaaaactaactaaatgtaaagccaacctgtgaattgcttggcatttggaatagttgcagaaagaaacaccaaattggtggttttgggcaataaaatgagagtttcttcccagacgacgccacgttctaaaaacgaaacgatagaaaagaactgaattattagaatattaaaacatcgacgagttccaaggtcccaatccgatgaaaatgaatctttgggtttcttttgcttacctttgtcgcgcatgtaatgaatctcatcaaagatcacccagccgacttctctcacaatttcacagcctcggtaaagcattgaacgcagtatttcggtggtcatcacaacacatgatgcatttgggttcagtgtcacatccccggtgacaaggccaacgtcttcgaactcttcaacaagttcacggtacttttggttgctcaatgctttgattggggacgtgtaaatcactcgctgtttgtcccgcaatgccatggcaattgcgtagctgaaaaaggacgacaattaaaaaaaagtaactcaacgattcaccacccgaaacgaaatgattgataaaaagttatagtttaataaacccacagggcaacaacagttttcccggccgatgtgtgagccgagaccagcacagactgttgattgtccaggcatttgagtgcctggctttggaacatgtcgagtttgaactcgtaaagctttgccggggtgttggtcttttttagctgttgatattcaacgtcaaaggggacgattgcctaaaagaagacaaaagccatgagaagtcaaaggaaaatggacgcactacacattaaatagggaagggggtcgacccccgcccctgactttgttcgtattagggcc

SEQ ID NO: 20636 - DNA, 901 bp, Heterodera glycines
tttttatgcgtccaatcaaatttttcatccggtgatcatgtttatgctagctctatttccgtttagctgcagcttaattcatcatagggaatggtacggcttaatcattggctaatttggatactgaagagcgaacccatggcctttttgcggagtttgtcctaatactaacaaaagctaccataaaggtcgttagtattaacgaatctagctaagaaacggaaaacaacttatgttatatgactggtaattctgctaagatattcaaaattttgtaaaaatagaccagaaaatcctggtggaatattgtcaatgcaatacaattcgatgtaaaaaattgattggacgcataaaaatttaaaaagcttaacgtttttttaagaaatttgttgaacatctatattctttccccagaggcacctataggtaccgccgcgtttacccctcttttttttgaaaaagtatcgaaaaatgaaggccagagcaaaaaagatcatcggtttggtcaaaggaacgaaacaaatccaagattgttcttgtaccaaacaccctgcataaaaccctaaaaatggattttttacaaaaagtttttcaaattcctctccataattgcgttttacgagtttcatattgttgttttctgatgaacaggccaagacacagctgtgaacgcagtgcagaagttgatggaagggttggaccagtacatggcgatcaaacagcaggacgaagagcagcagcggagaagaaccgagcgcgagcagttcaggcgtgagcagtcggatgagaccaagcgcgggttggccgccgaccgggcgaggcaggaaggagctgaggcgccgaaagcagaaggaacagttgagtagcaaatgatggtagctgaacatttctagtcccagtt

SEQ ID NO: 20637 - DNA, 2708 bp, Heterodera glycines
gcttttaaaaaaatattttggcttgtattttttaatttgttgatgtgtgcttctttagttttgtgtgtctgcggtagggccgaaacgcactttttttcttattttttgttttcttttggaagagcaccgcactgacgaggcccactcttccattagaaatttttataacaaaaaaaatttttttcatttaattttttctcaggaattgtccgcaaatgtccgtccgcaaatgtccgtccgcaaatgtccgtccgcaaatgtccgtccgcaaatgtccgtccgcaaatgtccgtccgcaaatgtccgtccgcaaatgtccgtccgcaaatgtccgtccgcaaatgtccgtccgcaaatgtccgtccgcaaatgtccgtccacaaatgtccgtccgcaaatgtccgtccgcaaatgtccgtccgcaaatgtccgtccgcaaatgtccgtccgcaaatgtccgtccgcaaatgtccgtccgcaaatgtcccactgcgccgattagcatattcatttacgcttaaagttcacttgtttaaataacttgtagcctttactaatttaaattacatgatgttaatgcttaattattctcacaaaattttgagcaatgcccttcttattggaatgttgccattttgaccggcccgtgccactgaaactattgccgattataccacgtttgctatttttacaattatttatcaagaattgaaaatacataaagatttcttatgtttaatttaaagcattatactaaaaataatttgtgaattaattatccataatattgagctaaattgatatactatccactaattgtagtaatcaaaataaaaaaactgaaataatcaaaatttaatttatatgctagcgataattatccagaggaggaaactcagccgaacatgatcctcttcgttttagtcaaaataatctaaatttacattaaaaaatataattggttctattgccataaacattagcacaaatacaagaaattcgctcatcatacaaatttaaaaagaaattaaattaattaaaaataagtaaaaacgaataaattatgcgataaataattttcaacaaacaataaaacatttttataagagaaaaacctatcgtaaataatcaaacgcatttgctaatgatctttcataatcagtaataaaaaatttttaattaaataattgcaagaaataaaataaaaatataaaatatacggaattgaaaatgcaaacagaaataaaacattaattatataaaaaaataattagattagtcacaaaattacttattgttggaatcaatattcagaaaatagaaaatacttaatgaatataactgattaaagttttcccaacagcgtaaagaattgctgcattcagcaactcaagctgtgtgttgaattatgcagcatgaaaatgaactaaatgtgatgagatgaaagcttaaatttaaaattttaaaatatgattcttccaattatttttataaatgaaaaagtttaatttttctattacgaataaaattttaaaataaatcgttattgaaactatttcacaattaaatgaaaaataaattaatttataaaagaaacaaatggtaacagtggtaaattataaatattcaatttaccataaataaaaaaataaattagccctaaaaaattcattcataattattattttatttgtaagtagaaaagactttaaaaaaagaagccgaagtacatgataaattataaagctaactattaaataaatatacaattaaaatttaatacaaaaataaccactccaattttttttctacacattctgcaatcgtactttttgatgtttgtagttttaaaaatatatgcaaatttttcatttatataattaaaaattaaaatttaaagcataaaacgaatcgttcgatcgtcttttaaatgcttatttaaacttgaattaaattaaatattaataatatattttttaatttattaattttccaaacactactttttctatttaatgaaccgagcatgttcaattttttggttatctgaatataactactctttttgaaagtttgaaaaaaaatttaaaaaattataatatatttttttgtccggacttatttctttcttcacttcatttcatcgttccattcccttgtgctaaacccatccccctttcttttctgtgtacttgatggatgggggaaggagtgaaataaatgcaagcaatctctctccttctctctttctcttctcgcactgtgtctcgaataatgtgttggtcttactaatctccgttttctgcactgtctcttattcactggaaaaatgcaaaacagaaaatcgcaacttatatatgaatgggttggaagggagaattgggaatggggggggggtgaggtggacaacggccaaaaattgtggacaacgctagaaaaatttgatcggaggagaatcgaatggacaaagctgtggatacggaccgattgtgctgcagatgttcaatgtaaatgaatgggcggtagaatggagcaaaaggccataggctatgggcatgccatctcaaatcattctatcaccaagctttgggccaaatttcgtagcctttttcctttttttcttttttatttctgtaattctgtttatttgagttttgtcctgatctgcttcaacaatgtcttacgtcccgaccaaaatgacctggatt

SEQ ID NO: 20638 - DNA, 1136 bp, Heterodera glycines
  misc_feature (45)..(45): n is a, c, g, or t
  misc_feature (127)..(127): n is a, c, g, or t
  misc_feature (174)..(174): n is a, c, g, or t
tttgtacaagtgccattaatccatattttcggcaaacgactgatntgccctttggtttttcggtgtcatgacagtgggtacaaaaggcaacaactcgtacaatggcttaggctaggcctctatgctntaggccaggcttaggcttgcttggacctaagcttaggcttctttatntagtaaaaagtttttattgtacgagtttcatttgcattccccaaattgttttaggcatttctctgtgccaccactgcggtcaatttcattattcacttgagacagcccaaatcaataatgccaattgatcaatttgaattgatgaacgaacaaaccaatgagcagttgacactgttgagcaatgatgaatcagctaattgtaatcattgggtgatgaagcgatgccaaattgggcagtcggcgacggcacaatgggaggacagaaatttgaatgatttgatgaacaatgtcaacgttgagccttatcatgacattccgagtgaggaaaacatcttttgctggtacttgtcaagtttacgggatacatttcaaaagcattttaaagaaaaatgaaaataaatttcaaggggttttcgaggtcgctgatgacgaatacagcatccatctcaaccaattccgtactcctttagctcattttgaatcatatatgtgaaattctaaaatttttacagatgctaccctcatgggcataaatatgcctatgagtgtacccttggcacaggaagctgtcaaattcgttgtaaaattagtacatttataggcatctggaaatgtatgtgaaatgtgccccgtaaactagacacgtacccttttttcttcggttggtgtcatttaatttaaaatttcgctttaatttagggcatctccgcccgagagccaacagattgtttacagacgacatcgatacgagttgtgccttccttttgtacgagttgtcaccagacaccctttccccccttcagggtttcactgcagtctaagcggcttccggcagtaaaagtggatgaattgtcgagaaatggctgaattactcgttgcgagagactcaaagtgctgctactcatttttatttgttgattctttcgctcgaataaattatttggctgttgtgtttggtccag

SEQ ID NO: 20639 - DNA, 1313 bp, Heterodera glycines
ttatcattgcgtttattttcataagtcactttgttcttcgggtatttttcaccaattttctcgaattgaataataataaattatcctacaaataagtaaattttaatagatataatttctcaaaatttgttttttttcttaaacaaataatattactacgtttttataaaatctttttcccttttgtcccgtgatccattgaaagtttaagagaaataatccggcaaaaaattttgcattgccttaaaaattttcaatttaaattataattcttttgccatttatttgattttttaataaagagtttgtacaatgtttttttgataggcattttttaatttttattatttttcagtacaaatttttaaatttaaagttgttctttggaaattttgattttaatataggaatctgtcactcttattttttattgcatcgatatttttataagtttgatcttgataatgcattaggtgaataaaagaaccttctcgatcttttttctgaccaacagagatcacaattctggcattgccaaaatatttaaaatgaatgtttataatgtcgttttgggaaattcaataatttttttaaataaatatttttgttactcatttaaatattttattattgtttgtcagattttaactgtttttcagtaattttaatttttttatattatttaaaatgaattactactttatcaatccgcgtattaaatagcaaaaaattaatcgaagaatttttaatttggtttaattttgactggacattgcgtatgaatcattaatttattaaaaaacaacatgaattactttaatccatgttttgaatttatgagcaaaaaataatcaagatttgaaattaattagaattttgattgggcatttccaattgaattaaataaattttttaaaaataattttttcctaatttttgaaagttcgcaccaaatttcggggacggtgcccctaaaaagggggatttcaaatgggccctagcactttcagcaaccccgtccccgagtaccgcatttttcaaaattcctgtctttaataatctcaatttatttgaaagcaaagtgcctttctatattattatttcttttttttttacttttttgcatttatttcacaacacttcgtccggcatgtcttacaaattagcattgatttttgggtggaatgaaagacagccaagactattgctttatgaaagattcattttaaatattattattaataaaatatattcgaattctcaactaatatgtctacaggcatttacagttctaaatatttcctcgcatctac

SEQ ID NO: 20640 - DNA, 1162 bp, Heterodera glycines
  misc_feature (1125)..(1126): n is a, c, g, or t
  misc_feature (1148)..(1148): n is a, c, g, or t
agaatgcaagaaatgtgaacgtccaaaaaaaaaggttgacatcttatgcccaaatcggtcatctgaacatcagcagaatgattgatacacgagacaaaatattgatgaattggatgtgccgcgaaattatttcccctgagtcaattcgttgagcaattgcgtaaaatattgctaaattcaaaataattgagaatattatttaaatattagaaagaaaagtaccatcaaattgttgagcttgtagcgttcaatcagaagaaagcgctccgaaaatggaatttccacacaattggccaaatggacaccgcagcgctccttcagccaatcaatttggaaatagtcggcaaaccaaaggaaagtgagcacatttttcgctaaatgtaagtgatcgatccgaaagttaaatttgttaattagaaaatatttagaaaatttgtattttcttctccctttcaccgtcttttgtgtttcccaacaccaacagaaattaccaaatcaattagtaattaaagaaagcataaattacgatttggaaaaaatgggtgacggaaggacgttgctgagatggcacccataaactcaatgaactgctccatggtgatgtcgtgcccgtccaaattgagcactcgctcccgcttctccttcatgtccacgctaagcattcgtttgaccatcggcgagacggacataagccaatgggcggacactgtcagctgacgatcgccgatgcgcacagtcaaatcatcgcccggagaataaattggcgggcacggactgtaaaaatttccaaaattggggtgcgggagaaattcaagagcattgtgcttctcacttgtccaccaattcgcgttttttgagaaatctgatgacaacagaaattggcaaaacagtgaaactaactgatctgcctttcttgagtacggtagtctaatcaaatttattaagctgattgtgtgagtgtattattagaccatacatttttaatttgctgagttccctgctcccatttccagaaaataatttcagccaaaggctcctcctttgaaacagtcgaattgccaatgtcactgatccacagacaatatcgtttagtgacaacatttatttggtacgaaaatttcctannataacatagaatattatcaaantaacattcattaag

SEQ ID NO: 20641 - DNA, 2514 bp, Heterodera glycines
agaggaagaagaaattgagcagatgaatgatgccgagggatactcagaaaatgaaaaagtaaaaaattaaataaattaaaaatgcaaaaaaaaataataattttctttcccagcagaatttctcatctccgaagaagcaaatggtcgaagtgaaaacgccctttttcgaaggcgggcgcctcaaaacaatcatttcttggctttcctacgcaaaatgttccgtcggctatcaccgggagaatacggtaagctaaacggtatattgaatacggtagtcagggggattttcagtaaaaaattaggattattcattaactaaaaaccatcgctaattggtccatcagcagctgaacttccgcgtgtccgtttattcgcttcgctgccccgtccaattgcctccccagcaattcgccgtcaaaaattgtgtcgccactttggtcaatcaaaaatatttgtaaccgcttatggatgaataattaattgtttaggagaatttgcaattttcgtgtgaatattctgtgggcattgagcacattggggaggacaatgggaaaatgtttgaatcggtgacgaatttttaaaaaacaattaaataaatatttaaacttaaaattcaaataattcgaataaatcactaattgaattcaatttttcagctgactttctccactttgtcttgtgaacaaactccgtcaaatgttctgctcaaatgcgcaaatggcgccaattcaaatggggcgccagaggcacaacgattggaagttgagcataaataattattatgtacaaatcattcaaaatattaatttttttatttttagcccattttcttatgcaagaaaaacgcgagtcgacgacagcaaaaataacgacagaactgacaaatttaaagacaaaaatggaggacgaagaatggctgccgatcgaagagatggaggaggaaaatgacaaagttggggaggaagtaattaaggactaattagagaaaatggatatttaaaaaattaattgaattaattgaacaatttaagaatgacaaagtcgagcgaagaaatgaggagaaatcacagacaaaacaaacgagtgagcaagaacaatttagaaatacttactgcctgtagtggtgttaatgtattggtatattaaataattattgtcccatttaattaattaattgcccctctccctcagattccgttgagcatcgtctgaaatgtgccgccacttcgctcgcctcggccgagtgcgcgtggacttggcctgccgaagagcaagaacagcgccacaattcgctgattggcttccgcaccattttggcctcgactctccacggcaattaattcgatcattaattaattataaattataatattgcctatttaatttgagttcatttcttggctctttcatttgcttttttctcacttttcatgccctttttccaggctcaccggccaatgtcagcattttgagtgccgatcagagaaaggtcattttgaggggactgagcccaaaggccgtctatcgctttcgaatccaagtccattttttaaattatttattttaattttgatttattgtgcgttttttttttttgattttaggctgtcacctctcttggccttggtgccgaactcgtggagtatttcagcacggggcatttggccaaagaattggcccgccaaaaaatggaacccattggcaacagtgaccaagtggcatttcccactctttaaatttcaatttttcgatgcttttcaattcaagtccgatttgtccgtcctcgtcgggcactttccccattcggtcgaattgccgtgggactcttccgcccgtaaggcatcgctcggccacgctttttgcctttggttggcttttgcgtggacagcaattgcaattggcagaatatttggcgaattcagcggccgatagcataatgaattaacaattaatttatgtgattttgttgtattatttgcacaaatatgggtattattatttcattttatttttaatctataaattattgtattaaaatattaataaaattaattaaaatattgtcaatcattcacttttcaacaaatttttaatgacataattggcatggcaattaactaattatttgttaataaaattaatgaaaaaagaaatgggcagaaaaaaagaaagaatttgaaaaaatgagttgggtcgtataattgtcaaaaggaaataatcttcgcctgtcctaaattaagaggcaaaaaccaatcattcaacaatttccatgcccaattaattcaatccgacgatccgttggcaaattgaaattgttttacctctccaacccatgcgatatgcccccaactcacccccttctcattccccccatcattcacctcactattttcatcccacccaaataattaattctgttcatagaatcttaccatttattggttacataatgtcggttaagaatgaaaaatgccataaaaaaacaaaagaaaatgccgtaacttttcataaaag

SEQ ID NO: 20642 - DNA, 2231 bp, Heterodera glycines
tttttttcaaaaattcaaaacaattttcagaaattttttgtccatattttcgtatttttgtccatgtttcagcgtttttgtccattttcttccatgttttgcatggcgctatgtaatttcgacactgagtatttcaaaaactttcactgttttcctgcattttcgacactggatagttcagtgtcgaaattaccagccaccttaaatccggcccctagaaataaatgaacaggtaaatttgtctcctttttttgatgattttgctcataaatttttcatttatttattttccaattaaaattccgtttgctgtgattattaattactctgttttatcaaaattgattgtttcttgtggccttatcactgctgctctgttgctgaagcattcattctcaattttgttcccctttttatcagcacagggttcactgacacatttataaattctcataataaaggaattttaaataatatttcaattttcaaaataaatagagcctcaaaattttgaaaaaaaagactggaaataagtcctaatttgttagtagacaatgagggatttaatcggcgggtacactgtcctcccggtgataggtcactgttaaaatttaattaaattgatccttaaatacacactcttctaaacgtttgttttatttcaaataaaattattaaccatagagagtggagcccgcagaagtgtttagcgcaatcggattttgattctcgcaatccgcaattgtggccctttaaaaaatccggcaacccgcaattgcaggcccaagcagcaatttttgaaattttttatttaaaaaaatattatttttttagaagagtttcatgagatgatgggattaccccacagcacctacaatatgtccaaaaccgggttaaaacacattttttcaatcccaggtggactaaacagtagagcctggaatttttaaatggccgggaccgggacttgaaaaatgacccgggcgggacccccgggacccccgttttttggtttgcccaaaaatcaccgggcaaaatcccggcggggtccggtcccgtccaggctctgctaaacagctttaaataagcaattgaaagtgattgtatgcgataatttgtttaaattttaagcttttaagccaattttttatgaaaaaataaatttgagggcccggaaaatagaaaattgaccatttttaacagattttcactgaaatttttgacattttacactcaagaatattttttcaaaatgaacaattcaactttcgcttcaaaaaatgataagttaaaaaacaatcattcaaataatgcatcttcaaatccaaaaataagcacaaaacaagcaagtaagtaatgctgaaataggcaaaaatcttgagaaagtccagtctttttttgctgacgaaattaattttaacagaaaaagaagaatttacttaatatgtgccatattttggacccctaaaatttaagtgacatcaaattatacaaaagcgtctcaaatttttcttaaaaaatcaaaatcatcggattgtcaagcccatgatgatgctccatcttcaaacgacgaaagcatgaacaatattgaacaaattgaaagttagttacctatttgatgggattagaaaataaaatactcaaaatttaatttttggcacgaattcgtcgccgacgaaaatgccactctcggcataattttaaaagaatctcgttcccccaagatctccgctccttttcagaccttgaaaacgaaaatttaccggtcaagtttaaataaagccaggaacggcaattttcggcttttcctgggttgccgaacactaaaaataccaaaaatgacatgaaaagagtacgaaggtaaaatggcacaaaaattggacagggcagtgaatttttcagttttaaatctaaaatggtcaaaaaatcaaaattattcaaattcaacagttcaatttccattcgaacactgagtaaaaaaaatttcaaataaaaattttgtagagaaaacccaaatatgatgagatgattttttagagaaagatttttcaaattcatcggatatttgtcgaaaatttttcggatcatttcttgagaaacgtatgagatttttcatgcctttttttggcctttttccgaaaattccattaaaatgcaataaaagtcggtctctagttattagttgttaattagttaattagccagcagtgtcaggtgctcattattagatg

SEQ ID NO: 20643 - DNA, 2103 bp, Heterodera glycines
ggggacctctagagtcacattttgatgatcaatttttaggcgaaacaaacgtttgatgcattttactaaatttattttagcaaattatttattaaatcttttagataaaaatttaaaaaaaaaacatttaccaaaacgctttacgtaagaaatgaaattgagacgataataattgattgtgcaaattggtacgattggatttaatgctaatggtaaaaacattggaattgctgccagtaagttgtaaagctgtaaccaattcaatccttgtgggtcaattttgaaaataagaaaaacacaataaaaaagaacagaaaaataaataattaggggcatcgaagcctaaataaacaaaaaattaaattaaaaaaatatatattttttaatttacaataataaatgattaatgaaccctgaacaagcagatttcgagaaacttgtttattcatttcaatcatttttttggttatttcagaagaagttgaaacgctttaaaacgcaaaaatttaaatttaaaaaaattaaaattaatttacgatttcgatttcttttccaagaattgtttgatacgaaatgccagcacaaacattatgagataagcaaaagtgcatactatgataatgtaacagtaaccaatagtcacacggacatcctaaattagaaacaatttttttaatttattaatttaaatttacattaaatgtatatccagccaaaataatttgatcgtcgagattaatgccgagaattgccgcgacgtatttatcgtccaaaattgcgtgatcagaaggagggaaaaagcaaatgaagacattaacgcaataagcaaatgggaacaaaagcatcagaaaaagcagcaaaaaatatttgagggacgaaatgtttttgtcacttaaacttggaaaattattttgattaattaattattttgattaattcaataattaattagcgtaccgaacaatgacaaaatagcggaaaataaattgtgacacatagccaaacatggacacgtagacaagaaacatccagaaagttaatgccaacaaattccaaattcgattttccaccccttttatggtcaccaatccgtgcacaaccatctccgtttcgcctttttccgttacaacattactctaattaaaataaaaaatgaaaacaaataaatatatataattaaaataaaataattaaaccggattgaaaagaagagtcattgtaagcattaaaatgtctgtcacgcatgtttggactaatatctgtaatttatatcaaataatcatataattaattaatgcgatttgtttttaaattataaaaatttcaaatttcaaatgcactttgctgtaaatgcgcatttgcactggtgtgtgtcgaacaatcaaatggatcaaaatgccattcaacaaaatgccaaatccgaatgccgaccaaacaaacaaattatcgattaaactcactatagttatggccataatgcaaaaaatgtttactctaattaaaaaataaacaattgcttaaaattaaaatgttgctttaatgcaacatagccctttctagaagcatccaaattaaacattcttagtatcattagacagtcctaagattcctctattagtctgtaaaatttcaaaaaattttgttctgtttaaaaaaaataatggccagaaaacttcaaaaaattattcatttggatgattctaaaaaaagttatacataatgcattaacgtttgtcaaaaaattttaaggtcatgtctatttttttgtggtcgcggtgaaatggaatagaggcaaaattttacacgatttgcccatggaaagttggtaaagtagacaaaaaaatcataagtttataatttgaaatggagcataatatcattttagtttgccaacttctcatgtaaaaatttaattaaataacagtaatttactgtatcattaattcaatttctttgcttctcatagtaattgcttttgaaacagtgtctattattaatttaattttcttgtttaatgtgaaatatcaaattgcatttatatatatatatatatatatatatatatatatatatatatatatatatatatatatatatttgcta

SEQ ID NO: 20644 - DNA, 3024 bp, Heterodera glycines
attttccagttttataaaaagttgcagattattaaaaataatattttattgaatctctttgaaattttgcagacagaaagcccttatactaaactattttcctgcaaaatttaacatcattctgacaactacgaaatgaacatgaaaatcaacattttcaaaattcgtgtcttttatttgtttaaaatttccatccctataattacattaccaatttaaaaatattttaatgacaaaataaaagtgtatttgacatttttacattttaaattaaataattaataaatgagggatattgttttatttttaattaaatttccgataaattttttatatgtatatttatttttgttttattattaaatggatacagtttttttttagcttattcgatgtaaataaattatttaaaattgagaattaaaaagaaatgttttaaatttacatttatttcattttaagaatttgttaaaatttcacctaagtaattagtcttactttattaaaatatttatattaaatattatttattttttttataatttggattatcggcatttttttatttatattaaactcttgttcttgacgcatccctagggttcatccgtcctctccgcctgtcactttaatatgtgattttaatttcttaatcgtatttttagattatataaataattaagcagtatttgcgcaatttttaaaatttatattaaattttaatattttatttttcttaaatcgcgtgttttttatttatttttattaaaattattactttgtttattaataaaattatttattttttgaattctctcaattgttctgcattttgtcgatttttttttcttttttattttattatttatttttgatttttgattcactcacaactttctttatttatgatattttatgatgcctttgtcttaatttatgtattttttttttattcattttcatttctaaatcgttaggaattttttaattaaattggaattaaaattcacaaaaaacattgaaattttaagaaatcgatttgagtgagtacgaaagctatgcttagttttgagtttaaaaattaatttgttattttagtatccattttaggtatttcaaagggaaccggaaaatccgaatcgaataaattttctttctttatcaaaggcaatcaaaccccaataagactgtagaaaagaatgttgtgtgattagtccttaataaattttcgctattttttacgttttaaattcatatttatttttcttaatgctttcatttatgtttacatttataatttcttttaggcatatcaattaacattaattaaacattgtaattagaattttttcacatattacgattaataagtgcttatttaaatagcactgtaaaaatattataaattaattcattcattgacaaaatatttttttttgctttataatcaaattaaacattttttgtctatttttaaaattattactattttcattaaaatattcatattttaatattattttatttattttttaatagatttgttatatggtttttgttttttcatctcgtatttccgctgcgtcaattggttctttaaatataaattaaaaatattttgtaatattttatatttttataatgtaaatttgtaattattaagcaaaattgggtccggcggcgtcgataggtgccgccgggaaaatttttttgaaattttacggcattttgttaaaaaaaaatgtaaattagtgttcctccacgaacaattaaaaacgcgaagtcataaaagtattgaacaattataatatattctttagaaagttagtttatttttttcttatttcttacattctttttaatgttcttattatgcatttttaatgtttaaatttttttattgctgttctatttttgaaataattcatttaatatttatagtttatttataatttggaatataatattttgtttgatttattaaatcctgatgaattggatgaagcgttttaggatgatgaagctactcaaatttatatattaaaatgggaattttgttttcgttttttcaatgatttctggtgattattttttgctttataatagatttcgtttaattatatttgaaaattgaatctatttatataatcgaaatttagtataactgcttatacaatctctatgaaatttattttatttatttctagtgcaattattatttttaaatttatgacagtttagatcatttttcattagcgtaatttttaatgaaagagtcagattttctttttcaatgctcgtaaataagttttgagaacgcaaaaaatttctttattgtcatacactctctcagcacgtcgataccatcatgatttcatctgatgctgcacatttcgcgacatttccttcattcttcgtgacacttcgaagaattcgcgtcgaaatgccaccagagctgccattaaaatttcaacgttgttggtacaatagcttggtagcgattcattcaaagaaatggttcgtagcggtgctcggcgtaccatttatcaaacttttaatgagcaaggcatcaaattataagagtcgcgaaaaattatgttggggttactcgttttcttctggtgcaccttcatctcataaagcttgtttccttttcttaatatgtttgggttaaagccaatccggaagagctcgcggaagacaagcaccatatcgaaacgtccaccaaaatgtgaataggcatatgtgtcgtatttctttggaagttgaaagacgagccaatccacaaatgccttcagtgggttctctgtcaccacttgtttattcacttgcgtgtacacaaatcgacgttggcagaagacgacggtacgatatggcccgcagatctggcagcccgccgtcgccttattcatttgccgttgtcgatgcaatttgggcacgcaactctttgcgcgataaaagttggctgatgttgacttttctccgactgattggggtccatcgcctggtgctgcatcgtttcca

SEQ ID NO: 20645 - DNA, 1153 bp, Heterodera glycines
  misc_feature (1135)..(1135): n is a, c, g, or t
ccggatttttattcttggtttttgaagcctcggaattccccaaaaccatttttgccacggctccaattcccttcatacaatggcacactgttgcggcatcgactgctgctgaagggagcccctcgtgccgacaaatgacgccgccggcggtgccatcggacttggcggacctttacaaaaccatgcgtagagagaaaaaggctaatgaaaagtgccacgcgaaaaatggcactgcattcaacacgtggacagtttcggcacaacttactcgaaaaggagaagccttggcgccatttcgaggttttctgctcacagaatttgttcagcccttggaagaagccgccaaaggcattgttgaccatcgttcggctgaattttgccaaaacgaattgaaaagcgtggagggattttcaaatttcaaaaacggacaatcgaaaaaagaggcgcaaaagcaaaaaaggacgacggcactttgccaatttgcaaatttaatcatgccattccccggtgtgggcggaaaatctgtcaaaaacagaaaacggacgacgaaggacggcactttgagagggcacttgaaaagggaggggaagtgaaccgaacgaaggacgagacgaatgacgagcatttgccaatttgaaaattgatgatgggcgagaaaagggaaagaaagcatcacacctcacagctaagcaatgctttaaggcatttgaaaaggcaattagtctcccggttttttgaagaaaagcgcccaagggttgggttacggttttgggtgggtgggctcatcaactcccaagtgcgtcgtgatgaatgagtttgcatgtgattaggtggattccaattaatgggactacatatagcatataaatatattttcccataattaattaaagtgatacttgcgtaaattaggaggtttatatttataaattgaaataacaaataaaaagcgaataaaaaaatgtcaaattagtataaaacaatcggtcttcgtagtgatcaaggcttgttcttcttcttccctacgcttatcgccacaaataattctggaaaaattaaaaattaaattacccaaagagcacaaaattaactaattagcattaattattaaatacgctttctttctctcgccttnaacgcgtcactgagcacg

SEQ ID NO: 20646 - DNA, 1352 bp, Heterodera glycines
  misc_feature (1178)..(1178): n is a, c, g, or t
  misc_feature (1294)..(1294): n is a, c, g, or t
tgaaagtaccatcttctgttgcttttgttgaccaagctggtgtatcttcagcccctgtacttgactgtcaaggtgttcaacaacagttgtctcaacaggaagagagaattttgacagacaaatcaaaaaaatggaagcaattacaatcaaaaagatatgcagaaaaacgaaaatttggctttgtcgattcacaaaaggaggaaatgccgccaggtttttttacatgggtttgaatttaatgtatcaacggaaggtatttagtgagattcctctaagaatgggttggggtatgtaatgtacttttccccgggtatgcaaaccttaatcgaatagccaatctttggtttcttggactggaggttggctaatgttaaaactattcacattcagaacatgtccgcaaaatcattcgcgatcacggggacatgacctcaaggaagtaccgtcacgacaaacgagtttatttgggtgcactgaaatacatgccacacgcggtcataaaactgcttgagaacatgccgatgccttgggagcagatcagagatgtcaaagtgctttaccacatcaccggcgccataacatttgtaaacgaagtgccgcgagtgattgagccggtgttcattgcccaatggggcacaatgtggatcatgatgcggcgcgagaagcgcgaccgtcgccattttaaggcattgttttttatttgtttattttttgtattcgaaattcccgttttaagagaatgcgtttccctccatttgatgacgaagaacctccgctggattatgccgataacattttggatgtcgaaccgcttgaaccgattcaaatggaactcaatgacgaggaggaaaatctcgtgaaggaatggttttacgattacaagccgttagcgaagacgcggtaacattttgggttacgactttaaattctttttcgaaatttcttcctcagctgtaaaagtgtcatttacaaagcaatttgtacttttcacttttaaggttcgtcaatggtgaatcgtacaaacaatggtcgttcagcatcccgattatgtcgactctttaccgattggccaaccaacttttgacggatctgcttgacgaaaattacttttacttgttcgacctcaagtccttcttcacagcaaaagcattgaatgtggccattccaggaggacccanatttgaccattaatgaaaggaactcactttcagtatgtctctttataccatttctaccgaatagggtgctaacttttaattctataaatctggaatcacacttaaaaaataataanatatctaccaacaagaacgaggattggaatgagttcaatgacataaacaaagtgatca

SEQ ID NO: 20647 - DNA, 814 bp, Heterodera glycines
acatcaaaactggaggactatgatttgcctgctttttactttgacccgttgatcaatccgatcgctcaaagaaatacagaaagggtaagcaaacgctgaagaaaccatattggcagcgggtaaattgatcgaccgcaaaaaatgggcaaattacaaaaacggttttgtttgttcgtgttgtggaggtcgtatataatttggcacattcaggcggatttgaacccaattggtcggttttgatcagattattactgtgtcacattttcagatgcccgagccattgcccggcgatgacgaagagttcgaaattccgtcagatctcgtgccgatgttcaacgaatttccgctttacactgaaaacacggcaaatggaatggcacttctttgggccccacgtccatttaatcttcgttcgggacgaacgcgtcgtatcatcgatgtgccattggtgaagtgttggtaccgtgagcattgcccggcgggcatgccagtcaaagtccgcgtctcataccaaaaactgttgaaagtttttgtgcttaatgcgctaaaacatcgaccaccgaaaccacagaagaaacggtgagcaacaaaaaaaagacaacacaaacattctttaatgttggacaaaaatggggagagaattgacagttataagaagaaaaatttaaatgaatcaaaaggtataatttgcatattatttattttagttatctcttccgttcgtttaaagcaacgaaattcttccaaaacaccactttggattgggtggaagccggtctacaagtgctccgccaaggctacaacatgttgaatt

SEQ ID NO: 20648 - DNA, 1822 bp, Heterodera glycines
  misc_feature (1782)..(1782): n is a, c, g, or t
gtaaatagattaaaaatttcgacgtctccatactttcactactttcgttcgaaagcttttttttgggctctacaacatgtgtatgagttttttatgttgccgcactctaaaatggtaccagctagtgatcagtttaacgccaaaatagttgaaaatagttttttttcaatttttaggtgttaaaaaacgaaatcgtatccctagatatgatacacgccctattcattaataatttcataaagacatatatgtagaatcaaactcagaaaaatactgaagatataaaaacacccaaaggtttaagcggtttttatccttcttttgaattcttttattttaataaatttgatttatttgaaaaatagaaatgcatttccttaccggcaatgagcaatccttcgattctgagggtcaagaggctttgcttgactcggcacttaaagtggtgaaaaatgagtccttcgagatgaaacgagcgttggatcggaacgaactgatggaagggctgaaacacgccgcacaaatgctttgcgaactgcggacatctcttctgactccgaagttctattaccgattgtgtgagtcgaaattgaaaaaggaaaacccacggggcgtacagtcaccgcctttttggcaattgcttcgttaagacatcgacgtcaccaatgagcttcaacatttcctaatttatctgagcgaccgatatttgggtgaagagcggaagtattcagttgcggagctttacgaaactgtccaatacacggggaacatcattccgaggctgtgagtttggttgggaagggaagagaagggtaaaagggctcgatactcgataatcagcgattgtttgttcttaggtatttgcttatcaccgttggcacaacgtacataaagtcgggcgagtcttcgaccagcaacattctcaatgacctcgtcagtgcccccccatggctttgctgggggtttttgttttaccattcgcttttctgttttgtttcttctgttggaccctgtccgtcccttatttcaaccaattcccattttcaggtcgaaatgtgccgtggtgttcagcatcccctgcggggtcttttcctccgcaattatctcctcacttccaccaaggaattgctgcccgacattcccagcacttcgtctgaaaaatccgctcaaaattttgctgcatcggaagaagaagaagagcaaagtttgggcacgcaaataaatgggggaacggtgcgcgacacaatcgaatttatcatgacgaactttgcggagatgaacaaattgtgggttaggatgcaatttcaggtgctttttaaatctcaataacatttcgagtacaattagggctgtgtccgggggaagaaaatcccactccctcaaatcaaaattaaaatttttcaagaaaaaatagacaaatttttagaaattctaggcaattttcttaacaaattaaaataaatttccaaaaaaattcccggcagcacataactataccgcggacccccattttaccacaacattttttgatatattgcctcaatttctatacaacaaaattttcaggcttagaattgtttacaattagtctatcattttaatttggtttgaatttagaaattgcttatgtcaatttaattttcctgcatttccttttgtttttcttgcccagcaataattaatgttccgttttctttgttttttagggtcccagcagagagagggaaaaacgtgagaaagaacgtcgggaactgcgggatttttggtcgggaccaatctggnttgcgactggtcccaatttgcagaaacctgaacctgaact

SEQ ID NO: 20649 - DNA, 2644 bp, Heterodera glycines
  misc_feature (1244)..(1244): n is a, c, g, or t
tttacggaggggaggggggggggtaattaggaaagacaataaataggaaaagccttataaggaaccgtttacatatcaaataagcatttgccatggttcacaaaacgcaccgacagatttcctttggttggactgtgagtctgcggttttcagcaccaaaagtgagttcggcgtccaaatccgtttcattcgcaacatcgacgatgacaaaacgactgaagggattgtaaccgggcaaaatattccacgaagaaacattcactgccggaacaatcgtaacggccattggcagcttggcaaaacggacaaattccttgaaacgggggacttaaaaggtataaaaatcatagacacctcctcaacgggtaacatttccaaatcggcactataggaaaaggaaaattccgcgcttagaagtcgctaaaaataagaattgcattgtcagatggtcatgtttctcattttcagtaccccaacatatgggatgaggtcgtgacggtcagtcgaatgctcttccgacgaactttccctctccaaaagcggggcggattctgccgacgatagccgcggcttcctcccttcccccgatgagggaatcgttgagggggaagaagccgcatggggcagggcgtccgactcggcaacaatggcaagggttgaggacgaggcggaagtgggacgacggacaaacacacgttgtgcttgtccaatgtgggacggattggatgccaagccgattcggtggtcggaccgattgtcggaaaagggcgtcgaagatggatctaagacacggccatcatttgcagaaaccgaaaaagcattagacgaaaccgattccaaagacgcgaatgttcaagctcttccgttcccccggtttaagcccatctatccgacacgttgacggggaatgaccaccggcagaattggcactttcaccggagaccatttggaagagcattggcccagcgcaagtctaaagggtggcaatggacgaagggactgacaaaagcacctggggttgttggattttgatggttatgtgcttaattcccactgaactgctcgaattacacaatgtgatggtgtggaagtaactgaaaagagacggacttcgcctttttcgtccctttgcacattttttacctttgcccggtgaatacgcaaagttccgcgatggaatcattcggattttcgctcaaagtcggcgaccgctgcaaggagctttcgatacgaagcgatggcangcgggggaaggactctgacggagaattggcgatggtttctgttcggctcttcgaaggtattcggtgaaggaaatttgcacaagtttttgcatccgagcacttcgcaagcgtagccaatgattttcaaagttccggttgacctgcaaaaagtcgacgattttaccgaacgtttttcaacattttcagacacctcggaacccccagaagtttcacttcactttgggtgggaccaatgcacgggccaaaacacgagggaaggctgagacggatcggaatgtgctcgaagtggcacccctcggtgatcagagtcaaattgttgacgattaaatcgacgggcaatggattttgcactttcactgaaacttcggaggcacaatcgaccacccaacagagttcatctgagaaaaatggaaataaggcgaaaacggggaaaaaagcacttgcctttctttgccctttcttgaaatggcgaataaatgaaaattttggagttacgcgacgaaatttcgacagtttttggtgccaaatgcgagggcaaagggaccactcgaaagtcccttaaaaggacgaggattcgaaattaaagaccattcggacaataaaactttagcgcgggaattcgcgtgagttgcaaaggcgccaaaagaacgggcggcgacgagtcgagggacaacggcacggaaaggacgtggaattgggcggattgaatcttggtgagtttgttcatttcctccaccagcgaaagcaacgcggccttgtccaaatggtcaaaaaaagactgaagagaaaagagtaaaccaaagccattcaatgcgtaatgaattccattgaaaccacggcattggcatttttgctattgcatttattttgtttgtgctttcgcccctcctccttacctccaacatgaagctgaggtgtcggatggccatgttgtgcagcccggccctaaccgcgacggtgcacacttcgtgcaccgctttgatttggagagaaaaagtggcggaggtcccttcgcccttgggctctttggcataattggaaaatttgccaccaatgccatagccaaaaagactttcgttgagaattgggtaaacctaaaggaaacagaatgaagatttatggcttcagccccacctttttgtagtcattttcggaatgattttcgatgaataatcggaaaaacacggccaaccgcaaaaaaaaggcacattttcgcttaaagccaatctaaaaagcgaacggtgcgattgtcaaaattgtgccaaatttgaagcgtaccattttgtacacttcggacgcggccaaacaaatgttcgacttcataatattgtcaaatgtaaggaatttgtcgtcgagaaaaaggcaagtgtgttcccgaagaaaagactgaaatccaagca

SEQ ID NO: 20650 - DNA, 997 bp, Heterodera glycines
ttttgtgtccaacaaagcttaacttaattttcataatatctctgaataaagcagggcttcgatttgttcttatttctaagaaatgttctgatttactgatttcttgaaatcattcaaaaattaagaaattttatggcgaaatcttgtccataatttgtttaagacgaaaatttttgtcgtttttgaacaaaaaataaagaaattagccaaaattcttttaaattgtgtcaaacccgtaaaattagacattttgacaaaatctgtttataaattgcactcaaattttcagaatttctccggcgggcgccggggggggtgaactatagtgaacgccccgtgaaaaaaagggtgatataccaatcgattcgtctcgagtagctacgcacggaaaaatatgtctcgagttgcgaaatgccaaaaaaccgggttttgaaccggtttaaaactcgaaaaattgagtgaaaacttgagcctcgatatggactaaaaacccctaattattttttaaaaattccaaatctccacaaccagatagctaatctaggtagcgaagctcaagaagcgcgaagcgctttatcccattcccagagccgacggttcatgcacccgctagtttatatataactaaagaaacaaggcaactcatttccaaaaacaaaatctcctacggggcgtagggaggagttcgaaatttcgaccttggggaaaactttttgaggcgcatctgggaaactatagattttcgatccgagggccaactgagcgccaggcgccgaaaagtgactttttaattttgcttcttcaccgacctcgtagggcctaccagtttttctgaaaaactggctaaaaatggcctacttttttgggccatttcagcgccggcggaataactcgccggggtttgattggaggaggtcggtgtaagcggcttttttgtagagcttgacgagctctatccaaccatgtttttagatttcagaaattttcagaaattttc

SEQ ID NO: 20651 - DNA, 1825 bp, Heterodera glycines
  misc_feature (100)..(100): n is a, c, g, or t
  misc_feature (202)..(202): n is a, c, g, or t
tgttgcaatggctgcaaaccgtgcccatgccgtactcttcccgtttcattatgcacaaaaagccacaaaaaagtgagaaaaaaagacacaaagtgtgatnttatatgggacaagacagacagacaaaaggatggataatgtacgttgtacgggtggtgatggccaaatttcaatcaagtaaaagtgccaaaaattactttcncatcatgaaggggagataaattataattttttatgaaattattgtacatgttttggtgcccttttgatggcatcactataaatgagaaaaaataactttcaaaaaccccgtattttttatccagagtcattattgattataatatttttcgaacactatatatatatatatatatattatgaacagggaaaccgaaacaaattaaaatttgaagaaaaaaacataattctttctttttggcatgtaaatatttttgtttaacgtgaaataattagcttttgttacaaatttaaaataatttttttggcgttaaaatggtaaattaagagaaataacccacaaaaaacattatcaaaaagcaggaaagaaagtaaaaaaacttgtttaaggataatttgtgctaaatttagtgggcttatcataaaattggcccacaaaatcaattcattatgcttatacaatatgaagcggcaacggatggaaagtcaggccaacattgaagcgcatttcaagttcattcgaaacgccctcagtgaagtgctcgcgaatggccgctttctgaatcaattttcaaaaattttatttaaattcgttattaatatattatttataaggtttcgtttttaggcacaaaaaatcgcaaaatatgcattaaatggcacaataatcctcaaataggaacacaaatatgtaggcaaaaaaaaattgtttgcattaacgctttttatgaagtaaaacacgtaaatactaaaatttttcaattgtaaatgatattattaaataatttaaaaaataggcattataaaagtcatgatagaccagggttcggatctattctgatttatcagaaatcttctgatttggaggtagtgaccaaaacaaaaaaaatttccgccggcccttttccctcgcccatttcccaaaagttttggaaaaatgcgccgcaaaaaaaaattcttaaaaatctgaatttttgatcccgaatggcagatcagaatctcaattaaaaaaacttttgtacttcatttggggaataaaaaccccaaagaaatatataaaattgatggaaatataataaatgttgtggatacaattagggatttaggcataaatattgataataaattgcaattttccaatcatgtcacacaaataataaagaatgcatatttacgtatgcgttctttatttcgggttattaaatcaaaatcttctaggatttggattattttgtacaaaacttatgttagaccgttattggaatatgctcctgaggtttggaatccatctcttctaaaaaatattaaaaaattgaaaaatgtcaaaaatatttcaccaaaagagttctttttaaatgcagccttccacccattccataccaacaaagattagaataccttcaactgccgacacttgaaagcaggcgaaagctgtctgatctgttcatggctcataaaataatttatggccgaacagatcttaatccctttgaaatattcaaaccttctgaacgctttaacattcccttttatagacttaactcgaaatataaattaggcaaaaaatttataccttttgcggggagggtaactaaaattggaaccaactcgataaaaggctcat

SEQ ID NO: 20652 - DNA, 1310 bp, Heterodera glycines
aaaaaatattaaaattaataaccctttttttttggtttttatttttagtaaaaattaattcaaagtatttttggaaaagcgatcagaaccccaccaatttttgcagggatactccccagtacaggactaaattgtcttgaaaatatccaatgcaatttataagggcgattttttgaaaaaatatttaaaataattacaaattttttaggcttaatttaaaaaaaaatttcgaacagtcagacagtttggggaggatgaatccttcgggaatagatttgatattctctatactttatatctccccgttaggtctgtcccgcccaaaattggcatagtgccggaaatgggcgatttattgaaaaaatattcaaaataattaaccttattttttaggcttataattttagtaaaaatttaattccaagtaatttttggaaaagcgatcagaaccccaccaatttttgcagggatactccccagtacaggactaaattgtcttgaaaatatccaatgcaatttataagggcgattttttgaaaaaatatttaaaataattacaaattttttaggcttaatttaaaaaaaattttcgaacagtcagacagtttggggaggatgaatccttcgggaatagatttgatattccctatactttatatctccccgttaggtctgtcccgcccaaaattggcatagtgccggaaatgggcgatttattgaaaaaatattcaaaataattaaccttattttttaggcttataattttagtaaaaatttaattccaagtaatttttggaaaagcgatcagaaccccaccaatttttgcagggatactccccagtacaggactaaattgtcttgaaaatatccaatgcaatttataagggcgattttttgaaaaaatatttaaaataattataaattttttaggcttaatttaaaaaaaattttcgaacagtcagacagtttggggaggatgaatccttcgggaatagatttgatattccctatactttatatctccccgttaggtctgtcccgcccaaaattggcatagtgccggaaatgggcgatttatttgaaaaatattcaaaataattaacccttattttttaggcttataattttagtaaaaatttattccaagaaatttttgggaaagcgatcagaaacccaaccaatttttgcagggaaactcccccctaacggactaaattgttttgaaaaattcacatgaaattttaaaggcccatttttttgaaaaaaaattaaaaaaaattaaaaattttttagggttattttaaaaaaaa

SEQ ID NO: 20653 - DNA, 2296 bp, Heterodera glycines
ggaattgatcggcggcaatccacgacgtttgatctccaaggaaaggccaaataactgaacgtttttgatggcacgttcgatcagctacacatgaaaataaattttaaattttgaacaacaaacaaacaaacaaacatactttaaggtcgtccattgggacgtgaagaaaaaggacgggggggggacagtgtcagacattttgttttttttaaaagaattattttgcagaactgaaaacggaggtgtaccggcaaacaaatgaataagaaagaaatacgtttagagagagaaaagaatagggagggaaaactatgttttaggcgaccaaacattttgtgtagaaaaaagcactcatcagaaaaaattaaaatgtagaccagacatggaaagagagaaaaatgagtaataaaaaatgagtgaattccctatttcccctcacttttatacacaccatcccagaaatgagctccaataccaaaaaagatttaaatacctgtctcagtggtctgtgagaaagtcaccaaaatgggggtcccaggttcggttcccagtgcatgctatagctgtatttcgatgattttaatgaataaataaaaggaaaagtgaccaaaataattttaaaattgtttcaaatttttaaaaactttatctgccgcttgtaatgaaaataaaaaccatcaatcctcgatcagtcaacgatatcgatgtcggcatcttgatcactttcttcattcattttgtcttcctccgcttgctcccgctgttcctcctcccgcttaattagttggacaacattttttaatgcccttctctcaacccacagcttcaattcgtcaaatctcccggtgtccagcagccaattcgagacaaaatgatgttccagctgttgtcgcatttgttcatcgtccggcatcgtcttccaaagttgttcaagtcgccgcaacacggaatgcagtgcctcgtctcctgaaaaatcacaacattcaaaattggactcccaaaaatgatatggtcccaccctgctcatccaaaagccccaaaaatcggtgttggcgcgcaaatggaacaaatgttgaagcagcaaatgggcctttgtcttttttgaaagaagtgtttgcaccattgattgttggtcgagaaataacttgaactgaacttgccgtctccagtccgtccaaatcagctggagacaatggctgagccttaaatttaaaaaattatttccacaaaaaaataaaaccaattactttggtgaaaatttggattttccccaaatgtgccattgtttggcaaattgttttcgcccattccgtttcgacaagattttggtgtggatttaacgtgcaggaaaaaagttaaacgtcacgaagtaaattttggaacgcttcacgaatttgcatgtcatctcattttttgtctaacaaaatttatttgatgtgaggtgagtatcctcacaaaaaattaaacatttgttgtttcattttttattgtttaattaaaaattaaggcgagtgtttacttatttgtttttgtttcttttacaattctttgtgcgtaagatggacactgccaattcgtcagccattgtccaacctttgaaaaacattgaggagcaaaagcgcattgcacagcttggtaaaaatggatttcgttcctaataaaaaatgtttaaaaatctgatagggatcgaattctggcgagaaactaaagaaattggcacttttcggttgggggcccgaaaaattccaaaggctacccttttgtagtgatttgaaattggttgaaatagctgtcagatttatgattagcgacccctaaaacccacctcaacaggctttacgacattgacaaaaaaaaaaatttgcaaagtaaagtggtccctctgggaaattttttttcgttgccctcaaacaacaaaaatgtcggataattgatttgagttttcatttcatacaaatcctcgagtctattataagtgacttaccaaatgttgttttttactggatatgaaaagagtgcaaaaaggccaatcattttccgtccaacttttttagagcgcaaaattgtctcactcagcaaacagttggatgagaagggcacagatctcaagaaagcgttggagcaaaacgcatcgttgaaggacagaattggcacactcggtgagtgttttgtgcccttaaatttaaggacatgtttcgaggacggatgagaaatttgtactgaaaaattttagagcaagaaaaatggaagtctctcttctcattgaaacattgacaaagagccgggacagactgct

SEQ ID NO: 20654 - DNA, 1265 bp, Heterodera glycines
cgagaaaagaattgaatgacagcaaaataaattttatcaaattaggtcccaaatatttggtaaatatttcttgctgaataattcctaattttgttcttttaagttagtcgtgctgccaaattgatgtttatttatttccgttgtcactatgattgtatgtatctgaataaattgcgtaaagaaaaattcactggtaaaaaacctgtacaaatagcaccataacatacttttaaatgccgaattaatgtaaattttggtagattctaggcagaaattttacaaaatgtatacctattgaatataaataatgtaaaatgtcaaaataaagaaataaaaaataacaatatcattagaactataatctcatatttttaaaaaataaaatatttaaaagcatgatcgtaataatcaggtgaaaatctattgacgcagccaatgcgcaaggcaatcgcaaattttgaaagcaaatacagtaagtttttgccataaattattaaaatattttaaattaacgcgtccaataaatgcactttagaggcagttggcactttatttcgtgaatttagaattttaatggacatcagttgaatttactgaacgatttttaagaaatgcattagacgtaaaaaaagcaagatatattaataaattagttgtaataaaaataaaataactaataaatgtttaataaaagtattaaaatattttaagaataaaattaattggcacacggttgcaaaaattaaaaaaaaaattaattttataaaaatcatgaaaataattctttacaaataaacaattaacacagaaacaaccgcaacatataatgtttctccatcgacaacgtcaagattccggagccaaacagcttgtaaatatgtttcttaaagaaaaaaatttagagagaactactgcccatcgcaacaaatgaatgaatttattttaaatattataaatttgaaaaatgcctaaaaaataaaaaataaactaatttttttataatcttcaattatagttagtcaataaaacttttttttaatttaatttaaagaaataaatattaatatcaaaatactaggttaaaaacaaaagtgcagacgaatacattatgttgtaaaaatgcatgagatcatcaaaacttttgaaatttctaaaaacacaacatatacaataatttataattaatataataaagatattattgaaattaatcaatcgcttttcacaaaagaaatttcaatatataaataaattctaatgttcaa

SEQ ID NO: 20655 - DNA, 906 bp, Heterodera glycines
  misc_feature (898)..(900): n is a, c, g, or t
gaaaaaaaaaaaattaattttttttaatttcttacaataaaaatgaaataaatagataaaaatttataaatttgaatatgtataaaaataatgattcgaaaaccctaaaaaatcgttgttttccaatattaaaaataatgaattattcttaattcacaattatacaattttaataacaattttggttaagttgaataaattacgagttggtttttcccgaagtgcacgaaagttttcgagtcgtaaattaaattttttcactaaaatattccaaaaatatgtcttaggaaatattttaagttgctaatcccaaatatgcaatcattagcttttctttattacatcgataaggctacagatccctacatatctgggattctgatgcatcattctgaggggggggggggggggggggaagggttaggttcgaatcctggtgagtaaatgatttttctacatttaatgattttaaacatttaaaaaagtttcaatttagattcgaaaagggtagataattggagactggcatataattagagaaaatacggtattttatttttgaatatttttatacatttttaatgcgctctgacggcgcctatcagcaccgacgtatccaaaatttaaaatctgaccaataaattggaaatttttggtggataatcttcaaaataaagccaaaatcttatacaacaaattaatgtatttttctattttagatatgtaatttgcttaaacggtacttactaatttgaaaaactgccaccgtttattttttaaatcatatcgccagggctggtatatctgaggctttagcctcattttgtggttttttgataggtcaatgaggctaaattttcaaaatgagaaattttgtggttttttgaggacctgcagnnngcatgc

SEQ ID NO: 20656 - DNA, 2343 bp, Heterodera glycines
  misc_feature (53)..(53): n is a, c, g, or t
  misc_feature (63)..(63): n is a, c, g, or t
  misc_feature (207)..(207): n is a, c, g, or t
  misc_feature (235)..(235): n is a, c, g, or t
  misc_feature (364)..(364): n is a, c, g, or t
attgctcctcacatttatttgttgcttctttcgttcccatctaagtaatgttngggttttttngaggagttgtgggttcccttgatgattataaaatgatgggttgttgagttttgagtaggtgggtatgtaggtggggtagagagggagaattttaaaaatttagaaaagggtggtattattttgataaaaaaaaatttaaaaaanattaaataatttagaaaaatttattttnatatttaaatgaatatgatagaagagagataatgatgtggtgagataaatagataaaataagatttatttagagtatgagagagaatggaaaatgataatatgtataaaattgaatttttgagttgagngtaataaattatttgcccgaagccaaccaagggtcggattacgccctctgattcggcttagatttccatccctagtaattaatctgtgaatgctaacttttcttttgaaatggaatttaatctgttagtgctgtccgtatatgaacagtttagccgactcaataagggaagggaaaatgttgaaaggtcaagattaataaatgcatttaaaattatcagaaattaagtcttcaaaagttaatttaaacaaagacaactgtaaattaaaaatttaatagtttatttttaactaatcattttagtttattttattttttcaatttcataattaaaatttgttaattagctatttgtttagactaaattaaaattatttttcaatggcaccgcccgtcgaaaaaaagaaaaaactttccttcgtcgaccaccgcctcatttcttctgcagctattggtgaaaatgaacagcaaccgatgggttcactcgtgacatcaagcaaaatgaaacgccctttaaaaaaaatgtgtgcaaaacttttggaaaattcattcgattgggaatttaatattagcgtatttcataaaaataccgcccccctccacattaaattagagccccccccccccgccactaaaacaaagcccccctttttagaagggttgaaaataaagcccccggggctcttttataggaaatacggtacgcggagaaacacggtaatgcaattttttgaacttttaagttggatttgtacggatgttttgatggacattctcccatcttttgaccatgcccaactcggactcaaaatggcattgctttccgaacgtttcgatgttttggtggacacgcattttgatggcaaaagcgaattgacaatttggagaccaatgacaattcaaaaggacaatggaatgccacaactctttgtcatgggcaaatctgtgccatttccgttgcccgacggtccgctgcccaacaaaatttgctttatggatcttcggattatgtaattcattaatagggcattttgaacagtgaaaccgtttctattgtagttacattgaccattccgtcctcgcatttctccgtgccaataagcaaatttggtacaaaagtggcaccaaattgggtttgacagtgtcgtcaattgacaaggattttgcccagtcgctttgggaaatgttcgtccgtgaaatttggcccatttttatgacaaacattcgccatttgacttttcctaatggtgctcatttggacaattttcgtcgtcacatttcgccaacatttctcactgatcttgatcaattggattcaattgaattcggttttctgtaccctgacgggacaggtgatgatgggccaaatgcaactgctggccaagcgttgtccaaatggttgcacattccgcgaaaagatggccaacccaagcgattgtgttgcagattttacactgaaccatcaatgccaatggaatgggttgaaaatttcaaaaaggtcgacatggacatatttttcgcaaaattttcgttttcccattgtttaggcatttctctgtgccaccatttcttcctctgcccgctacacaattcactttatagtctccgcttcaatgccaattgtgccatttgaattggtgaacgaacgaatcaaacaaaagctaacactggagaaagaacgcgattttgtattttctattctatggaaaattaaatgttgtccaattggggagaggacggatcaatggaatgccgagaattgggataatttgaacggattattcttccaattttatagtggcaaaaattgcattgggtgagaaacggcatttgccattgctaattgaaccaaaattgcacttcatttagcccattgtctccaccacccgaagtagaagcgggacaaagcggagtaaaaagcgcttaattatttgggagtcaattaattaattaattgcatttgacaaattgccgatcatt

SEQ ID NO: 20657 - DNA, 1712 bp, Heterodera glycines
aattcaggaacattattgtgacataaattagataattattgcaaaccttataaaccaacgcgttggcaaacacggcgcctcgcgccacaaaggcattgtcaaagttgcgcttgtttatgcgcttaaatttttttttccaaaaattatggttaatacctgaaaatataaataaattaaacatattttaaaatatggtataaacatttaaaaataaaaacaaatctacaaatttattaatcatagtattgatactttttagccgagcaaaaaataacacaattaatttatttttaatggctcccgatttttctctatttctctaacacaattcttttcattttttctctctctttctctcactctctcacttttctatttttctatcgcacactctctcctccctcactattttctctttttatcaattttgtattattttcaattgaaataaattaaaattaaatttttttttaatttttaaaatttttttgaatttttaaaatttcccggttggttccggttcccggtccagaagaaaaatcgaggtcccggtcccgacttctcaggtcccggcaagtcctggtcccggttttgcccaaaattcccggtcccgcttcactccagtatatatcctcccccccccccccccgggggaggggacagaaaccccaccgctatttgcagcgacggcaccatacaaattgccctcatccacggcattttgcaatccaaacggcggaagcggcgacgaatttgtgccctccctctcccttccggccgctgctgcggagacggcacacccctcaaaaactttatttggcacaatgtatgggccgggcatccatttgtccccctccgggcccattcaaaccctttctcctactcaaatgaaccaaaaaaagttccgtttttcttcatacataatgataggcttttgaaaaaggggataggcttgttgcaatttctaaaaaatttgaaaaaaaatattttagccattagcgttttcgggaactattttggtttgattaattgaccaggattcattatgggaatttctattgcgaatttgccaaaatcctaaaagaaacataatgcaatttcgacacatcaaaattgtgtaattaatttttttttaattttttgaaaattcccaataaattaatagggtcaaaagctccaatttttaattggaataataaaataaatccaaaaagctaacctcaatcattttttattaaaaaaagaagaaaaacttggtcgtctcattggtaatcacaaaatgtggtactactctcacacatctggcacctccattttatgggcttctcgggaacgaaaatttttaactcattgacagaattttattttatttttttgtctctaaacttagtaataatttttccatccatccattatttttaaaatttacttttttaaacaaaaagccaaacccccgcatttgagtccccgtccccgaatttgaaaattaattatcgaattttatttaaattcccattcccgcatcatctttttttaaatttttggctcccgattttccgtccccgcatttgtttccccgttgctgaatttgtaaattatggaattttatttaattttgaatcccaatcctcgtccccgcattggtccatgtccccgaatttttcaatattgacagtttttatttaaatttttggctccgcgattttccgtcc

SEQ ID NO: 20658 - DNA, 945 bp, Heterodera glycines
  misc_feature (5)..(5): n is a, c, g, or t
attanttctcagaaaaatggctatctctttttaggaaattttctatctcgtaaccccgatgctttccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccattaccgtaagagctgcggaaattgtgaattaattctcagaaaaatggctatctctttttaggacaattttctatctcgtaaccccgatgctaatccgttccggagagcctcttcaaaattttttccattaccgtaagagctgcggaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccattaccctaagagctgcggaaattgtgaattaattctcacaaaaatggctatctctttttaggacaattttctatctcgtaacccc

SEQ ID NO: 20659 - DNA, 2493 bp, Heterodera glycines
tcaacaaaatttaacattcttggtatcattcgatagccctaagaattctctattagctcatctaaatttcaaaaaaattttttcaaatttgaataaagttatggcaaaaatattcaaaaaccccggttccttgggtacttttggccataactttgctcaaacatgacaaaaaatttttaatttaggtgagctgatagaagagaactcttaaggctatcgaatgataccaagaatgttaaatttgattgaatttgacaaaagttatgggtagttttttgttgaaaatttccatttgattgttttttttcaaacttcaaaaaaacatccccactttttttaaatttttatatacaataaaaatttataggttttgtatatttttacataattttgtcgttcagtaaaaaaattatgctattttacttgaaacagtaaaattattttaaaatgagaaaaattattttaattttcgggaactctacgtctgtttccatttgaatttttaaattctgttactggttaatcaatccaacacaattttaaacatataaaatctaacggcttcaatttttcgaaaatctcgaaacgattgggcaacttttgtgggcaaattcaagtgtacgaattttttttcttttcaaaaaccctaatttgcattttcgaatttcgtaggagagggggcggcgcgtgggctgtggccacttcatgccattatttccttgacattttttgatttagttacaataaataataataaaatttatgtgttaaaattcgctcgcgcccagacggctgcgcccaaatggcccagttttccttttgcaaaatccagtgactaatgtaacacggcacgggaaactgttcgaattcatatcgtaattgcggggaggggggaagggttgatggccacttcatgcccaatgaattttaccatggtatttgccacttcatgcccaagtaattttgccaaatctttattggccaaaattttaccttggtgttggccacttcatgtccaatgcaattttccaaatcgtcgtcattggccaaatctgttgggcaacaaaattcatgaagccctggcagtacggtcatggcaaactgtgaacgggtgttcaactttttggccatttttggcagctgaaatctgaatagctttaacacatcgtcctcatcactttcccatgtttcgttgttggcatcgtgccaaaggaaataattcaaatatgccttgcccataaacaaatcaatacggtcaattttggcaccggtttgccaacgcgcgaaaaagttggtcaaatatgtgaatttgtatgtgccatggtaatgcacgtcacagtgataattcacatcggtacgatttttattgcctaaaaaatggccaaaatatttattatttataacccgtattcgaacaaaaagtcgaaagcccaaaaatttcgagtttagcatttctagttcaaaattgttttaaatataaggaaaaaattgaaagccatcaatcctgcaataagaaatcatttaagccgttttgaatcaaaaatgcaaattcgaaaatttctaatttcgacttttttgttcaaattcgagtccggggttcagaattaactaatttgttatttgcgatctcgaaaacccaaagaacttgtttttattcattaatttttgtcactgtatgcttaaaattacgtgcctaattcagttgagaatgcaagatttttttgaaaaactaaaatttgtttattttttcttgatcaaaatttaagtttttcatttatttatttttttttgaaaattatattccaaatttattatttttttgtgtcaattatttaaatggaaaatttgattgtttgtgctaagagtaggtccgctcccttaatcttcacctttttttccagctttagcatcaattctctgcactatttgctgttgcggaggattgtctggatcaatttcgtctttatataatcgcttaattaaaatgccaattaaaaaaacattggtaccgaacaagacagactacaattggacagacgggcatatatgagaatgtgtataagtgcttaaattatatggactaaacaacaccaaatatggactaaaaaatgccaaaaaaatggactaaaaagcttgcccaatatggactaaatactgccaaaatataaaaaggcacttaaaatgattatgattttttttgtttgatttagggtttctccctagggacagggatgatgggccaaatcgaaaaataaaatgctttttatttaaaaaaaaaatttaaaattttctcaagccatctctcagataaatttatttcgggtaatttgctctccgatccccgacctttctctcctggctgaaggtcgggaaggaaccctaatttgattatcaccaatttttattgtgcaaataacaaaaaaaaaatcggcactaatttaaaattaaattttaaacatttacgttaaatggatccatcgggaacacgtggat

SEQ ID NO: 20660 - DNA, 2212 bp, Heterodera glycines
cgttttttggctctgtgccgtgccgccattggccaatgcgtccgtcagcgaatggcaaattgtccaatagattttggcccttcggttctccaaatcctggggggggggggcaaaatgttttcgggaaattgaaattagagcccccgggggggggggggctttatttcagcaggcacgtaggaaaattggcaatttttttttaatttactcaatttttttaacatttgtacgccaaattttcaaagaattttccgggtggtgccattttttcaatttttttttagaatatgatccaaatggcaaaattcggcgaaaatggcaaaaaatttcttagttttcccacggaaaccgaaaatttaaaaataatacaattgctaattacttttgttgcgcgacttttcagcatttcttcaatggccgccaactttacgagtccattttcaatttgtttgccaaatttgtcccgctcaatggcaattgtctcctgtaaattgaacggaaaaaaagaaatgtgaaattcaaattggtataaaaatgtttgacaaaatccatataaaaaaatctaaaataattattttatacgatttgcattcatttccaattgtaattagtcactagaaaaaataaattggtaaaaaaaagcccataatcaaacgaacgaagaaaattaaattttcatttttcatcgattgattttctattaccatggcaggcccgtaaccaaaaaaaaaatattggtgggaagaacccgaaaatatttttttttaatcatcgggcaaaaattttttctcccgtattatttttcagaaattttcagtgtcgaggagaaaaaaacaacagaatttttggtcgtttttcgccaaaaattataaaatttttgctatttgggtgccagattttgaagggttctgacggtgttgataagcgaagcggcggaaattttttgaaaaatttaaagaaaattgttaggaaaattgtgcgaaattttcaaaaaacatgcacattttttcttgaaaattttttcatactcgccaaaaccacgcgcacatgttcactaattttttttttttttaaataaatttttgaggaattgaaaaaatattttaaaatttatttccatagcgcatattagaaaaatgttgcaccaaattttggcactttttccgaaaatttttgagaccaaaatttgcaacactttttcgcactactccttcaccaccaccacctgcacaatctgctgagtctccatgtcgtggatttgcttctgtgtcctgatcactcgctccaaatgttcggcgtgtgcaagcgccgcccgcttcagttgcgcgtccaattcggcttcatccgactcattgcgctgctggttaaatgtgcaaaattgcggggcaataattttaataaaatttataaaaaattttggaagatttctaaaatgttttcttaaaatttcttagaaaaatgggaggggggggggcggacaattattcccaaattatttggtaaatccaacaggaagtgacaaacaagggaccttggtttctcccacccccccccccttatcagtactccatgggttttcaaagaaaattccaagaaaaattttttttttggaatttccaaccatttttttcaaaaattctccttaaaaaatcacctgaaaattgttttcttgaaattttatttaaaaaattcgggggaaacaatacggggagaatctagcagttttcaaatatattttcttgaatttttttttagacaaacgggcaggggaattgaatgaacccctcggcattcgagcatcattccctgtcgaaatggcatttttttttctgaaaatttcaaattttgagaatttttaaaaaaatttttcaagggaaaaataataaattccggggttcggcattggttgaaattgaatgagcagaagcagtgggccaaattcaaacaccacaacaggtgtatgtcataagcaaatctcacaacaccgttgagccgacgaggtgatcagtttgtgttgcgccagtggtcatttctctgttccgtctccgctcaatttccaacgcccattttggaaagactgaacgaacacataatttcacagacataaaaaattgcaatacacaccgccgaaatttttgaagtggggtcggttagaaaaaaaaaattttttttttttgaccgcccttattttttttttctaaatcgtcaaaaa

SEQ ID NO: 20661 - DNA, 1325 bp, Heterodera glycines
  misc_feature (1263)..(1264): n is a, c, g, or t
gaaaatttttaattatttaaaatatagaaagaatagttattattttaaataaacaattcaaataaaaaaagcaaaattaatacatagttttccataagaattataataaatgagcttctaaagagacaacgtcaaccgagacgaaccgatgttttagaaagaaaaaaatgaaaaatttaatttaattatttatttctaattaaaaagtaaacaaaaaatcatttacttataattttaaaaggaaataagaagaacaaaaaattcacgcaaaatttagccaaacaaaaaatattggaatcaatttatttatattattaaattttttagggtttctagatttttactaattgtaagtccacatttgtgcctccaacctttgcgcacaagcgttacacgttaatttttcgcctactttttttgtaaaaaaaaagctaaatagaaaatattcatgacatttcctacaaacgtaagttcaagttcgactccttagtaacaattggaaaatattgtaaaacaacaaaatccacaacataatattttcccggggtgccggcgccaccaccggatctcaagaaatccttattctctaaaaattgcaaaaatttacctgggttttcagctatgaggatgtgaaatttatcatttcagataaatgaaaaatatatgacaataaaaaaaatactaaacattttaagtaactgaaaattcttattattttaataaaattgaaattatttattattttaattattaattaaaaattaaatgaaaggctaattaataattaagtctttcattaaaagcaattaaaataaaaagcacattaattggctagtaagtgcaggttcgagtccgctccatgccagcattatttatttatgtgcagtaaataattaaagagaaaataataaaatattatagaacaaaataaaaggaagtatgtaaaaattaaaaattgctagaaagaatgaaaatttaaatagataagtaaaaaatatgtaaaataatgaaattattacaaaaaatacctacatattataaataatgcaaatataacacacggcaacgcttcaatactcagtacccagtcaagagaaaaaattaacaatttctataaatctacatattatttatatattttactttactaatcgtcctgggcgtgtttcctaaatgtgcttaattcgaactaattgattgcattatataaaaaaaaattttttatataaataaataaattctagcgcatttattatttttaannttaaattgcgcttttaggaaaaacgccggcacctcgaaataatttcattataaaaaaatat

SEQ ID NO: 20662 - DNA, 2086 bp, Heterodera glycines
  misc_feature (105)..(105): n is a, c, g, or t
aaagtgcgcaggaatgtgcaaaagtgatcaactccgttttcgcttatcgagatacatcgtctcgatgctcatcacaaattcccctttgcttcaccacaccgtcanacctgtatagcgctaccatcttccgaaacgtagattagccgcggtttgtccctgtgttcgaacacgtatcgcttgtgctgctcgtcaaatggcacaggtgtctcacagtcgaacagtatggcaaatgtatgaaatgtggccaaacagtcggcaagtacaaacgaaaacacgcccatggcttggcaaattccctaaacaaaatcaacaattagcataagccaaaatggaaaaattaaaaaatttaaataattcaaaacaaaacccactccttgtgacagacgatccaacatctcaagcagcaccggtgcttcatcttccacaaactcattgcgctcttgtgccagcgggtacggtccatcgagtacaggtggctgcgagttttcgtcacggttttggctcatgatttgtttttgtgtctaaaattttaaaaataattctttaaatttgaacaaatatttattttgttgaaaaaacacaaaatggtaaaaattgggacaataaaaaaaatttttttaacaaaatttggagtgatagatgcaaaataattcgtaataaatggacaaataataaataaattttggcgaaattattatcagactggtgtcaaattacataaatgaatggcacagcggtgtggcgcaagacaaattccagacaatctttttaatttttaacgaaaagataaaagaagcgttgtcaaattacacaaatgagcaggtgtgagggaggggcaacgtaaagatgtgaaattaaaaattattggtcaaataaacaaacgcccaacacctgaaagggtgctgtaattatttttgaggagataaaaaattaacagacaaatcaataattaaacttaaatgtatttgttaattcactgaaaaatatttatattattttagaagtaataaaaaatttattttaggaataataattaattaattaaccttttaattattttaatttttaaattatattttattatacggtcccccatttctttttgcttttaaaagagaaaaccctgaattcaataattgatttgtttatttgacccccctcccctctctcgctgctcgctctcgccccccctgcccccgctggtgacgtcaaattttccctttatgagagcaaattaatgtttatcatccattgccaatgtggccgagtggttagtgcgtcagtctggccgccccccctggggttcggatccgcttggtgcggggaatttttggagaattttaaatgaatttaaattcaacgtctttgacctttaagacgtttaaaataatttaaaattaaataaatttaattaaaataagttgcataaagtcgcgcagtcaaaaaagtcgcgcaccccccctgcaataggtttgggtttgcaagaaaaaagtcgcgcaataggtttgggtttgcaagaaaaactcgcgcaataggttttggcttcagtactgaaaagtctggcgctcagatagcccgcgctcacttggcggcgctcaaatggctggcgctcagttggccatgcacccctcccatacctatggggggctaccgtaatccggtgaaaatggagtctctaactactcccactcccttctcccaggggtattattttgtaaagtctttttttcaaaataaacttttcaaaccccatttttcgcaccgtgaatgttatttttattgaattctgaaccgttttgagtagattagactagaaaaaattgaaaattttgaaatcatgtttcccactcccttctcccaggggtattattttgtaaagtcttttttcccaataaacttgtcaaaccccatttttcgcaccgtgaacgttatttttattgaattctgaaccgttttgagtatattagactagaaaatattgaaaaattttgaaatcatgtttccccactccccttctcccaaggggtataatttttgtaaaatctttttttcccccaataaaccttttcaaacccccttttttccc

SEQ ID NO: 20663 - DNA, 1020 bp, Heterodera glycines
atagagagaatcaaaacaaaaagaaattttcagaacgtgagggaggggaatgaagaaagaaggaggccaagcgcggctgccgtccatggccgaaggcgtacagcttggccttctttcatctgcgcgcaccagaagtttgagctttgccacgagtgcgttcccgagtgccaccttgaggaagataaggttgatatctgttctccgccccccttgactcaccggagttgttgtaccacacatttttaccgtacttgctgtagaaaagctctgaccgtaccgcaccgccgttggctgagatcagctgtccgtccttgtcgtagtagttgtcggggttgttgaactgctcgaagtcgaagtactccggaccgaccactgttgtctcagtcgtcgcttggtccaggtagcgccgccacgtctccgtccggttgagcagcagcaaatcgccgatgatgatcattccatggctggcgcgggagatggcgacgtccacccgtgcggcatcagcccagaaaggctgagagtcggctccactgtcgaagacggagcatgttgtgacgacgacggcaagtgacgactcgtggccctgtgtcgcgtccgctgtcgtcactaaaatgtccgggatttcttgttgggccaccaaccgttcgatctccagggcttgggcggcgtagaagcaaatgcagcggatgagtgtgccggggaaggcccgcgccaaacgccagagggctctcatcgctgtgtcggtttggcccggattggccgaagaggtggacacttcatcgcgttgcgcaggcgtgttctgatggactaaaatgagggggactccctttttcggcaatttgaatgccgtttggtcggtcatgagcgcccgctcggagtcgtcgcgtccaggtgtcaactgctcgccgtgcggtttgtaaaaaccggcctccgtgcagcggacgagagcagaatgtgagcgaaaacagaccgacaatgttgtgacgtccgtccctcgcgccacatccaggttctggatga

SEQ ID NO: 20664 - DNA, 1223 bp, Heterodera glycines
gtcatttctgtacaaaaatctgtaagcaactcgcattaaaaattacaaatttttccggacccccctatcctcaaaaaattttttaaaaagcgcgccgtaaaaaattattgagttaggctcgataacaaaaatttaatttttttattatgttgcggcgacattttgtctcttccgaataatgcatgaccaaaactctaaaatatttaaaggatgatagagcaaaaaattggagaaatttgaccatattgatcagtcacatttaatttacgataaaatgcatatttctgatcattttaacaatgcttgatgaatttagaatcagtttctctcattttaatgtaggattttactccttattagatgctcagaataattattttatcaactgccttcaaagttcattaattatcagttttaatcaatgttttctgaacattttttcagttttctagtttttactaattgttcgaaatttgatcagattcagattttactccatttcttgtacagaccagctttcaggccgttaattaatcgaagatagaattttcctttagttaattattttccactgattcgtcaattatgttttcgtttttcctaatttctcggattcagaaatgaatttttaacattttttttgcggcaaatttttccaaaaaacttttggtgaacgggcgaggggaggggtcggcggtaccgataggcgccgatggaaatttttttgtaatttcgttctgatttgttaacagattttcactaaaaaggccaataaaataaaatgcaatttttctaaatattttattgaaaaattgtcatgcctctttgaaactatcgacacattcaattgcttctgacgtatcaacacagcaaatcaattgctttggctggccatcgcttctcggcatttgcaaccattttgctaacgcttggccaccagttacatttggcccatcatcagcaatcaccgcgggcaacaaattatcggagtcaattgaattcaattggttgagatcggtgagaattgccagcgaagtgtagcgacgcaaattgtccaaatgttggccatcggaaaaggacaaatggtgaatgtttggcgcgaaaatgggccaaatttcatgagcaaaaacactccaaattggctggacattcttggcattataggggaaaggcaacacatgcaaattctaattgatgcctttgtcaaaaatttgctggttggc

SEQ ID NO: 20665 - DNA, 2525 bp, Heterodera glycines
tttttcaattggggtagacaaagtgaaaatgcaacagccgcgggcaattaacggacgacgaaacggtcaattctttgcctacttacaattaaaataatcatcagagcaagccattaatagtgaaagcggacagtgcccgcttaatctcccgcttcaaagagagcacataaattaaaatgccgagaaaataaagagaatgaagtagaattgttaaacaaaaatatctgtggaaataaagcaaaagtgtgttctactggctggtcattcatggtcactcctcacaaataatcatctattatccctctcctcagttaatgacagttcaattagagttccatccgctttccctcccgctcttctccctccgcttcttccgtctcttcgtctttcacagctcgtttcgtcgtccgtcccttcctcgtcatctcttcctctccaacattctcttgtccctcccctctttcgctctcttcctcctcctcctctccgtgtgctttcgtcggtccaagcgcagcagcggaagaaaacatcgccgccatcaaatcggcgcccgatggtgaggataacaaagcggcgtacgtcttccagtcgatggcatgcgaccccggctgattgtgcggcgaatccgacgacggcacaaacgaagcggtggacgcggcggcagcacccgacgaacaacgcacttcttctgacgacgcttccgttgccttgccattcgaagccatgctgatgttagccaatctgagcaccaaacactaattaatcaattaagcgtaatggtttttgttattggtcccctcatctgccaaaactaaatttaaaaatatttcaatttttgccctgctcatattttgctcgttccaacaaaatgtgataaaaaattgaagggatgggtctcttcttcttctttttgcgcatttattaccggacgaatgaaaatgcgtacaaccggtttctcgcctctctctctctcttcactaaattttgttgattcttcacaaaacgattataggcaaatgaaacccatatacaggtacatattgtacataaaattaaatcatcaaattattcatagattcaaaaaaattctggaaaaaattgaaaaagcgttttgcattaaattccaaacgccgcaacagactcagcagaaaggaaaagaaacatatcacaccacacataactttgaaaaaatgaacaaaagaaaaggcaaaacaaacgcagcgaaagtgagggagagagagaaagaaagaaatagagagagagagagaataggagaggagagaagaaaagaaagagagagagagagaaagaaagaaagagagagagagagagaataggagaggagagaagaaaagaaagagagagagagagaataggagaggagagaagaaaagaaagagagagagagagagaaagaaagaaatagagagagagagagaataggagaggagagaagaaaagaaagagagagagcattccaataaaagaagtgccgttgttgttcgtcagtttgtttggcattgttttgcgtccattcggcgccgtcgttcccatcggcgacttgcgctgtttcgcctgtgtcgagctgtgcttccggcactcctccgccaaatttgaaccgtcacagtcgcgccacggcgtaatttttggaaaaatttttttaagcgattttttagaaaaattttccaaaaaacttactaggtaatttaggcgaaattaaaaccctaaaaatttgcggtaaaataaaggaaacattggacgtgccgtggggtttattccgctgagcatcgctgcgaattgcgcggccgttgccattgcggaggcgacggagtcggaagagccggcggacgaaaggggcggcggagagagcaaaagggcggaggacgaaggcaccggcggaggagggacggagttgccaccattgttggcactgctgcgattggagggagcggaggaagtgaacatttccaacagaagagacactttctgagagggaaacgaacggtgaaaaaggggaaaattaaaaagagaggaggattaaaatgccatcggaagggatcaacagcaaatgcaacaacaaaaagcccttgccatgtcaatgtcgttcagtcggctgtttatgccgtggagcatcgtacgcgagtaaaaataaatatttaaaataatgaaaaaacaaattacttttcaaactttatcaaatttcttttgggcacattcaaaacatttttctttgtaacattgcatttaattaattaagacaataattgattgtttcattgtgtctgagttcattggtaaattgacggaatctgtcatcagaggtgaaggaccctgccaaacatttccgacaaagcgaaggaggaatagcgagaactgaaatttaaaaatctagcaaaattatggcaaaaagtgattatgggcaaatgccaaaagcacctgataattaaacactgtgaaggagtcgaggctatgcccaacgtctaggaggaaataaaatttgcaatttttatttggcattttgtgtg

SEQ ID NO: 20666 - DNA, 1342 bp, Heterodera glycines
tcaaagcccttttttgcatggataattattagaaagaaaattaggaagcagcgggatggagctgtttgatttgcaatttatccgaatgaccaattaaatgtacatcgatttttatgcgaaaaagtcaaaacaaaaaaggcgacacgacacgtatagtaaggttaaagttaaacaccaacgaattagaaagacaaaaaaataaagaaacgttaaatgctttttgttaaggtatggaaattagactggttatttattcttcggcattttctcatccttctgtcgtagacgacaatcgttgctcacattctttgaccatttcgatcagaacgttgatcactccggcaaaagcatagccgccaaaaccgtgcgtgacctgaaaaatcaaaaaatggaaccgacaaagccgacaattgaccaaaggatgcgctgtttcccattttttcgaccaaccgaatgcaaattaacttaacccgcccaaaaccaaatttttgttcttaattaatttgccaaacggtaatagtaagtggtgctatcccccattttagaccagaaattattaactcgttgagttttggactttttattcaaattcgggtccaaaataagaattggtcgtgttggatgaaggattcgtgatccagaaaacttttggacttgtttttattaacacccaaataaattttctcgtcggcactttttgtttcgagaagtgaggccaccctttctgctcaccaaagagaagcggttgaaccccgcgctgacgccgtcgccaatttgttttttcaggacagccatagttggcagattaagatgagcaggcggcgtgtggggactctcatccgcctgttggaaagccaaaatgtcggtgagaaaacgtctaaaaatatgaatcaaattaattcaaaaaaaatgttggtccaatttctcacccaattgtttccagttcttccttgttgtatggcttagcgccgctctcaccaccattttcacctgacaaattgtggcaatgaaaatcaaaatcaaagtctcattaaaatggtcattttcgtattcacttccaatgtaattcttcgagttttagagaatatttggcacttttacctgacgtcaattcgttggcgattggtttgatggggtaattgctaatgcaaagtttggcaaagtcttcagccaactaaaagaaacagaaaattaaacgtcatattaaagaaaatccgtgcgcgactaaatcaggcccacaaccagaggggagcggcaagggggcagtagccacccccctcccccaatcaaaaaaatatttcctttttccagaaaaatggcaatttaaaattttccatatact

SEQ ID NO: 20667 - DNA, 1399 bp, Heterodera glycines
  misc_feature (15)..(15): n is a, c, g, or t
  misc_feature (22)..(22): n is a, c, g, or t
agtaaaatggcaatntaaaatnttccatatactttagaaatttttttgaaaattttcggctactaatggtccaaaaatgaaattttctagaggggaaacgatttgggtggaaatgcttcgaggaattagtgcgccgcccccaaagggtctctggtgataccctcggacttttcccacccattgctcagacattctccgtaactcgccttgacggcttcagcctctagcaggaaggtgaagcaggtgtcctcgctgtgttgccgttgtcctgtttgaatttcaatcccggacttctgtagcaaattcaggagaaattaattgtggagattaggtgataaaatcagtttggttggttaatttttaaaatttggtagcccgtcaaaaatggtggttgcttttttgaagccatgccgcccaatttacatggcattttaaccattgtcacagagttagatgacctgacgcctttcgggcatgttctttgccccttgtcgtttcccaaaaaattttttacattttaaataaaattttcaaagaaaaaaactttgccgtcaaaaacatgaaaagaacgcggctaatttttgaatttttgttaggcataaatcaacaaacttcaatgcttttacgcagatcgacgctgttgctgcctgttttgcgcaggtgatctttgaatggctttgatggtgacttggcagaggcggttgacgatgattgggactggtcagtgatgagcgccttttgctgtaaaaaggtgaaatcagtgagttcatcaaactgagttgaaatggatcacttttccagccttcagctcttcaataatggccttcaatcgtttgttctcttccgtcaattctttattctgttctttttgcatctcgtttatctgaaacagtgatagcaagtgaagaatggtagaactggaattaatttagcatataatctttttgggtcttatgcagtttcgacatatataaatgactctcttcattttcttagaagataatttttgaattaaaaaaagttgtaattacattacgccaaatatttattgtgttttagggatgtgaaagttcaaatttgcgtgtaaagaactaaaaaaaataaaaatctataaaaattcttttttccaggctaaaaatctttttgtttttagtaaagttaatagagcatccgaggagctttctaatgaaaccaacactattgggtaatagttaagatggtaggctctattttttgcggaagttttcaaaatttaaaaaaatcgttccatatatatatatcaggggtgtgacttgtctcagaaaagacgagagcgagagtttggcgagaggcgagagtccccaaaaacacgagagttggcaagaggcgagaggcgagagtttttcaatttttttctgta

SEQ ID NO: 20668 - DNA, 2313 bp, Heterodera glycines
acttataaaattcgattggactcattaatttgcactggagcctacctggttcactctgaaagagctgattcattcggtttatttgtttgtttttttggggggtgctgtgggtttttggttttcattttcctaattataaacgtgtcattattgacttttcctctcacattttgcagtgctgggccaaggatgatgcgggtgccttatctgtcgggcggcggcggaggcattggcggacagagacgttcaacaggcggaggcacagattattggcacaagaaaggcggcggcggtagtcaatcgggcggaggacgcgaagacgacagggaccgacgtccgggtccgggcggcagcagttattaccaccaacagagaaacaatgaccgatggaagcggaatcagcacccaaacgcaccgccgccgctgagtgttgcacagcgacgggcccggggtccgttgcccgactgggacgaggtgactgggactttgtccgtgcatcaatcaattcattatgtatcggaacacctcatgtcaggtgcaagaagtcgcggaagacagcttcgactacatggaaataatggagagccaatattcgtaagaatgcgtgtcattgggctatggtaacgaatctgtccctcattctttttttggctaatcacattcggaggttttgaggatgctgttcacgaatctgaactcggacttgcccaattccgaccactgacccgaactcgaacaaaaagttgaaactttttttccaaaatatgcgttaaaataaatcaaattcaattgcgcatttttcaattaacaatttaagcactgatttgttgtaaaagcttttacacatggaaaagcatctttagaaaaaaattcgattttctgtatcggaatcgagtaagtcgcagtgcagatttgtaatcagctactaaaactgtttttgagcctaaaaagtaaaaattagggactcaattctttaccattgtctgtcgttgaaattaatcctaaaaatgacatcaaattcagtcagtactacgccctttccgccgttcccccctttgacccgtcgcttggcgtcattgcttcagccgccgcacatccctcggcggcacccatcgttccgtctgttgccgtcaccgctgcgcatgctgccaacgtggtcagtgcgtcggtcgtcccgcccgcctcccttctgtcccccaccggtctcatctccttcccactgtctgctcccactgcgctttccccgggcgccgtcgtcgtggccaccactgaccaatttccgcccacttcggccgccgctcagttcactcccgtcgttctgactgctcaatttccgtccaatgcgctgttcgccacgcgtccgacgaccaccgccccattcattgacgaacagaagctgaaggacttagtgcgctcgcaaatgtttgtgcatgcatctagctagccccaggcccgtaacccggaaaaatggactagtggagtgttttttgaaaatccaaattcaaaattgctaaaaacggtctgaaccgatgtataaaagccgaaatggataggaaaaatagcctgaataagggcaagcgcgcccccattgctatttttcctatccatttctagcttttaaacatcgattcaaataatttgctaatcaaaatttaccatgttttaacccacattggttacgggcctgaacccagcgcattcttgatccatgcacattaaagtgttctttctttccagtgagtactacttctccgctgacaacctccagaaggacttcttcctgcgccggaaaatggacatcgacggctttttgccgctcggtttggttgccagcttcccgcgcgttcgttcactgacgctcgaccagaatttcattgtctccagtttgtgtgacagtgacaaagtggagctgaacgaggaccaccaaaaggtacagacaattgacagggttttatcagatgaggaggtcgatggggggagacgagcaatttaattgaattttttcggggatgcgacaaattcgtcatcggactcttgccgttcgaaatctcgcggccgcatttttatcaattttctaatttaaaaatttttcaagaaaaaaatcctagaaaatttttttgtaatagaatttcaagattaaaaattttgaaaaattttcagcgctttttttaaattttattttatgacattttcgttataaaagttttctttatttttttacttgaaaaatttctgttataacatttaaaaattatttactgaggcgagatttatgagtgcatccatttgatcacctacatatgctggatttag

SEQ ID NO: 20669 - DNA, 3069 bp, Heterodera glycines
  misc_feature (1941)..(1941): n is a, c, g, or t
ccctccttacccacgcggcttttatttaatcatttttattcatatattatatcttccattctcacaactttttttatgagttaaatcaaataaaaattttttattttttgtagtcatcaatgttttgaaaattaaataattttatttccagctctaaaaataaaaaatcctaattttttcttataaattttttttgcattttttgttgtactctcttactttttatgtccaattttctaaaaaaaagatttagttatttatccttcttctaaaataggaaacttcatcattcaatttgttttttgtctctattacccattcgcggtttatttatgcgcaaactgtcaaaaaaatgttttcttttcttttggtttttaattcgtttcttttttaaatttttttatttcccgcaccaaaaattatcgtatgacaaaacaaccgatcgtttttctaaacttttttttccattcgtaattgtatgtgcattaaaaacattcacaaatcggcaatttccgttgatatcgattaatggagtgtggggggggggggataaaaaaacggctggaactcgcgcagtggtgcgaagcgtactcgagaataccattaggctggggttttagcattaaaatggtggccgggttccctttacgttttaatcgtttttcattgttttcttgagcataatattattatttatttaaacaatttaaacaacaaaaataaatatagcgcttagcttagctgagggcgtgaactgtctaaaattgacaataaaacgatttacaccggaaatgaaaatatttttactagaaattctatgatataaaaacgagaaaaatagtaataaaaatcatttttcgctcaatttcatatttcttgatttcccgcactaaaaaatgtcataggtctacagagggggaggggtagatttttaataatccaaagaaattttctaaaaatgtggtttttatttaggtccataatttttttctcacccaaacaaaaaaacaataggggagggcgggattttaaccaaatgctttttctaaaatatattttttcaattaataaatattttaaattgctttatttgattcaataattgttggtccaaaaaacagcagtgcactcgcgcagttatgagaaggatccgccattaccaataggcatgggtttttgcattcattaacttaatagtcgggtgtctctttacgttttaatcgctttccttttgttttgcaattactctttttctctaattctcttctctctcctatggtgaatgcgcatctctctgcccagggggggggggccaagatttttatactaatactactaatgatttaaaatgagttttctcatacatcaaaaaccttcgcaacatttcagaaaagttctcaaatcataaaatgaaaatatatttcatttgtgctatgattggaaaatttagttgtttttaactatctatttatttacgatgtataagataactgaaaaatttgctattatttgaataaaaatggaaataattaatatttaacaaggattaattaaaaggatatatgcgataaaattattgccaagaaaaaaagcggagacctaactaaaaacaaagatctaatttaaatattttaggataaatatttcttcaattacataaatcttattttttaaattactaaattccacaaaacatttcaccacttaaataacatgaatgtagacaacaattaaaaaataatatacttattttacattaaaaatgaaaggattaaatcagtaatttaatttatattctaatgggacggaaacgaattgcgctcgctggccaaggtggcagaagaaatgtttttcaacaagagtttaaaaaatatatttatatttgcaaaacaaaattaaaaactaagtcagtaaatttaatttattgtgaaaaataattanaatataaatgaataatctaattttacatatttattttctttaaatagttcttttattgacacaaacaatcataccaaatatcaaaaaatcttaaattcgattgaaagtaattattaaaattataatataataattgataaattgaaaggacaaaagtctcagagaattccagaaaggattatatattagagatcggattggtcagtttttttcggtttaggtttttgttttatgttcaataaaagagaaatgcgttaatttattgaaaatatttaatggtcgctttgtaatttgattatattgaatgtgaaaatcaataaattgtgaaaattaaatgaaaaaacactacctcatctgcacttgaataaaatataattacttacatattgaaaagtaattagtcattcaattatttggtacttttaaaattttaaacgaaaaataataaaaaaattacaaaaacttaatttttcacttaaaaaggtaatttaatataaacaaaaatataatgaaaccatatattgaaagatatttaaatgaaataaataaattaattaattaacaaaacgttagataacatattattatggctaagcatacaacacaaaaacgcaatagtcttctacaactaatcagtaagataagattcaattaatttgcaagcttaaacccctaaatagaatatggtaacaaatgatagactaagagaaaaataagtcagcttaaaatattgatttttacaaagacataaaacttcataaaaacaaacaaagataaaaaaggatagttagtgtaagcgtgtaatcgattgattaaaaataaaaattttataaaaaatagaggaaatcataaaactaaaatattttttctttttgaatcatatgtataactttaaatgaattaaaacgtcataataaataactgttaattttaaataatatttatttttcaagaaaaaaaatagataaatacaataaattattttatgttattcttataacaaattaatataagaaacccattttaaataagattaatttaaagaattttacttataattataaaatatgcttattcggtctccaaaaacaagaacgagtcgccgtttggaacaagttgctctttgta

SEQ ID NO: 20670 - DNA, 2333 bp, Heterodera glycines
ccaattttaaaaattctataattttttatttttcataaattttacaacattttgcagttaaatgcaattgttttggatcagttcaaatacaataaaaattaataaatttttgggtgcttttcgtcttttttatgcttcaccattgcttcgtcaacatttcaaaataattgtccatttcattcattttcttttcctgcatccttttcccgtcaattcgtccgatcttttggccttctgtgtcaccaatgcgttggacaagtggaattttcatggaaaatgccttgaaaaatttggacaaaattcgcagggcatccctttgcaaaatcggatggcgactaaaatttcaatttattaaaatacaaattttattattttttcattaaatttgcctgattgtcgtgaattcgatcatcaaattgctaatggacaaaaacagaaaataaatcacccaaatcatttccaataattttggatgggtgataatttggtaaaagccaagcacagatgggataattacaacacaattatttaggaaatgcagcaaaaaagtgggcccaagttgtcgccccgtgcgaatgttttcggccaactgaaattaatttaaaatatattaaattattaattaatttttccatttttgcttcacctgatatcgttcacttaaattgtgcacattattctgagtttctaattttgaagtgaacaattttaaattcaacgtgctcataacagaaaaagccttaaattaatttttaaaacaaaattatttttattatttaataaaattacaattatttcgaagaaacttatggccaatgctacgtaaaatgcaattaacgctccatttgtaatcgtttcttgagtttggtctttaaatgattgttcagcactaattataacggaataagtggtcttagagggaaattaattaattattaattaattaatttgaaaacccaaataatttgatagccttaattcgaaaattaccaagacaataaaccaaacacaagagaacagcggatttttggcattttcataattcttgaacagaattatggcaaatgcccgttcgataaacaaaacatggccaatataggtaataaaaagctgtggaaaatcaaccaaaaactgaaaaatgattaaaattataattaattaatttttaaatccgttaccagaacaattttgtaaccaaatggccaccaattttccgccttcaccaaaatgacaattatttgggtggcacggccaatggcaaaaaaagtgaacaaaacgctttgagtcaaaaggacaaatttcaaatttcgatgcaaaagcgaagtacggcacaaaatgccaatgttaagcagagaaaggggaatttggagtacaaaaacggccaaattcagagaatataggacggaaatgagcacatccaccggggcaatttgctcaaaaatttcggaggaattggacattttgcagctaaacaattaaatagtaaaaataattatacaaacccaaaatttaatttcagattagtgagggaaggggtgttgggccgagaggatgcgcgggaatggagggatgagggaagggtttggtgagggagagggaaccgacggtcgaatgccgagggaagggtgctgctatgtcattataaaaagccaacaaaaagggcgttataaaaaaccatcaaatggaaattttcaacaaagaactggccataacttttgtcaaagtcaactaaattagacattcttggtgtcttatgtaatagccctaacatttctctattatctcacctaaatttcaaaaaatttggtcaaggttgagcaaagttatagccaaaagtacacatgtggccaggttttcgaatatttttggccataatttttttgaagcctaacaaaattttttgaaattttgcaggctaatagaggacacatagggctatcgaatgatagcaagattattttaatttgttcattctaagaaagttttgatcagaatataacggctcagcaccgagggaagtgcgcaacttccgctcggttggcgagttcgaaattgaaatgcttctgtgattacggaaaaagagagttaaattggaatggtttattttgaattttaatatttaaagttaattctttattatgaaagcagcaattttttaaatcaactttcaaacactaaaaaagaatgataaaaaggaacgaccgcggtaacgaatgaatgttcaaaaaaaatttttttttttttacattataccaaggtaataaagcacgcaaagtataaatgtaatttaataaaaactgaagttggataaaaggaaaattaatttaatcaaa

SEQ ID NO: 20671 - DNA, 3199 bp, Heterodera glycines
tcagtctgaactcaattttggcgttctgttcacttgcggttgagccgccaccaccctttttggcattggcacgataagtgaccagaatggcacaattcagcagcacgcagaaaaccagaaaaattgtcgaaacgatgaacgtcaatttgctgttgctgggtgcctaaaaattttttaaaaaatccagaaattttttttagaaaatttacattcggataagcaacatggtcataggtcagcccaattgcttcttcgccaccaccgatttgataatgaacccatccaatttcaataaagaaattatggaatacaaaagccaacggcaaaaggaatgccaacgcgcacaaaaatggcagcaattttttccatacataaaaatttttaaaaataaaattaattattagctattggtttcggctatcagcaagaaattgttaattttgtaaatttataagcacatttgaattgcttcaaacataaatatatattaaggcttttgatatcaaaaagttaaaaaatttaaagataataaaaaacgaatttaattttaattaggtagttggtattaaaaaattgaaaatttaattaatatgtgtgaccttttcatatgtcaacggtttgacaattgctgacagccgatgggccaaaagaagaaatgtcaagcaattttccacaagcacattgtaaaaagtcgaggcgaaaatgagacgtgccagccaaccaggcattgatgccaaagtgtcaaaaagtgccgtaattgccacggcacggattgtgaccaatacgttggggaggttgatgaaaatattctaaaatttaaatacaatttttaatattttcaaaaatttaaaatttgggtaaattcaattcaaaattattaaaaattattttttaaattttttgaaaaatatttcattccgaccaaatttttttaactaaaatgcgatttgtcttttcataaataaaaaaagttatgcgagaaaatttagaaagattaattttaaacaattttatactctctcagtttgccgctttttcggcaaattaatttttgtaaatgcaatttaaatttattttacatgatggcggagagcaagaaaattttgtagaaactgccttcaaacttctggttgcgtccttcaaaaataaaccaacattccaatgcatacaagaaaagtgatgggacggaaatgaaaattgagacaaattggacaattatcaaatttatcattttaaaaaattctaaaactaaattttgtaaatttttaaattattaaactcaattaacaaataaaatggtcggattttcaaacaagtttttgcttatttttcacttatggggttttagatgcttaatgtttgtttctgatcaaattttatttttttttaatattttatcctttgaaaaatatatttcgtttaacatttgaaaatggaaaaaattggctttctttcgccttatttttgaataaaattagtctttaataacaaaaaaattttctatcatttttcaaggttcattcatgcctattatgatcctttttctgtgaattctcaatttaccaatttggcgccgcccaaaaatttaattattgaaaattatattaaaaaaatgacagaaagtccctaagattaggttaaataggtaagcaaaaattaacacctgctttattatgtaaaaaagacgtgaaaacttattattattatttttttacttaattttttggccataaaattttaattaacggataatagaatgccaaaaaattccaaccttttaattaaaattttcacctgttttaaaggaattccgaagcaattaatatatttttttatcaaaattaattaattttgaataaaagaatttttttatagtaaaaattcattttcgatatttttattttattttccattccaatgctttttttattttctgatcaataaaagtaatgaatatattcaatcatttctcatccacttcaaaaatttttttaacaattcatctcaaaatatttttgtttacttttacttgtgtagcagccaacatctgtttaactttctaatttctttgttgtgaatttaataaattttgattttatttttcgtaaatatttattaattaattgtcatatggttaatcaaattttatgacaataattcattatcaaaatttaactgataaattttcaaattccaattttatgacactccccgtaatattgttttccaattttattttaaattttctttttgataataattttaaatgaaaaaataattaacaaatttacactaaattctgaccttatagtagagcccaaattcaaaattaaaaaaatgtgttagaagaatgtaatcaccattttaaattcactaaccaaaaacaaatttcattcaattaacacaaaaacaattaacgaccagggctatcaattacatttaatggggttaatggagtgaggaggtgggcggtgtaattttttttgagaaaatcattgtcacacgtcagcattgcatctgtatgagtgagtatgtatgaaaaatcaggcgatgttggttaaaatgggtgaaatgttataaaaaaagaaaacatgaaatttaatttgattaaagaaaaaagcagtggtaaaattttgtgtttatttaattagacatactgtaattcagaattacagtaatgtcgtgttatcattctctgtgtttttttttctctttcaatttgcttattttaaaatcatttaatatggacatcttcaaaattgctatggtatttattgtctttggatacggtaccttaaaatttgctttcaattcgattgcataaatttttgtgaaaatttcccgcgaatttttgttagtttgaaaaagttggaccgatttgcaataatatacctaataaaaaaaccggcttcttgtattaaatacaattataatatattttaaattaaaattattccttaaatttatttttattccctttttatttgttttataattccgttttatttttggaattaatcccgttcctaaataagaaccaattttcacacatttccggcagattccctctcccccaaaaaatgtccaaatatggcaattttacgcccgtttaatggcattttattttgcgttaattggaaatggcaaaaggcttctttcttttttcgtataagctcatctgtccgtataaattccccat

SEQ ID NO: 20672 - DNA, 2127 bp, Heterodera glycines
tagcctgtaaaaaagatatagagaaaaaactccaaaaatttcgactttttcgaaatttcatgtataactttttggtaattgtctaattgagaaagcttattgttaaaaacagcttctaaacatgttaagctttcgaatgataccaagaattttagatttgatcgacaaagaaaaaaaaaaccaaaatacaaatttttcgagttaaatctttctgtttattttcttcatttccgcttttaattgcctgttttttttcttcggcacttgtacagaataagttgctctaacaaaaaatattaactgtttggctccctttgatttccatctctgaaataaaatatacttttgaaaattaaaaaaagacgaaataaaatacaatccgagctcctgataaagtaataaaaaaaattttttaaattcgatacctaaatggaaatataaacagtgacttttcgcttttatacccaaatttatatatgccgacaaattttccggtcattcattttcccttttctgtgaaaaccacactcaaaaacatataaatatggtcactttttgattcaaaaatcattttctccatttcttcaacacaatttcaatttgtcttctaatcccccccccaatttcatttagcttccacacattttgccatctgtcaaccaatcatcatcatcaacatgactaggaagtgttgtgtgacagacgtgcctcccacaaatgaaccattggggttgtccgactccgggtcgccgtccgcgagcgacagcagctactcctcaccaagtgagtttaatgcggggcgggaattttggcgccacaaaaaatttttttttaaggtagtacgacagcggacgtgagttgaatgggggtggggaatggcacaatttcaattgtataatcctaatgaaattgaattttcagattccgaagagagtgcctcggggacgaagaagaaaccaactcgcaagagcgctgctgctggacgttccacgaaacagacgaagtcaggcccaaagagtcgtcactcgcccgccggtcgtggaggaggacgtccccagacgccgcgcatgaagaaacaaccgctgaagaagaagccgccgagtcgcactcctggtcgacgtgtgaagaaaccgtcaacgaagaagtcgcctgctccccgccgtgcaaacacctccaccaagaagcgcggacgtcctgccaagaaagcggaacaagccaaaccatcggacagcggaacagccgccgacagtggccgcgacgacagcggacgtgagttgaatgggggtggggaatggcacaatttcaattgtataatcctaatgaaattgaattttcagattccgaagagtgcctcggggacgaagaagaaaccaactcgcaagagcgctgctgctggacgttccacgaaacagaaggcatcgcgcggaggacgtgcgggcaacaaaaaggcgcaggaagaacgctctgaatcgtcaactgaatcgggctctgatcgcgaggaggatgaagaatgaatgagccagccggagaagaatgctgcttcacgagaccaccgcgataataacactaacccccatttaaaaaaagagaaattgtatctctatgtatgtatgtatatattgtatgtccatatccctgtggcattatcttgctgaatgtaattctcccacaaatggttgttgttctatttaaatatgccatatatatgtgtatttttaataattgtaatatgtttgccctgtttatgcatgttttatggtcatttattctcattgctgaataaatacatttatatgaatgagtacattttccatgtcatcattagcaattcctctaagaaggtcaaaatcggttttcaaaaaattttatgtgctatatccataatcatttttttttgggcttttacatacaacaattttaaaatcattatttaaatttacatggtttttcttttttccagctcggctgttgcttctcattttcatttgccacgtcatcattcgtatctctcctttcgctctgttttcattcatttttccttctgctcttccaccatttctcttattgctctaattctctctctctctctctctctctctctctttctctctctctctctctctctct

SEQ ID NO: 20673 - DNA, 2544 bp, Heterodera glycines
tttttaatctttaagaaaaatacgtaatacatatccatctttattttatttttctaggacttttgaaaatgtttctatcgcccatcattttgtttttccaataatattttttaccttgataatggtggtggtagttaagaaactgaaaaagtgccgaaaattgtcttaattatttgacccaacagaatgtcagacaactgaaaagaagccgaagaaaaaatggcaaaagcaatgtaaaattaaaatgccaattttcaatttcaattttaaattttgttttcctttttttcagttttatctccgccgactgttggctttcagtgttcgatttgcttgagccttctcaactgggccttggaattgcacttgtcagccaccgttttgacttttacatcgacgaacacttcaggacgcggcgttggacactgaaaccaatgcaaattaaagccaaatttgaagcggatggcaaaatggatgggaaattgtcaattacgatggaaatccgttgccaattccacaaaaagcgatgccaaagaaaatcgtcggatttaagagcatttcaatcaagtgaaatgatgattttctttttctgtttgtaaaacgattccttaattttcacagatacatcgaccaaaatgccatcgcttttctctgccgtttcgccaacttttcgcctcctgtccaattaatttggccatctacacgggtggtgaccgcactttggagttcattttgcgcaaattttggccaatgatcgcgaaaaacatttgtgccatacaattgccccgatatgctctcagccgtttgcgacgctttgtcccgtcaattctaaacgattgtccatcgcttcgtattatcaattcctattctggtggctttttcgccgaatttccggccgatgacagtgccatggcgtcggatggacaagcgttggccaaatggcttttcactgcccatccaaacaatgtgccaaagatgttcaaatgctctttggacatcgatgacgggaattggtcgtcgagggttgaagccttaaaagcggtgctttgttttatcatttcgtattcatttaatcattttttccatcttttaggcattttccaatgcttcttcacccgccgctttcattgtcgtcgtttggtttcgttcgtcatattttgctgattccattttggcatttgatcaaaccaatgaatttactcgagaacattgacactgaaaagcactgactatcgccgtcgttttctgctgatccgttgtccaattgagcgagacgcgagcaaatgggcaaaatgggaagaagaagcgattgtttgggaaatttatactcagtggaacagaattggaattcaaatttgtgatgcggatggcatcggggaagggtcagcgaatgattattcaaaaatccaattttattgcttttctatttttaggcttctcaatgcaactcccggcccaagtgatgacagaagcgaatgatttgctgagaagtgatcgatcaatttgattatggaattggaaattgacgtgctcattaaatgttggagtgatcaacatggatttgtgttatgccttaggataattttaatgatttgttcaaataaatgtacttagctttttcaaatataatgtcactcaacaaagtaattacgctgactgtctacaaccacttcgccacctgcagcaggatgggagtttgcggattgacaaaatctgtcaaaaattcaaaaaaaaaatttttcccggcgcagcctatcggcaccgccccggaccttcccctccccgttagcaaaagttatttgaaaaaaacgcacagcaaaaagcggtttgaaaagcaaaaaaaaaatgttagacattaaatgggccaattttccataatttttggttaaaaattggtaggggtcaaaatattaataaaataaataaatatgctcacaaatttggccaccactttctcattgtttggttttttgaattagtgtcgtcccacaaatctacagcttccggcaaagatttcgatgaacgaaagtgccaaacacaaagagtcactaatttggccaaaaatgttcaaatgggaagaggaggagagaatgagtaaagaatgtgttaaaataatttaattcaaaatatattcacaaaaaatggcccattccctcggtttaatttccccaatttcgtaattgaatgccatttgggtcattttcttcccgcttttcccttccttccttccctcccgtccatccatcatcatttatgtccctaattttctgcccattaagtcgtccattttccatcccaaaattagaaaatccccgtgccgtttctcccgttcgtttggcacgccgtctcacaatgtttctgccccgtccatcaatgagcggactgttcaccaccacggcatcgaccggcgaaggggcgaagagtcgccgtgcgctgctgctaatgggtgccatgttggcatatttgacgatgggtgccgcggtggtcaacgcgttcgaattcgaccaggcgagtgccaatgggagaaggcatatactaataaaa

SEQ ID NO: 20674 - DNA, 2133 bp, Heterodera glycines
aaaccaaaaaaatctccgaatttttgaaggttttttgaagcaaatgtgccaaaggtgccctatttttcgtccgtgtgtctgtgagcttcttcctcccgctttttccattcgattcgacaatcaaaaacatttttttgtctgatcactttttgcccattttacatgggctgccgcttggcttggccaattgagcggcgtttgattaattgccgaaaagagttctgatcagcgccgttaacccccgccccccccccccagggtaggcattgtcttgtcgagagtgatcaaaaggagcagcgacggcagctgtcccatcaatcgcccgggcaaaaaagggggaggaggaggccaattcgatcaaattgagttgtgtatgttttggttatctgctgctggtaaaacaaagccgctttttcgggactggtagaagctgatcagcagttattagggctgcccgaaagtcggtttgacgaaaatttaaatttctcatttttgggtcagtattaacacggcttttgaaaaaaaaaatccaaaaaaataaacacgtactataattgaattattaaaagtttgttaccgtatcaatcaattcgcgtttaaaatttcaattcatcatactaccgtatcccgtttttaaagaaattctgattcactgacgcatttcctggtacggtatcaattcccgcggaatttttttaaatattggcatacctaacgaatttttcggaatatggcataatttgtaagtagctagccaatttttgagctgagaaagaggggataaaagcgaaatttcggaattttacgatttcttatcgttgaattaaaagtgaagtgcaccaccaccaatcactttagttggtgccttttcctcctccaaatgttgaaatcatttgcactgaatggaaggagaggggaagcaattaatcgtccccaatttttgccgccgtttgatcattaaatgagggcaattacgtcaattggccgcccaatgctttcagcaacaagaaaaacggaaaagcttccgctttttacgtaaaatttatggccgcacaaattttgtccaaatgtaaaaacatttagactcgaaagggattggaggaccatcagcagagggtgagacacgcggacagaaaatttgaagcgatttgaaatgacgccttcgcgatacatggaaaaaaatcgccgtaattcgcggtcgcgtcccacccatgttggagaccgagagttggccccaaaacccgagactcttgagcccgcccgcgtgcacggggccggacttgagtcacgaagacaccacagattcggcaatcataatgggaaagtatgtccctgatctaccattttcctttcgcaaaaatggctggctgggagttttcaagggcgctgatcacgaatctgaactcaaatttgacatcatccaatccgtgatttttcgaatctatggtttttggtctgacaaaacccgagtttagattcgtgatcagagaaaacactcttgaaattcccaagctaacgctttttagctaaaaataaatctccaaaatgaatgccgtatgcttaaaccgagaccaaatatcgccgagatttctgggacaaagaccaagacaatttcttgcggctcgagagtctcgccaaatgcactcgcttcaaaagtgtgaaatgccgaggagctgtttttttttgtgtgttatggccaacaaatccataaataattggcccaatattttctgctgctccatcagtgcgtgccgtttgctctctttaagtgtggtcattgtttatgcgcggcaaaataacacaccacgcgccggaggaggagggcatttctgagggattggatgtgtggcatgggccacccgcccgtcaataattaattaatgcaactttttactttcatgacgaacttatgtaaaaagacagagaattatgttaagcgactttgttaacaaattttgaatggctgaggagcaatacggtatcgcggtggacaatgtgtacggtgtcaacaaagaaaatgcccacaatacctaattaacattttcggataaatattatcactatattatcagcgccaacaataaatgacgagaggcacacacaaaaaatggtgcggtttttaaataaaaacaa

SEQ ID NO: 20675 - DNA, 1797 bp, Heterodera glycines
ctaaagcatcagagtgctaaaattaagttgtaaataaaattttggtgcactttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgagggattcggtctccccataaatctgggcgcatcggttcggggggaatgccccgaaaacaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaaagcagaattaaagtacaggctatagggaagctattcccgaaggattcggcctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattattaaaaatttttagatttttattcatctccctttttgatagtgaaagcatctgagtgcctaaaataacttgtaaataaaattggtgcgtttcagagcagtttgtgaaaaaatatttatgaattaattttgctaaaaaaataaaatagtgaagcttaaaaattaataaaaaattttaaattcagaattactggagttagcatcatagcagtgcttttccttgtctttttgatgccctcgcaaaatctggttcgcttctgatcagtttataaaaaaaaagttaagcctaaaatttttcgcaaatttaaaaagcaattaaaaatttttagattttttattcatctccctttttgatagtgaaagcatcagagagccttatttaacttttaattaacatttggtgcgtttcagagcacgttctaaaaaatatttatgaattaattttgcaaaataataaataattaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaactttttggcctgtttaaaaaggaattaaaaatttttaaaatatttattcatctccctttttgatagtgaaagcatcagagagccttatttaacttttaattaacatttggtgcgtttcagagcacgttctaaaaaatatttatgaattaattttgcaaaataataaataattaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaactttttggcctgtttaaaaaggaattaaaaatttttaaaatatttattca

SEQ ID NO: 20676 - DNA, 1992 bp, Heterodera glycines
  misc_feature (33)..(33): n is a, c, g, or t
aggatttcatatatctcaaggaataaattcctntttgttaataaaataaaaaataatttccaaaaatttgaaaaattaaaaaaaaagaggaatttcttcctttttcgacaaacaatgatggtgagaaaacgctttaaatttgaaatgtaaataatataattcattgaaaatggtgtaaaatatccaaactttaaaatttaaatgcattgccaccgtccacaattctcaaggcatgactatgagcaaaaataggaatttgttctcaaatttcttaccctaaaatttctgtcggacaaacaccaacacaaagaaaaaaaatttgaatttttttttctaatttttattttctaactgaaattatgactttttattgaaaattaaagaatttcctattatttactttggaatttgtcatgcgatgaacgcgttatttgaaaccaacaacaacttagaaaaagtaattaagatagtgtcgatgttaagcattggcattatgtgcgtaaaaccgggatttgcattttcttttttaattatgtgatatcggcactgttccattcgatgacaaaatgtacgtgcctttgatacgcttcacacttcaaataagcagcaaatatcacccgaaattttttaaaccaaaatgcccgaagagggaggggtccaataattgttagcattcaattgtctgacactttttgtctgaagaatgtttaaataatgcgaatttggcacatttttgaattttctaacaagtggaaacaaaggcaagaacagacaaaaaaatgaacaaaaactcttgaaggaaaaacaatgaaaagaagtgataagtctctcaaaatgtgtcggccgtgccagaaagaaagcttgttttaggcaaatgatggcacaatgaacgacgttttggcacaaaatattttatcgaaaaaaggcatgttgtgacgttacttgaaattaaatcaaagttttttttcctctcaaatttgatttttaacatattcctaaaaactcacacatataatttgtgattggcttttcggatttgccgttttaaattcaatttggaatggtctttggtgtgttttatcggtaatttagtttattgaatttcattttttactttcgaaaaagacgtttttaaaaggtgcgttaaaaaggtaaaatgcttcggtagtttaatattaaaaaataaagtaaatttattgtaaaaaaattgttttaagtaaatattttaattattataaatttttactttttcaaaaactcatatattattttttagtttatgcacaggtctttcggattcctcttttgaaattatgatttaagcaggcttttatcaagctatcaaattaatgccgaattttcaggtgttttcaattttaaagtttgggaaaagattttcaaaagcaccaatttttggagtaaaactctttaaaactttcaaattttctcaggcggcgcctattggatcgctggatcggtatttttcgctgacaaatcggcactcgctcgacgacgaattcatatttaagatttaaaatatttgcagtaaaaattaattaatttttgtttgttttgggtcttttttaaattaataagcatcactaaatcatcttaggttctaattaatttgagattaatccttttcctcttctttttctgataccttttagtaattattctttggtcatcaatcaattatattttaaatcactttcccctaaatatttgtttctttttataaaattatatgtttaatgaaaaattgattttaaaacccattgaattgtgatacaattaatgataaatgttttttatatatgcaattcaaggtgctaacacagtgaagctttggtttgtgacataattatcgttgtcaaatattaaaaaatgttgcaatttttaaagcaaatttatatgctataataatattttcagtaggaaaatgttaattattttgtatatttaattaagggggcccgaaatgaaaatgga

SEQ ID NO: 20677 - DNA, 1884 bp, Heterodera glycines
ttatttcacatttcacgacaatttcatctgctgtcatcaacaacgcaacgccaaggtgctcttcgcattgctccccgtccagctgatgctcgtcgtcgccgccgtctgcctggtgatcatcactcaatgctgcggcggtggacagaaggtagcgatgcttctgtcgtgactgattttttaaaataatttccctttttcattttcagaacacggaagagccgcaaatgccggcgggaccggaaggggcggaggccagcgccaaaccaacgggacagagcgcagcacctggtggaacttcagcagctggtggaacttccgcggtgggacagcagccagccgaagcctccaagaaatcattggctccagcggggaccgcatcggcgggtgagaggagagggacgggcgggcggggaagcgtttttggttcaccctaacattttcctcattttcagtgccctcagcgtatgcggcgcccggcacggggacggctatgagcacgacatcgcagaagtcagccgccggaggagccatgtcgcagaagtcagcagcgcctgctggaggagcctcggcactgagcaccgcgtcgcagaagtcagccgccggaggagccatgtcgcagaagtcagcagcgcctgctggaggagcctcggcactgagcaccgcgtcgcagaagtcagccgccggaggagccatgtcgcagaagtcagcagcgcctgctggaggagcctcggcactgagcaccgcgtcgcagaagtcggcagctggaggagccgcgtcgcagaaggcctgaacaaccaccggacagcacaagaacaagacgctctacaacccgcttcaatgatgttcatcaacagtgatcagaaatgattttaaatgatcccatattgttcccccatatatgcctaatgtgctctattgcctgtgatcacttgtcattgtgttgtgtgattaagaatgggggtatgagtgaaaaatttgttatgaaaattagagtcaaaggaaaaaattaaaaaaaataattaatataatcttaaaaagtagcactgctaagcgtgcaaatcctagtggctagtctacttgactttcccttcttctttcccctggttcaattcctctacagaaattaaattatcttgaattttctttttgtatactcgtgggtttcctatagagaaaaaatgattcctcatagtttttttaaattgatacatattttatcattttttaaatgaaaatcctaccaattgagcttaataatcccaaaaaccacggaccgggtcagtttagtctggccggtttagtctgaggggtcgttttagtctggcaagctgtttttgtgccacataggttatattctgatttttttcgagaaatgtttaatttattatcaaaaaatatttatcaatgtgttaacaacaaaaaaaaaacaaagcattgaaaaattacgggcgcatttcataatttcgagaaataccaacgagcaaatggttgatgttatcgggattaacattgacattggcatgataattatggtcattttggtgagcagggttattgttgatggcattgtagccctaaagtcgaagaattctcgcatcagcggcacgatattttggcgcttttgcaggagggagttcaccagcgatgcatcgtgagatgtccgcatcaatttccgaagtcgaagaacgagcaaatatcaaaattcttaatatggaaattagtgaaatttaatggattttttcacctttgcggtccgtcactgagttggtgaagaacataaagtgcaccctcatgttccagattgtgcttgtttcgctttgtctttatttcctgattggagtttacgatttgatttgtagctaaacagacattttaaagttatgt

SEQ ID NO: 20678 - DNA, 2155 bp, Heterodera glycines
  misc_feature (820)..(820): n is a, c, g, or t
gtagtcattttcaagttttgttattttttcgttgaaaacacactgataaatatgttatggtgttaattttaatcatttttcgaaaaaaagctgagtagaatctattttgggcaaaagcagcttgccgtaatatagcttttttatttgttatctaatccaacaatcttggtatcattcgaaagctatttaacatgctctattagtcttacaaaaagagaagagatttttaagcctggaaaaatttttattaagaaaaaacttcaaaatttcgagtttttcgcaattttcatgtataactttttttggtatttgtctaatcgcaaagcaatagcttagaaaaagtttttaaatacattaagctttagaatgatatcaagatttggatgacaaagaaaaaagttgtagaaagttatagtggaaaaacatgctggcgcccaaccgtgcgagcccaactgacgtagaccgtttcctccacctgacaaagtgtgccctcaacaaattgccgacaatgccaagcgaaagaaggcacaaataagcggacaattggaattgcatgatgcaaaaagattgatgcgcttttgtatttctcaattagctgaaaatttttgaaaatctttgaaaaataaatctcccaaaattagcaaattatttagtgaggcttaagcctcgagagagtctcaagtcttggtaaacatttaaataacattatcggttttattaaaaccttagtcaattttagatcaaagcattttacaaatgtttttaattaaaagtcaaccttatttacaaaaataaaataaaatcaaataaaaactattanacagtaattagaaatttttttggaaaagagtcgacttttggtaattattcgtctcattcctcaataatttattttccattttttaccactcacttcaaaaagtaatgcgaattgatgtgcctcaacaacaatttttgaacaaaattgtcgtcccgtcagaatgaattcaatcactgaattgtcaatttcatacaatttttcaaattggtgcccattttgtcgcatttcaattaaataatttttgtcaatttctaaagtgattttttgcttcatcagctcaaccactcgcttaaatgcccatggttcggtggaagtgcgaattttgaagtgttcggcgtggggcttaattaatttaaatatttatttttaatttatcatttaaattgccttgaatattgggcaatcaattaaaaacaaagtcaatgctttgtcattgaaaatgtcaattgtcattttgccaaagcacaggtccttgaaatgccaaaagaaatgcgcactttgcggccgttcaatcggaaaatgtttgttttgctaattaaaaaacaactaattaattaattaacttgccttccacacgcaattattcagtgtaatttttttcaaagttgtgccatcattagcaaatcgctataaaattaatattaattaattaaaaattattggaaattataacttgaatgtaaatgcaaaatggtattcgctgtgccggccattcatcgcttataaaatttgagtaaaatgacaagcatttgtctgtgcaattcgcaaaaatctaaacacaaataattaagaattaaacaaccttaattattcattagggtatattaaaattaattacttctccattggttgtttcttcatgtgccctgagtgaatattgaagtgaacagaacaacgggcaaatccacaatttgcccattttaaattttggaaaatgattggcttcatttgcggcaacaaaagcactccaatgagctaacaaataagagactaattaattgaatcattatcattaccattgacaaattcaaagcgttcattgatactaaaacgatcacacaatttgaacacatcaaaaagcacatcatttggaatgtaaattgatgagttcattttttgggcaatttttaaataattttttctaaattcgctttttataaattaaagaaataacaaaatgagcaattgttattttgcagcagataaaggacatctaatcagctaatgggagtgcttttgttcattgaaaaacaatggtcagctgtcgcaatttgacaatgaaatgcaaacataaacggttgttactaaatgaaaatttaaaataagacagaaaag

SEQ ID NO: 20679 - DNA, 2609 bp, Heterodera glycines
aaacagtaatggaattggggaatcagggttccgggctgtacaggaactgttagccgaactctcgttatcccattgtttggtcacttccgttgtcagtttttgctcgacacggcactccccgcgccgccgccgccggtgtcgtgccccggcacgtgcggttggtggccaccgtcgacgtcggcactccccggcactttggccacgacgacgacggcccaacaatggcaacaacaacaacatgaattgttcggcgtcggggacgacgaggcgacgatggtcgaactgatctttgcccactgcaaagtttgttgtatccttctttctaacacaatttatttgtctaattgtaaaatttgggtttaaacaccaaaaagagggttttttataaaaatttaaaaattcacccattttccttaaatttctgacctttcttttaatatggaaattcaatttttgaatgtttccctcttttaaccatgaatttcaatttttggttttaccagtgaaattgacaatccaaaattaaaatttctcaattttttagccctgcccttggggcacccggcgtttgccgtcgtcgtcgtcctcggtatttttctcccctgccgaagtgccatcgccgtccttgccctcgtcccaatgccatccctgcgaagtgccgttgcccaccattgactaccttttcttgttgttccacgccctgttgcccttcgtggtgaaccagttcgtttttgcagcgcattttttttttgttgttgatatttttggtatattttttcatagtgtggcgatctgtcaccattccgccagacgtctgaggcattcgccaaggtttgaaattgttaatggcattggttattaatttgttttgcattttccatttgctgggatggcattggctcgttacaaattttgctttattttacatttctaaatttttttgctgtacccggcggaatttgctgccattcgaaggatgtttaattcactacccaaatttcgtggttcaattttttaaaattccatttccttgtatcatttttgcctattcgtatacatgtccctctttttaccccctcaatcccccttttttgctaggcttttgccgttgactctgtgccaattgggctgcgccctcatcgaatgttcgttggcatttgtcggcgctttgctccttttccgtccgtttggccatttgcggacatttggctgtccacgggacggcaaattggccgaatggtaacaaaaaatgaaaatcccttgggaacaaaagaaagggcattttccggcaaaatttgttgccataatttttcatataatggtggcacaaacaattctaggtttttcatgttttgtctcatgttgcacaaaaaattgtttatcctccaaaaaactaacaataagattttttcattattttcaacaaaaaacagcgatacggtaaaaaatttttcggtttttcgtgtcctaaataagcgaagtcagtgtaattaatttctccaaaaagatttttatttttcatgcaaattttggttataaaaattttattaattactctaacgcttttttgaatcatcaaatgaattaattgcttaattaaattaattagttggaattttccaaattaaaacttttgcaattaccctaattagataattaatttgtattttttaatccccccccccttcaaaaaaggtattctctgttcaacaatccggtgctccaatacacacgggtcctccactgtgcttctgagcttgtctatccgctgtgagtgccgccggcgatttgccaccgaaatttattttttttaaatattattttaataattatttttaagtcaaaatttagttcaattgtcaaccattcattcctttgttaccactaattttttgtacgcttttttgcatcgaattttagaaattatgataattgctaaattccttcaaatttttttgaaaatttttttctaggaaattttcttaaaaaattttctaagcttttttaaaaaatttctaacaatttttccccctgttttttcagttattccctcccatttgccatttatgcgctcaatttgctcactttgctcgttctccgtgcccttctccattgcgttgtcgccgccttttcccgccgtaccgttttgcccagtggcccattttatgccgccctttgggccctcccattgctctcgttggcacacgccgtcctggtcagtttttggcggtgattgtggcagttgtgccgaaaatgcaacaaaaaatggccggcgggcacaatttttggggccactaatttcgagttccgaaaattttgaaacttcgagttactcccaccggaatttttttttgaaagtttacaagccattttagcatcgagttttgtcagtttcaatcaaatcccggggattggggacaaatgagccgccattttatttggaaatttagtgaaaatcatccgagaattcgatcagaatctatcatcaaagacttgttgtctccaccattcaaaactcacctattttttaaattggcatttggcattccatattccttcccctttttttgttcagtctggcgttctgcacgcgctgttccccttcatcg

SEQ ID NO: 20680 - DNA, 2476 bp, Heterodera glycines
ttcaaatcgtacccaattgggtcctctttttttacaaaaatgttactctcatttcttgccatgttttgagcgatcattttccgtttacaaaaatagccgaaaatcggatctttattacatcggaaatgcttgtaatgtatttaatttcaacaatgaattcattattgaaaattattttttatttttttttgcattttttcgggttgattttcaattagaagaaaattcattttgttgctataaatttcatttttttaatattttaaaactttttggcattttttcttaaatatttattaatatttcggaatatatatatacaaataaatcctcgtcctattaatcacaaataatgatcaaatcattataaatatttatccaatggcaaaggcaaattagaagaataaatttacattgtttacctcaatttttactccaaatttgctcatttgccgcagattctgctggccaaccgtgaccagcacagtgccgtgcttattcctctcattccatcgcttttcgccgtttcccttcgtttggtgcctttttcttcgcagcttcgcaccgtttgcctgcgctttgagctttacggatgttcagcaaaagaagggaaaggaaaagccaaagtcggtggaacaagcgaatgttttggttttcaaatattaaaattattgattaaaatttttttgccttccccaccgaaaaatgccgttcctctccgctcccccccccccccacccccccctctttcaagtccgtctggtgcttcttcttcttcctcttcagtgttccccctgctccttttgctcattccctcctcttttgtgcttttcctcctcctccttttgctccttttccgtgccattcgctcttttctccgtcgtgccatttcgtccgatcaaaagggactgttcggctcgtcttctgccggcggttcgccgccccttttgccctcgtcgtcttggcagaatattcgactccctttcgacacgacaaatgcaaaagtaaaatgatggggcaccatataaagaggtcaattcgaactcagtcatggctaattggccactaattgctgttcgcccgatgatcaattagttggtaattgctgttcgagagtcattcattctcgggtccaatcaccgcctcaatttgtcttccaattgtccctcttcctaaggtattctcgccaagtttttgccgcttcgacactctctctttgggctgttcgcttcgttcgtcgccggcggcggaggagcagccgaagaacatttattatgcggaggaagagggggaggaggacgaacaaatgcaacggaagaacgaagtcacgcgcagccgatcactgcacgccgcggcactcattggcacaccgacaaaagtgggggaaatggaggaaaaggggaaaggcattttaaaggggaaatgccgaaaaattctaattgattttatgattatattatttaataatgagtcattagcaatttgatttcaaatttcttttaaatgcatgtatcccacaaaggacaaagcatcccatccaattcggttaattttggcaaatgataataataactaataatgcactgatttatttgtacaggtatcagctcaaatccccgtgcgtccggtccgtctctgtcagttggcccattcgtcctcccaacccgagtctttccgggcggtgactcgtcccttgtgccaacgggcaaagcccgtgccgaagccgcggagaacggcgaattttacagaaagaaattaaaattcattttatttatttcgaattaatacaaaatttttaaaaaatttggcaattgttcagagaatgaatgaatggtttgtctgctgcttttgttcatttcgttctgcaaaagtgcgtttgtctgatgatgttttgttgtgttttgtttggcaaggaaaataaaataattttgggacgataaatcggacatttttggagtgccagtgaatatttcaaatgtgttgaatagtggtgacagagaatcaatcacaggaggaagagaagaaaaggggcaaatgaatgaatgttcaagagtcttgagaaacagcggacaattagagacggaaattcaattttggacatttaaagaaagtctcaaatattggatagaataatcaaaagaaattcaaaaaaattttgggagggggggatggacacgggggagaagaacattggacggaaaacgacaaggagaaagtagggatggacgagagagacagagatagagagggggagagagagagagagaagggagagtgttaaatgaaaggaatggcaagacggagaaacaattaaggagcgaaaaggcaaatccagagaaagaaaaagactgttacagtattattcaaagtgtactgtatgttgtttatttgtgtcctagcgaaactttccaccattttacagtaacagttgtaataaaagtggaattgagtgagtaaaggtagcacaaaaggacaa

SEQ ID NO: 20681 - DNA, 1293 bp, Heterodera glycines
  misc_feature (1279)..(1279): n is a, c, g, or t
cacccaatgctggacgcggggtgatccaacgcatggtcagctccctgctgaacgcgtcgccgaacagcagcttctgtggcatgcgccttaatgaagtgtgcttcgacaatgcggagttttaattaatggaatggaaaacttccatgaattgtgataccagcgctaaaaaaatcatacaaaaaaagtcactcgataaatgcatatttggccatttttgcgtttttagagcatatttagatcatttttggcaaattttcataagtaaaattcaataaaaacgaaaaacacacccctaagatcgacttttttggaatttaaaaaatatacccttgaaaagcaaaaattttgaatttattgcaaaaacattgaaaaaaaaattgttaatataagaaatgtaatttttgttttagtatataataaaaaattaaaaaatttgaacttgcatatataaatttagaaatcaaaattttttgcaattatctaaaaacgctccttagccatttttaaagccaattctgtatttttacacaattttggccttttttgagggttaaaagccattttgggtcatttttaaggcatattttagtgaatatttgggcattttcctggttttagggcatatttgggggatttttagtggcgcatatttggcattttttaggcatacaaataaccctaataattagtagtgacttttttgtatgattttttttaaatgttaatgaagtgtgttaatataatggatgttagaaaataggaatatgttggttataaaagaaataatatttattagaattttattaaatttatttcgataataatataataaaatgcatataaaggacgcctattaaacccaaggacaaattttcttttataacatttctcgcggcacgaatttgaaattaggaaattaaacatttttttttgcaattttttcgtaacgcatcattgggaaaactttgaaaatttgtaggattgtgctaatattgtgattttaaaatatatttggcgttttgttatttaatttgtttcatttttgttgtgatttttgtgaagtgttggttgttagattaggcagtcgtcagttttcctattgatttgtcttcgccttatttaattttgaaataaataattgtcttcgacattgggctgtgttttggttttgctttgggctgttgtctttgctgtgtgctgtgcaacaacaacattattataagccccctgacacaatcatatctgttttttttacgacttggcgctcctggcaccgggnaatcagcagtggac

SEQ ID NO: 20682 - DNA, 1124 bp, Heterodera glycines
  misc_feature (36)..(36): n is a, c, g, or t
  misc_feature (46)..(46): n is a, c, g, or t
  misc_feature (115)..(115): n is a, c, g, or t
tttttggtcagcggtgtgtcgcttatttcacgtcgnccacactacnaatttcatccctttaatctgatcgttttgggctcgaccaagctgcttcactcgaatttgaaatttgttntgatgtgtcaaagtggggccgtttttttgtttgaattctttcgcttaatgcagatattgcaaaaattcttgtcaaaggacattttcaatccatgctttgtgtttttacaggtgaaaaagattcagtctttccatgattaaagcttcttcaatagaattttcttgagagaagttataaagagcattgaatttagaacctggacctgtactttctggactaaataggaaaaaattaaggtctttcgtgcggaacatttctgaacctggattttttggacaaaaatacaagaaaacccaggtaccaaaaaatggcctgaacctagagctggatatccaggaaaaatccaggcctgggtccaggttggtccagattgaagtttattgattcttattcattaccggttcattatgccatttagatgaccctttttttctttggcatgtttcggacattaacaattcacgttttatttattgagcgactgatggccatcattttcttggacaaatatgaatcttacaagaaaattacattcagcatttgttggtttacttttacggtaaatgaaaaattaattaataaaaaaaattaaatatttcacttggcttttattagaccgttttatgctttttgaatgttctcacaaatggacaatcatggacatcaacaactttaaatttgatcacaatattttttacattttccctgagtctcgtggaatgtattgtaagtaaaattaaaatttttttaattttaaataatttgttgtttcttttttgtttagtttatcgcaatttttggaatttattgcagagaaaaatataaaaagcaaatggaaaatgtacaacaattaaacaattttcttggagcaagataccaggtatattaatattttaatgtttgataaataatttttattagccaaaattttctaattaaaggattaaaaaaaccattaaagtcttatcatagttataaattatgagaaatggcattccgacgccccaaa

SEQ ID NO: 20683 - DNA, 1785 bp, Heterodera glycines
ttttgagcgtaatacgattttacttacaccatttttgctagcttagatcacatgcgattttcggcactctgataattttagcgctcataatgggatgtataaaggcgattgtagaaggaattggaagcgctaaaattgtttgaggagattttttgagcgtaattacgatttttacttacaccattttttgctaggcttagatcacatgcgattttcggcactctgataattttagcgttcataatgggatgtataaaggcgattgtagaaggaattggaagcgctaaaattgtttgaggagctttttgagcgtaattacgatttttacttacaccattttttgctaggcttagatcacatgcgattttcggcactctgataattttagcgctcataatgggatgtataaaggcgattgtagaaggaattggaagcgctaaaattgtttgaggagctttttgagcgtaattacgatttttacttacaccattttttgctaggcttagatcacatgcgattttcggcactctgataattttagcgttcataatgggatgtataaaggcgattgtagaaggaattggaagcgctaaaattgtttgaggagctttttgagcgtaattacgatttttacttacaccattttttgctaggcttagatcacatgcgattttcggcactctgataattttagcgttcataatgggatgtataaaggcgattgtagaaggaattggaagcgctaaaattgtttgagaagctttttgagcgtaattacgatttttacttacaccattttttgctaggcttagatcacatgcgattttcggcactctgataattttagcgctcataatgggatgtataaaggcgattgtagaaggaattggaagcgctaaaattgtttgagaagctttttgagcgtaattacgatttttacttacaagggaacattccgagctgtgagtgggaaaatgcatataagctatataccattggatagagcggggtcgacttgtattgtgaatttttaattttagcggtgcattccgcctgcttcaaaagttacagggcctcgaaaatcgaaaatttggctgtgttttcacatgaagttggtggctcagttggttaaattcctaattttgggggtccgggttcgaatccaacataaaaataaataaatttaattaaatttttaacaaattaaagattttaaaaatacatttttaaatatgaaaaatgcattaaaattatttctttgtttaaaataaatgtggactgtcattgtaaacacgaaaatgataatctcaaacaacatctcgttcgaagtgggatcgaacattattttattgaaaaccattattatttaaataatataaattttacatcaatcacatattttgaaaaaatagaaaaaaatctacacattataatttgggtgagataatggaaccgtctcaaattaaaatctaattagattgttattgtatgtataaagaataaaaaattaaatttaaaagatgatatgagataaatttattattttttatcataagttgtaaaaatcgtatacaaggaaaatattacaatatagcaataagaaaaataccacagattttttaaaaaatattataattgctattgtccttattcatatttgcaaagcgaataactattttggaatcatataaataagattaataaaaaaaatatatgtaaaaagtagctgtctatgtaagagtggtaaataatagttgtggaaaatacaaagatctcatttcgaag

SEQ ID NO: 20684 - DNA, 1337 bp, Heterodera glycines
ccaccagcattccaatcaccggactcaactccccagcatttcaatcaccgagactcaaatctccggcatttcaatcaccgggactcaaatctccggaatttcaatcaccgggctcaattctacggaattgcaatcactgggactcaaatctccggcatttcaatcattgggactcaacccaccagcattacaatcacttgtactcaaactcagcaatccatcggcttctaccgcattacatcactgggactcaattctacgacattccaatcattgagactaaaacctaggcatttaaatcattggactcaaatctccggcatttcaatcaccgggactcaaatctccggcatttcaatcactgggactcagaccaccagcattccaatcgggactcaattctacggcattccaatcacttggactcaaatctccagcattccaatcactgagactcgacccaccagcattccaatcaatgtgactcaattctcatgcaatccaaacacagcgatgcaatccaccagcattccaatcaccggactcaactccccagcatttcaatcaccgagactcaaatctccggcatttcaatcaccgggactcaaatctccggcatttcaatcaccgggctcaattctacggaattgcaatcactgggactcaaatctccggcatttcaatcattgggactcaacccaccagcattacaatcacttgtactcaaactcagcaatccatcggcttctatcgcattacatcactgggactcaattctacgacattccaatcattgagactaaaacctaggcatttcaatcactgggactcagaccaccagcattccaatcactgggactcaaatctccggcatttcaatcactgggactcagaccaccagcattccaatcactgggactcaaatctccagcatttcaatcactggactcaactctccagcatttcatctccgggactcaatctcaccatacgaatgtaaaattgaaaaaatgcaaatgacaaattttttactgatttaaacagaaatcaaaatgaaaacgaatgtacaaactgaccttataccgttatttgtaaatccattttgtaaaattaactcctctgccaatgagaacagtaaataagcgataagtccaaccaataaaaacaacgaatgatccattcaaaatcttttttcaaactcttttcaaatttcaaaacgaattctcgaaccaaaactaagatcaaattctcgagtcaaaattaagaacgcattgagtttgccatattcaaaaacaaagaagaacaaaattaattcataattaatcaaatcaagttaa

SEQ ID NO: 20685 - DNA, 2289 bp, Heterodera glycines
tatttatatgcttctgcatctcttatacattttgctcttatactttttcctatttgaattatatatatctatattttttggattttaatattttattttaaaatgaattttatgtatattttgaatatttgattaacaataaaattgttgtaatttcaatgattaccttagttaaaaaagtttgaataaatttatttaaattaagtggttaaatgatgagatgacatattttttgttttcattttaaaatacttggcgtatgttgccgtagtgtagttaaatccccggattgctgggaatgattttgattgatattcgcaacattactaagtattatttaaataaaatatatgactattattataatattttcatctggttaagataaagtcgggtttaaaatattaaataagaatttcgcaaaataaaaatttatattaatactttttttcgtattttaaaattcttttgtatttaaactttttctttataagttctgtatcaaggttggtggctcctctgttgtttggccgtagtctctataatcgtagtcgtcatccgggataaagatcggggtcaacactgcattcgggtcccagcgtgtcacgatagtttcgtgtgtctcgtgagcagatgagacgggcaaaagactgaggaggtagtagagaaggcatgtttttatataaaactttattttgtagttaaattagataatttttccctaattattgtgagttgctttatattttgggtgttcaattctttaatttttaggagaacatttaaattttatattataattttcttaaaaatcatttaaaataatttattaccagtttttttctatttatttgtattttcttgttaacttcgcactgttgcgaaattccctcgatgaaaaatatgattataatgagtttttgaagttattatcgttaaaagaaaaagccaataaaagcataattaataaaaatttatttttatagtctttgaaaattatcttcatttaattgataagtatatgatataattatatcttttaattctattcgttttttaatgtaaaactgataatttaaaataatttattgaaattctttattcaattataaagtcagtcatttattcctttgtagtatttattattagtaggatattttaatttgtggtttgttttgattgttctactattaattaattaataattttctgataaattttaatgcgaatcttaaaatttattgatgtgggttttcataatggctgatcgctgatctgaaatttcggaccaatcccgcagctaatcgaattcgaacaaaaaattaaaaactcataattttcttataagcaccaattttttaaaaatttttaaacaatctaatccgatttaagccatcattagattacattaatatgcttgcttctaagtgtttaacggcttaacatactgtattttttgttgattatttttaatagaggaaatataattttttaacaaagatttgtaaatattttgataattttttaatagtttttaaatttaaaaaaattactacatgacaaattattttaaaaaatttaaatgttcaaaagaattatttattattagtttaaattaattagatatttttattttgataaatttattaaaataattataaattaacacctctgaagattatggccttgcgcgacagtaatggttttaatttaaatgtttttataattaggtttcattttttaggtattttttcttatatttttggttaattgaattcattaatttctgtgcatgaaaataaaatcaatatgtctccagcaaaaaataaataaaaaatattattttatttaaaaatatcagttcatagccgagtaaatgtttttccaatgttatacaatctgtaacaaaattaaaggtccatgtattttttttgctacttcacctacttcgcttttttcagtctaattgttgtggacatgagcaatgtaattgtccgtgacgaatgattcgatatatttatacagttacaccttaattgcacataaccacaagagctttgatccatataaatttttatttttttattatagaagtttatatttggaacgctacataagatacatactctctaacaccagttagacaaataaataataatttcatttcaaatatacttttagttttggacggtttaaaagacagaggattaacacttccaatcagggctgcacgcaattgcggattgcggattaaaattacggaaattgcggggttttggacccccgtaa

SEQ ID NO: 20686 - DNA, 1466 bp, Heterodera glycines
ttgttaatttcgggattagttcgtttccccttccttttccccctccccgccgaaaattaaaaaaaattatatcaaacacagaaatttttcaaaaattaagtaaatgtttttgcatgttttgaaacaaacaaaaatgaaaaaggacaacaaacgtgaaacttttggaggacatgagtcgaacagagagcgcaatccacatggccgagtagtaagtgatcatctgcgcaacgcgagctcgccgttccgtgatcaccatctccacgttgggctgtgtcctgttgcttacctggtgggaaaattaaaaatggaggcatttaagacagcaattaaggcattaattgccgtttccagccctggcatgccatgcctaccgtgatggacataagttgtggcaccgtgttcatcagctctttgatggtgtgcgcgagacggagacggacgagcagccgactgcgcagcgcaattgcggtcaaattgatggtgaacgaagaattgagcagaggagagttacaactgtgcacttaaaaaattggcaaataacggaccaaggggttcatactgttgaaaatttggtaagcaatgaattaataataaaaatcgtgtgaaatttaaaaaaaaattttggagattttttgtgtgccacttttttttatacaaacgtttggcattttgtctgggagaacaatgctcggcaaatgtgttgatgagctcgcaaagttcgtccgtgtgtttgctgaccacgtcaagcgttttcgtgcagtccgtcacgtgggatttctgttaaattggaatgattgatataaacatttagtgaattttgcataaatgataaagttttaaaattaaaattagccatctttttcgccctcctcctcctcccaccggtattttagaccttaccaagttgggcttcacaagatcgaacaaagcacggacaaccgggtcatttgggttggaaattgtacgcagttgagcatccggcggggaatatatggtgaaacgacactgaaatatcacttttaggtattgtaatgtgttgttgcctaatgcctaatgaacaagaaacacgtacgtccccctaagagtcaatttaatttttttttaatggatcgacaaaatttacttactcaaatcagcgagtaactcgaagcccaaaaaactatgcaattgacgctcatttaccgtttgaatgacgccaaccagcccaggcactgcagctgtccaaatggcgaccggcttcagctgctcctcctgcagctggttgcacgacttcaacaagttggtccaaaacttttcatacactgccgcacgcgacgtgccaccagcaccgccaccttgtcaataattagtgtaattttatttggactaaatggctgtacaacttcaacttcatgtacctagtttgggggacagtaaaaaatgtttgcaatttataacagattaattaataaagttcatggtcaaca

SEQ ID NO: 20687 - DNA, 1526 bp, Heterodera glycines
  misc_feature (1517)..(1518): n is a, c, g, or t
tgtataaacgccaaatttgttaaacgactatgaatctcccgttatacttgtctggatgacaaatagtcgtccaaaaaacggctcagcccgacccaattgtcatgctcaagaggtggtcgaattgtttgtttgcaaacaatctgaaaagggaaaaaccaattttggatgagttacaaaaacccaaaatttgtataaaacatttattttataaacccaaaaaattgttaccattttgacacgttattagattattttttggtgtttaattgccaaaaccatggatggccaataggaaatttgatgaaatttataactgttttcaaataatattcaagttttgaacaaaaaaacaagacctgaaccgctcgcaccacaacatcaaaggcgtaggaattgccgtcaaagatgcgggtgcgcaccgcctccaagtccgggtagtggaacagcagcgagtccaccgctgtgccgcttgaggtcgccgctcgtacgccctcccacatggtcgacgatgtttgcaaatggtgatgcctgtgtccagtggcggcgctgtcgccgacttggtcaagcagttcaaactcgcacattttcagtgcgtacggttgtccgtccgattccttgcaaattgggaatttttataatagcatttaattgggaatttataaaattttctataatttaaaaatccgtgcacgaaaccaacctgtttttaatagaaaatccaaaacccatgaactttttttcgacgaaccggtcaaaaacccgacccgtcctttttctttaacacagacaaactcaaattcacattttacgactctaaacagtttcaatagtgaacctcggcttggtcgtcctccaattccgacccttcaccggaagtttcgttgacaacggcccaaagactgcactttctgcccccggcaatcagagtggaggagcaggcgaagtcaatcacgtaaatctgtgcaattatttgtatttgtcattttttgtcgagaaaaaacagttattacattgtccaatgttgtgtaaaagagtttaatcagtttgccagccaattgtttaagcacagtgaactgaaaagtgcaaaaaaatatgtacaaaatgatggtacgcaaattccatcaaaattttcagtcaagttttgcttttcattgtctcttcctccgaaaagaatttttaaattaaattcaaataaatttgaaaaggtttagcctcctcccgtccctcccacctgatttcggtccgcaagcagcacacggacgagcagaaagtgagctctttgaccagtaactggacaccccttcagctgcacatccactggcggtggctcggccggatgggccacaacgaggctggccaagtcaatggacatcagtggggcagatgaagcggaggcagcggtgccgggctggacgcaagagccgctggcaaatgcacggattttggcatcacgaaaagcactaaaaatcttaaaattaagagaaaatgaatgatccatgataaatccaagaaatagnnataaataa

SEQ ID NO: 20688 - DNA, 2681 bp, Heterodera glycines
  misc_feature (2655)..(2655): n is a, c, g, or t
  misc_feature (2671)..(2671): n is a, c, g, or t
ccaaatatgcagagaaaattatttaattcaattgttcttcatgacaattcaattcatatggtgaaaactttaaatttacttttttcccaaattgactcgataaacaattttcgttgttttggggagggcaatctgacgattggtactccaatttactgtcgagaacatgactgttttaaaaataattcattcaaacaaatatatggaacaaaattttgcttttacgatccatacgaaaagatttaccttgtgaaatctgacgaagaattaattcaaatcaaagcatggggaactattgaaaaagttttttacttgccaaataatttaaatcaatcatttattgaaaatagacggaataaaagagaagaaaactcttcaatcaatgaagaagcaaccattgagtgtttaaaaggaggcattattattaaagcaataaatgatatacaagaattacaaatttccattgaaaattatacaattataaaaaagaacccccaaaaagaggaaataatttatttacccccaaaacttacatcctttgaatataaacctgtaattaaatttataagtaacccagataaatcaaatgagaaacaaatcacatgtcaatcatctcccgtatgcgaattaattaactgtcgattttgtatggaatatcttaaaagcccacaatgtgtagaccagattcactgggcattaatgcttgtaattataatgataattttatatgttatttcattaagcctccaaattattcgaatactcacacgttttatccattggattttacaatttatttttaattgttttaaaagaaaacccaaagtaaatcgaattagaatttcaagaccaaagttaaaaagaccattgatttatttaatcacttccagtttaattttattcaaaatgatttttgcttgtgatgaagtgacaaatttagtcgctggaacaaatgactgtgctgtaactcaagaaggaaaaattgaatgttcttatgaccaaacaacccaactctctattacacctgaacacctaacctgcctaaaactcgacaatacaaaaactaacaccactatggaaacactacaaattacaatagaaactttaacaataatttgcaccgaaaaatctgattattttacgagaggttacgaattatcttcgacatcacaaaaaagatgctcaggcgctgggaaatgtaccggccaaacttgtcaatcagtaaaaatgtcagaccggaatcccgaagtgaatgatcacgctaataatcaaccaggttattcatactgtgtaccatcgtgcggaggatggcattgtcaatgtttcctcgcaactgatggatgtctattttacagaacttatgccgaatcagttggtgacgaaattttcgaagttgttaactgtccatcttggaccattcaagcgagaattaaattgtctatcaatccagaattaacctattctgttaacttgaaacccggaattttaacacacattggtgacgagtctaatagttctatatctgtcacactgacttcgacttcaattccaccgacgccgttatttggttcgacatttattatagttcgcgaagaattaaaagcagcaatagttgcgaacgaaaatttactcaaaaatatattacggtgtaaaaacaaagaagaagcgcaaagttttagttgcacttttccaccagaagcatgtcaatgccacggaggtgattccgttgtacattgtgaatgcgaaaaaagtccacttaccgaaatatttgctaggcaagagaaccttttacccattaaaacacagggaagttacgtatacttcgattcccaaattaaagctaaaatacagcaaacaacttctcttcaaatgcaagtcacacttaaaggacataaggttaaagctatttatgataaaaatatttgtaatattgttacaatatcattggaaggatgttattcctgtactagtggtgctaattggactctatcatgcaaaacaaattttggtaccgcattagccaatgtggaatgtccaagtcaaaaggtccaagtgaattgtgataaagaaggaaaagaacaacaaatccaacttgcatataataagcaaaatattacagaaaattgtgaagttatatgtcccgatggcaagtctgaaattactttaaaagctaatttggaatacatatcacaacaagatactaaaattattcccgctaacaatactaatgaaaaccccatcatcggaacttccttggaccaagtaattgatataataaattttgtttacactcttattaaaactaattttttcaccatatttattattatcatattcatacttattctattttttctaattccatgtctactacctattatatatagaattatgtgtgcttgccttcctcgttcgcgtgggagtgtcgcgacagcgcgaaatcctaaaataaagaagggaaaaaataaaaaacactaaaaaaataaaatggggaaaaacaaaacataaataataaaaaataatttttcatttttaatttggaaaaacatattagaaaaaactatcaaaaatataattataaaaaatgaatgaaatgaataacggaaaattgtttgaaaaggaaaagtgcattccctcaggaatgaaaggaacganaattaattaatattanattgcgaatt

SEQ ID NO: 20689 - DNA, 1856 bp, Heterodera glycines
  misc_feature (1772)..(1774): n is a, c, g, or t
  misc_feature (1782)..(1782): n is a, c, g, or t
  misc_feature (1786)..(1786): n is a, c, g, or t
  misc_feature (1798)..(1798): n is a, c, g, or t
caattgcctatctccaaaccctctgttttcgacaacataatcgtcattaaaaataaaaatatttatttcctaaaatccaatcactgaattggaactaattaaatttaatgaatccaatttgcaatgattgttttgtgcagaagtgacgtggcagtgattgcgcctttttctcttttcccgtcgccattccctcgccatgcttttgagcacgctttggccgtgcaaaaggtgggcaaaattggaaacacaaaaattaaacggaaatgtcccgaaaaaggcgctgaatttgctgtactttcgcgtcgccacggacattgactttttggagagagcgtacagcgatctgatcaaaacggacgaaaatttcagcaatacgatggacgtgctcagaacggtgcgcgaggagggcatcagacagcccattacggtgatgtaccaacgcgcggtgcgtttttgaaaagaaatttagaaatgtcaaaggcaattagagcaaatgagagaattcccctgccattaattaattaattaaggattacatgttaaatatcgttggtggccaagatgaagcagagccaaactacgaaattaaacaggcaaagaaggaaataataaaatttttaatgaataattcatagttggaagtgaactgcggttcggttgccggcacaagtttggaccgacggacagctcagcttaaccatgtgatgctgcaaagggccggttttcagccggcccccgaagatttgcctgaaaattggccagacaaagcgcaaatcgaatcaatcaaaatggcatggtgagaaagtgaatataaaaaattatatttgaaattgaatcaaattaattattttccatttgtatagggaagcctataacaaatccgatgcaattgtggtgattttgatcaacgaaatctcggagactattttcgatgcaaatttcttcgagactgagttggaccgactctcaaatggacgcattaaagtcgaacggattacattgaatgattgtgtacacaggtgggaagtcggcttaattaaaaattaaaaaacaattagcaattatggatttggaatagagctgggatttttatttttatataaaaaactcatggccacaaaaaatgttggtttttgtaactcagttcaggcctaacagttaatttcttcataatgatagacctaatccaacgtatttttgtgtaaaatttcgactgtttctgttatattaaaattttccatggccgtgagttctctccctaaaaatattcgccctaattatgagtatcgcatttttaattatgcaaatttttcaaaagatgtaaattggatgaaaatttcgcactgcgtttggacggtcgcgaagtggcggtggttaagtcgcgctattccgtgcttggattaagagtcaggggcagcgaattgaacatattgaaaaatttgcggttgatgctcgaacgatcactcgcaatcgtaagaaaaataaattcgaattttatttttcccatttattcaaatgttttttcttccgtttagaaaattccgtcgactttcattggctttagctgctcaaagaaagtgcaacaggcaatgcttttctcataatttaattccatttaaaataagccatttcgaagttcagcttcttgccgagcccggcgaattggagcatttcttcccggaggaaagtgacgcggaaatggtaaaagcgattcggaaaacatttgccggaatgtggtcattggagaacacagacgagaacaccgaaaaaannntcccggcnctcnttccaatatacnaataatataaggaattttggtttaaaattctctaaaaatttaatgacgcgactctaga

SEQ ID NO: 20690 - DNA, 1148 bp, Heterodera glycines
  misc_feature (21)..(21): n is a, c, g, or t
  misc_feature (1113)..(1113): n is a, c, g, or t
aaaaatttaatgacgcgaaanaatattttgaaagcaattctctaaaaattcatttaatttgagttaaggatgccattaaccatcctgaaaattacgtgctcaaatcgaacatggaatgtggcggcaacaactatttcgatgaaaaaattccgataaaattaacgggaattactccgactgaacgttcgttccacattttgatgcagaaattgcgaccgatgccaattaaggcatctttttgaattttgaatttttattttggaaagaaattgccttttttatgataaatttgttttaattttagaacgttatggttcatccaaacactagaccgaaaattaacgaaatggtcagcgagttggccgtgtacggagttctcattggcaacatgaccactggagcggtgagtttattcggaaaaagagtgcttaatccattaaagtgtccgaggcttttaattattattagtaaaatgattatttattcaatcaaataaaagtgccgttgttttgcaggtgtcgcacaatgtgcagcagggccacctgctgaagaccaaattggccactgccaacgaaggcggcatttccacggggtcggcggtgcacgactctccaattctgttctgagcaatggcaaattgaagaagaaaaacaaacatttgcgattttcgaattacatatatagaataggctattattttgtttggttttcaatgaatttatccatttgcattttgctatattttgggaaaaagtgaaataaattaataaatgtttcttttctctttttttaactaatttaattacatttaaaaaattaaaattaattgtgttttttgaatttatcgaatattttgtcaaaatattcgattattaactaatttccaaaaggaaggccacataatgcgatcgtacgcattggccattttttcttttgtttattcccatttttgtcatattaattaatttgcagaatatcagtttcatattccatctgcactttaatacatttattcctttgagttaaataatagcacagagatgtgaataaatgtgattaaatgaagcatatcaaataaaggtaatagttacgatggtttttgttaaaaagctnttatttgaatacacggaaacgaactgaaaatcaca

SEQ ID NO: 20691 - DNA, 2676 bp, Heterodera glycines
ctagagtcggacgaagtggagaaataaataaaacaaaaatggaaaagcattacaaaaaatggcaaaaagggaataactcttgtaaattttgtaaaaattattattaatttttaaatttgtttgattttgattgatccatgcaacacaaaaatcgaagaattgtgcagcgaaatgcggaagaatgttcaaaaattgtcggatttgaagtggacaaaaaaaacggacggaccggcggaaaaaccaccggagggaataattgcgaagcgaaaaacgggaaatgggaacaaattcatccattcattcactatttggggctgatcagcagaagcggaccaaccttgggctgaaatcggcagaaactcatttttgatgcccttgggatgacacaaattgtgattaaaaagacgatgcgatgcgatgcgatgttgatacgaccgtgggatgattgatcactcagtgatcagtgatcagtggtttgatcagttgtgatcactgcgggagaagctatttaatacttgggtagccatcattctgtgaaatgtgattgcgatgttttcgaattgatcaaacaaatttcaattaaactttattttcctatttaattgcccttttcccacgtcgcttttctcttgggcgtttgtttttcttccatttcaccattatgctgtaaaattcattttttcattataatctctccgtcaatcttttcccaatccatgcccctctccctccccctaaaatcatcaaattgccctttttctttctcattagtctctcactagttgattaattagtgccttgggcatgtttaatgactctctcctgatcactcgttgttctttcttcccctcgctctcttctcttcccgttctcttttcatttgtcctccgtcgatctgtgcgcaaaaataaatcagtgaaaattcttccgccaaaatcgatcagagcgaaggacggacggacggacgtggtcagttcagtcagtcagcaacaaccatttgcacatttattatgacgaactctgtcccttccttttgcctctttatgggcgccgaaaattttaaattttaggaattaaatcaaaaatttttgcctaattattaattgctttttaaatttgggttggattcgatgcgataaatgatgaacctcttcgttgcttccaaacggatgagagagtctttaaatgagtctctaaggcttttttaaaatattcttttatttttttcgattttttaccaacaaattttatcggggaaccgcgattttcctctccccgaaggtcggggagcaatattgtttttaattatttttagcttttttcgttaattatgcgccgtcgtccgtttctttcgcttttcattttattcctttctctgcgctttacgccaattttggcacacactgacaatgaaaatgccgaagaagcagagaacagcaacaaagttgagcccgaaaggccaaaaagtgacgtagaaggggaaatatccaaagacccctcaggcggtaaatttaaatcaaaattatttatttatttgaaaatgattaaattggtaggttttggcactgacattgagtgggtgccgtgggatcaagcagtttcggtggcgcttgacttgaatcggccaatttttctgctcattcacaaaacgtggtgcggtgcatgcgatggtaaaaattataattaaactttgccctaaaaccaattttaatttactgtttcaataaaaagttggcacttttctctgccaatccaacaaattgatcaaattgatcactttgcgaatggtcctttgatcactgatcatttattattttatttaaaattcgcgtcacttcactctgatcattaaaatgccgaaaagcgaaacgattgtttggttttgttcagcgctcaaaaagagttttgccacctctccaaaacggaaggaactgttggagctgagcaagcagttcgtgatggtgaacacggaggacgaggaggagccggaggaggaggagtacgcgccggacggacggtacatcccgagactgttcattctgagtgagtggaaaatgtgccgttgctgaaccactggcggttgattagggcactttgtcggtttcgggactcgaaaagaaacggcactctcgagacaaaaaaagagctaatgcaagctcaactaatcaattttttttttatttagcccctctccaattgattttaattttaattaaaattatattgaatttagataaacatggcaaacgccttccggtggataataagaagaactatccgagtaacgtggcctacttcccgcagggtaattattttgttagtctaaacatttgtaagcattcgactaattaagtgccggatgtgatcagagcgatgaaagagggcacggaagagtttgagaaggagcagaaggggacagagagaacggaagagggagagagtgtggagggaaaagagaaaagggagaaggaggaggagggaaaaaagaaaaagaaagacgcagagagtgtgacagaaaaggtggacagagaaacatagaaattatatttggattttttattcatttttagaaaacagccaaatcggagaaaaaggcgaaaaaggaagagccaaaagcggaggacgaagtgggcaaaggcggatgtccacacgcggcaggaaaagctgcggcaaagt

SEQ ID NO: 20692 - DNA, 1198 bp, Heterodera glycines
gtgcacccatttggacaatgcttgtccagcagaaattgttgcatttggcacatcaaaatcatcaccaaacgcagcgggcgacagaccatgtgaatagattgaagtcaattggttgagatcagcgagaattgttggagaaatgagacgacgcaaattgtccaaatgctcagcatttgaaatggtcaaatgaccaatgtttggcgcaaaaatgggccaaatttcacgaacaaaaatgtcccaaattggttggccattcgtggtatgtgaaggaagccacaaatataaattgatgcctcttttgtcgaaaatttgatgatttgaacgaagaaaagcgatgacggagtgatcaatgtaactgaaaatgaaataaatgcttttattgtcatagctctgctttttaagtactcaatctgaatagaatcaaagcgaattttgctgggcaacggacggtcgggcaatggaaattccacaaatttgtcaccaatttgtacataaagtttcggttttgttccaatgtccttgctaatttcgattggtctccaaattgtcaattcgcttttgccattgaaatgtttgtccacaagcgcatcaaaacgtggcgaaagaagtgccaatttgaggccgagttgaggacggtcaaaagaggggaaaatgtccatccaaacgtcgttgcaaatccaactgaaattatggaaaaacagtttagttaaataaatgatgaatttgtgtgactattaaaattcttttaccgtcggttcattttttggtaattagcacaatttggccgagttccgaatgaggtcaaacaaatagcagaataattaattaattgcgttggataaaacctggtttttagggttttcctatttttttacggattgtatttgatgaagaagcaccaaaatcacatttaacgaattttttccaaaaaatggaaaatttttgacagaaaattattcataacttcacccaaaatgaaaccaaattttaaaatattgatatcattcaataggcccaaccgttttttattagcctataaagtttcaaaaagttacgttaagtttcaaaaaagttataacttgagaagctcaaaaaaccaagttttttacaacatttttggtcataactttcttgaaacttaacgaaacctttttgaaggcacgatgacatttcgcctactaagccaagatctgacatt

SEQ ID NO: 20693 - DNA, 3688 bp, Heterodera glycines
  misc_feature (32)..(32): n is a, c, g, or t
  misc_feature (71)..(71): n is a, c, g, or t
  misc_feature (135)..(135): n is a, c, g, or t
  misc_feature (3469)..(3469): n is a, c, g, or t
  misc_feature (3615)..(3615): n is a, c, g, or t
ttattttctaaagagatttcacccaaaaaatntatgaatttccgtgaaattcttatttatttttttatatnttgtcaaaaatattttgaaaaatatttacttttcattatttagtcaagaaaaattaaatttttntaatttcaacgaaaggaaaattgtttttaaattttgccaatgatgaccaatttttatgggtacttttgtttaaaaaaccctattaatcacaaaaaaaaaattaattaaaaaagaagtcaaccaggatagaactgttgacaaaagtagtgtttagtgttaacgcactaaccactactccactactacatatgaacgaataaaagcaaatttctttatttaaaaaatttggcaaaatggttaaaaaaattcaaatttgtataatttattgctaattccatttagcactttttattactatttgctatagaattttgctgatcatttaaaaaataattcattgcttcatcattattgtgaaattttttatgaatttttttgaaattttgccatttttatctttttcaaaactttaatcacttttttctgatcaattttggcgactgcactaaaaaagccgaaaatttaaaatataaaaataactctgcccaaaaagataaaagtggattaaatgatctgtgagcagccacagttcagaatgtccccttgccaatgtatagaaaattgtttaaacgccagaaaggaatttattttgcctgctaattcaaaaaagacggttatgactgccttttttaggcggcttatttcaatagaaataattgcttaacctataattaatatcaattcattttgttataatttaaagtctaggcagaagttttcgttaatgcaaaaaaaaaaaattcgacgattctaaaagtctaagtgatttgtacttaaaataaaattttagcatttgctgtaaatttcttgtataaatatgaaagttgttttaagcccaagtgccgagataaaaatgccaattttttgcggacatttagacaactagagacctcgccagctgccatttcgccaaatgaaatttaaccaatttagacaaatttggacgtatcaccaactcattcaacattggatatttcgcaaactaagccaaatttggacgtttatacaaactgacatttcaccaacagaagaatcgtacgcggtagtcctttataggttagagacgataataattctatatggaaaataaattataaattaccaaaaaaactgattttttatgagatatttccttagtttcagatttttatgctaattggaatagaaaaaccatgaatttgatatcaattttactcattagcacagagctcccaagtttttttttcaaaataaggacagatgaggctaaaagtaagattcggactccaaaaataagatttttctaaaactaatagtagcgtgaagtaaacgcaataaaaacatgaaaaattgacttaaaacaatatttattaacgtaaaaaccggagctgccaattgagaattttcaaaatcagcattggccgataaaaaatcatcatttggagtcaaaaaccaactttttggaaagttttattcaaaatgaaaaaaatcaaaaaatgtttttttttcgcggcgcgcgttttccaaaaaactttttgggacaggaagggtgggtccggcggtgccgataggcgccgccgagaaaattttttgaaaatttacttcggatttgttaacagaatttgtcaaaaatgaccaatttttgagattttgagcttatttgtttatgaataaataagttttgggggcccggcggtgccgataggcgctgccggaggaaaaatagaaatattgacagttttttaacagattttcattgaaattttgggcattaactcaagaaatgaaaaaatttaaatagaaatcattcaaatactcgcttcaaaaaaaatatgtaattcaaaaatattcactttttgaatttttattttcaaatccatgaataagcacaaaacaagggaggtcgtgccaaaataaggacaaatcttacaaataaggacacttgggagctctgcattagcacaatgtccggtgatgaattcgaaataaaactttttgtaagaaactcaacttgacaagaaacatggaaatggtcaattccgtaaattcaatgattccaaactttcaaaagttcttttcttcttttttgttctttttcgctttgtcctgtttcgttttggcatattgttcagggtgttcttttttcaaatgtgcccataaagctgaagttgaactttgctcagaaagtttaatttttgttgagcaataatggcatatgtttttcattaaagtgcgattttgcgtaaaatgttcccaaatttcgctaacttttgactaaatttgatgttaaatttagttttaaaaagtaaagctctaattactaataggatattactcgaattaataagattttataaatcgtgcgaggtgatatttaatttcgccaacggtaagaaatgactaaacaaaaacataatattgctcaaaggcagcggttctttatttatattaaatttcaaaaaagaattaataaaatttagatttctccattttttggactttgataaaacttcgttatctcaaaatattccctattaatatataaaatttaaaataaatttcaatcaaaattctgaaatagtttgattatacgaaaaaaatttgtacgcacattattggatttgtttcttttgactgtttctttgttttgtccaacaatatcttttataaatttatttatgcaaaaaaagaaaaaagtccacaaaagggagtaatccacttactctgcggacgtgtcatagattaaatcgtcctcgagtaatatggattaaaaattaaacaaaaaaaagaaatcacaacaaaattaaatataagaatgaggtcaatgattaataaaaccaaatcactatataaaatatataatatctttaattaaagagataattcacttttccggtcattttatacgttaaggagtttaattttagttttaaattgacaaaaaacgaattaatgagcaatttgtgaaagtgaaacgaatgaacaaaaagtaaaaaatggattttaaatttgataaattatggcgttaaaccatttgtttgaattgaacagaatcatttcacttgctaaattaaccaataaaaattgatcaacaaatttgacaatcgcatctcaatttaaaaaacataatatcaaaaccacattgcgcctgaggctttaaatgccgatatgtcttcgtcttcttaatacaggctaattaagttctgctgtcctcaaattgcccttaattggcctccctctcccacttggcccatttgctctaattacatccaatccgcgaattgacgagcataaagcgcttctcggaaacttccatcagttaatgttccctggttaatccatttaagcaatgatnactttttttcggttccacttagcacctatgtttttacaatgtcatttttaatgaattcgaataagtttattcgaatgaatccttgctaattgcttctaattatttaaatttcctaatgattatcttggaagggccatatttattanacggcatttcaaagaacagtgaaaaatgacatagttagaacagctaaaaacaaacaaaaaactttggcattct

SEQ ID NO: 20694 - DNA, 2351 bp, Heterodera glycines
cgtctataaattctactattatctataaattctaatactatctataattcaaatattatctttaaattctaatttataccgtctatgatcgactataaattctaatattaaaccgtctataatttaatattatatcttctataaattcaaatattaaaccgtctataatttaatattatatgttctataaattctaatattaaaccgtctataatttaatattatatcctctgtaaattctagtattataccgtctatacgtcctacaattatctataattctaatattatctataaattctaatttataccgtctatgatcgactataaattctactattatctataattttaatatgatctataattcaaatattatctttaaattctaatttataccgtctatgatcgactataaattctaatattaaaccgtctataatttaatattatatcttctataaattcaaatattaaaccgtctataattaaatattatatcttctataaattctagtattatacctatacgttctacaattatctataattataatattatctttaaattctaatttataccgcctatgctcgtctataaattctaatatgatctataattctaatattatctttaaattctatataccgataacttctataagttatttagtataattgtattttttttaaatttaatattatatttatatagcagcttggacaatattaataatttattattgtttgtataatattcttatattaaaccgtctaattgaaacggaaaaagtttttctcatttcaaatatcaaaagtttttatcggatttgaaaaaaaaaattaacagcaagccgaggcttagcaagaggattttctatgaatttatttaaaattatatgcattcactcagagatgaatagcccgagagagatgccgtgccaaatcaaatgaattggcaaagagtgattgtagtgggggtgccaaatgtggggcttactaacacaattttgaaggggaggggcgaattggtggccaaaaaatccattaattgtagggccaaaatcaatgaatggattaataataataatgtaattgccaccaaaaaaagctattattagcatttccaaatgccattgaattataatataaaatatttttgtttgattatattaaataatgtttaatacagaaatgttgaatgaattgtgagttagcaaatgggttttaacctaagaaaaaatgaaataaattgcaaacatgaacaaaaactttgccaaaaattaataaaatcctaaatttgaaaattaaaaaaaaaatgccgttttatatgattaccccgaccccgactcgggatgacgagttcgggatcggggggtgcggagagtctgggtcggggtataccatgaaaaatggcataaattttcggggtcggaatccgggttttttaattgcaaaatttttatggacctcggaatccaaaatccaaattacatccatggaaatcccaatatatataatatataaatattttttaatataatatgtattaaatataaaattaattataattttttgaaataattaaacttgatattaataaataaaaataatggattttatatcttttaaatgacattttttatttatttttattacatttcaaccaaatcaattagggcacaaatggactttttccaatgttgaatttgtcggcattttttcggctgaccattgccatcacattcaattcttgtctctccccttaagggcacttcatttgcccatttgtttgtgaaaggcaaataattattgccaaaagcacacaaattttgaaattttgtgccattgggggagtgattatttgccctcgggcatttctttcggctcttttttgtttgtccaccatttgtacatttgtccgccgtgccaatgccaaaaaaatggccagcaaaaagtcaaattgtttcaatttcttttaaaaattatttttatcgcatccatttaatggaggaatcgattttcctatgggtttttcgtttacctaactttgtcatggctgatgtcggacgagcacttagaaaatcagtaatcccaactacgggtcggggtcgttttcgcgtggggcgagtttttgaactataacttttttctttgtcaaccaaatccaaaaatcttggtatcattcgatagccctaagtgttctctattagcctacaaaatttggaaaaatttcgttaaggtccaaaaaagttatggtcagaagagttcaacaaaccaaattttccaactttttggctcgaactttttttaggctgaacgaaattttttgaaattttgcaggctaatag

SEQ ID NO: 20695 - DNA, 2529 bp, Heterodera glycines
gggctccctatcatttcgtcactgatcgtttcgttactgttcagttagtcactgagaaaatttttttttaatttgtttgtcagtttgtcaaaactcaaaataagctttactttattttaataaacaaagctgtcaagttagctccttcaaaaaaatttttttaaacccaaaatccatcgtttaacctgccaaaaaatttcttacaaaaatgttattttttggcaaaatttgtgataaaatcgcttcaaaaatcacattttttagaaaagcagtgccgcgaagaggacgatgtgcgggatcgtgctggtcgagagtttcggtctcgactcgagaaaaatcgcgggtttttcctcgagtcttggggtgaaatctcggtgtcgagtaacgggaaatttttggtctctagcagcactagtgcggtgggcctcgcaaaacggtcagaaacggtcgtcgtaaaaatcatctcaatcagtgttgtgattgggatatagtagtccagttggccaagtggactatttcccaataacaaaaggaatttcaagtcgattcctcctggcggtgtgattaattattcagaattctacaatgccgccacggaaacagttaatgccgataaacaccagagtagtgtgtaaaggggggcaagtagatgcgtaacctcataggcactaaaagtcgaacctactacgtaggtaacctatcctgaagacacatcaaaatatggataaatccgatttatttaagggttatcttttttgattagccaattgtttgaaaatgtctgcctttttgattagttttcccggtttgttctgataaaggcgatcgtttgtcaagtcgccgtcggcgcaaaaaacgccaatttcccttgacgattgtcggagtgctcgtcgcaatggccgtcctcgtcataattctgtactttgtctgttccggacagtgcagctattcgtccggcgaaaagtatgccgacatagacggggacatcgaagcgggcacagcccacggcccacactggcccagcgaaatccgtgtcaaattccgttacggaagcaaagacagggacctggaggaaaatcggaaaacggaccacgtttatatcgtagtcggaaaatacggtagggggaggttcggttaactctattagtgagcggaagttaagtttttttccgattaggataaaattcggtaattaattctaccgatttttcatacctgtcagaaaatccgagaaatgatagatattatgccaaaatatattttcctttttttcgttattcaaaagtttctaatttttagaatacgaccacacaacaggtggagctcgagctcgaaacaagtgcgatttgaaataatttcatttttcaattatttgttgtaaatatttagaaattgacgcaaaaatttcccaacaaaaacattttccttcaccccaaggctccatgttgacggtgatttgaaaagagttagccaaattttaaaagggatggctaatggtaaatggtccaatggaagtttggactcatttcgtctgtgcctcgactttgcctaccaatttgtgtgcctgttgagaaatggggagtaagtaaaataaataaataaagaaatcggtatttacgaggccccaaatatgccagaattccttaaaaattattcaaaagggatgctatgtcgtttcgtaaaatcctccattttaactatttttggacaaaacatggcattactttgcaaaaaaacaatcaaatttcaaattcttggtatcattcgatagccaagctttttctctataagtttgcaaaatttaaaaaaatttggtcaatattagaaaaagttgtttgaaaataagtactatttctgccataacttatgttaactttgataatttgctatgcaaaatttggttacttttagcaaagttatgacatgttttgtcgaaaaaatcgccaaaatggcggattttacgaaatgacccagcacgcagaaaaggcaaaactagcagccatggcattaagaaccatatttttgccgatctatcaaaattgaaaagaaagcgattgcatttttattttttgctatgaattgccattttgcacaaaacaaaatcaatgttattgttttgtaaaaattaaaaacactttaaaaggtgtccactaaaagaacaatggccagaggctttcattgatttcgaccggcgatgggtaagaaaagtaaacgatcgtttgccagtgtacgacaagcgctaccgtaactcggcacaaaattctgaactgtcacggggcacaacggaggtggccaatgaaatgccggaaacggccagcgccacagtgccaacatggctgaccatggcggaggtggacgtacccgtggagtttggcaggttattttgaggatgaatggtcataatcagtgatggatatgattgattgatcatttgttgaattttcagagccattttaagattcttttataacttttactgaacattctacggaaattatcaaatcattgggttttatttgtcctctttta

SEQ ID NO: 20696 - DNA, 2309 bp, Heterodera glycines
  misc_feature (5)..(5): n is a, c, g, or t
  misc_feature (2232)..(2232): n is a, c, g, or t
  misc_feature (2281)..(2281): n is a, c, g, or t
tatantggaatacaacaaaaacatatgtaattaagttggattatatacttaaaagttaacaaacttttttgcctttcccccacaaaaatgccattcatacattggtgatgtgtaaatctttcacctttcaaatgtacaacgaaatatttcgctatttttaaaaacaaaaacatattttttggaatgtatagataaaatcacagcgtaatttaattaaattgtttttaattttcaatttttttatttattttcaaagtgcacaaattagagacaaagcgtaagccaacgaccatttgttaaaggcatttctacaaagacttttctgtcaaacggaccaattcattttttcgaaaaaactttcgaatcactcactaattttcaaggtttaggaaatcaggaatatttcagaattgaaaaccaatcatatttgtacagacttttttccaggcaaaattacacaataacttaaaactctaagacatttttccaccattaattaattataccaattattctgcgtgtctttataaaacaagcatatctagcattgcaattgttgttaattaaacgcaatgtaactcttcagcaacggtaagtttaccatttgtcatgatggatacctttatttatggttaattgaccaaaaataaaaacatagtaaaataatgcaaacaaagtttaatagtaatctaaatcaaataacaaaacaagatttcatcatctccccttttcagttactatatgtccttgcgctttttacccagtggaattcgttttgattaaaattgtcggattcactgccgaagacgttgctaaaataaataaatcaacaatgcacgaattgataaaatcccagttaaaaagtaagacaactagctgaaaagctaattcgaactggaaaaagggcacaatcccaagatggcactgcgcgcgctatcaaacgccgctttctcagaaattggagccctaacccaaatgccaccagtctcgagaaaatttcggcagaagtaccggcatcatcagttgcggctccacccatttcagtgccgccgccattcgctgtgccgtcgttttcgtcatttttgctgctgctgcactgtgtgttctgttcactttggcatttcttcccctcctcctcttcttttgctgtgccttcgccatgactttgtgccaacattttcaatgatcgctttcgttccgtgttgcgctggcgacggtaatccttcgcctgctcactgctcaacggcaccgaatggttgtgggagttgcgacagtaaagcatgttccttccaatcaaatgcataactttgaatggacaactgatcggccaaaggcgatatcggcacctgacaatgaggaaaaataagggaaaaaattcgaaaagccaaaagcatttgggaaggaagggacagagggggtaatggggggggggggtaattaccacaaattaaacgcagtaatttagaaaatgtttataactgcttgaaattgagagaggagcagtgcgtgcacttggaatggtttttgaaaatcgaaaaaaactacaaatcaaaattatcaagaaaaaaaagtgagaggagcccgaaaaacttttgttgcgtttcatggcattttttgggccaacaaataaatattttgagggtatttcagggtcaaaagttttgactctcgaattgtctgatggcaccgcccccactccaaaaccggcgaacaaccaccgaccgacccaccaataggtaacgcgcgacccatcctgggcagaccacaaccggttcacacaatactgacgacgaaagcccagcacagtggcattgctggcgtcgggaaggttggccagccaaagccacggtctgtcgcaaaggtcgacgaccaccggcggcggcggcacgaaagacgacgagcacagctcagaaaagttcatgtggtattgaccaccaccagcagcagcaggaggaagaggaggggcggaaaatggactaaaacggaaaatggacggactgaaaaagtttatttattttttgtacagtcggagagagttgggaaatttgggagaaggctcaaaatagaaaattggcactttgctaaacacccttttctctttcttattaaattcacgaaaaaatacctaaataaaagttaatacattcacaaaataatttgtactccttgaacatgtgtgtttatactattggcaaaaatggtagtttttgtaatttcatatcaatttgcccngccattgcctgtcggtgcaacttgttcaatggatttatgggacttccangtgcagccgccctcacctttcacactgt

SEQ ID NO: 20697 - DNA, 1705 bp, Heterodera glycines
atagcaagggaaaaggtggcgaattcgctctctcttggcattgtgatgtttttctcaagttgctcaatcatgtgcctgttccgactcggcttgagcctggccatgtctttgccccttgcccacatgaccaggcttgcccgttgctcagcaagcaaaagtcatgcaaattcaaagtgcgttggcaggaatttcgaaccgatcacagaactaaaagtgtgaacagagacgggactttgacgggagagttcagtttccttataatggagaagggcgagcgaaagccggcggacgctgtgccggcgcgacttttgcaggtgtaaagccaaacatgaaagaagacactttccatttagctggagcgagctcacaaatgtgtgtcgtgccatatttgcactgcctttgacggccttcagcaactcgtcgtgtccaaaaggcatgagaaagtgtacgcgcgcattcgaagggcgatgccctcccaacttttgccagtgaatgtgcgtttatataccaatcccagcattttgtgttttgatttacgaagcttgttttagatggaggtcgtcaagagtgaaactgacttgttgagaagcagtgaaactttggaggaacaaaatcggcagagagtgctgtccatttccgatgctgctcaaaccaaattattaaattaaataaaatgttttatttatccgttttttcgaattgaggggggaggggtaagtggcaccgactgttctttctctcctccttcgctaatactcgtcagaaaaagtatagcaccgaccgaaaatgtaccccgccagatttattttatttttcagtctagtcattttagtcctaattatatgtaggaaaattcagtaccgtatcgaagataaacttattcttcggaattttcttcaaaaaattgcagtttttcactctcatttatttatttgaattttaaaatacgaaataaatcaaattacattaaatagaattaagcaattttcgattgtatacgtcatacttgtatatgcttgttcaacaacagtgtcgtcattattcactacattttttctttttattttttggcgtttcgtctccgtctgctaatgcacattggcgttgtgcacaacgttttttccacaattttcgcgcggtctggcaaatctttgcacgggtcgtctgtccgttttcgcgattcctccatcagaaggtcgatctgtgaggaaagtccatggtttaataatgcaaaacagttttgattttgtaaaaaactaagggataaagcaaaaataaagcctcttcttattctaaatattttatttatagaaaagaaaaaaaaataatagaaatattggcctttgtgaatttaggcatttttaaaattaaaggggaagaaaaagaataaattattaaactcagtttttaaggtagccgaaaactgaaatttcaaaagccaccaaaatagagatttaattcattgttactcgcatttttgaatttaagtaatttaaaatttaaagggaagaacattctaggaatttattgtctaaacgagataataaatagttctacatgaataattcatgtttcagaaacatctttaaaaaatttttgaaaaaagtgaaaacatatttaacaactgtatttgcatactgtaggtcgaccgaactcgagccgtaaattagtgagcctttttactgtatatcgatttcaagaaaaa

SEQ ID NO: 20698 - DNA, 1391 bp, Heterodera glycines
agtcacaacaaaaaggaacttcaagtttttagctctgaactgagcactcagtcacaaacgaattcataaatctgccacaccatcttttgatgggaacttggctcgacttttcagtgccgaaattcgattacgcacctacttcctcccctttacacactctctggtgcttatcggcacaacattgccgtggcggccttactttcaatgctgccgtggcggtgcaattattttttaaataatccaccgccaggaggagtcgaacttgaagtcaaatccaatatacaaatagttgacatgaatttgaataaggaaaatggatgaaatagaaaaaacaacaatgaatcacaaatccaaagaaaaaaggccaccaaaaatagaaattaatatcattgtaaatcatctaacaatggaaaagctgaaccgtttttctacataattcactaattatgaactcaattacttggcttgaagtagtgaacaataaataatattaagaaaaaaacagttaattcatgccaaagaatgtgtctcgctcgattcgatggttttatgaaacaaaaaataaataaatgtttttcgggaatctcagtgatgattttagttcgaaaatcgaactttctgacaattcttggcattttcaattataaaaatatacaaaattgattttaaataaatatttcccgtgtgatatgtagaaatgattgttaatgattagtgatttgattatgtgtgattatgcaatgccatcatcacatcaaacaagaaggcaatcatcgccatggcaagcgtccaccaaacggaggtattggctcaaatggaactcggacaatggcagcggcttcttcagctgatacaaacggtcaacagcagcggtagaagaagaaccatcatcatgatgatcatgttcatcatcaagtggcaacagtgtctcgcaagtttggtttgagaaccgggaaatgcctacgaagaaaagagtgccacatgcattatataggggaaaaatgcacctttcaaaaatgggagtagctcgtttcccgcgcatttttctattttatttcgagcttagaaaaaaatccgaagaaatttttttcgaaggaatttgaagaaaattttttttcggaaattagcgatttttagtgaaaacttcaaatggatatttttcaaaaagtttctttctgaagttttttagaaaaaaatttcgggatgatttaactatctgttttttccgttattagaccccttcgaaactttcaaaaaaaaattttctagtaaaaaagtataaaaaaagttttttcttattgttttttttttgaaaaactttattaaaaactgaattttttgccactacagtacaatattcaaaatcttaaaaaaaaaatcacaaatatttt

SEQ ID NO: 20699 - DNA, 409 bp, Heterodera glycines
cggggatctctagagtccctaaatcgaatttttgacttcagcccccccccccagtaagggtctggctacgcccttggttgttggcagtggatgataaaaaaaagcgaggtccttttttttttgtgcgacggtttttccaaaaaagtttttggaaatagggggtccggcggtgccaataggcgtcgccgggaacatttttgcatttttttaatgctatttgttaacgaattttgtccaaaaaaatgaggaattttgggttctagtcggttttatgcgtcccatggatgatcgaccatccccagtttcttaggccataacttttttcttacttggacaatacctatattcttggtattaaacaacagtttaaggcctgttgtatcttttgtataattatattgataaataa

SEQ ID NO: 20700 - DNA, 1907 bp, Heterodera glycines
  misc_feature (26)..(26): n is a, c, g, or t
  misc_feature (1837)..(1837): n is a, c, g, or t
aaatgaaaatcaaaaaaaaaactacnaaaacaagtgcttgtctggcatgagaaacaaatcattcatgattagccatgactccaactcatccaaattgccgatggcactctgaagcaccgacgaccgccgcaacaattcaatgccatactcaggcaaaaatgcgtgccgaaatgcttgagccggttgatgccgatcaatggggtgatggacaaaatattccatggccaaatggggcagaattggtgcaatggcggcgacgagcacttggccaacaatgtcgagagtgaccagaacggcatcatgttccggcgaattcatcggcccctggtagagacggtcgcgcacaaagtgctaaacaaaatgaattttaaataattaaaaagacaaatatttattataatttagaataataagaaaaaagggtttaaaaagagtacaaatgcctccgctccatcaaattttgaaatttaaatttttacaattagttgaatttcaaataatttaattttttttttaatgttgaagattaaattgaataatttttaattcagtttcaaaatagggctgcaaccccgacgtcggggttggaagcgtcggagttcggggtcggggttaaccccgaaaatggccaaaaatgtcggagttcggggtcggggttgcaaccctatttcaaaatttaaaaaaggcaaaaatttaatgatttcttttcaaattttttgtagcgccctttttcagaaaaaaatttctgtgaaagtaggaggcaggcgcgtgccaacagtcgccgccaagaaaaaactacgagtctctaaactaaaaactatcacaaatctaaaaatgacaaagttgggagaagaaaatggcaaaaaaagagaagggagaaaaactgaattggaaaatagaaaaaggttgagaaagtgtgttccggaaaagaaaaaaaataagagaaagataaaaaggaagagagagagatagagagagcgagagagaaagtgtgtttcagaaaagataagggagaaagacaagaagggagagagagagagagagagagagaaagtgtgtttcggaaaagaaaaaaaaataagggagaaagtaagttggaccaaattggacagcattaaaaaatcataaattgcgcacaatgtatcgggaggagagtgggttctgcataaattggaaataatggtcaacaaaactgccgaagcgatagttcagccgatggtccgccaaacggtccatcaaactgtccaactcggccaaaatgaactgcaacaaaaaaagggaatttgaattggcaatgaatgcatttggccacaacaacaccctgtccaatggcatcagtttgagccgaggaggcggcggcatttgttccccatttgacaatggcagtgccgaattgcgaaacggaatcaacaggtcggccaacgcagtgccactgttctgcttggcctcggccgcggattccaatgagccaagaaggaagcggaaaatcaagcggatttggcgcagccgagtttccacctgacagagagaatgtgcggcatgaaaaccatattttttgggagacaattaacgatttttggaaaattttttttaaagctcattaattataaattttcaaaaattttttagattatttggacaaagcatataattcagtcccaccaatttgagcgttttgggcccgatgctgacactgcccgaggattcggaggcgagccaagcgcaccaaagacgaagtgcgtccaccccgagggcacccgcatcggagggagccgattcttcacaacctgtgatcttaaacaaattcaattttgtataataataatatttaatttgngatttttcacttctttttttttaaatttcaacggtgtactgttgttagaggaatatttgatactgtaccg

SEQ ID NO: 20701 - DNA, 2857 bp, Heterodera glycines
tgctcattacgcccttcgattctgtcaaactctgtttgtgatttgtttccactttttccaaaaatttcgccatgttttcatcaaaaattttacggtgacggagatacgaattgtcaaaatttgaattggcacttattttcaaatttttggtgttgtacaaaaattctgtccgattcaatttgtccaattcaacgccatatttcttcaccagtgattcttgattaacaaaactcggtttttgaattcgatgataggcaagccaacaaacgcttctgcttttgaatgttctccgatacgactgatcaaagaagaagcgccaaatttgacacagactttgcataaggtcaatcagagtgcccgcatttcggtacagtacgccccatccccgttcatggtaggcaaattttacgatcggctgctccacaatgggaatttgttccgccaagtcgggatcagctgcttaaaagtaagattgcgaaatcattgattatttttaatcagtatttaagagaaatgatcatttcaaaaccttttacactttgtcgagcgtattcccgaaacaaatattcgtacagtatgatcacatgcttacggtaaataccacattccttcacgtcattcacatcatcatcactgttggtcttaataaacaaaagagctaattactttacagtaaatcttatcttttaatatagtttttaagaaatgcattaattggaataaaattataaaatggtccgaagaataaaattgttgtcgctgaaattacaaattccagcgccaattaacaaagtgttaattaattggcctccattacctcttccttcaccaatttgtcaacgactttctcgcattgccaatttgttttaatgaagtacaaaacgccaagaaatgtttcatatttttgtgccaaattgtcattgtaacggtcaatggtcaaccattgagtcgcacaaaattcatcaaaaaacgtccgaccctttgcaaatgcaaccattgcttcatcttcgagttgttgtacagtctgctacaaaattgaatggtaattaatgaaaataaatttaattttttcggtcagtgattttaaaacctctcaaattttttaaaacaaaagttgaaggattaaaaatgtttcaattataaaattattaaaaccattaacttttaatgcggttagtcgttttggtttaagtgtgtcattgaaaaaggtctgttttcggcggaccaaatcaactcaattacattgattttttcttaaaaaccgtcaattatttacgttggcccacccatcttaattaaaaatggcttaaaaaggggaattaaaaattggaaaaaatggtataaaatttggtcaaaaatttgatatccttatacttttggaaatgagaaatttacatagaatgtttggctaaataaaaaatcaaaacttaccaatgattttacatttgaaataaaaacgaaataaaataaaaaaagaaaaattgctggggtaagaaataaattcatttttatgggggcgtattaaaatggtaattttaataattaccacaaaatattattattattattgcttaatttaattgaatgctaagaatttcaatatatttatatgcgatgattacgtaatgctgatgatatgttggtgagggggtttcttccgtgtttaatcggataatcacatgaaaacacatgaaattcatgctcgtattaatgctataatacgcgcaatatgaaatttatcagaaattttttaacggaaataaatccatcaaattacgtaaattgactactgacattttcatattatgactacaaaaatttaaaaaaatattaatatgtttggcgatggaaagtcactacgagcgagaatttgaaaattttattaaacgctaaagaaataaaaagtaattagtcggtagatgaaaaagaaaggcataattaattactttttggaattggaaaacagaataaatttcaaatttactttaattaatagggacgtgaattttaggttttaactattttttttgctcaattgatttgaagaaaggagctcaaaaaacgcatttccgcataaaaatttttcgattctgatgtcattatcggtcactagaaatcactattttgggattttgtcactaaaatagtgaaaattcactattttggagttgtcactattttttcactatttcgacattttttgggaaattccttaacaaaaatgcaataaaaccaaaaaatacacccctaagaatcgagcaaaaatttttcaaaaagcactcctaagaaatgaaaaaaattttctcaaaaaggggcaagaattttaattttaaaaattatttttttatgtacctattttgttttttttgcccttaaaaatcccagccctactcatttgcaatgcaatcagtgaataaaaattatttttgcttaatttttggctgacaattatgtcactattcgtcactatttcggactttttgacactattttgtcactattttggcatttttactcactattttagttaactatttcgggatttttcttcactaaaattcacgtccctattaattaataagattagaacaacaaaatgaaaaaatagaggtcataaataatattaaaattaacaaattctggcaatttttatctgattaagaagaaagaaaataatgtgccaccgcaaagtaaatttttaaaatggacttaattcataatcgagtgatttatttatgatttttagaaatcttaatttttaggcactgttagacccccaattctcattattgactgcgtaggcccgaagagagtcgccctggttagctgacttttgcgccgcagacatttgcgccgc

SEQ ID NO: 20702 - DNA, 1335 bp, Heterodera glycines
ccccgagaaattttttttttgaaaatttctgtttgcaatttttttttttaattttggagatggggcgaaacggggcaactgattggaactgatacggggagatctaccgtctgtaaaacttttatgtgacgggctttttccgcctttgttgaatttccactttcaaccccccccccccgccagcttatccattcattaaaaatccggtttcaatttacaaacacatccctccttcattccctcccccattcaattaatccgccgtcatccgcctcaatcctggaaaatcaatccgcaaatgatttctctctgtgtctatgccctcttctagcgccggaggcggcacgaattagtcatcaccggtcggatcggcgccggacggcgccgctggatttgtgaaaattttcatttctaaaatagggttagaccccaatttcccccgggttttttttggcatttttcggggaattccccgacccgacatgtccccgacagtagcttccctaaaaatttccatccccccgatttcgggatgtgtaaatttttaaattactcataatttagggaggcccatgggtttaaattctctcccaccattaaaaaaaatcaaattttcaaaaattaaataaaaattttcttcgtctcttctaattggcacattcagcctgtattttgtacaagaaattttgagaaaaatacgctgaaaattgactttgattagcatttttttcttgaaaataaaaatcacaaaaaaactaaaccaaaaaatcaataaaaaaatttttaacatttaattaaaaattcaggctatttattatcaggcatttgtctaaataatggacattcgacggcattttatgtgccaaaaattgttttgtttgccccttttaatgataatcacttcattttgtacacggtcatcaaatgctgaacttagtcaaaacaacaaaaaattgtcctggattattggtaagattttgcgtgttgtgatggggggggggctatagaaaattttcaaaaaatcttagaaaatttttttaaagaaaaatttagaaaaatcttttttcaaaattttattatgaactactaattttttcaaaaatcactgaaaaatgtttcaaaatttttttgaattttcttacaaaaattttctattttttttttgaaagtttcaattgaatttttttttattagttaaggggataggttaatatttttataaagtacatttttaggttataatttaacataatatggttttactcagggattggtctaataaactttctatagaaagaattccgatgtgtttttttttggatttcaaaaatcgga

SEQ ID NO: 20703 - DNA, 1190 bp, Heterodera glycines
cgaattaataataaaaaattctattataaattttttttgtagaggggaaaattctgaaccaaactactatttgaaaacccaatcaaaactgggaaaaatttgaagtcaaaaaattattcgaatttctccaattttgtttccataatttccgaatgttattcggtatcataatgccaaaccaaaacgaattcgttttaaaatattcttttctggacttgacttggtttctcaatatcgaagcttttttctccgcaatttctaaaacgcttataccaaaccctagatttttggttccgatgggtttcagaaaaaatcccgtgtggtgaaaacatatttcacatttcacttcataactttttgagttctgcacggatcgagaccgggataagaccattggaaagagcagctcgagctctacaagaagctatggaaagaaaaaatcgacatttcagggactttttcagaaatcatatttaattccccaatggggccccattttgggtccccagccacagccccatgcttctcccaattgtggcgaaaacaatatttcacatttcacttcataactttttgagttcggcagggatcgagaccgggataagaccattggaaagaacagctcgagctttacaagaagatatggaaagaaaaaatcgacatttctgggactttttcagaaatcatgtttaattccccaatggggccccattatggttcctcagccacagccccatgcttctcccaattttaagtcttggatttgtcaaataaattaacgatttcgaattaataataaaaaattctattataaattttttttgtagaggggaaaattctgaaccaaactactatttgaaaacccaatcaaaactgggaaaaatttgaagtcaaaaaattattcgaatttctccaattttgtttccataatttccgaatgttattcggtatcataatgccaaaccaaaacgaattcgttttaaaatattcttttctggacttgacttggtttctcaatatcgaagcttttttctccgcaatttctaaaacgcttataccaaaccctagatttttggttccgatgggtttcagaaaaaatcccgtgtggtgaaaacatatttcacatttcacttcataactttttgagttctgcacggatcgagaccgggataagaccatggaaagagcag

SEQ ID NO: 20704 - DNA, 1709 bp, Heterodera glycines
  misc_feature (38)..(39): n is a, c, g, or t
cccctaagaatcgacccgaaaattttcaaaaaatacanncctaagaaaagaaaattttcaaaaaaattcatctccaaaatttatttattgacaagaatttgtgattttaaaaatatttatctcaatactgatttggcttaattttgttacctttttggataaaattttacgattttacaccccaaaaattgaaactttttggcacctattttcccatttttagcacctattttggcagtttttagcacctaaaaatcccagccctaattataaggttaccttactttttcatttttattgcatttttattgataggaattttacagaaaaatagtgcataattccagtcaatcaatttgaataatgtggaatggtcccaatataaccacccataaaaaaaattgaaaaaggcatgaaaataggcatttaaaattttttattaaggattttatggagcaaaacacttttaatttaatcaaaaaacacttttggctggtcattaaatgattattaaatattttttataatttttttctaataagaaaatttttaaaccaaaatttttatttgagatattggcgatcaaattttgtgaaaaattttaattcttaggggtgtattttccagattttattgcatttttaatggaatattcagaaaaaaacgccaaaaaaggcaccaaaacggcaaaatgccaaaaaaaggcatttaaggcacgaaaatcccgaaaaaggcataataaaagtcagcgtagaagcctcaaaccaagtggaaaatgtcttatgtatgcttaatatatcggaattagtgcgcacaaaaaggcatatacctcaaatctctaatcataagacaattttttatttaaacaaaaaatatttatcatggcaaaatatagaaaaagaaagtgtgaaaatttggccaaatggacggtgaatgtgaaagcgagtcccatcacaaaaaaaaataaaatgccaaaaaacaaaaattgaaatgccattgcccccggtggcgaaatttattgacatcagccgcctcactttttcgtttatttggtcagccgtttcttcgcggtgccaccgccgccgccgcttggtgctccgtcgcccccgttgctcatgccgtccccgacactgacgatgccgttgttggtgttggaggaggacgatgtggatgatttcaaaatttttgtcgtgtttggcgtgccgacaaagtgccgcggtgtcacgacgggcggcagcggacccttgcggaagccgccgtcgccgaggtcggtccggttcagcgcttggatgagcgcggcaagcgtgatggcgcgcaacgcgtcctcagtggcctcggccgcggacggcagattggcagcgaattcgcctgggacacaaagaatgagtaattaaaacaatataaggaattgattaaaataatgatcagctgcttgatcaaaactttgttgttaaaaaacattccagctaagaaaaattgattggaaaattagagagtggaatgaaatcgggatcccgtggggtcaaattcgggtcccgacctcgggatccgaccgtatccttttataattcaccgggattgatcgggacctggatttggacgggatcccgactcggggtccctcctgaccgtttgtaacaaaatcatcccgattgaaaggaaccgggattaggtcgggggatctctcgggcccaattgcccggtcaact

SEQ ID NO: 20705 - DNA, 550 bp, Heterodera glycines
ggaaataaccattcgattgccgtctctatgcataaatgactctggcggtgctgggattttcatgttcagcaagtcttcttcctcatcaaaagcgtcattcgcaattacattctcttggttggccggcattgggtcctcattctcctgattttccagtgaatccgtttgtagacctttctttttagcatttcttcgcagtttctggtgcgacattagcttatctggatcaaaaaaagaaataaatgcgtagattctaaaaaaaaaatacaaatttgtgcttctttaagaaaattcctccgtatgtactttttttttgtaacaagcaaaattttgaattcttagaaatacataatttggcgtgttgtcgctctgcaggttttcactaatttggcttttttgaaacagccactgcttacttacaaattaggtaaataatgctttacttacatatgcgtctacctaattaggtactcattgggtttgggaccgcttttttggccagaaattttcaaaaataaaaatttcactcttgacgatttattcaaattac

SEQ ID NO: 20706 - DNA, 1015 bp, Heterodera glycines
  misc_feature (94)..(94): n is a, c, g, or t
tttccaatcattggaccttttccattctttggtcggactgaccaatgccgggtccgtcgcttcgcttctccaagtccgttttccttcccatttntaatgcatttttcgattggtaattcattgcatttcgcagatttcgggtcgtctcgccatgcttttcattgtcaacggatgtcccccgctttggcattggtccccggtgttctcattggtcctcacttatcttctctccgaacaatttcggtcttccttttttccgatggcattttttataagcactcgctttttctttttttgctattaatttgtcattgttttccattttaagctaccccttttacgcgcttaaaacccttggcatttctcttcgatttgtcacttggcttcgttacaacgtttggctgctgctttatccgctcggccttttccttgagggtacattttgaaaacttcactaattatctcaatttatctttgaattctttcagccctcgttttgctcatttccgttccgtttttttactcttccgtcgtttattcactgcaacttccaaatgcgctcaatttcagttacaattttggcgttgtgttggcccttttcagcttcatttgcttccctttcagtgggtttattactttaatcatttatttttacttttggacaaataaaatgtcaaaggcgctaaagccgaaaaaaaaatggtcggccatggaattttaagggcgttcacttatcactagggctggcaaaaatatgtacaaaaagtggtcagaaaaaaaatatgtatttacataaaattgccagctctacttataaccgatttgtaaatctgtgacaagggcgtagctagggagcgaatgccggtccgtcgtccatcacttccgccgggaactgcggagcaacgaaaattaaaattttcaaaaattaattaatttgatttactgtcttaattaggtttgattggcattgccatggacccaagagcaaagaaagtccttggattttgttcccatc

SEQ ID NO: 20707 - DNA, 2789 bp, Heterodera glycines
  misc_feature (27)..(27): n is a, c, g, or t
ttaaaacgacttcggaatgcttcttcncaccttttttacccaaaattctaagtacacttttaagtcaatgccacctttttcgctttcattgtttttttgattattaccacttgtgcttggtttttcgttatcattaccatcatctttaccatcactagaagcactatttttgctggagttttccttaattcaaaaataattttggaacaattatataacaattttttttttaattatttcaatttaaggcaataaaattctcttaagtttaactttcgcgagacgaatttaaaatagtaaaaaaaaagtccaaaattcaaatataattttatggcttagaaaaatgccaaaaatgttctctttctacataatggtgtttatttatttaaaaaaaattagaaagaaaaataaattccaagctatgagaacttatattaccccaatattattactagggattctttttttaggcaaatgcctaaaattcttgcgcactaacacagataagcacgactaaagcccgccctttccgcttggtttggggtgtctacgatgacttttataatgcctaactttccctacttcggggttttcgtgcctaaggtgcctattttaggatttttgaaaaatccttaacaaaaatgcaataaaaacgaaaaacagacccctaagaaatgacccaaaaaaaaactttcagaaaatacaccccctaagaattgaaaaaattttcaaaaaaataattccaaaatttatttatttttttctcaataaaaatttttgttttaaaaatttgtccgtatctggaaaaaaactttaaattatttaataatttcatttacaattaaaatatttaaatttttacgtgttttaatacctaaaagcgttaattataattttttttgcctatttgcggatttttgtgcctatttgatgcctattttgcgatttttttctgcctttttaggtgcctattctcgatttcttgtgcctaaaaaaagaatccctaattattacgctattaaaaactcaaaaaattatactgactgtaccgaaggcgtcgggaaaagcgcatctcattaagtttgaaaattaccaaaaataaagatttaaatatccgaaaaggagaatttatataattcatttttaaaaaagaaagtaaattttaaatttttagtaataattttatttaaaaaaaattcattcaatttggtaccgaattgatgcgtttcaccactggtttcaccactgcttcttccacacgcttaaacaatccccacatttgagatgtggcctttgcggatttcttagatatgctgatttcttttttgaccttttcccgctcgaacaacagccgcattttcatgtggatcagcgtgtacagcagtgcagcaccgactcgctcagcttggtctttcaattcctcgcgcaatggcttttcctcgaggatttgttttttttctaatatcgcaaattcttgctgcaattgcttctcgtaatttgatgatgataattgcttcgttttctgcttgccatttttgtcattatttactgttttcaaaatttccggcattacttctgattcaaaactagaactaaaaaggagcacacattgaatgtcggttatatactttttaatacagatttttgtgcatatgtttgcttataaacagtattttttttaaaacaaaggtagacgaaataaatccaaggtttatattttttttaaagacaaaaaatataaaaataataattgctaaaaaattaaactataaatgtctttgttttttaggcaaaggcctaaaatgtcttcgctaggggtttcttcgatgacattttaatgcctgtttcgcctattttggggtttttatgcttaatgcataggcgcgtattttttgcctatttcgccatttttggcgcctattttggctttttgaaaatttcataacaaaatgcaaaaaaagaaacaaacaaaaataaacctaagaaatgacgcgtgaaaatacaccccgaagaattgaaaattaccaaaaattggtcccccaaattttttttctttataaaatttttggtttaaaaattgttcttattcggaaaataacttcaaaatatttaaaatttcatttacaattgaaacataaccaaaatgaagttggggagggggggggggggtggggtcaccggcgaaatgattgaaaataattaaaaatttgaacaaattacagccggatctcttaaaattcctcgaaaattccaaaatttgactttaaaattgtcattttcggtgaaaatctgctaaaaatggtaaaatttcaaatttttcctgggcgggcgggccgtcccggcctcccaaaactcctattttttcataatttgactttaaaaaaaactccctaaatataagtatttaaaaacctaatttcgtcaatggattcatctagtgaattccagaaatcattcggcttcctcttgaattcattgttcaaaaattcgtgcactttcgtaaagccaaccttcacaatcggttcaacaaaatcttccctgaactcttttaaatcaattaaaattcttctatgaaaaaaattgctataggattggatcgattcttcgtcacttttctcgatctaatggcggctgactgttttggccggtgataagaaaagtcgttttgatcgtttcgttcacggtgttgacaccggatagaatccacgactaccgtaacgccaaactgtaaaattcgtaggaggggggcggtaacttcattccggcgcccccaccaaagagtaaaagac

SEQ ID NO: 20708 - DNA, 2233 bp, Heterodera glycines
tctctgctgaccaaaaaggatttttaaaaaatgaataacgcaatatttttttcgaattccaagataatatagaaaatctttgagttgatttttcgattttgcagcgagaggcgccaatatttcagctaatgaaaattatttgctaattaaataaataaaaaaataaaatgtaattacctaatgaattttaaaaattttttcatttaaaaatgccaaattatttctaaaatttttactctactattctctaaagagatataaacacatattgtgaagaataacaagcaagattattacgtattaataataagacagcccaaaattcattaactgaatacaataattaatttaaaatcttcaatccacaaaaaagtcaaatttattagtataaaaatttttgaaaaattccatgatagcgacaaaaaaatagtaaaaatttgttgaaaatctcaattctcaataattgaccagattaatttgaaaattgatgtcggggggtcggagactccgatcgggtagtgatttaaattttattttgtggtaaatcttcgttttctccaatttaataattaggaatatgatttttagtgattgaacaattttttgctcaattgttttgaagaaaggtgctgaaaaactcatttttgcgttgaatttttggatcggggaatgacatgtctggggtcgggggccggtgggttcgagactgatccctattttggatcataaaatttaaaaatttaacattttttaattgaaacgttctaaaaatcattcttcttcttctgttcttcgaaatttattctccaaattaccaaaagattattaatttcctatcattttttttctcaaaactttttcttccattctgaaattctctgatgatgaattttcaaaatttttgcaatttccgtgtcactcatttttgattttcttttttcatttcccaatattttttcattttattcattttttctttctcagttgtccttttcttgataatgccaaattgtttcttccatcttctaactgtgatatggctaactccaattttcttaaaaatttcggcaaagttttggcttaattttactccattcttttgtggagtattttcttcctttttgctttattttctcttttattttataaaattttccaattatttctctttttttgagttcatttcgtttttcttcttctttttcttgccatttttctccaaatatttcgccaaatgacttttgttgcaactttttctcttctgatccaatttttccaaataaaaagataatttaaaaaaacagcgagaataatttcatttttttcgtctaaaactggttttttaattttttaataaatttgcaatattttttggagcatataaatgaacaaaaatgaagattaaaaaactgacagaaaaacgaaaacctacttatttaatggaaaaaagattatcctacttaattgcaaagaaataaaataaaaaatttccttaataattttatccaattgacaaaaatataattgccattggtaaaataatgattaaataaattttcaattaattaaaattaaaatatatgttttttcaatcgaaaaatcgtaaagctattttaaagaaaaagtatcactactatctaattcatagatttataaaaaacattcttatcaatcagagctgttgagttagctatgccttatgtttttattagggttcgagccccgtgggcgggggtggcttttcgcgggggcgggggcgggggtggggggtttgtttttaattggctcaaaaaatatcacaaaaaaattattattttttgaatgatgtgtttggctcaacattctttaatcgatgtatcgcctcgattgaattcttttttggtataattgcacagatattgtctaaaaatgaccaaatttaaggattataaattatgccagaatagtcaatttttatgggtgtttttgtctaaatccaggttttctatttcaaaattttcaacataagaataaaggccaaaaaataagattttagggtcaaaaataagaacattttgcaaaatcgcttcaaatatttttacattttattcgatcaaaaaggtattctattattatatttttcataaatttcaatgcattcgggatcactaaatcagatttttaacatttttgcggcacatttccaaaaaacttggtgcatgtgcgaggggagaggtccggtggtgccgattgg

SEQ ID NO: 20709 - DNA, 2782 bp, Heterodera glycines
  misc_feature (29)..(29): n is a, c, g, or t
  misc_feature (71)..(71): n is a, c, g, or t
  misc_feature (112)..(112): n is a, c, g, or t
  misc_feature (2777)..(2777): n is a, c, g, or t
gcctaggaccctacttttggagggtcatnggtgtgtgggttgcacagtataatttatacaaattcttggcncgccattggtaccacagagaaccaatggattaaggtgcatntaaaaaatggtgataaaataaaaattgatattcccgctgggtcataccaaaatgagcaagaattggaaaatgctataaatgagtcgataaaaaatggtataaaacaaccggctacaagagttaaaagacaattggaagatggagtggatttgttttttcattataatccagatgattactgggaaaaaattgaggaagaaaggcaaagatataaagaattgttaaaattgatagtgacaaagtcaagagaacgtgatgatgagacggacacgcataggaagagaaaaatagaggatgaagaaattactcctctccaaaatcaatcgttgactaagaaatcaagaatagaggcgctagaagaagcagcaaggcaaagagatgacgggaaggaggaaaaggaggagagaactggtcaagaatttctcaaaatgtatccagtaaactatagagagaagctaaatgaagttcgattagaattaataagagatttattcaacattcaagaccatatgaaaaaatatcaaggtgtaacagatggtagaagaattcaagaactaaatgaagcagcactaaggatgagaacagcaatgaaacaccgaagaaaaaatttgaatgcttttaataaagcagtgttgaaaaaggatttacgaacaacagctgaagaatatgagaggacgagctatgaacaaaataaggattacgttgaaccgttttttgatagttatccaacagattactgggaacatattcataaaaaatatggaggccttcaagacgattacaaaaaaattcgcaaattaagagagcaacaacaatttttaactgatgaacagaaaaaacagtcaattcaggatgaaattgatcaacttcgtcgacttattgattataggagaaaaagatttgctgcattggaatacgaagctaaaaagagggactcactgcaacaacaaccaatggctttagccttgactcatggtgaagtactaaaggaacgattaggaaaaatagagcgaaccaccacatcacatggggaagagacaaaaactcatggaaaatctttagttgagttgatagaacaggtacagaaagaaagaggtgagaataaggtcgaaaccgagggtaagacacgaggagaaattttaggagataaattaaaagccaaaattgatgaacaagacagtggtgcagatggtgcaaccgatggtgaagcactaaaaaataaaccagaaacaacaattattggtgaaaaaggaatgacaagaggagaaattttaggcgaaaagttaaaatctaaagatgaagaaaagaaagaagaaagaataacccatggcgaagcattgaaaaatagaattgaacaaattcccgaagaagaaaaaacagaaggaaaaacaagaggtgaaatgttaaaagaaaaaattggggctagtaaaccaatagaagaagaaaaaacagaaggaaaaacaagaggcgaaatattaaaagaaaaaattggggctagtaaaccaatagaagaagaaattgaaggagtgaaaacacgtggcgaatcattaaaggatttaattgtttcaaaacaaattgaaacaattttatttaaatatttgaaggagcggcggaaattttcaattgattttaatgaccaaagaattgacttcattgaattgtcagctcaattagggtacattctcgggttcgaagaccctacaaaaattctgattggagctatagcaaagtattattgtgacttaaagggtggtatagacagcctttgtgtgtatattaatggaataactgagaatgtaatagtaggggaccaactcgcttcacttttgcgaattgttgtcgttgaaggaaaatttggagacgtgattgagaagatttataacacaccaatgtacattaaggtggcagtaaaggaaattaatgagattgaaattgaaattaggactagggagggaaggcttattccattccaatggggtacaacattacttgtattagcatttaaaaaatctattgtattttagtatttaaatattcattttcacattatagtatatattaataattgaataaatatggtgcatcaaatatttgatccaaactcagttagttttgatgattttgttgtagtagagcagattggctcgggagaagcctttaattattttcgcgggatacccccataccaacgagggtatgggcgtcagcgaggtggaggagtaggagatgtgttgaggtttttatggagagcacttttaccaaaattaaaatctgctggtacattattgggtagagaggcattagacactggaacacgtgtattggatagtatagagaaatctgaagcaccaaataaaccatcaataatcaccgaagtgaagaagggagtggataatattctcgaaaaaggtggggttgggcgtcaattcggaacgggaagacgaagaaagagtattaaaaggaacacgataattggaaaaactgtacctaagacagtgataaacaagagaaaaagatcggacgtatttggaaaactattttaaaatggtctttaagaaaatagacaaagagtcggtaaactctataacttcagctttatcaatattcagccttccaccaactaatggtgtcagtgagtagttcttcagtgcgggaatatttaccngctca

SEQ ID NO: 20710 - DNA, 1063 bp, Heterodera glycines
  misc_feature (847)..(847): n is a, c, g, or t
  misc_feature (952)..(952): n is a, c, g, or t
  misc_feature (979)..(980): n is a, c, g, or t
  misc_feature (1027)..(1027): n is a, c, g, or t
ttctttgatcactttgtttctcaatatatttgacaattggttcttctgaggcttttggtttgaatgaaaaggatccttttatttctgttatgaattcagtccgctgaatattgtttgtgctttgctttcgctgttttgcccgtttttgttgactgtttgatgtttctggaccaatttgatcacttttatggctgatcaaatttgtgtcagttgttccttcggacatcggatgggcttgatcaacataattttgatccgtagaatttaatttttgaccgttcgctgaattgacatgctcattgctcacttccattgacatttgcattggcatttggacatttcttggatcaacacttccaatatttggatttacttccatggcttgatcatctaattgactggtgtgcgtgtttgataaagttaactttgacaaatttgtagaaaatttttcaatttctaaaaaacaatgagaataatataaaatttgaatatttttgaatattagctttacctttcgcatttgaacttgaagaaacattggcattttgtatgttctttctagtcacttctttgattttgatttttggaagttttgcaattatgttttctacgcagtcttcttcacatatttcttcacgaatgtccactcaaaatttatttttaaagaagaaatgttacaataaaattaattcaaaataaaaaaaaagtaaaaaataacacttaaaattcgtttaaaaatttaaaatccaatatccaagtctaattgccttttgctccctttttgacacatttgacaattaatgcatttttaatttctattacaaacgggccagaatttttgttttanataaaaattggagcttgtcggtacaagcgaactcaaaattattttgaaatttgctaaaaatgatcaaaatccgccatttatgtgaggtgtaaaatctgctaattncaattttttgtgattttttggaactannatgtaattaaggtttcttcatctattttctttatagtttttacattnaattttaaatctgcctagaaccttgattttgctggt

SEQ ID NO: 20711 - DNA, 1839 bp, Heterodera glycines
gtccactgtcggattgtccactgtcggattgtccactgtcggattgtccgggagccatttggagggccttggttcgagtcccatcagcaggcgacgaattttttaattaaaataatcatagtttaaataatactttgaatttgctcatttcgacgccgtcgcatatctgttttggctgcttcatcggcatgtttgccggctaaacagcagttttcaattaaaattcttgatgttaaaaatagaaatattaaattcctatttttcattttaattttcctgctaaatataaataaattttaaaaatgatgataattattcgaatgaaatacaaaaaatttatgattttacatgatgtgaaatataaatgtaattaaatttgatgtaatattctataatattttacgcaaaaattattgtaattttattttattcataaattcataacaattgatttatcgacgcaataaaatattattttagcgtcgcgtcttcattttcatatattttagcataaattattatttaaaattataatacgaaagaaaatatttgttgcatttaagaaaattaatgctttggctaaaaattttcatttctgtcaaatattttgaattagcgtactttcgtttaaattttttaattaattttaagaaattataaataattcttataatttagttaagcttaggactttctgccctcggcctcgaaaaaaaattttgtttatgactaaaagtcgaaaatttattcattcattggtatttttcaattatttctcttttttcttctatattttcttcttctttttcttcccattttcctccaaatatttcgccaaatgacttttgttccaatttatcattagctgtttcatttggataaattagagcaattaaaatgaaaattaaacagactaatataaataatttcattttcttgaatattcttgaaattttgtttaattttctttaataaaacccaaatgattaaattttattattaatgagcatttatttattcgtgaaatcaattctcagaaaaacaaattggattttctaataaaataaactttaaaacattaaagtattctaatggtcttcaaaaaataaatcatccaattattttttattttttgggtattttttttcatttatgtttttttaaattgatgaaggaaaaatttattgcaaagataaatgaatacaaagataaaaataagaaaattatttttcataatttttattttattttttttattaatgttgaatattttgtttaatttatgttttgtagtttgttttaataataaaatattttcattatgattattattttttcatgtgtaaaaaattgtgcataaattatcaaaattttattaaaaattcatttgagaatattttgaagaaaatgaaattgggcctaaaattgtctttaattttatttttcatcgtcgcaataaatattaattatgttttaacagaaaagaaaaagttgaagcaaaattcatttgacgaaatatttggagaaaaatgggaagaaaaggaagaagaaaggcgaaatgaactcaaaaaaagagaaataattggaaaattttataaaataaaagaaaaaataaagcaaaaaggaagaaaatattcaacaaaagaatggaataaaattgaagaaaaaatagcgaagaaattggggacaaatcgaaccacaatttttaaatggatcaaagaattggggcttaatcaacaaaaaaagaaaagctataaatcaaaaactgatgaacaaaaactcgaaattgtgcaaaaattaattgtaatgaagaatgaatttaaacaaaacagaaaatat

SEQ ID NO: 20712 - DNA, 2317 bp, Heterodera glycines
aaaattccatgggaaatttacaaagccattatataaataataattataattatatatatatataattttaccaatattttagctctgttaattgtttcttcagaaagtaaaacattgacaaacaaattaaacaattttttctgttcatcttctgaaatattttctgccaattcgtcaaaattaattcgattggcacaatttttcatttcttcagattcattttcaaaataccacaagtgttggttgcaatttgaaaaaatgaataaaccaattttctccaacatttgggcaatgttttgcatcgaaatttgaactaaaaacataattttatttggtcccagattttcatctaggaacttaaaaaaatgatttatggaaaaatgaattaatacagtttagtttttcatgctttgtttcttctcgatccatcaatttaatttgtcttttaaaatcagaaaaaatattggagaagggatcaactctgttaaataatcattattaatttttaaatttcaaagtcaaaaaaaaattactttctgccgaagtgattgagtaaaattttagaaatttctaaactaattgtgttaaatttctcctccaaatttttataaaattcaaaatagagcaatgggtattgttcgccgtaaagtttcaatttcatttcgttatttttatcataaagtttttcataaatttgctttgcataatcaattgaaagcagcatcaattcgtgtaaaattagcaaattctgttctgttgtcaattcctttattgcccttgttgcgaaaacatttgggaacaaatcgaagaatttcaaaaattttgtaaatttctaaataaaaattactataaaattttaacatcaagttggctcatgaaaatgttggcattatatttttcgcataatcatttctatttcccagatcgaaattcaaattattattattatctaattttattgaatgccaaaatttgagattcaataaaattgcttaccatccgaagttgctccaaactgttggacggattgtccaatgtttgcatactttttacaataaataacttcattaactgatcagaatccactactcttggggtcatttttttatccatatcactttctaaatgctttgaggaggatggcttttgctgatcgggcaccgactgttgatcattttgggtggcattttgaagaaaaatgcttcgcaaatccacaatttttaattctttaagacaatttctggttgaatggtcatcagaaattaattcgcatttagaaaaaaatttgtccattttgatcagaaacactgatgcttggctaagcgataattttactaaaattttgtattatttgtaaattatcttattattatttttattatattataagaattaaaatgagagtccaattttctgattgggatttgtcatctaagtccaataaatacttaaaaaagcacataccttcaccaatttctgatcactaaaaaaaatttatgaaaagaaaattcaaaaacagtaggttcttttttaatgaagtggaattagaaattttttctataaaaattttgcaaattaaaaaacaattttttttttgaaaaagaatacaagcaaaaaattaataataacgattttttaaattaatcatctaaaaaattaaattagtttttttttaaacaggtgacaaaggcaattttacttaacacctagcaatttaacgaaacagtcaatgaaatatgcctaatttgcacttttacaaaataactatgttggcatttttaagaaaatgaagaataaattatttttttatttttcgagacttcaaatctaagcgttacatttttcgtttttttgtatttttttaaagagattaggtaatttctcaaaaaattcaatagctcaaaaccagattattttttactggatattttaaaattttgagacttattatatgcgtttttctcaagtaaaatatttcttaaaaaattgattactttagatttttcaaaattaaatattttgattcatacttattccatcttctgagtctgaatatgcaatatgaggtggttcttcagatgaagcttccgctgtgagaataagctttcgttttttatttccaccattggccttttgtgccatcagaataactgataaagacaaagcagtccagaagatttgattataaagcattcttttaacaatgtcaaaaaataaattaataaatttaaaaaaaaaatttttgaacaaattttggctttcaattatcccatttatttctaggaatagtttcttagcactttttaaggacctttac

SEQ ID NO: 20713 - DNA, 909 bp, Heterodera glycines
  misc_feature (888)..(888): n is a, c, g, or t
cattaatgagatacataattttcaaaataaaaattctcgtcaagaaaataaacaaataatttttgagacgaatttttgagaaatttttcatttctcaggggtatatttttgaaaattttcagttcgattcttaggggtctatttttcctttttattgcatttatgttaacaaatttagggcaaaacgccaaaataggtgaaaataagtttttaaaattttttttaggtttttaggtgctaaaaataaaaacctagaaaattggtgctaataactcaaaagtagcttaacaaccccccctaaaaaaacatgtttttcgtgcgtttcaggccaaggggagctcaggaaaaaaatatgtaaaaacctaaaaatcgaagccctcctagtcatcaggtatatgagattaattgaagaggtttaattatatgtttttaaattaattgtgccaatatgggtcaatgaaaatgttcgttatttgtcaccattacattttaaagcagggctcccagatcaaaattttcaaaagcctcatttggcaggcaaaaaaccctcattttgggtcaaaaagcctcattttttacaaatttattcaaaacacgtttaaaatgtttgatttgttaacagatttgtccacaaaaatggccaaattttgtgattttgagcaaatttttaagaaaataaaggacttttaaggctggcggtgccgataggcgccgccaggggaaaaattgagtattttgaccatatttttagcagattttcattaaaaaattattaattttgtgattttttggaaaaaaattggtttttttctggtttttataaattcagcaaaattttttgggaaaattggtgagattttcatttgatgctctattaaaaacccaaanttatttaataattgaaaacat

SEQ ID NO: 20714 - DNA, 1259 bp, Heterodera glycines
caaatttcaaacaatttccttaaataaatttcccacgctctttgtaaaagatgattcttttgttctctttctcatcccccccccctccctttttcctgcccttaccgtaatgcgatgtttgtggcattggtactgtaacggttgtccgtcggtgactgccgttgcgatagttttgcaccaagcttttgcgcagtgtttctctgcttgacagcggattatcttaaaggaagtaactaattgtcaagtggtcattaatttgaaaggaatcccaatgaaaattttttccatttttcatttgattttatcaattttgaaaaataaaaattcttgaaattaattaattatccagcctattttagggtaagttgaaaattgtcgaccctttggtccaaatattaaaatgttgctcatttgtccgtttcccttctcacccgctgctccgtccccaatgcccttcctttgtcgggtggccgtctttttcagattggcaatcttcggcaactgatgctttgccgcgtcgctgatgccctccagcgcattggcaacgattgccccaggcgttgcactaattgcgttcactgccgcccgacggatgtcacttttggcgattagcacctcaattcgggtggaggacggcgcgtggctgtgcgaccgagtgacctaaaaaagggattttaagaaaataattaaaaaaatatttaactctaaaaaagacttaatatttttttcataattgataaaaataagcataatcatccaaaacggtgttcatacgtttttttgaaagtcaaaactttagaccaaaactctagaattgcgctaacaattaatgcttgttctctacattatttatttatttcattttaattatttcaattaattaattgcattttttctccatttggctgtacgtccagccaggaactgccccgatattctctctttgtcgtctagaaaattgatcatcacccaaacaacccccctttttttggtgagaaacaaaagttggtgatcacgagaattttcttgccggccttcttccatacagcccatgccgatttataattctgcatgccgtccttctgctcattttgaccccgaaagtgccacgcgcccatgtcgccacttcagacgccgatttggttggatccaatctcaattgcctacgtattgccctgtcctggcattacgatgatattctatgatccccagactcgggttttgtgatgatgtctcctgtatgtctgtgccgcgcgtac

SEQ ID NO: 20715 - DNA, 1561 bp, Heterodera glycines
caatttaattatgcaaatttatgaccaattaaaatttttaaattaaactggaaaattattttattttttaattaaaaaattttattgacaataaattttgtcaaggaaatcgcataagaggaaaaaccaaataacatttttaaaagtaaataaagagaacttttcttttaaaattaaaaaaaataagtccgatgcgccgaagtctcctttttaaaatttttgtaaaaataactcaagcaaaaaataataatttttaaattaaatttaattgttggattaataaatgtgaaaaattcgaaaaaagggaaagaatttgttaggatttaatccatttttgtttttgaaaaaaaaaatccggttttagtctcaactcgagaaaaatctcgggggttttcggtctcgaccagagcacaagtgtggttgtggagaattttttttattatacatttgtctttttgttggtgaattgggtgtgctttttgtttgtgatggtttgggggtgggcaaagaaatgttggaaaatcaatagaaaggaggaaaaagggaagaaaatggaagggaaatgagcagtgagtgatgagtgatgtgaagagtgagtggttgggaggagagggaagaggatggaggagttggtgatgagttgggtggggcgggggaatttgtccaaatttcaatttcataaaaaatttagaccaaagaaaataatttttgattttaaaatggataataattattgaaaatttcttacaaattcataacaaaataattaataattagggatgtcaattttatgtaaatacatattttttcctggattctccatgctctaaataccgtatatgctctaattatagcccagtctctattaatcccgcagtctccaattatcccccagtctacgaggtgttttgaaaaataatccctctatcataatcccccagtctctaattatccccccttttctgaggaggttgaaaaataatcccccatgggctataattagagcatatacggtagtaggaaaaacactttcttttttgtgtttgcgaacaaaaattgggacttttatttacatatttttacatatttcggggttttatacatattttacatatttcaagattttatacatattttggactttttcggactttttcatacatttttttacatatttttaggattttttatagaaattttcggaaattctcaaaaaaaatctaaaatttcggcaaacttttcgtacattttttattacatattttgagaatttttgaaaatttataaaatttctagtgaaaaataaaaattaaccaaactaatttttaaaatactaaaatgtgattctatgcctatttaggtcatttttatggcattttgtttcaccctttccgaagaattttttttccaaaaaataaccattttaaaaattttatttacatatttgggacatattttgggtttttcttacatatttcgggattttttttttacatatttatgtacatattttgaccactttttgtacatatttttgacatccctattaataatatttatt

SEQ ID NO: 20716 - DNA, 949 bp, Heterodera glycines
aatttccactcttagggtacacaaaaatataaagtgctgcaggtttttcttaaacagattactcgcaaaataaaaccacaaaaaatagacattcgaatgcattaatcccttaaagagtaagagtgctggtcgtttcaactaatactaataaaaaatccattgtaattctggtgctttttgaatttttattgccttcaatttgctttcattacggacaaaagaaacctattgagatttcgaaatttctttggaaatgctgacagagttgaaaaaacaaccaagtttcgcatgaatttcaggatgcgactccacatatgggaataaagttgaaaatggcatcaattaagcaacatgccgaacggcaaaagaaatgaatctttctcagaaaatttccacttagggtacacaaaaatataaagtgctgcaggtttttcttaaacagattactcgtaaaataaaaccacaaaaaatagacattcgaatgcattaatcccttaaagagtaagagtgctggtcgtttcaactaatactaataaaaaatccattgtaattctggcgcttttttggatttttattgccttcaatttgcttacattacggacaaaagaaacctattgagatttcgaaatttctttggaaatgctgacagagttgaaaaaaacaaccaagtttcgcatgaattttaggatgcgactccacatatgggaatcacgttgaaaatggcatcaattaagcaacatgccgaacggcaaaagaaatgaatctttctcagaaaatttccacttagggtacacaaaaatataaagtgctgcaggtttttcttacacagattactcgtaaaataaaaccacaaaaaatagacattcgaatgcattaatccccttaagagtaagagtgctggtcgtttcactaatactaataaaaattccattgtaatctggcgcttttt

SEQ ID NO: 20717 - DNA, 1188 bp, Heterodera glycines
  misc_feature (23)..(23): n is a, c, g, or t
cttagggtacacaaaaatataanagtctgcagtttttcttaaacagattactcgcaaaataaaaccacaaaaaaatagacattcgaatgcattaatcccttaaagagtaagagttctggtcctttcaactaatactaataaaaaatccattgtaattctggcgctttttggatttttattgtcttcaatttgctttcattacggacaaaagaaacctattgatatttcgaaatttctttggaaatgctgacagaattgaaaaaacaaccaagtttcgcatgaatttgaggatgcgactccacatatgggaataacgttgaaaatggcatcaattaagcaacatgccgaacggcaaaaaaaatgactctttctcagaaaatttccacttagggtacacaaaaatataaagtgctgcaggtttttcttaaacagattactcgtaaaataaaaccacaaaaaatagacattcgaatgcattaatcccttaaagagtaagagttctggtcctttcaactaatactaataaaaaatccattgtaattctggcgctttttggatttttattgtcttcaatttgctttcattacggacaaaagaaacctattgatatttcgaaatttctttggaaatgctgacagaattgaaaaaataaccaagtttcgcatgaatttcaggatgcgaccccacatatgagaataacgttgaaaatggcatcaattaagcaacatgccgaacggcaaaagaaatgactctttctcagaaaatttccacttagggtacacaaaaatataaagtgctgcaggtttttcttaaacagattactcgtaaaataaaaccacaaaaaatagacattcgaatgcattaatccctaaagagtaagagtgctggtcgtttcaactaatactaataaaaaatccattgtaattctggcgcttttgtgaatttttattgccttcaatttgctttcattacggacaaaagaaacctatttagatttcgaaatttctttggaaatgctgacagagttgaaaaaacaaccaagtttcgcatgaatttcaggatgcgactccacatatgggaataacgttgaaaatggcatcaattaagaagcatgccgaacggcaaaagaaatgactctttctcagaagaagtccacttagggtacacaaaaatataaagtgctgcagg

SEQ ID NO: 20718 - DNA, 2020 bp, Heterodera glycines
tttgcagctaactttagcactgagtcaagcgaaaatgccaaatccgacgatctgatgccatttcctctccaattattttgtcctattcccctgcctaaaaatctgttgccatttccaatcttggcacaaggtccccagaaagtcgcacgctctcttccatccccccccccctaaatttttggcatttcctttcttgacattgggttccgcccgattctctcctaattttagtcaccatttttttttggcattttcccttcttggcattcgcttgatcctctcctaattatagccgcgaagtttttggcatttgctttctttaattgaaacatatgcccgatcctctcctttttttaatccctacttttttttatggcactactccattttcttcaggcccgtctgatcccgcgaggtgttaacaatggcattggcattggtggcccatctgacgcccagcagcaatatgtgcgcaccaaaatcacgctcagtgatcagacggaggtgcggctcacctactttgcgcagtgccattatgacgcacatttggcggagaatccgagcgcgtacacgcgcgtgttgcagttcatcgtccgtggcgatgtgcgttatgaggagggaggcgccaattatgcaatcgattccccgcctcttcattttttgatatttttttttaaataaaaaaaaatttttttttaaatcagatttttcccgggtttttttttttttgaaaattatgcatcatttactaaatattaaattgttaaaaattttccagggtttgcaatggtcgaattttttaaattttttgatggattttaataattttctgaaaattttgcattatttatgaattgttgaaaactttccaaggttttgtaatgccagaagatttggcaaataattttttgcttttttttggaaaattttgacaggttttttttatttaaaaattttattttcagtgaaatatttggctattgatcagaagcagtcggctcaaattttgatcattccgcttttcctttctctgatcaggtccaaggcgttgagctgctgaacggctccgacctgttcaaggtggacagtgacggggtgatgattgtccggtccggcgtcaacatcgaccgggagagcactgatcggatcattgtgaaagcgcgactcatggtgatcgctgttcatcatttctttattatttttgaattatttgcttatttaaaataataattttaaaaaatttttcgatttcatttaatttgtctttattttttaaatttaatggaaaaataattttcttgaatttctccatatgtagaataattaaaaaatatatttaaaaacatttataataaaaaatttttaaaaattaaaaaatctacgccttttttgtatgttacaccatgtcagaaaattcattaaaaaatcccttttacatttttttaaagtcaaaattttttgtttaattttaagatgtatgaatattaacttccaaaaatagctttctacctatatatttaaaaaaatttaaatttaaattttactattttttaattaataattcacttaaaaaattgagtttttttctctctcagattatttattattttttaaaaacatttactattatttcccgcctaatttaataaaaaagaatttacaaaattaaaaaaaaataatttcgttaaaataataattaaaaattattaaaattaatattaaaatgttaagagccgttccccgcttcatccccgctcgttggagctgtgccaaattgccaccgcggacattcacattgatgacgtcaatgaccacagcccgcggttcacgcgccgctcctaccgcttccgcatcgacgtgcgcccattcaacaacacggaggtgggcccactgcgtgccattgacggagacaaagtgagtgggggagaaaagtgccaacatccggaaaaatgccaattttaattgttaacttttgtaccaacaaaactatggcttttttgttccgatttgtccaaaaaat

SEQ ID NO: 20719 - DNA, 1615 bp, Heterodera glycines
agaatgaccattttttggttttgaaacggcttttgtctaaagttaacaaccccgaaaacacaaaacaatgttttaagagaaatttaaaaaaaaatttaattctcgaaaaatcagcggttgaaaccaatttttttttcttttatttaatgacgcaatcaaaaactgtttattagggcaaaacattttgcttctttaagaagcaaaggcacaaatggcaaaagaccaaaaatgatcagctctgatcagaatagcataattacagtgatcattatttttcgttcatttgtccttcctccgtttcctttgctcctctcactcctccgtttgctggtgttcttcttccccgcccttcttgtgcttgattttctcggctttctctataaatgtcgagaatacctttcccacatcgagaattaccccccccccccccccccctcttttgttttacccaaaacgtagcgttctttgtcctccgccgctttctctccccatttggccttctcggattcgggcaattggcgccattcatcgcctgaattggttgggtgtgttaaatggtaaattagttttgtgtcattttatgccggcatggcactggcaaaacccatcgattttcgagcatccctcgccagttctatgccagttaaaatcccatggctaaaatggtttttaattgcttgcacgacctgcgatgacggccaaatccggttgggtcatccccggcttgtagaaacggtcacggttttcgttaatcctaaatttttgtttcatcaaataatccgttacaaattaatatttcacaaaacaattggctacagtaccaaagaaagaatgacgattgggcgggcttcggctcgtcggccatttttgaaatttttaaagaagaaatttgttaaaggctctaaacatttataaaaaatcaggcagaagaaaatgaaaatgcataaattgatgaatttttgtttgtgcgcaatttgcccatttatacgccaatttcaactgccaacgatttttggttgcttggaaatgccgcgtaaacaaaaacaaaaaaggaagaaatacataacaaataaacaaatgaatatgatccacggattttgtaactgagaaatgaagaaaagggtttcctaagaaaacacccgccgacccttcgccggtggcgaattgtcgggggaaaggggagaaaggggggggggggcatcaacaaagatcaacacatgagacgatccaaaagtggccacaaaacatgaattgatcaacggttctgtgggggatctccgaaaattgggaaattaactaacggtcagctgccaaaatgtgcgagaggaatattaaaattcataaccaaaaaaaagtgaaattaaactctgctgctgcatgaattaaaaattttgtctaccgtaatccacaaatggcactattgtaacaccagtccctaaagccaacttcactcactttctcctccatttcccctcgggaaaggttttgtagcactcccaaaagtttgaacaaaaatgtttatgaatgatggaagacaatgacatggccatgacttcacagtaaaaagagagggtgatccaaatggatcaaaaggtgatcatttgttcctcctccc

SEQ ID NO: 20720 - DNA, 1070 bp, Heterodera glycines
agcgggcgcagacgcagcagtagcagctgccgcctcaacagcaattgctgactcaacaatgcccataatttgaattggaaattggaagaaaaaatggaaattgaaattgcttaatttaattataaacacttggaccggcgaacaaacgatgaacaaaaaataaataaaataaggagcatttattataaaaaatcagggaagcttttcagaatataaattaaacttgtgaggaaattgtaaatcaaaaaaggaagtgtttttgccattggttttcgaatgtgaaatttcgctcgctttaacacaaaacaaaggaatgaatctgccaaattttatttacatatttatagcaatgagttttttgtaaacaaaatcgattacgaatcatcggcaggcaaaatgtttattattttatacataatgtccgaatggcacgagggcccgtgggtctttgctgccgcgttgaacttcgccaaagtccgtcggcagctcgaccactaagggcaaacggactttgtaaagcttgttgggctcgtcaatcccaagtaaaatccgagcagaaccagcaaggtcgtacgtctcctactttcctatggtatcctctaaaaggacccacaccgacaaaggaccaacggacaaaggacccacaaaaaataacagatcagaaaaatgcttagtgaccaaaaataaattcaaactaagctatgagaaaaagcacttaactccatggcacttgaaaattcggccaggcatttcttgacttaattgattatttaaatcaacttggatcggtcgtccgaattggcgccctgggtttagtgagtgcgtgccggcttcttacgttttttgcagaaaaaatcctggttttgagttcgtgtccgggtttttgagttttgcctatagaaacgcacaaattcaaatttaatttttccttaaaaattgaagtgaactacataactcacaaatgtagggcaactgaaaataaataattaccgaatttaagggagcgtaacttttctgctaaggaccatagacttacacttccaaaaggcaatttagtagagaatttcatg

SEQ ID NO: 20721 - DNA, 2926 bp, Heterodera glycines
tcccgtcggcctgagttttgcgagtgttgtgagtgtatttgttgcgtttcgccttttcccctgggtcattcattcattgttcactcattcgataggtcccatccctcgcagtggccatcgcgtctttgctgactccgatttcatttacgtatttggcggatacaacccatttcactctcctgacagcacttagtctgtgcttttctattttaaaaacgatcttttagctaaagatcattttcataattttagcactgatttttggcgcttcaaccgtctcacccatttatggcaaaaatgcggcctttcctcctctgacccaacgactcagttgccgaattcgttggcttcttttgcatgtaatttcatttgtgcaattatcaatcattgaacaattttttaataaaagttcaaacgaagggacaaagtccgcatacatttttgaagaaaaattaatacgtttatttcccccttttagtggcttcatcttctaggcccagcgagtgttttatttttgggggtaccggcattcccttcggtctcgccgcttcaaatgaattgcatcgaattcgaattgatttgcttggaaatgtcaatgttcgggtatgaaaatggggtggtatattcccgatgccccccccccccttttttttgacagaaaaaatttttaagacgaaaaacatatttctaaatttagaattttttattttttttcggatcagtgattttatataggccaaataaatgatatatttgtgaaaagcgactcccaaaaccctcagaagcatgctttcacgacaaataaaacaaattgtctttcaaaaaaaaggggggggaacagcaaaatttgatatggaacagaacgaccattcgcaagactctgcttcagactgagccgaaacaaagctatgaacaaagacaaaacacagcgaacattcggcagagggggcgcagtggcggggaggcggcggacgacgcggcggaacagcggctgatgcccccgcggatgtgagcaaaggcatttttagggatgggaaattggcaattctttgtttttacgcttgtgcggttattaatgatgctttttacccatttaattgtttttttcagatacggacacgcaatgtgcaggagagaagaacaaagtgatggcaaaacgaaagtgagctctcatctgctttaaacattttatccaaaatgtctaagggctcgtaatttcttcagacaacttattatccatttccttatcgatagaaaaaatggactcggtcaatttaccatatttgggccatcttttcggtacttaagcagttttaataaccaagaaaattggcaacattttattttcattctgaaatttttttggggcaagtcgaggatgccaacaaaactctgtgacttcattattaaatttgtcctctgataatgggtttttcaataaagggagtcgacagattacaactcacaacctccttctaatttttattaggaggttttgtacatcgccggaggcaccaccggccacgtttataacatggacatttggcgcctcgagcggccacttgggcaaccgcgaatcccatggatttgcaccccaatgcacagagatgggcttgaaattggtcgttatcggctggagatggctgcacatggccaaaagctgtacactttcggtggcggagcacccgaattttgtgctgaatttgaagaagtactttttggtatttttctcctatcaatcttttctcacagattctcgctttcgacctcagcaccaatcgtttcggaaaggttcgagctcttcccgacccgaagtacggagttcccatcggccggaaatgccatgcgttggtgcaaaaggggaatttggcgtatttaattgggggatgtcgcgacgcagaaacacaacaaaatgtgaggggaaaaggtgatgaacgaggcgaaagggaagggtattcagcaaaatcgaagccatcagctgatagccgacgtttggaagttcgacatgaacaccgcccaatgggtccgaatgcgcaacaacttggcgaaggcggtgtttttccattcggctgcccttacctccgtcagtattgtcgggatttttatttaaaaattccaaatggccaactttgctgctatttgttaggatgactgtttgtttgtgtttggcggttgcaccgacgaactctccgaacgccgctgcaattccctgcagcaaatgtggctccaaccgccctctctcaagtatttggcctcgatttcgttattgggacttttaaacgaaacgcaaattcggcggataaacaaagagggcatccgactgagcaacgtggaggcaagtgccggtcggattggccaattacgtgcctaattgacatcccttcaggcttttattccgcgccttttcttgccgacttccgctgcttagggctcgcgcaacaaaatgaagttaggcgaaatttcagaaaaataaaacaatccatccgataaaactgcacaatcaaatgtattgtaaaatgtaaggcacaaatcccggcttcttttcttttgtgttacatcaattatctataataaaacgtcacaaatatcatttgtaaaaaatttattttgtaatttggcaaatagcaatttaaatggatgatgagaattttttatgaaaaaaaaactctatacgtagaaaagaaatttgtaaataacttttttgaattgtaaaaataatcacagatttttcaaaagcattaatatatataattccacccccggcacaaacatcaaaggtgaaccctcccccccccctttttccgttgtttttgtttacaattgtccctccctcgtcacttttttccccttcgttttcccttttcacaattttccctttctcttctcttctctctctgaaaatggttcgttaaatgctaatcactca

SEQ ID NO: 20722 - DNA, 3138 bp, Heterodera glycines
  misc_feature (1539)..(1539): n is a, c, g, or t
tgtcgtccccagcttttggaagaacagcttcgccttgagggtcgccgggcagaccaagccgagcgggtcgaacaggctggcgacgctgctcagcaccgttctgcgtgtggtgccgatcggagtgccgggttcgctcccggggtacttcattcgtattttgtccgtctccgcattccattcgagtcccaagactttggccgtcgtcttgccgaggaattccgcgtccgaaaagctgctgttgagtgtctcgtcattgctcaagaattcccgaaggttcatccgcgcgtccgcaaacattcgttttgcttcttgtcctttaatggctgcttcttccgcagtgtccgccgggatgagcacattatccacgtatgtgtcccgaatgagttcttccgcgaagttggagtcgtatttgcgcaggtggtgtcgtacaactgcggcgagacaaaaggggcttggcgtgagcccaaatgcgaggcgtcgaaatcggtatgtcaccaaattgtccgttgtcactggccgaaatgggtcgcgcacccacaaaaatttgcacacatctctgtcgtcctcttcaatcccgaccatgagaaatgctttctcgacatcggcgatcactggtactcggcatgctcggaaccgaatgagcatgccggccaaatccggcagccaaactgggcctctgagtaggcagtcgttgagggaaggtgcccctcgtgtgtgtgcgctcgcatcgtagacgacccgcaactttttgggcgtgatcactgcttggtgagggatgaagtgttcgtgtttaccagctccgatcgtcgtttcctcgattattgctgcattgagctgatcggtgatcactgtggtgtactgcttgagcacctcgggagtcttctgcagccgttgaagcattgtcgttagccgtcgataggccatgctgaaattggtgggcaaagcggggtggcactcccgccatggcaatcgaatggagtagcgcccgtcgttgagttggcgcactgatcgttcgaattgtatcactgcttgcgcatccgcgtcgtctgtcgggtcgtctcttatcccgattgcttccaatgaccaaaattgttcaactgctctgatcggcggcatttgatcgcgttcatcttctccgcatggcaatgtcatgaacacggacggagcgggagttgccccgctactcacttggaaccgttcgccgcacacgattggcccaaacaccgtgtcgacaatgtacgtgccctttccgttttccgaaagccggtcacgaaatcccagaattttcgaatcccgatcaacagctgcggttgtgttgtctgtgtgatagtcctcatgtcgctgtcgggtactgctcccgactcgatgagctctgttctgatcggggtgcagatcagaggcacttccgccacctcaatgctctcccatccgccatcgatccgcttgagtcgcaagcgataagttgcggatcggatccgctgctttttccctccaaaaacttgaactgttagtggccgcttttcggtcggcttcggtcgnagatgttgaattagctcagtctcggcgcagtcaaggtggcttcctggatcaaacaacaatgttgtttggcattcgtcttcgccttcttctgctgctgcggtcactcttcgatcatttgctgggccgggactcggcttccaaaagcggtgaaagcccgttgctccccggcattcatctcggatatgtctcgactgttcggctcgtctcgtgatgtagtgacgtgagtgggttggtccatcccactgatcagcatcgcgtggttgttctccttccgttcgggttcaccggagggccgggattggtttcccggttggttcttccagcacataagccaatgatgatcgtcctttcgacatgcgtcacatcggaccgttcgttggcactgttcgaatgtgtgatcagagcccaggcaacgcaggcatcgcttttgctcaattagtcgcttcctccgtgcctgcggcgtcggataggcgcggcattcactcggccgatgtccgctctccagacaaaacgaacaattccccctcccgaagcttggagggagcccattttgcgcgaagcggggtccattcccacccttgtgtccgttctcgttgccgcgtgccactgttcgctcggtgaaacgggcattcgtcccgtactgctcttcttttcgtgttccgttgggctgcgcacgggtttgttggctgtcccgtaccataaatgctctttgaaatggctcccgacctgctttccccccccctccttccccactcctccgcttggccaattccgtaggagaaagggactttcacagactgtacatctccttccaactttgaattattacgaaaaaatattttgcgctccatccttttggtttcgaaatggcaattccctttcgccctgccacggcattcattcaatggatggtctcccccctcccgtgccgtgccatctctccccttctttcccttccttcgttcccccggtgccttcctttctcccccccccttttcctccctttgcccttccgccgttcgtttcgttcgttcttcgctcatcaatttcattttttgcgcaatgcccggcatcgcccttttctaattgcgaatgccccaattcctctgcttgcattaattaagtgatttatctcaatatttgcccgcccttttccctctgagttcgttcgttttacttatgccatcccctccctcctcctcctcctctctctccccctctttttctccgttcgttgttttatcctccgattcgaattctttttctttgataagatcttttttccattcttccaccgaatttcaattctgtttaatcagttttgacttcattttacaggaaaaacaaacatctgtttcatcccaaattatttggcccgaatacttcgaactttctgaagcctaaattaaaaattaaattttaataagcgccgcctaattaattgcttaatttcgtctctctctttgcttagcccacccgtccgatgaccgtggtcagtagtcattgatcacaatctccgttcattcttccgatgcgattgcacttaaagaaactcccaaaaagaccccacctcccaaacaataactcatttagcatact

SEQ ID NO: 20723 - DNA, 2613 bp, Heterodera glycines
  misc_feature (2521)..(2521): n is a, c, g, or t
  misc_feature (2526)..(2526): n is a, c, g, or t
ggctctataaagaaaggcgtacggtaaaggctctccttgaaaatagaccacagaaggtagtgattgagaatcatgtacccggtccgaatgttgcaccatatctaggcctcaacgcccaatccaaaccacaggagaccgaagaaccacggaaaataattattcctaggaaaagacttaaagagcgaactcctgatcctgaatcagataatgatacccttgaggagttaactccggaaccccaaacaacatccacactcaaaacacccattccgatcaaaactattatacatcctactcttttaaacggtcttttaggtatgtaaaagaaaacaaagatttatttaaaattacggcggctggaaaggtacagtcgaacatgaatttgccgattgaaaacagtaattatagagatgttttattgtatctcgcggggaagaaagatgaaacgccgcgcggtgcaaaatttctcaaagatcggttactgaaggatccaacagtaaaagacatggttgataaatcaaaggtcatgtggggacgtggaaggaaaaaggcaataaaatctataaaaacacccgggatagcacgagagaagaaacccttcaaaccactaatatgggcaagactgtagagaaaattttatcaaaaatttattttaatttaaaatctccggcaagtttcgctgggattcaaaaaattttaattgaggccaaaaagattgacccggaaatcacgaccggagacgttaataattttctcgaaaaacagagaacttacacgattcacaagcccatcaggaaatattcccgagactaaagacgataccgagtggcttccataccgattggcagtgcgatttgtgcatatttgaccagttgaaaaagcataacgacggttacaaatatctgttggtatgcatcgacgtgctgagtcgaatgatcttcagtgcaccggccaagtcaaagaagagtgaggacatgatcgaggcttttgatcgggtgttcgaaaagtctaaaattatcccgatgaaaatatatagtgacagtgggcttgaattccaagcaggaaaaatgaaaaaatattttgaggaaaaattcatcatcaaaaatgtaatgtatagtcctgatctgcacgccggagtcgttgaaagggcaaatcggacaataaaggagcgtttgtacagatattttacaaagaaagacactcttcgatgggtcgacgtaatagacaaaataataacaaacattaacaacagtgtgaatagaacattgggagccaaaccgtcttcaattaattttgaaaatgcccgtgcgctctgggaaaaattatataaggctagggaatttaaaattttaaaaaagaaaaaatttaaaatcggtgatatcgttcgtattaccaaggaaaagggaaaattttcaaagggatacctcccaaactttaccgaagaattatttaaaatcgttattgtcgacgacacccgattcatacaggatcgaagatttggaaggaaatttaataaaaggtatattttataaccaggaattagtgaaaacagatggatgatttttacattgtactaccttcgaacacaccggggcaggagaacactacgtcaaaattcacagtacgcctccccgagactttggaattgggcacaaattggtcagtagctctctcatcaattatttacccctactcattcaccgctctcggtataaatggtcaagagtttataaaagtatgggaaaatgacaacaatgtccccattcaagtttatttaccggacatgaattttaaaaccgccgggggattgggaaataaaattaacgaagcattcacacatcattacaaaatcaaaaaacaacgtgggaagagagaagccaaggctgaagataccaaagactcaaaaattgatgtcgcaaagagggccgcagaacgcgccgggagagacgtagaaagacattttaatcagatcaacaatatctcgaattccatccaaacccaactaaacacactacgagaaacaaatcctcacattttagaagagcctgatataaaaatttggtttgacaaaatggttgagatgggaaccgaaattcaaacatcccgaaatgaacttaagtcttttcaagaagaagtagataaagctaaaaacataacattggagcatgtggaaaagaatgacttgaaaaaagcaaagaaatcagccgacgtcgcaaagggaatcgccagacaggcaaagaccaaatatacatcaactctcgagggatataatgataaatcggaaaagggttttagcgggatagtgaataggcttaatgaggctttgggtgagcatattaaacgtaaagatattgaaaatagacaagtatctgaagctgagaaaggaccacaaaaaagagagagactagccaatgaggatgttcaatttcaatatgacagcattgatcaaaaatttattgtctatctttcccctgctgtctcccacatagatttgtcaaaacacctccgctatgtgcttgcntttangaacacaaggctatttcacgcggaagaagcgaatatatgccagatttgacgggaggcgtaaggcagctatacatttatgcaccaaat

SEQ ID NO: 20724 - DNA, 1494 bp, Heterodera glycines
  misc_feature (77)..(77): n is a, c, g, or t
  misc_feature (1442)..(1442): n is a, c, g, or t
  misc_feature (1451)..(1451): n is a, c, g, or t
atccccccccccccccaatgggcctggctgaaataacatctctccacaggacacagggaaacaatgacatttctagncgtaacttttgattacaaaaacgctaaaattggtaggtgtctgaaaatgagagagacgcgagtaaaagaggcaaaatttactcaagaaaatgcgggaaattccgcagcaaaaaatgtggagatttttcaacaaaaaatggtttggtcgcgcaaccagcagctgatcacttttgcgcttcactttcttccgttgaatgttcttcgccatttgtttctgtaatttgcgcctcctccgtttgtcccttctcatcacttggcacatcattttctcttatttccaaattcgccaacttttccgttggcattgcgtcggttgtgccgtcgttcgctgtctcagcagctctctcttgtgccactcgttcacacattggcttatacacttcccaatattccaaccgacacttttcaattaactccaaaacctaaaaattaacattttccttctagagtaaaaattttagggaaaagcatcatccagtgggaaaatgaaaaccctgaaaatttagtaacaaaattaaattcaccttatcaaagccctgacccgtctttgccgatacggacacccaatttaaattttcgtagaacgaatcgagcacaagggacaaagagcgggtcaagtcgttcatgaaactggacgaactttggtcaagcgcagtctgaaaacaaaggcaaaaagagcataattttccaaaaattgttggtcacttgaaactgctcaaaatctctcatccattcgacggcaaaagcagggtccaccacgtcggacttgttcaaaacgacgaaaaatggcaatttggtccggtaaagaatggagcaggcgtagagcatgttggacatgaaagtcgtcgggttggtcgaacgggcactcgaattataacaattttgtatattaaaaaagtaatgaatgggcggcacaacgcctccaattacctatccatcacataagcgacaacctgcaaaaagccttttgcatttgtgttgaaaaactcaaaaaaacgaacggtcggaaaagaggcggccaatgaatcggtgatgacagtgccgctggcggaccacgtgaacacctcaatttggcccggggtgtcgaaaatggcgtatggcatggacccctttcgtctgtccaacaagtccaacacctgaaaagacggggtaaaccatcggaaaatggacgagaggcaacacttggttgaagcgagtgcaaaacaaattcagactggtcagaatggcaccgtttgggccgaggcctaaaagtacggggacaaaaagggtttttaaaaagcaattggaggtgcaaatgcttgggttaccgtattcctgcatgacctttttgtaatttacagtgtctctgatgtcaatgtttgctgngaatggaancgttgctgtacaaaaaacgaattgaaaaacgcgcgacattttc

SEQ ID NO: 20725 - DNA, 1061 bp, Heterodera glycines
  misc_feature (29)..(29): n is a, c, g, or t
cgagatgaccaagtaggggaacaccttcntgggagtgagatgactcgccaacctctaaacgggaggtctcgagaatccaattaatttgggttaaatcccacttggacaaatgagctttttccagaaccggccattccaagcacaattaaacacggaggcaacgcagaagaagcaccgtcacagcttttgtcatcagccatttctgtgttttacttgcattaaaaatgacattttccattttcaaaaataaataagtccataaaaactatgacagaagatgaaaacaaaaaagaaaatcattaagtcatttatcacaatttaagacgacaagacaatgagcaatgggaatttgggaagggactcggccaaagtgcataatataattatgtttaatgagtgattagtgtggtaatgtgtagtggtgttgttctacaagtgatgtatttggccgggcaaaagtcgtgccgtctccgggtcaggcggagcagccgacgaatccgatcgctggtcgttttctttggtttgcatttgtagtttctgcactgagccgggtgcaatgccgcggggccttttctcctccgtcgatgaactgctcgccgagttcgactgacatgggagggaatgtcggaaggcaatgccatcattttgttgttgctgttgtggcggcaagcgtatgccgaacagttcagcgatcagactgagtttgaaggcacgcgaacttttcttcccacggcttagccgctgtttggcggccatcaatcgaatgtggtcatcgaagatgagttttgcatcaaaggacggtttggctgatggttgggaacgcattttaacgtcctaaaaatgaagggaagggaactgagaaaaagaaacaaagaaaatggcaaatacaatgaaaactaattaaaccctattaaaattacatttatcaaaaaacaaatggtggaactttcactgaatcactcacttccacgacaacgcgaagtgttcggctatcgaatgaagacacttgaacgtcctagaaggcctttaaaatttgtaaggattataaaattcgtagtgga

SEQ ID NO: 20726 - DNA, 1304 bp, Heterodera glycines
tgggccccagcgcccttggcctttgacttcatgatgggccccagcgcccttggccattgacttcatgatgggccccagcgcccttggccattgacttcatgatgggccccagcgcccttggccattgacttcacaatgggccccagcgcccttggcctttgacttcatgatgggccccagcgcccttggccattgacttcatgatgggccgcttgcgcccttgaccattgacttcacgaggggccccagcgcccatggcctttgacttcacaatgggccccagcgcccttggcctttgacttcatgatgggccccagcgcccttggccattgacttcataatgggccccagcgcccttggcctttgacttcatgatgggccccagcgcccttggcctttgacttccagatggcctcagccaggctcgtagtgtagaacacaaagatttcgcccggtgggactcgaacccacgatctcctcaaagcatgaagtgctctgtccaactgagctacgggcgccacttagtggttctccagtattgcgcctgtggtcgtctcagtttgcgtcatcgttctgtttgcgcttgtgttcaatctcagtctgcgccctcgctcagactcagtttgcgcctgcaattgatttgcgttcccatttgcgttcctcaatgtgcgttccaatttcgcctcaatttgcgcgctgtctttttgttcctgctcagacagtttgctcttccctttcgcttcggtttgagcttcctcaatttgcgcttcctctgacaattttccattccgcctcggtctgcgcttcctcaatttgcgcttcctctgacaattttccattccgcctcggtctgcgcttcctcaatttgcgcttcctctgacaatttccgcttcccttccgcctcattcgcacttcctcaatttgcgcttctcatttgcgcttctccaatttgcgcttctcaatttgcgctgcttcaatttgtgcatctccaattgcgcttcaacaatttgcgctgctccaatgcgcttcaacaatttgcgcagattaggctcactgccctctttgtgagctcggcacaatgccgccaatgagagcgagataggctcgctgcctaagcgcatgaccattctttcctgaggggctgtggtgcggaaggcgaggcgccacgggccaaaaagagacccgaggggccgtatggcgcggaatggaaggcgccccgggtcacaaaaagaccaagggaccatatggtgcggaatggagcgcccccggttacaaaaaaccgggagggcaaacgggcggaatgc

SEQ ID NO: 20727 - DNA, 1640 bp, Heterodera glycines
ctgttgcggctcggcccacaagccgcaacgggacggttcgtcgtccattggttcggggtggggtgggagaggaaggagagggggaggggctaccgaatacccattgctgggttttttctctttattcggtgcacgatcggagccatgaaatgaacaattcatggggcttaaatacgatcacatttgggttgggcctacatacaaaacaattaattagagaaatgggctgatcaaatgggctgtctttttctcttccttctcttctttcttcgctgtgacttccttcatttgcggtagaacattcacatgcattggttgatgttgtctccattcacgtgcactttttgtccccatcggaccatgtttgggcggggagggccggtttctgtgttcattcatgtgcgccgcttggtcgattgagctgttattctctctccaaattgccacttttttgcccatttttcatcgtttcatcgcccactgattattttcccccttttttgccctttcgctcgtcgctctctttccaatcattaactgtccgttccacggacagtcgcggctgaattccagtcgcgacaaaacagttttttcgtcgcatcaaaaacaatttatttgtgtcataaattaatcgactcaaatatcccgaatttaatccggcgggatcccgactttaatcccgcggggaaaaattgttttttactgtttttcaataaatttattatttttactttggtattaaatttggagaaaaaatattaattaatcatataaattatttttttaacatgttaaagtttgaatttttgttttttacgataattttataaaaaatatatctccaaaagacagtttttggattttcttttttattatggcaataaattttcatttttttctttttccgttattttacaaaaaattcaaatgtttcttccatttttcaattactgaacggctaaccccacaaaaattacaaaaaagctacaaaccaacagcaaatgaagaaaaaattgaacttatacaaaaattcattaaaatgtcaaaaaaatataagcaaaaaagaaaatattcatgaaaagaatggaaacaaaattatgtcgaaatttgtaagaaaattggagttaattatggaatgattaaaaatggaagaaacaattcggaatgacaaaatttataacggaaaaaaaatggaaaaaaatgaaaatttatttgaaaataaaaagagaaaatccaaaaatgagtgaaagaaatatttctaaaattgtgaacactccaaaacagaacattcataatttgaagaaacaatttggaaacaaaattttggagcattgaaaaacttgagattattcttaaattttatttttggaaattttttggattttttgtggttttcggcgtttgaatagctgtgtataaattgtttcttccattttctaatgttccatgatttttgcaatgtttttttccgaaatttcaacataattttggtgttgagaaactattttcgtttctgtttaatttaaattgtatataatttcaatttgtttttcattagctttaattattagcccttttggtgttgtttaataagacacaaattttaatgtgatgccagaaagaatggagtgtgggagaaa

SEQ ID NO: 20728 - DNA, 1328 bp, Heterodera glycines
tggcgaagtggtttttgtaagatagtaaagggacaagggtggtggttcgagtccgttgtgcaacatgaatatttttatttatttttgtccaaaatattaaaaaatgacgatatttgggaattatttttgaaggtttttgccaaccaaattggataatcttggtatctttcgaaagctcttgatgtgtagaaactttttctaagcaaatgctaagcaatttgaatgagtagaaaaaagatatgagcgttcgaaattttgtttttgaataattcataaaccaacagataaaatcaaaaaataacagatgaatcgatgcagaatttttttttcaatcggtatgcaaaatttgaagcagatttaacaagtagaaaaaattttaaacagcatgaagtaaattcagtttttctctattaacacagataaagaaatagtacgccaaaagagagatgtttttttctctgcactctctctttattgacacatgtctcgttttttgactcggtgtgtgctatggcatacgcaggaaaaacgagtttttaacttggtttgaagcttctagcttgaactttttggtgcttttttgcaattttggtgccattttcatgcccttttcagtatttttgaaaaaatggaaaatattttgaaaattttgcaaattttcttatgatatttcttacatttccaaaaaattttcccagcggcgcctatcggcaccgccggacccacagtataccttggtttttgaaattttaacaacaaaacagccaccaaaaattgtcattttttggtccaaaactactaaaaattccttcttttcgctccggtgttgaaatttttaatataacatatgaggaaaatttgcccgaagagcaaaaaaaaggtcctttggaaaattttttgctaatttgatttgacaaaaaattattgcccaaaatgttgatttttgctgcctttttccaatttttcgtgtctttttgacgttttgttcattttttatgccttttttcacatttttgtgcctatttgagaaattttcgtgcctaaaagtccgggctctattaatgatacgtaaactgcattagagccaaaaaaatcgaccaaattttcgagaaaattgcgtattttcggtacttgtacagtttagaccacataaatttttttaatgataaaaacgtgtttcgagaggttttcggggtcgctcagcatgaatccggcatccatttcgaccaatttggaaccccggacccgaacgcgaacaaaaaatcgtaaattcactttcaaaaacgcagagtaacggtacaaaagccaggggcttttgatttgaagag

SEQ ID NO: 20729 - DNA, 953 bp, Heterodera glycines
gtacacacagtttcgccagaaggagatcatgtcagtttcaattaacaaataattagtattaaaaataggagagtgagaggaaaccaataaatccattttattgtgtatttcaaccaaaaacttaattgtccctttaattcggacatccccattagcccaattagctcttccccggcttcttcaggttccatgtgtccacccttttgccgtttaccattggcgacgcgcaacaattgcagcgcaaacggcacattggcaacgacatcgtggccattgttttccaagagcagaacacacccttctgtccggacatgatcgcgagcaagtacaaaaaagggcaacattcagtgcctaatttaattattttctttttttccaaagctttctccacgcctatttggtggttcatcccattgagccgggcactgaccgcacgcgttaccgcgtgtcgatgacagcgcgagacgacgtgccgttctttggcccgacgcttccgcgctcttccataatttggaagtgccaactgcgcgactttttgctcaccaaactgatcaatgcggaaaacgcggcttataaggcggaaaaatttgccaaattggcggtattatggcaattttcattttctgaattaatcaagtttgttcaggaacgcactcgggcatcgctgctggatggactgtactcaaatttgaaagagcgggcccaattttacggcatggcatttttggattcggtggacagcgcgacgaaacagcagcaacaggagaagcaccaccaccaatggcaaaacaacgggcaaaaccatcaccagcacagccaacagcagcaactgatgaacggaggaacgaacccaacgttttgttttccattgacactgcgctcgttctgatgctcctcttattcaatgatcaaaagagcaaaacacatttttgactgattatataatatatctg

SEQ ID NO: 20730 - DNA, 1281 bp, Heterodera glycines
tccaataaaaagcaaggagaatgccgccccgttttggcctttttcacaattggggaaggaaaggcagcgcggcattcggagtttttttggtggcccagtgagtttgattagctgacgtgggtgatcagagaggcatatctgatcacagagccactggaccgaatgatctgatcagaaaggcaagcctaataacagtgactgatcaacaatcaaaaaattcagaccacggtctgatcataacattgatcagtcgtgttctaatcaaactcactgaccatccgtttcaagggtctgatcagagtaattgatcatccatgggtctggtcagggtcactctgatcaatgatcacccatgggtacgctaatataaaaaaatgaatgcaatacattgaacagcagagagacagagataaacaaaggacactaaaacaacaacaacaaaaataaaacacagacattttttttggggggggatcaaacgaattcgcctcctattagcacgttggcaaaacatgcacaatcatcaacatttattattattattttaattagagttgttcggcactagggaattttcttaccgagaatccttcgaaaaaataattcgagagtcgagagaatttgtctggcagaccctgactgattcacacgggtttggttccggcatatagaatggcatgaaaagcggaaacaaaataaatttggcattttttggtaaaagttaaagccgattcccgtcgcgttcagtcccggccgagcaactctaattaggtactaattgttcaccgggtacccgaaattatttattcaacaaattctgctgctggtgtgtgcttttcccattttgtatctgcactttcatcaaagcggcaggcaggcacgcaaatcaatcacaacagttcatgtcgatgtcgacgaggacgatgatgacggcttccggccggacggcggctgaccatcattagcggcaattagcaacaaattgagcgatgaagcggcggtgacgtcgcaagccatcgttgtgttcgtcgtggaagaagctgctgctgctgatgctccttgtcgagtgcttgtgatggttgaggagcagcagtccgctccggtgaccagcaccaccgtggagtcgggcggcggcattgcgtggcacttcaaaaggaatgggaacaaattagctaattggaagattgattcttttttttggtttttggatcgaaattcggcaaataagacaggttttggacttaaaaaaactgtgttgggctttgtttttcccgctctcga

SEQ ID NO: 20731 - DNA, 1773 bp, Heterodera glycines
aaaaagcatcaaatggaacatttttgacagaaaattattcataactttgcccaaaatgaaccaatttcttttttctttatataattcgatagacctaattgtttctgttatcatgcaaaattaaaaaataattagttaagtttaaaaaaagttatgacttgaaaaactcaaaaaaccaagtttttttttaaatcataactttcttgaaacttaacgaaattttttgaaaatttccatgataatagaaaacccatagggctctcggatgctatcaagaattaaaaagttggttgctttggagcaaagttatatcaaaaaatattcccatttgatagttttttgaggggggaggggaatgaggcggggttctgaaatggcacccagcaagagcaagcagtgcggactgactacggacaccgacccgttggagtccaacagggacagtgttgttgttgtgccgagaccaccgccgccaatggcaccgttgctgctgctgttgctgcgcgacccgttgccattgccgttgccattgttgccgccgaggaacatcatgttgccgaacagtcccgccgccgtcgcatggtgcagcaacggggatcgactgttctcgttgaagcagtgcaacaatggcacacctgttggggcaaatgctggaccatttttttgcatatttttgttgaatttgaccctttagagtgtgtctcggatttggatgaccgtttttctgaaaaaacccgaacccgagggtcagggaccttttttcacgccacttttttgagacgagttttttaaataagttttggtgaataggagggagtccggcggtgccataggcttcacgggcaaattttgtaggttttccctcggtttttaataaattttcattaaaaatggtaattttgtggatttttggaaaaatttcgcgaattttttttttgggtaaattttagtgagttaagtcttgaaaagggtacaacaagggaactttcagaaaaataattatttttctcttaaaaatttcagggtgcgtagggatcggaaaatttcaaattttctggcttttttttgagacaccgttcgagctggtcgaggtggccaacatggactgcatcaacgagctgtagtcgtccgcgctggccgacccacagctcagccgactgccaacgccgccggggatgggcgtgccgcgcggggtggtcaacggggaggagaagaaggggatgggcgaggtcagtgtggactggtagccgttgcgcagaaaggcggacgcctgcatggaatggcaaacaaataaaaaaaaatgcccatggaactgctggtacctaagtggtgatcagaaaacgaaattgatcaaaataatgatcagcaatggggtaagagacaaattgggaaacaaagtgatcagacagtcaatttgagtgatcatttaaagtcataagttgagccaaactgatcagttcaaactaaatttggccgaaaaagtgatcagccgatcaattggaaggaccagttaaagtcaagatcatttgggacaacaagcgtgatcagatgatctatcgaagcgctcagttaaagccaaaggcagaatcaagaaacgcaccgtgaagatatcgcccacaaagttggggatgattggccgtggagtgatcaaacgctggagaaaaatttaatttttattttaatacaaagtctatccccgtccccgttttcattatcatcaacactaattgctggggtaatcatttaacaaatgaatactgattaatatccata

SEQ ID NO: 20732 - DNA, 2413 bp, Heterodera glycines
atattttttctgcgcatatgctatgagaaaggggcctaaaaatacgccctaaagatagactttttggaattttaaaaaattatacccccaaaatacgaaaaatttgagttttcgtcggtaattttggcatttttaataaatattttcgccatttttttgcgaacttttcttttttttaatgagaattttttcgaaattttggcaaacttggatttagtttttatacaatggacgacaataaaaatttgcgtttttaaattttaaatccattttttggttgcttattgtactttttaattttatttaagcaaatatgaatatacacaccttttggaattttggagggtttaaaacaaatattttggcagtttttagccaatattttggtccatatttgaccatttttagctttttagtccatatttcgggcatttttagtccatattttatgtccatatttgacgttttttagtccatataatttcgagccctaattataactcaagccctaggccgctaatccctaccaaaatgctaaaattaatattttttattgatataaatgtataaattggttttatacccttacaaccaaaattactagcatttactaatttcatgttttttaatgtgttagaaacatgaaaatagtacgccaaaacgagagaaaaagaaatgcaaaattttcatcacagacaacttaataaccgagcgtaaaaattaaaacctcaaaactttctcaattttgagaaagatctgttaaaaaagcgccattaaaaattacaaaatttaaaataaaagactaccgattttttttattaattcaaaattccaaaaaattacaaaaaacgcccagcctaaatttgacagggcctgggacgcccgtttaaactggcttttttgaccgggcggttcggcctgatattttcaatttcggtctctaataaacacttcctaagatatgaaagtcattaaattaccaacatcacaagaatctccttccattggcataacgaaggaaattacaaggagaacataaaattcaacaattaataaaggcagcatttttgctgaatatttaaatttaaggaaaattttttttttgagtgagagacaaaaacttattaaaaaaagactaatatttgcaaaatgcgtattaatttatgtaagcaatgcgcgttttccattttaaggacatcgtatgtgcatttatcaattatataattgattataactgctttttgatgttggattttgtctttaccatgggcataaacaatattaaaaaaattcattaaatcgtctcctctgaatccatttacctatctataataataattctccaaagctctaattattttttatatgacgcttaaaaatggaatatttttttattcgtgattactgatctgtagggctaggaattatatggatataaaatcgcaaaatatggccataaaatatggaccaaaaatcgcgaaatatggacataaatttttccaaattgagggtacaatttctcaaaatttcttcaaattcgctaaacgcaaagtaaaactttcaaaaatgttaaatatgggattaaaaatcatttaaaaaaaacacgatacagcttaaaatttattcattttagcgaaaaatcaacctgaaaagcgaaattttcgcttttttgtttatttttaatataaattaaccaatttttaagaaaatttaaatttaatcaatattttcggcaaaattttgctgaaaaagtctttttcggaaattttttcggtctttagggacaaaaatgccaatttacctgatgggggccgttctaataggggttttttgggaaaatgccaaaataaaaacatgtttttcgtgcgtttcaggcttcccacagtccaggaaaaaaatatggatttccatataattcccagccctactgatcagcgtcacaaatgtcctagaaatgactttatttaaaatttcaagggggtctcaaaactgaaaagtaccaaaggctgttcagttataataaactgcgaaaattttaaaaagaagtccaaaatattatcatagaatataaatttatttcttttgaatatttttttaattaaatttaaaattttcagtgatttgactgtcaaataaaaaaaagcaaatgtaggacttttaaatttctgttaatcttctaaaatgaaagaataatttgtatttttgcaaaatcaattgcgtttaaatactcatcgtttcagtattagccaaaaaatcccactccaaccattgtttaagggtatcgttcaatggacattttttactctttttgattgacaataatcttcgaagacaattatgaaaatagtcaggtaatcttaactctgggtggtaggtatgaaaacacattatattcaaaagtgactatcataaa

SEQ ID NO: 20733 - DNA, 2559 bp, Heterodera glycines
  misc_feature (49)..(49): n is a, c, g, or t
  misc_feature (2527)..(2527): n is a, c, g, or t
gatgatttcgcaaatcagctcagatggtaaacgttcctttatgggtttntggggaagatgaaatgaatggtttgactgcttgcattggcaacgaagggcccaatatcggaagacccgttgtcttacaataagccccaagggaataaaatcaaaggaaaatttgaaaatgcctccactacagggtattggtgtcgaaaattatcgattactgggcggaacgtgttgaatttaagaaattcaaaaatacattccttgagggatagcgtcgaaaattattgattagtgggaggagcttatcgacatttggacggctttaaaacacacacccgggcatcataatttcatttgctctattttttaaataattattattatttgctgtgctgttaaccagggcgggagcccgacttacagaaccccgtttatcctggcagcaatttctaatttgacttttagtacttgaggtagtgcattagacaattctaatttccaaagctgtttaggtgccctgtcgtcttgtgcttcatgggtggcagtgcgctgctcttcaggtcaatggttggttttgaaattaacacatttaattgaattgatacacaaattttgcacatccatgccaatttgaataccatatataaatatgttgctttttctccatgtttcattttatttattcaaaaaacacaaaaaaataatatttaattaaaatagattaaaaatgtccaagcgcttcactgatttttctattgactcaattctcggcaaaaagcctcgacagggcttcctcatcaatcaaattttgggcatagcccacgtgcttggatccgttcaacacggtcagggttcgtcgaataaacctgtcaacgagtacgtgaagaagcttgaaggaagcttggaacacaacgaaaagtttcactacaccaaaatgaagagccgattcagcatcgaggatgtacctgcaaacccggaagccttactatcagcaatcttccaatactgtatcgaagaatcgattgcagacagtcgcaagcgaggaatcgagcccactcacctcggttgtctcatcagcagcccactgctctctggtggtgacattccgattcccatccggcaaatcaacgaaaacactgtcaacaccatcctgaaccgcttcacccaagtggcccagagtaaaaaacagcagaacatcaccttgtggggcgagccgtttactgtggttgtgactacagtaaaccgtttgggactccccaccaaaagacaagtgaagggaggagcccgtcgtcaattggctcgggtgcgtcatcaaatacatgaacaatgtttaatcaaggttttcccgcgattaaaaacatttggcccactatcaatgtgctagtttaagatcctgaacccggatagacacaacttttgtttgttttacgccctgcaggcaacaatggttgcgaagacaaaacaatggcctcgatggaaatttcaccgatatttgaataaccagcacgggcaacagggacaacttcagcatgatgcggtgcaactcatgaaccaaattggtgcgcctttgaatttgaacgcgtacgacgctgacacatacgtgccgcgagttatcaaccattggaataacaaccatcaacataaccgatttgctgtcttcatatttgggacaactgggcactacaaacccatctacaaatacgtgaacaacagctacaacactcctcttctcctatatttcaacgacaatcactttgatggggtgcagaagcagagtggcctgttcggaaagccttactgtttggagtgcgaacagccatatggaagagcatcaaaacacagcaaatcatgtaaagcacgttgcattctttgcgctcgctgtggtccggcattcccttgtgaagcgactggtggcttcttcagaaattgcaccttatgcaataagaattttaacaacaatgattgcttccaacaccatctccaatccggtttttgcaaacggtcaaagaagtgcagggattgtggtgttgtttgggacgttacagacaacaacaggaacggaagaaaaggtcatgtgtgtggtgaacgctactgcaagctgtgtaaaaacttccacaaccctgaacgtggctgcttcatcaaaccgctcgagcctagagaattggacccatatcgaattgttgcttttgacttggagacaatgcaacatcagcctataagtcgtcgtgagccagagaagagacagcatcagcctaacttcatctcagccaaagtgatttgtcccggatgtattgacaacggtagatggcggaatggaaccgcaggatgcaaagtgtgtggccctcaccgcacagtcgccttttgccaacgtcgatttgtaaacacagctgtcgacaaacaagttgtcactgacaacccgttagagacgtttgtcggttggatcatcaatgatcttccgaagaaatacgattcctacgcattctcacactttggaggccgtttcgacatggtccttgtttttctgaaatgtgttcanagatgggtttcaaccctgaaatgattcgtcag

SEQ ID NO: 20734 - DNA, 1328 bp, Heterodera glycines
  misc_feature (1243)..(1243): n is a, c, g, or t
aatgactgcacggcacaatgaaatggacttattcattattaggactcgagcgagctctattttgtttcataatttaactgtgaataatggcactgaaattcgactagggaaaaataataaacttttggcacagaaaagagccaaagatgaaattttaaaaggttatacaaaattcgaccggcaattctttggcgttattcactgcccctcccaaattgagcagcggcgattgtttggaggtgacgccaaatgaagcggcggatgagctgatgaaagggataagcggaagaatgcctgaaagtgtgcggagattcggcgtttcacattattggtgagatgacccgaaatgaacggcacaaaaaaaacgatgttaatggaaaagtgtacgaaggtggcgaccaacatgcaatagctgcggtgctgagttgccaaaactccgacgatgcccgcgcaaattgccgaaatgccatagaaaagttcctgacttcccttgacgatatcagcacgccaataaagccgaacggcgctcaaacagaaaatggcagacccgaatacaatctgtgggacaattattgcgtactcagatgcacctaaccattcagcttaaacgcaccgtcagccaacttcccaagcttatcgtactccacggggtcatctcctgccgctgaaagccttgctcgttttgctcaccttcattcaatccgactccaaagtcagtttgggaagaattgaaaaaggcattggaattgggggcaaaatatgccggaggcaacgaagtggcagttgaatttttacgtccgagtgaacgagaaccactgagtgcggacggagaacgaaatggcatctgagaattgtggggggggaggggggggggaagaaagttcaacagtttcggcgcagaattgccgaaaggttattgccgtcctcgcgcctaattccgtaattttgctgctgttggttcgtgttcggattggcgaatggggccaaaaactgctcatcggcgaccatttccggcacggcgtgctccggacgaggcagcgtggtgtaagactgacaccgggagggcgtcagtttgtcttagacaaaacaactaaccgttacaatgtgcaaaaaataaactcacatgttcccatgtcgctgactggccgtgatccgaatatcagtcccgggttttgatgcttatttttcccgtttaggcaattcagcgcagaatctagccgattgtgctggtggattaggcggngaggcgcgtaaactaagcgaattcaatagaatgagcagcaggcgagcaaggatattaaaaggaccctactcgaatgcatgtaatc

SEQ ID NO: 20735 - DNA, 952 bp, Heterodera glycines
gataatgaatgccatcatagcaaaggaaagatgaaagggcaaagcaaaaggaagtcactgaaacggcggaagtgataccagaagagagaggaggagggagcacagtgtggtcagcagaaagaagcgcgaggggggggggggggaccccataaattaacggagtaacagcaaaatgacctaatttgatttgatccaaatgaatcggagggcggagaagtgagtgatcggaggtcgctaaacaaaacggagcatcgccaattggttaaagtagcaaaaggtatttatgtcggaaattttggaaagtgaaaatatttaaataataaagaaatttcttttttttttattcaactgaccattgaattcgaaatacatagttttaatcttaagcgataaaaatttctctccgttggacaaaatttaattttgatgctatgtgattcggcgttaaggacaagcggcgcctttcaaaattactttttgccattattctctcataatacagtaaatgtccaattcacctttcaaagctgcaaaactacaatatgagttttgtaacaatattatcaatgaggttgaatctatattatctttttttcaaaatgtaattctttaaattttcttataaaaaaattttctaagatttttttggtaattcgcacttttataattgaagaggtcatttattgacgcctaaagtgaaatagagccaaaatttagcacttggcatggatttcaagggttttaggatcgctgatcacgaatccggtattcatttcgaccaattccgaaacccggacccgaattcgaacaaaaagtagaaaattcaaaattttcgactttgagtctaaaaatggtttaaacttactttttattgaaaccttacgacttttatctagtttccgcctattaaccaaagtaaacacaaatctgaaattcgaaaatttggaatttt

SEQ ID NO: 20736 - DNA, 2831 bp, Heterodera glycines
  misc_feature (85)..(85): n is a, c, g, or t
  misc_feature (95)..(95): n is a, c, g, or t
  misc_feature (101)..(101): n is a, c, g, or t
  misc_feature (105)..(106): n is a, c, g, or t
  misc_feature (112)..(112): n is a, c, g, or t
  misc_feature (117)..(117): n is a, c, g, or t
  misc_feature (152)..(152): n is a, c, g, or t
  misc_feature (163)..(163): n is a, c, g, or t
  misc_feature (180)..(180): n is a, c, g, or t
  misc_feature (182)..(182): n is a, c, g, or t
  misc_feature (184)..(185): n is a, c, g, or t
  misc_feature (192)..(193): n is a, c, g, or t
  misc_feature (195)..(195): n is a, c, g, or t
  misc_feature (198)..(198): n is a, c, g, or t
  misc_feature (208)..(208): n is a, c, g, or t
  misc_feature (213)..(213): n is a, c, g, or t
  misc_feature (217)..(217): n is a, c, g, or t
  misc_feature (222)..(222): n is a, c, g, or t
  misc_feature (230)..(233): n is a, c, g, or t
  misc_feature (235)..(235): n is a, c, g, or t
  misc_feature (237)..(237): n is a, c, g, or t
  misc_feature (242)..(242): n is a, c, g, or t
  misc_feature (249)..(249): n is a, c, g, or t
  misc_feature (251)..(253): n is a, c, g, or t
  misc_feature (258)..(259): n is a, c, g, or t
  misc_feature (264)..(265): n is a, c, g, or t
  misc_feature (268)..(268): n is a, c, g, or t
  misc_feature (271)..(271): n is a, c, g, or t
  misc_feature (275)..(277): n is a, c, g, or t
  misc_feature (281)..(281): n is a, c, g, or t
  misc_feature (283)..(283): n is a, c, g, or t
  misc_feature (286)..(286): n is a, c, g, or t
  misc_feature (297)..(297): n is a, c, g, or t
  misc_feature (304)..(304): n is a, c, g, or t
  misc_feature (310)..(310): n is a, c, g, or t
  misc_feature (313)..(316): n is a, c, g, or t
  misc_feature (319)..(319): n is a, c, g, or t
  misc_feature (321)..(321): n is a, c, g, or t
  misc_feature (324)..(326): n is a, c, g, or t
  misc_feature (329)..(329): n is a, c, g, or t
  misc_feature (332)..(332): n is a, c, g, or t
  misc_feature (334)..(337): n is a, c, g, or t
  misc_feature (340)..(340): n is a, c, g, or t
  misc_feature (343)..(343): n is a, c, g, or t
  misc_feature (346)..(346): n is a, c, g, or t
  misc_feature (349)..(350): n is a, c, g, or t
  misc_feature (353)..(355): n is a, c, g, or t
  misc_feature (357)..(358): n is a, c, g, or t
  misc_feature (360)..(360): n is a, c, g, or t
  misc_feature (363)..(363): n is a, c, g, or t
  misc_feature (365)..(365): n is a, c, g, or t
  misc_feature (368)..(368): n is a, c, g, or t
  misc_feature (375)..(375): n is a, c, g, or t
  misc_feature (377)..(377): n is a, c, g, or t
  misc_feature (379)..(379): n is a, c, g, or t
  misc_feature (383)..(383): n is a, c, g, or t
  misc_feature (388)..(388): n is a, c, g, or t
  misc_feature (390)..(391): n is a, c, g, or t
  misc_feature (394)..(395): n is a, c, g, or t
  misc_feature (397)..(397): n is a, c, g, or t
  misc_feature (401)..(402): n is a, c, g, or t
  misc_feature (405)..(405): n is a, c, g, or t
  misc_feature (407)..(407): n is a, c, g, or t
  misc_feature (409)..(411): n is a, c, g, or t
  misc_feature (413)..(414): n is a, c, g, or t
  misc_feature (416)..(417): n is a, c, g, or t
  misc_feature (419)..(420): n is a, c, g, or t
  misc_feature (422)..(423): n is a, c, g, or t
  misc_feature (425)..(426): n is a, c, g, or t
  misc_feature (428)..(428): n is a, c, g, or t
  misc_feature (431)..(431): n is a, c, g, or t
  misc_feature (434)..(434): n is a, c, g, or t
  misc_feature (444)..(444): n is a, c, g, or t
  misc_feature (455)..(455): n is a, c, g, or t
  misc_feature (457)..(457): n is a, c, g, or t
  misc_feature (462)..(463): n is a, c, g, or t
  misc_feature (466)..(466): n is a, c, g, or t
  misc_feature (469)..(469): n is a, c, g, or t
  misc_feature (472)..(472): n is a, c, g, or t
  misc_feature (476)..(476): n is a, c, g, or t
  misc_feature (481)..(481): n is a, c, g, or t
  misc_feature (483)..(483): n is a, c, g, or t
  misc_feature (486)..(486): n is a, c, g, or t
  misc_feature (492)..(492): n is a, c, g, or t
  misc_feature (496)..(496): n is a, c, g, or t
  misc_feature (498)..(500): n is a, c, g, or t
  misc_feature (516)..(517): n is a, c, g, or t
  misc_feature (523)..(523): n is a, c, g, or t
  misc_feature (526)..(526): n is a, c, g, or t
  misc_feature (532)..(532): n is a, c, g, or t
  misc_feature (535)..(535): n is a, c, g, or t
  misc_feature (546)..(546): n is a, c, g, or t
  misc_feature (549)..(549): n is a, c, g, or t
  misc_feature (552)..(552): n is a, c, g, or t
ggggggggggtgaaacgacctgcctctcacatggatctcatcccttttttaatctttagactgcgtctttatgattgtgaagttnggggtaattnattgtnaganngaaaanagagnggtaattgtttgtgagatttgttttgtaatttttnaattatttaanaaaagaataaattttgnantnnttttttnntngtnatttttgaanaattnattngttantgtaaaannnntnantttanagtagtnannntttannataannaanagnattnnntaananaanaaagatttttngaaaagnaaaggnatnnnnagnanttnnnttnttntnnnngtnttnttnagnnttnnnannanatntnttnaggtaantntnagtntgtgntnnttnntnagtnngtntntnnntnntnntnntnntnntnttnttngataagtggngaaaattatgntnaaagnnagnagnagnaaanggagnanggntttttnttgnannngaattgtgtaattggnnaaaatnagnagaagnaanagtgggagtanaanggnaacaacaacgacgactgctgcgaaccatcggcgacaaacattcgcttgcgacaacttcagcagtccgcggcaccgccgcccactgagcacacagtgatcatcaaaacacctttgccaacgccaccaaagcattacggcacactgctgaagggcgaagagcattgcctgggtaggcacggagaaatccggggcagacagaaagtctaacagtagcggctgaaaaagtttcaattgcaataaaaaaaatttatggggggaactactagaatatttgttcaatttttgaatttaatatttagtttatgacttttgagttcattatataatttttgttctttctttaaggtgttacaccttcttctgctgatgccgggccttcacttttgtttgaacaacagagcaacatttgatcatttccaaatgcatttgtacagaaatcgccatcacttatgcggaaaatacatttaaaacaaatttcgttaaacatttcttttctttcgttataaaattcctttgttaattagttagatagaattgaaatacttatgcctaaaatcgcaaaatagacattaataggcacaaaaataggcaaataaaaaatcatagacatcctaaatcaagcggaaaacgcgtttttcgtgcttatctgagcttttttaattctcgggggtgggtgaaacgtagcgcacccaaaaacgaaaccctagttattattaggcccggatcacggacaaaaaattaaaaatacaggcagaagtgtttgaatttggtaaacttgacaatatggacaaaaaatttagttctttaatttttgtgactaaaagcgaaaaatagtaactttcacgaaaacaaaaataaataataaaattaaaatatttaatatcaagagaaagatatataacaaatttttaatattttaaacatggaaaaagagacaattttcgaattttgcaaatgcccaaaaatggaagaaacataatgaaatatggacaaaaatgaatttgttaaaatccacgcaaatcacagagaaaacaatcaaatccgtctgaattttaagtccagaatttccgtcactttcagttgcgttgacagaatttttgtgtcaaaaatggacatttttgggtatttaaacgttctattcattaggccaaattcatttctactcacaacaaccatttgccattctgctgactggtgtttcgtatttgcttgtggcttcttcctttttcgttatgcaatggaatgcgatttttattcaatttacattttactgccccatttgttgtttctttagcaaaacgctcttcgaataaccctaatctctgtccaacaagcaattcgatgtctgacatctacggcttcatcaacaatatctcagatcgtatatcacgacgcgtacgtcgcaagcgcccaacggagtctggggtttctggtgaggaccgagtcactttttcgaaagttcattttctttcggttttcaggtgtcagcggcgcaccgccggagactcggaaggacgacaaggcgaagggcggcggctgctccaaaaagtgcgcttgcatcatcgtgtgcagcattctcacgctcattgtgctcgtcatcggtggactcgtcctggccgctgtcctgacgcctgaaacattcaaaaatgctcctctgttgagcctcatcgcgggcaaaaagaatgggggcgtggatggtgaggagaaagaaaccgaatgataagcgactctgttgtcctattgtgtggctatattgttcaataatctgtatctgatcttattgtacacacattatgtttgggataaagaaagtacatttgtttgccaagttttattctttgtttcataaatgcgactttcttttttgaatccagtttcctaatgagtaaaagcgatctttatggtcgcgaaaacggtaatcgttcacatcattggtcccataaaaaaggcaaaaaaaggtcgttttttcgattctaagaagtactcgggggttatcgagggcgctgatcactaatctgacatcagattctcatataaatcatctaatctatgacttttcgtcaaaaaattttttgatggattttcacttttttatcgctgttactaaaaaaactcacctaatatactgttttgtttataccttttatgtatgtacttgaataagcataaaattaatcgacaacataaaatttgtcgaaaatgttttcatgtgaaagttggatttttgacttgtgtcattcatctcgaacaactattccagctacatacatattgatgga

SEQ ID NO: 20737 - DNA, 1547 bp, Heterodera glycines
acgcattcattaaatccaaattttgccgccgccaaaaacatgtcaatgggcgcttaaagtcacttattcttttctgtccaatattcctagcactaatctttgctgatcgccccgaaccaaacaaagaaagataacatctgtatggccattttgacaatgagtcaataggacggaaagaatttcgtttcacccggattataaaacttgactagaagtcattgatggacatcgagtggtgaagtccttttgttataaattacttggttttccctatttaattttgtgaaattttaattttttatttaaaataaatatgaatttattttgagaaaataaaattatttgtaaatttctttatttatcttaattattttttttaatcatgacattttcgcgttgtcattcattttgttaaggcgaggctgagtttctttttgttaattatctaaattatttttagttttattttccttttatttatggcttttttgttttttaaataatttaatttatttgtgttctttatatttttttctgaaaattaattaaattttgtaaaattttaaagaacaaaattcatttttttttcttttttttaactggtatgtattaaaaattaataaaataaattgggaccagaagatttatttagcaaatattaattcatttcttattccaattatattaataaattagaaatttattttctttcttcccttttttatataatttttattttatatatttaaagttaaaaatcaaataataaaaaatgaataaaagcaaaaacaagaccaattaagtatgaataaaataaatttaaggaaaatgaaatagttttaattttatttttaaattgatttaatgagtttatttcaataagctttttatcgagttggttccaaatttttgttacccgccccgcaaaagtataaattttttgcctaatttatatttcgagttaagtctataaaagggaatgttaaagcgtttagaaggtttaagtatttcaaagggattcagatctgttcggccataaattattttatgagccatgaacagatcagacagctttcgcctgctttcaagtgtcggcaattgaaggtattctaatctttgttggtatggaatgggtggaaggctgcatttgaaaagaactcttttggtgaaatatttttgacattttttcaatttttttaatgttttttagaagagatggattccaaacctcaggagcatattccaataacggtctaacataagttttgtacaaaataatccaaatcctagaagactttgatttaataacccgaaataaagaacgcatacgtaaatatgcattctttattatttgtgtgacatgattggaaaattgcaatttattatcaatatttatgcctaaatccctaattgtatccacaacatttattatatttccatacaattttatatatttctttggggtttttattccccaaatgaagtacaaaagtttttttaatttagattctgatttgccatttatttgcccattctgataaattatg

SEQ ID NO: 20738 - DNA, 1757 bp, Heterodera glycines
gggctcaaccccaagtagaatataaaaaaacaaaacttcattaaatgttgttgcttcggtcattcaaaagttaatcaaatagcaatttaataaaaaaaataataacttaaaatttttttacagcactgacaaaaagtgatattaattttttgtggaataagggatgtgatttcataaaattgacagctgtgattttcatagcattgtcaatggcattaaattaacttaaaggaaaaagcgaaaggaatgatatagaaaacaaaatggtgccattagtaattaaattttgtttaatggcggcaattaagcaatttgaataagaaatgaaaattcaattgctgtcaattttatgaaattacaagtctttattccccaaaaaattaaatagcactttttgtcagtttttgttaactttctttaatatgaagagtggtaaaaaaaagacaacattatattcattagaaaaattttttcatgttgttattctgacttcatcccaacaaagcggctttatatggacaaaaaaccaaaatatgaataaaaaaatttgcaaaatatgcagaactgtggaagaaacgctgaaatagtgacaaaaaatacgaaaatattgacaaaaagattctgaaaattggtttgattttataaaaaattcataaacccacaaaattcatgttaaaaggatcatttttactttgttttattaaaacagatgaacacagatttaattcagtgtttgggggtcgaacttgaggtagaaatagaagaaagactaaaggtttagccagttggccatcatattccacactgcctaaaagaatggatcaattttgttttttctttaaaattttcccctttcagagtatttcttaacaattattttaccttctaccccccgccgcccccgtttatttatatccttctggcaaatacgctttccaaaggtcggaaacaattacatcagcattctgtaagttaaaaatgccgtgtttaagacttggataaacatattttattcaattaatttttcaattaacagaaattctgttcaaaaattttagaactcataaaattacaggtaccggttgagaaagttggtgccttttccagtaatacttgtaatggttaaaaaataaattttttgcaatatttgataataatttaaaattattctgaaaattttcttattccttttttgcttataaaattcataaattcgtaaagttgttaatatttttgaagaaatctcatgtggatgctatagctcactcatattaagcttttctctaagaaataaaacagataatcaattttattgataatctttttttcccaaaacctaataataaatgcattagctactttaaatattaaatttatgttcataattattacttttttattgagagtgaattttaatttaagtctatcattttagttgatttattaaatgtttggagtaattttcctttttactttatttacattatttgccggtggaccaaacagcaaaaactgttcaaatttgcaaacattttgggccagcatttgcgaaaatgccgtgacaatgtttcaaaatgccgttaagaagccaaaaaagggagcaatttgtcattcatttgatcattcaattgtgttaataaatttgttgaatcgttgcgaaattcgggagaaataatataatttaataataaattggttaattcctaaggaataattccttagaaggtcgaattaatacaaagagtctcgacatttgg

SEQ ID NO: 20739 - DNA, 2384 bp, Heterodera glycines
cttcagttccatctaaaagtaaaatttaatcaaaatataatttaacaaataattgggttaaatttaatcaaatttaaatctgataaataattaatttagccccgaaaatgtttactagttattaccgaattggcattccatttgttttgtgttgaaaagtttgcagcgtttttcaatggtgagtgaagaagccattggggagacgatcaattaattacaattaattaattgcaaaaggaaaccccgcttaaatatccacttgctcagcaataataaattgaaaatttttgtttacgcgaaaaggaatgaaatgaacaaaatgataaggcaaaggcggaggaacgaatgaataataaaatgcccagcacagcacacaaaatagaaaagttaaaatgacatcacctcaggttccttttccttgttctttttcactgacatcattcgaattattttaattataattaattgggtatccatttggaataaaattaatgaattttcaaatccctaggaaataattcaatgcccaaaaaattttccaacttaatttgcatttacattaacccgtcattttaaactaaatcataattttttttattccaaagtaaatttagaaatttgcttaaatgaacatcatttaatttttggtctcgtcgatcatcgtatttcgttttctttcaaatggtttttgcgattaggctgcggcagccaccaacttctcaatgtccgcttcgatgtcccttggctctgtgttgggcgagtaacgctgcacaacattgccatttcggtcgaccaaaaactgaaaaccaaaacagttcatcaaagaagttttaagaccaatcggcattatccccaaagaaagaaagatcagaacggccaatgtttgcgtgaaaatgagagaacaaacggtaaaagaaagtcgagagggcctccctccgccctctattagcctagctaatggggtaattaggcaaaaatcaactatcaatgaccaaagagacggttaacatcgttaatattttgcgctacaccactctttttgttgtggtgtgccttccccttgccttggtgaagttccatttgatggcgtcgatgagtgtgccgtgctgctctttcttcagaaagccgtacaacggatgctcgttggatccattgacgtcgattttctcgaaaaggtccggctcaaagttgtactttttgtgcacaaagtctttgatttcgttggcattgcccggttcctgacaaatgagttttattctgtattaatggaatcttttgaaagtatttcgtttttaaataagcataaaatgcaaaatttttcagaattaggaaagaaagaaagcgtcggacggtgccaactcggcccacctgtcctccgaactgattgcacgggaaggcggcaaccgcgaagcctttgcccttatacttgtcgtacagctgcttcagttggctgtagttgaactcggtggtgccgcaattggacgccacattgaccaccagcagaactttgccccggtatttgtcaaaactgatctcgtgaccgtcgatgtcgttggccttaaagtcgtagatgctcttgtgctgaacgtcagtggtagtggacatttcgccaataaatttaagtgaaagtgaggggggattatcaatatatctgcggattaatgaaaaagttcaactaatttaaaatcaaatttaatataaataatttattattcagtgctggcttcccgtggtttaagctcatccttaaagctgtggcaacgtacaagctatttgttctgacaaattagataatgctggaaatccattttgaaaagattcgggaagaattactcctccccaaagcaactgtaaaataaaacatcacttaatattttccacacccttcagaatttgccaataatacatataatcaacgaggtgtagcaaaatgataaaatggttaacgaatttacaaatgatttgttgtatttatttagaaaaagccaataatattttagaactcataataatttattttagcatacctatttataagaaaaattaaataaaaatattaaagaaaagaatgatagaaaactgcaacaacacacacaaaattgttgacgaaaacaaacaaaacgttttgaggaaaacaaaaataacgaaggcaaaggcggggcagaaaatcatttgctaaccaaacaccgacaccaaagaccaaccattttccattgtaataaatgataaaacaaagatataaatttaaatatatgtataataaatagttttatttaatttggtcagcaaatcagtgaaaaggactaaaaatgtgccgagtttggcaatgacattgcctagtgggccatttgacggcccctaagggtaaaacctaattatggagg

SEQ ID NO: 20740 - DNA, 2183 bp, Heterodera glycines
atttgataccgcttggtcggctttggatgttcagctccgcggcagttcggctgcgggagagacttttgagtgcagcgccgagtttctgtgaattggtgcggccattgattgttggtttgctgttgctgtactgcttgatcagctcgtgtgcggctgctgcttgtttgtcgttgcttgctgcttttgtttttgccgcttgttgtgcttctcgtttgccgctttgccttttgttgctttgctgcgcttgctgcacttgcgtggttgtactgctgacacggaggtcaagcagtacaccttggggttcccgtcgtttgacttgtttgtttgtgttgattgtgcaactgttgccacggagagcaaacagttcacaccgatcccccttgtgttggcttggattgggtactgctaccacgaagagcgagcagtacttgaattactgacggcacaaagaccgatcagtaattttactgattacttatggcacaaagaccaataagtaatttgaaagtgaaatactaatggcacgaagaccaaaatagtaagtcactgtttcccctgtgaaactactgctggctcggagaccaagcagtatttcacaattcccacttttgctccccccctttttgatgtattcaagtttggctacggagagctcaaacttgatactttttttggaattttttctcaaaaaattccccaccagttgcagttccactactgcttgaagtcgttcagttgtgctggtgctgtcgagggtttgtcgtccctgcccaggtcgccacttgtccgatcaccacccgttgattgattgattgattgagttgagctccgttgagctgcttggagatggccgtgttttgagttgagctccgttgagctgcttggagttggccgtgtgcgcttgacgttgagtgcggtgcaggtcgccgcggtggtgtcgacaaagcccgaggagttcgggcgttgaaattgacaggagaggaagcagaaagtgggacgggaaatgtaccgggggtcaaacgggggcaagtgcagaggaaaaattcacaccaaattttatctcaaacttgggtaattaaaccgaaaaagtggacaatgggcggacaaatgggggaggaaaatccggccaaaggccacaaaataaaatgtgaatgcaaaatggccctattggctgatcacacaaaaatcacaaatgaaatggtaaaaattgggccaaattgggaggacatgaagttggagcagtacaacaagtaaatgtgtgcgaggggaattgggacaggacaatgagcgcatgaaatttggggaggtgcgcatggaaatgaattggccagagggggccaaaatgggacaaatatggcggtgaacgggggccgaggggttggagctgttcggccaacaaattgttgtcgatttggggaaatgaagtgctgtttgttaagcacacattaaaaagggacggaaaatggggagagaattttttgggtgataaggaacggaatttgcgggggggagtgacagccgctgataaggcggcaattgcacatcggaccatttttaaattgaattgatttttggtttttgtccgatgtgcattttggcacaaatcaaataatttgattttcgaaacccgtgtttcgacaaagataatgcttttgggacaattggacagaatatcacagaaaagtcagagagagagagagacactactgctgtttgggatagacagacagacagacataaaattctaatcaattaataagattttatgactgtgcaactgcactttgctaagtagacatatatgttatctgtgcggagattttcaaaaaaaattttttttgaaaataaatgttttataggttttcggggtcgggaaaaccgattctggcatctgttttgacccaattcgaaccccgaacccggactcgaacaaaaaagtcaaaaatccatttttcaaaaaaattcatattttatgcataaaacagggcgcgtatctgtccttatttataagatttgtccttatttggagggtccaaatcttacaaaataaaaatgtccttatttgtaagatttgtccttatttcgggctattgttcttatcccctaagtatattaaatgagagcaagccccgccccctcaattaaattggcatttggcgttttgacttaatagaaaaaaagaa

SEQ ID NO: 20741 - DNA, 1290 bp, Heterodera glycines
agctttttgtttgttcgtcatctgaaaacaaaaatggaggagatgatgtgtgcatgtggcaaaatatttaggaattactaccgataagccacacgtaaatcaaatatttatcaaatacattgaaatagtgtgaaataaaaatggtgtatattccttatcgccacagtgaagccgctgcaatcattcagccagggctcacatatcccatctgccctaagggcattgagtgcagagttatcattattgatcaatgaactcatcgatatacaatgcgaaccacaaatctcacgaaagagcaggtcctttaatcacgattccaaaggataagtccttattatcatcaagctttaacttgataagttttggttaactccaatatcctatgttacttctcaccagtccactggtcatggcaaagtgcgggaccagcttcgcaccggatgttggccggtaacaataaggaaatcatcattgtaaaccgtggtggcccacaatgttcaaaggaaagttcatcgtgctacaatcccaagaaggggtaggacaagttgaccacaatcccgtgatgggcaggacatgttggccacagtcccatgaagggcaggcaacgtttaccacaaatgtgacagatgcccgaagggccagtcagtgaatcgcaaatggtgcgacgcatgccctgaagggccagtcagcgaaccgcaatggtgcgacatatgccctaaagagccagtcagcgaaccgctttggcgcgacacatgctcagaagggccagtcagcgaaccgcaaatggtgcgacacatgcccgaagggccagtcagcgaaccgcaaatggtgcgacacatgcccgaagggccagtcagcgaaccgcaaatggtgcgacacatgcccgaagggccagtcagcgaacagcaaatggtgcgacacatgcccagaagggccagtcagcgaaccgcaaatggtgcgacatatgcccagaagggccagtcagcgaaccgcgaatggtgcgacacatgcccagaagggccagtcagcgaaccgctttggcgcgacacatgctcagaagggccagtcagcgaaccgcaaatggtgcgacacatgcccgaagggccagtcagcgaaccgcaaatggtgcgacacatgcccgaagggccagtcagcgaaccgcaaatggtgcgacacattcccgaagggccagtcagcgaacagcaaatggtgcgacacatgcccagaagggccagtcagcgaacccgcaatggtgcgacatatgcccagaaagggcagtcagcgaaccgc

SEQ ID NO: 20742 - DNA, 2876 bp, Heterodera glycines
tttatattttcaactatttattaaattttaaaccattagctttctagattaccaaatataaagatttttttaataatttgtttgtaaatattatgcaattccgttttatgctatttaaaatatattttttatttttataactctaaatttttgctgtttaaattgaagcattattatttaagtgatttaaagattatattttatttaataaataagtttggattcaaagtaaatatttattaatattctgtcaaataattattatttattttgtatttaaatttttaataatttttaaatccttctattgtacactcattattctatagagcttaagaactgattaacattttttaatataatcttttatttaaatttaaatttttgttttagtaagaagcctatcaaaatttttataaaaatttttagaagaaaaagaatttctaaaaaagatttaaatttttaaagaaaaatttatataattttattgtacattattcaatctaaatttcgataaaaatacaatatttttcaaaatgtttcatttttaaaggtaagacatgaacacttttctaaatttctttaaatattttttaattttaaatttttctttaaatttaatgtggtgtggtccataaattttcgttattttagtaaaaattggagttgattatagaacaattggtaaatggaagaaacaatttggaatgggtaaatagtttcataaagttttaatgattatgtttctattcaatataaaaattgtttaaaaatgataacaattttttggtattactttacaaattttttatttaaaatattaaattctcataatttaatcactgttctagaaataatttaaattgttaaaaaccattttaaaacaaattttaagacagagaaaaaggttttatttttgctggttgttaaattttttgaaaagttaaaaattattggtttacaaaatatttgcattttcaaaaactttaaaaaataataataaacattaaaaaactttcaaaaatattaaaattataatttatagcgtaaaaggaaattcgaaaaaaaatataaagtgtaaaatgcaaaaagaaaatttatttcttaattattaaatatcaattcaaaaggaaagattgcaaatttgtaaaaattaaaaacctcatatatcaacgagtaattaataaaaaagtaatctaaatgcatcttcatgtcttatccaaattccaaatttttcaactaactttgataatgttaaataccgcatagcctctaattgctaacggacaacgaaacaaagcaatttccgactgagaagaagtaaaaatttattaaataataatattataaatctaataattttaaaacaatctaaaattaaagaaaaaaattgaattttactgattgaaaaatgaaaagttaaaaaattttttcaaaataaaaagcatgatgcccgttgtgccaccatttcacgggcggactcgctggagcgctgaggagctggtgttgtatatctgttaaaaattgataaaatatataaataaatactaaaaaaatccatacatgcaaaagtaaaaaaaatcattacaataattaaaagaaaaaattcaagcatattttattaaacctacggtataagataatttgcccattctcgacaggccggaatcagaagcccagaactgagcatgaaaattaaattaaataatgatagaaataaattataacaattttactgataataataaaagaaaggcttaaagcaaagtaaaaagcctattgtattgtctcgaggtcacaagaaaagcaacaagataacattgattatttttattgaaaaaatattgtaaaccaaaatattattaattttatattaattttttcttttcatccttttaactattttagtgaatgaatgttatttatctcaaatggattttacgaaatttcccggtgaaaaccgggctattttacgaattgcaaaaaaattacgtacgaatatcaacaaaatcggcgtggcgcccactcatagaagccaaaaaataaatttgaaaaaataaatgataatccaagtaatagagtttaagtaattcaaattcaaatttttataaattcataataaacgaaaaattaaatttttaattttcgtataattattaagtaaaagaaatcatttataaaaaaaaattttataaacaaaaattcattcaactggtcggcaaaaagacgaaaatattttgcaacaaaattaaatttgaattctctaattaataaatcaaagtggcccaatgaagaaaaggaaaaaaccgacatgtgaacatgatattaaaatagtaaaaaaagatttaaaaaaataatattttaaaattttgaataaataaatgattattcattacaattagtacaaatcttatgaaataaatggtaataaaaatacaaaatcattatcaaaattgaagaaaatgtacaatttaataatataatctacttatttgcaagatcaaatcataaaactaatgaaattggcattttatttttcttttttaaatactacagaaattacaaccattttttgttgccatttttctcatgtttggggagttatgaccgggtcaaataaccattgccaaatgacctggtcaaatgaccactttctatatgaatatgtatttgagaagaacaaattaagatcgcttatcaatgttgataattatttaatgacttgaaaattaacaacttagtttaatacatattttaataaattatctcttcattcgtaaaatcatgaaaattataagcattatggttaaatattattattatagtcaattaatttaagagtgatggtattattttaattttaaaatagctaatgg

SEQ ID NO: 20743 - DNA, 929 bp, Heterodera glycines
acagacgggaatatcgaactgcactttatgccaagtttatcgagacaatgcccggttcccctgccaagactctcggcaaaatttttcaaaatcccggccccgactcaacactctcgagcagtaagggagttggtctcaaattcatttagtgccaaggttgtcgagacaatgtccggtctcctgccaagactctcggcaaaattttcgaccccaaaaagtggtcgccgggaactgtccccaaaagtctcgggcattgccccccccccccggcgggcgtttgtgccgtcccccgcgccgctgtgccgcgtccgagcgcgcccccacctttttgtccttcttcagctccttgttgatctcgcggttgacccgctcctgctcgcgctcctcatcgtcctgcccgttgtgtccgccttggcccaacacgcagcccataaggcgcattttctttttgctggcggttgacgagttgcgctttttggccgccgctttctctgccgccgttcctaaattattttcaaatttattttttggccaaaaatatatttttaaatgcaattttggcattctgtcaaaaggtgtcgttggtgggacactgcttttgcttctgctgttgctgctcctttgcttgtccttttgcccgccccctgctaatggctaatgctaatgggccggggtgagtcattgttcttcacttttttttttgtaggtcggaatcgaatctttctgagtgttgagtcgagaatagacgagattttaaaacagcgggggtcgagacacccagaaaagtttggtaatgtgccattttagtattctcctctcggaacgcaaaaagttcgagactgggaattcgagactgaaaattgtgccgaaaagcccgcaaaatgccaatcaatttttcaaaacaatgccgaacaatggagaggataagg

SEQ ID NO: 20744 - DNA, 913 bp, Heterodera glycines
  misc_feature (900)..(900): n is a, c, g, or t
agttcgcctcaatttcgtcaccagagagacccaaacatttgaatgggaacaattggccaacaaaagatggacacttttttaaatttaattaataaaagagatttttacccaaacggtgtccatttttagtgaaaatgaatgatctgtcgaaaggcccaattaacgccaattcctacggtatcgccaacaccgtaagaatatttgtcatttctttcttttggaaaacgaaaacttccatttgcaaaaatggccttgtttgtacagccgttgcttggttttctaaacgtaatcttcttcgttttttgcttgttgtcgaattgtaccgaaataattatttatttacttattaaaaagttggcatttttatctcgccataaaatttctaccttttctttttgtggacagtaatttcataataaaaaatgtcggacgaattattttttcaccaaaatcgaatgtttagcgaagacggaataccaacaaccttttgaaggaaaattactttaatttattgttattaatgaaattagcaccgaatctttcgtccaatagacagttaaacatttgtcgccactgatttcgaggttttcgtgacaagcggtgacatcccaataattttttgggaattccttaaaataaataattgcttttaaaattattttagtccaagtcttgaaggattgattattttatatgaggtttagctaattaaaaatgtttacttgtcaaaaaatgaattttatttaattttttctctttcgcttattcaccattctcttctgaacgagatacgtcagatataggcctagtttgatcaagttcatggggtctcaacatatttcgttggtactcactcatcttcatctttgattcgactaataaatctttaataagaaaaanggtaatttatgca

SEQ ID NO: 20745 - DNA, 986 bp, Heterodera glycines
ttttcttaataattgctaagtaactgaatattttagaaatccctggaatttttgagaatttatatgtattttttggggcgatatttcggccgtgcatatgaaagcgatggatggatttggattagacaactaatttcgaggtcataagaacttacgaatcaattactctgtaataattcgattcagggaagttgctcgtctcggatctcgtatttaggcactagacacgagactttcgaagtaatgtgtcaagcaattcacttttttaaagtttcttgtaaatgtttatagaaaattttaaatttcgcaaaaattggaaaagtcaaaattttttggtttgcattttattttgcatttaactcaataattagttttttcgagtttataaatatcattatgaattttagcagataattggaaaaaaacctattttttttgcaaattttcatcttttagtcttaaatacccagggaaacgacaaaattttccgattattgggcccaaaattcgcctcaattttttcaccagaataaaacaaagaaacgaatggataaagagaaccatcagcaaaagatggatcaaccaaaagatcagaggtatctgtgaaaaagttaagggatttttgattattttaaacataaaataaattagataaaatagacaattaaccaaattgtaatttaaaatcgtaaaattatattatttattatttgctaacccaaacgaagtccatttttgatgaaaaagagctgtcgagtgattaaatgaacgccaattcctacggtatcaccaacaacgtaggaatatttgtaatttgttccatttctttttccgttaatccaaatattgctatcactttcatatgcataagtgcccctttcacatagaattgatcgatccaatttgttctgctgtttaacagcgaatccgaagatgatgccccaataactgcagaataaagaaaaaataaatattaaaatatttca

SEQ ID NO: 20746 - DNA, 1725 bp, Heterodera glycines
  misc_feature (52)..(53): n is a, c, g, or t
  misc_feature (57)..(57): n is a, c, g, or t
  misc_feature (122)..(122): n is a, c, g, or t
  misc_feature (166)..(167): n is a, c, g, or t
  misc_feature (172)..(175): n is a, c, g, or t
  misc_feature (177)..(177): n is a, c, g, or t
  misc_feature (189)..(191): n is a, c, g, or t
  misc_feature (193)..(194): n is a, c, g, or t
  misc_feature (198)..(198): n is a, c, g, or t
  misc_feature (203)..(205): n is a, c, g, or t
  misc_feature (1648)..(1648): n is a, c, g, or t
aaagtgttaaatatcatttttagtcaattttcaaggttctacaagggaatannaatntttaattaaatggaattgatgctttaaagaaataattgggaatattttttgagattttaatttgnaaataattgatataattaataataattacctaaaattaaattgnntttannnnantaaagtgtgtgnnnanngaanagtgnnngaaggaaaaagtgcaacagatttgcgggtgcgacacttacaaatgtcgccacaacaagggctccgttgcgtccgtttgctgtccggacgattttgcctttgaatgctgccgcattgaagcagtaaaaataattgggcgcaattagcaactaattactattaatgtagagccccggggcattttctgtaatggtgaaaagcccacaaaaagatggaagaaattgtttttaggaatactgtataaattaatttccaaaaaaaaaatacaatacataatttaattaatgccataattaactccaattaaaatttcttttttttatattattaaaattttaatttttcgtaaacttttatgtaattcttattcaaaaaaataataattttatttttcaaataaattacaaaatttctcattgaattttaatttttattcttacatatttagaaatcgacaaaagttccagaaacgactaccacaactacggtatgattaccataaacggaataatcgaattttatcgaatttacatatttttaatttattaaattttttcaatttttttcaggcctctacaaccaccacaacgacaacgacagaagaacagccgagggttgaaaaattcgccaacactccgccactcatttgtatcctggacagcgcgtgcaattagtaaattttttttcaaattttattcactgttaggccagcggaaaattttttgagggattcgatttttttcgggcaaattggcactaacaatcctattcattttattaaatattatttttttttatcatccaattttcagcgcaacaaaatacccaacggccaagctgagtaagcggttcaaaatcagtgaggactgttcggaattggccaaacgcatcgaaatgaaatcgacggacgcggattggcagatgagcttcgagttcatgaacggcttcaaatacgcggcttttatcttcgatttccccatgctcgggggaggaaaaggcgggggacagtgagcagcagcagcagccattttaacaattaatattttattttaaattatttaagcatttttaatttatttttattcatttttttaaatatatttctttttcatttttaaattttgtttttatttttatttaatatgtatttgtcatttaattcatcttatttaaaaatttaaaaaagccaaaaaaagagcaaaattaaaattgccaaaaaaaattgtaaatcttttttaatttttttattatttaagcattttcaattacatttattttaattgtattattcagtcgttttgtaatcatttttcaaattttatttatatttcacttaatttatttcttttcaatatttgtattataatcttttttaatcatttattttctttaatatgcatttatcatttaaattaaaaataaaaaatcaaaaatcccaaaatanaataccaaaaaatttctaattcaacattaatccattaaatccattaaacatttttttactatttaatcattttcaat

SEQ ID NO: 20747 - DNA, 1006 bp, Heterodera glycines
attttcatatttttttcttttaatgtttatgtttttcaatggttgatcatttatttatctttaatatgtattcatcatttagtcaaaaatcaaaaagatgccaaaatattttctaatattttatttaattattcatatatttatcatttatgtttttttcaataaataaactttaaaacgaaagagtgccaaatgaaaacagacaaatttaaggaaagaaacgaaaaattctttccaaatactaattaattacctaattaacaaattaattgatgctaagccccccaaagatatatctaaattatatatgtcaattggctcctcttaaacattagcttttttaaaatctccttttctcgaaaaaaatgtttcgaaaaatgttttcattttattgcccaatttcaaatgctttggccatggctgaaattagccaattaaactctctgaaaaccatttgtctgattattattcacccaaatttgcggcctaatttcttggcaaaaaaaaaatgtatgccgcgaagagcaaaaattcgaatttcataaattaataattctgatcaaagctcggtactttcctttttggcgtcgcacgccaaaatttcaaaaaaaaaatcaacaaaatacgcaaaaatttaagaattcttcattattttgaggacatagtaaatgctagagaccggcgcgggacgggctcccgcgcgggattttgcgggatcccagtccgcaatcccgcattttttgcaaaatgcgggatttgcgggattaatcccgcgggatcccgtcccgcaaaaaattttggattccaatcccgcagcgggatccgcaaatattgaaatttccggtctctagtaaatgctaatcaacaattgttgatgataaattccaacaatttgactcagcttgacaatatgtattttgatgctttgtgtgaatttgtgcgcctttttgttgattaattaattttaaaatttttatgcgacgacatcaaaaaagtaaattaccaa

SEQ ID NO: 20748 - DNA, 1497 bp, Heterodera glycines
ttttgaaaacaaatggccttttggatgggcacgcccctttcatagagtaaatccatcgcttcacacaacggaaaggcggctttgtggggactcaacgatgttagccggtcgattgggtaacgacagaaaagcgggaaagacgaattgagagagagccgcttgtcctttatctgaagacgtcgtccggttgccaaactctcgaaaaattcatcacgaattccctccttcaaactgcggagcatattgtccttgagccaattcttgtcgaggaaaatcacatttagctcattcttcttctgtacaatttgctttatcattgcaattgccttggaaaactgttcattgctggtaaagagacgggcatttgacgtcttaaatttatacaaggcaagcaattaattaattgacagttgctaagtgagtcggtcaccttcattatcgtgtcatattcatgtgatatcagtgaccggtggatgacttcgatttggtagcccctcgccaaccgatcggaccccaaattgtcctcttcctgcttttcctgctgcggatagacatcggcgtggagtgtaagcggaatagttgagctgcctttttctccgccactttggcgatggttttttggagaccgtttaagcgggcgcgcatcgggactaagatggcctctcgtctgaattctctggatgtgttgttgcattctgtgataataaaaagtgtaacagaaaagatgaaaaaaatgggaaataaataatggacaaattaagagaaaaaattggtaatattgccgatggtaagaccctttttgaaaaaaatatttatgttagaatctaactttaaaagtcactgaagatatgttttaagggtttcgggattgctgaatacgagtaaaaaaaataaactgcagccaagcgggctcgaaccccagacccccgtctcaaaggcccggaattaaatttcaaaaaatcgtaaagaactaaaaacttgacttctccggccaatcaatatctcatttgaaagctcgttttgagctctacaacatccatctatgcgtttatgcgcccgattaattttcttaaatctatttttgaaaaatcaagtacctgacgaaaaatcatagataaacacaccgtttcaaaaaacgagagatgaaccaataaatagagagtgcagagaaaaaaacatctctctttttggcgtactatttctttatctgtgttaatagagaaaaacggaattcacttcatgttgtttaaaattttttctacttgttaaatctgcttcaaattttgcatatcaatagagaaaaaaattctgcatcggttaataggtcaagttaatattaaaataggtcgaattagaaagttataagaaaaacaaaattttaaagcctcataacttttctctggtacaccaaagcgcttagcatttgcttagaaaaagcttctcattatcaagagctttcgaaagataccaagattatccaatttggttgggaaaaac

SEQ ID NO: 20749 - DNA, 528 bp, Heterodera glycines
caaaagccatttttcttacaattttcgttgtactttggcaccctgccggtggcaattaaacgtttcatcttcagctcataattctctttattttttttgatgaatgctctgaacagagctgaggtttttaggtttagtcaatttaaaatgagctcctcttcactcttcaaatttcaaaaaaagaatcctcctctaaaaattactttcactaaataaatattataaaaaattccaaaataatattatgattagatttattattagggacgcgatttctagtgaaaaaactttttttttttgctcgattgattttaagaaaggagctcaaaaaacgcatttctgcattaaaatttaacggcttctgttttttaaattagctactcttgaaaaacgaagaaaaaattttgacctcctaactacttataaaattttacatggttttacacatttggacccaaattctttgtttaaaagaactaacctaaatactcgaaataactcatttttccgtttaaatgttaaattaca

SEQ ID NO: 20750 - DNA, 1089 bp, Heterodera glycines
ggtgtttgcacttaaaatggctggctcattttattaaatttgcatttttggagctccggttcgaattcaacataaaaaataataagttttaattaatgtacaatataactaaataattaaaagtgcattttagactaaaaaaatgtataataatttttatttagtgaaaataagctaaaaaaataataataataaaagtaaagtttggaaattaatagaaagttaacaaagctaggaatgggcccttaggccttagtttcggtttttgaggccacataacttttttatttttcgtcacacaccgctaatataaaaattcacaatagaagtcgacctgctgtatccaatggtaccaaatgtatacccactttttggcttacagttcgtgagttcccttgtcagagcaaccgaataataaccaatacccttaatgattagttgcttttaagaaaagtttttaattgttttcttattccgtggcatgaaactcaattgaaaccatgccaatgtctcagaagagaagcaataaatattgaaaaagttaccaaaattaattgtttatatcaattttcaattagttcatgttttacattgccgtcatcgacatgctttgcttgcttataaatgccatcacaactggcattttggccattttgggagcggttttttgttcttttccacgctttatttattttgttggtgcctttggtttaggtaataaatagggtttataattatatggatttacatattttctgcacatatactatgaagaaaggagctcaaaaatagcatttctacattaaaattttttgatctggtgaaagttttttgtccatataaatccatattttgggggttttcggaaataaatccatatttcgatatttttgctagattaaataaactgccattattaaggctaaatccatttttagcagattttattgtatttttaagactgtttaagcaaatattgactaaatactcatttacaaaattttttatagctacaaagatatatattggtagattttataccatattttgctccatatcttggacatttttgagctttgtagaccatat

SEQ ID NO: 20751 - DNA, 1110 bp, Heterodera glycines
  misc_feature (1052)..(1052): n is a, c, g, or t
  misc_feature (1099)..(1099): n is a, c, g, or t
cagcattcaatgcagctcttcaaaagctgtccgaacatatttttctttcttttctaacgcatctccaagcggatttacacccatttttggacccgtattttttgtaccccgatcacattctgaaaaaaataattgatgcgctaaccctaagtctccccagttattctgcgcattgctttctccacgcgagggcaaagcagcgaattgtttcattttcctcctttttgtattttttcatgccgatctcgaccctaactcagcaacgcgtgggcgtacagcagcggcgactgcagcattcaatgcagctcttcaaaagctgtccgaacatatttttctttcttttctaacgcatctccaagcggagttacacccatttttgtacccgtattttttgtaccccgatcacattctgaaaaaaataattgatgcgttaaccctaagtctccccagttattctgcgcattgctttctccaacgcgagggcaaagcagcgaatttgtttcattttcctcctttttgtcttttttcatgccgatctcgaccctaactcagcaacgggtgggcgtacagcagcggcgactgcagcattcaatgcagctcttcaaaagctgtccgaacatatttttctttcttttctaacgcatctccaagcggagttacacccatttttggacccgtattttttgtaccccgatcacattctgaaaaaaataattgatgcgctaaccctaagtctccccagttattctgcgcattgctttctccaacgcgagggcaaagccgcgaatttgtttcattttcctcctttttgtcttttttcatgccgatctcgaccctaactcagcaacgcgtgggcgtacagcagcggcgactgcagcattcaatgcagctcttcaaaagctgtccgaacatatttttctttcttttctaacgcatctccaagcggatttacacccatttttggacccgtattttttgtaccccgatcacattctgaaaaaaataattgatgcgctaaccctaagtctccccagttattctgcgcattgctntctccaacgcgagagcaaagccgcgaatttgtttcattttcctcccnttttgtctttt

SEQ ID NO: 20752 - DNA, 2541 bp, Heterodera glycines
aggtcatgggcaatttcgtgttgattaatttcagatttttgacgcttgttcgctgttacgccatacaattggacagtttggatgtgccgttgaagcaactgtttgactctgctatggagcgcaaaaaggcggatgaccaaaggctgttccaatacaatgccaaccatttcttaggcattaccaattcgatttatcacaaatccagcgctcccaagtgtcctgatttttcagatttatctgccttttgaaaattggacaatattttaaaagcaacaaattcttgaagttatttctcttaaaaatttacaaattttcccgaaaataataatgcccatttttgtgcaaatgtttatcaactgacaaaatttttcaaattttcctctacattcataccggcacatcggacgcctcgccacaaagctgaagtttagcgctgtttgcttaatttgaaaaaaaaacttgggagcgctgcacaaatgccactgttacgagtagggttcgagccccgtggggcgggggtggcttttcacgggggcgagggatgcgggggccagcgtcacgggggcgggggcacgataattccgcccagcggggacggaggcgggggtttgctttgaattaggtccaaaaatctcacaaaaaaatattttttaagaatgatttctttggctccacattcctttatttgttgatcgcctcgatactatttcttttgacataaattgcacagatttcgactaaaaagtaaccaaaatttagggatttttgggtaattttttttaagaaaaaaaaatttttttttgggggggggggcgtgccgataggggcgaattttaaatttatttctaacagatattcaccaaaaaaattaagactttttcgataaattttcgttttttaactatattaaattatcgtgatttactcaaaattggaactcagatttttaaaatttttttcttgcggcacatttttcaaaaaaaaaaacttgatgaatgtgcgaggggagagttccggcggtgccgataggcgctgccgggaaaattttttgaaaatttgaatgcaattgttaacaaattttgtacaaaaaatgagcaaaattcgcgagcttgggataatttttaagaaaaaatataggaattttgggggccggcggtgccgataggcgccaccggggaaaattttaagaatttatatgaattttgttagaacttagccaaatttttcagaaattttcttcttttagatgaaaataaggcattacccccaaatcagaacatttcttagaaacaagaacataaagaaaccctgtattaatcagaaaaaataaataaattaaaggaaaacgttagccggaatcgaactcatgacaaaagtactgttagtattgaagcactatccaccaatccacaaataaaataaaaaacaagttaaatttattttatttcataaaaatttctcgatagttaaaaaaaattcaaaattgtctaaattttttgccttatttcccacgaatatgccattcttaggggtgtattttcacccccgtgcccccgcgggggtgaaggtcgcgggggcgggggttgcgggggtcagagtcacgggggcgggggcgggggcggggcccaaaccctactcccgcccccgagggcgggggcggggggcggggctcgaaccctacttctaagtcttacgcgggtttttaagtcatggcaatgactaatttttattttactcttcacccgacttttttgctgcacaaaaagttcataatgatatttaaattaactttaccataagccaatcattaggggtgtatttcttactttgaaaactcgatctttaggggttatttttcccgaaacttcgggtaaattacccgaaactcgaagttcgaagcccaaaaaacgcgaagttttcgaagcacgaagctcgaagtttcgcccatccctgatcgggaaagaggtcgttaggagtagtctgaaaataaatcaaagcgatatttttttattggtccgttattttcgaatttattggtcgatgaccaggaaatttcggtgggactccgaaaatatgtttgacgtctgaaaagtcggtacagttttgaaactagaagataaattgaacttttagaagaaagtcaaaaattaatcaccgaaagtgattggatttttcagatcgctggtaaattgggaatattccttgtgcaaaataactgtaaaaattccgggcactttaaaattgccaaaacttcttttttctttgtgcaattatataaattttaaattttaaatattcatttataaatacaaaaaagtttcatttttgtaaaaaaaagacaatctgagcataatgaaatgtcgtcgtcataatgtaaaacacagtaattcatcagcgacgtttaccgtacccatagccaccgccgcttccgccgcccattccacctccaaaaccgttgcccattccgcctccaaaaccattgcccattccgcctccaaatccattgcccattccgcctccaaatccgttgcccattccgcc

SEQ ID NO: 20753 - DNA, 1084 bp, Heterodera glycines
  misc_feature (1038)..(1038): n is a, c, g, or t
  misc_feature (1045)..(1045): n is a, c, g, or t
  misc_feature (1060)..(1061): n is a, c, g, or t
aatattttcaggaatggaattccgaggacgaagtgaccctccctagttcttaaatcagaaatcgaatttcctaggctcactataaaccgaatttcctaggcccaaaattttcgaaaatcggaattccattcacttcaagcatttattgaaaattgtcattcattttcaaggacaaagcccagtcattttcatgtctgttggcattttaagagccagttaatattttcaggaatggaattccgagacgaagtgactcaaaatatttcttaaatcagtaatcgaatttcctaggcccaatataaaccgaatttcctaggccccaaaataaaccgaatttcctaggcccaaaattttcgaaaatcggaattccattcacttcaagcatttattgaaaattgtcattcattttcaaggacaaagcccagtcattttcatgtcttttggcattttaagagccagttaatattttcaggaatggaattccgagacgaagtgactcaaaatatttcttaaatcagtaatcgaatttcctaggcccaatataaatcgaatttcctaggccccaaaataaaccgaatttcctaggcccaaaattttcgaaaatcggaattccattcacttcaagcaattaattgaaaattgtcattcattttcaaggacaaagcccagtcattttcatgtcttttggcattttaagagccagttaatattttcaggaatggaattccgaggacgaagtgactcaaaatatttcttaaatcagtaatcgaatttcctaggccccaaaataaaccgaatttcctaggcccaaaattttcgaaaatctgaattccattcacttccagcaattactgaaaattgtcattcattttcaaggacaaagcccagtcattttcatgtcttttggcattttaagagccagttaatattttcaggaatggaattccgagacgaagtgactcaaaatatttctttaatcagaaatcgaatttcctaggcccaatataaaccgaatttcctaggcccaaaattttcganaatcggnattccattcacttcnnagcattaattgaaaattgtcatt

SEQ ID NO: 20754 - DNA, 1464 bp, Heterodera glycines
tgaaacaaagatacaaaacaaacaatgatttaatgaaaacaacggtcactaattttgaagtactgtagttagtgattgcctctgagttttccgttttttaatgtgccaatattaatctagagtaaaagcaaatattaacaattttaaaggcaaaaattgaattaatgtgtctggaaaatttaatcaattgtgtcttaaatgtttttttaggattaaatgataataaaaaagaaaattgcttaaattcagttagttgaaagtgaatttgtttagctacaaaatattaggagattttataataacaaattatgtcaaaaaagagttaattccaaaatttgtctattttttaaccgaatttcaggcattttccacttccatttttggcgttatggaagatggacagaagtcatcattgatgacagacttccatgccgatctaatggacaactgctttacagtcggcctccgactgagtaattaaaaataaaataaatttttttaaattttattttatagaaatgtcttttgggccattttactcgaaaaggcatatgccaaaatgtacggcgggtatgctgtacttagcggaggaagggttagcgactccttctccgacttgacgggaggtataacggaagaatgggacttgaagagtctcgatgtcgccaaacgaagggacatggaattggtaataaaaaaatttaaaatataagccatttttcctaaattccgcaaaggagtaataatgaacccgcttaagcagagccagatcaataaaaaaaatttgggattgtatgccaagcttggccaagctctggtaagaaaagcactgacaaatgagtggaaatttaaaatgtttagctctgatttgtaacagatattcaccagttgtggcaatccctaacaatttttcgtgttttcatcaaaattttcgcaaccagaatgccgggctcaaaagtgtacgaaacggaagtcgacaatttaattgttttttgccgaaaatttttttattttttccggaggcatcgactgcacctgaaaagctatcgattggcaccaaaaaaaaaaaaaaattaaatttggctgagtttaacagggaaaggctcattgattgcggaatttaggaaaaatctcggcataaagaagaatgataatttaatgatttttaatattcaaattaaacatttttaaagatattggtaaagcgtcctccgaacagtggcgttaaaaactactctgagaactgtgtatttggctgcgccacgggaccagtgaatagcgatctcacgcgagcagggctcgttgaagtaattttcaacttacaataaattcttaaaattaaaaaaatttcacgaaaaaacaactttcgcaaatattgctgcaattcgttaataattttgttgaaaaactgtgccttttcaaagaaagaaataaatagcgaatgatatgcataaaaatggagag

SEQ ID NO: 20755 - DNA, 530 bp, Heterodera glycines
acggcacattagtgcacttacatggtgcaaaaatgaaaacaaacaaataaatttgatcaaataaaaaatacaaaatgaatcaattcttcgtcctgttttttccttcattttctgtctaactttttcattttggtccattttgatcacttttctctttccctctttgtccaatttgatcactttcagtttggctcccttacatgggtcaatcgcgggaattgcttcatcttatccggatgcttctcgatcatcagaacatgattttcatccttgtataacgcaaacagaacaggaaaaattttttaaagaaatttttatcattttaaacgactttatcagttcataaataatcagaggcctcgttttgagtcatgactccattaaaccaaatgaaaaataagatttaaacaataaactaatgatagacggatctgactaaaagcaaaagaaggaagccaaaaggagaaaacccaaaaataatgacgtgaaaataaaataaaaaaaaaaaacatggatgaaaaagctcctca

SEQ ID NO: 20756 - DNA, 2109 bp, Heterodera glycines
taaaattttatttaaaccgattctattaggaagggaataatttaaagaaatcaccgtattttttaaatatttccccttgccccataagaaaaagtcgcggtacactgatttaatcgcttccattgctgaactcatttggagttcgcgttcctcaattagcaagataggcttaacaattttgcattccaatggattttcttaaatttgttaattatttcaattaaaaaatatttattgactattttctttgattttatgagtttttttttcatggaattttggaaaattgctttccaaaaattttttaaattttatttaaatttttcattgtttttatttatttacaaaccaatttctcccatttcagggcttttttgtgcccccgatgaacttgtgccaactttgtccccctgtttttgtccttttctgctcttcttccaactgttcacatatgcattcgctgcacttgccatctttttcaatattcgcaaaattcgagtaattcttcgtctgatttcaatccaatgtcttttggttttggattcaatttacttatttcacatcgccaacttcccatcatcaaacgccaatagattgtttggctcagtgccactgcttttgccatgtcctcctcctccgttatgtcatcttcgatcacttcaaattgcggctgatcacagtcgtcttctttttctagcaatggctcctttaatttttcatagttgttatgctgctttcctcccacagcattggcaattccggtcaaattgatcagcagaaggcacagttggatggaagggattcgaagcatttaaaaaaattaaaaatggaataatgcttttttagagcaatctgctgggtatttattatgcacattattcaacacaatcaaaaatggcattaggggagaataggcatgacatttcatgtgacatttgtgttaaaccatgtcattttattttcaattgcccaaatccacttcaggagatttaaaaaaccaggacaattaatccattctccaactcaggacagatctaagaaatcaggaccaatattctattccatttgcaatctcaaattcatgacaatctaaaaaatcaggatgcattttccattacatttgccaatctccaattcaggacagatctaagaaatcaggaccaatattctattccatttgcaatctcaaattcaaggacagatctaaaaaatcggtacctatattccatttgatttgccaacatacaatttaggacagatccaagaaatcaggaccaatattccattttattaaagattgagaaagaatagtaatcactgaggacaggcagattcttaggtttttactaattttttctgctgctttaattcaataagaaaaacacaaaaatcccatttttagcgcgaaaattcttcgttttaacttcttaatcatccctaggaatccctattttgaactttagcccataaaataggggacctattttggcatttcgcccctatttcggcatttaaaaaaaaattcatacaaaaatgcaataaaaaaatatcaacgaccgacctctttttcaaaaaggttggaaaaagtaacaaaaacaaaatttttgaataaaatttcaaaatttttaattaaaaagaaataaaaatttctcattaaatattgacctaaaaatttaacaaaaagttggattttcagtaaaaaaaaaatcttttttttccctgggaatcccatattgtaaaaaatcgtttgccgtggtcctcaaatatgaaatttctggactctagtttgagtggggccttctattcccaatcaacgccaccttcccagtttgggcgtaatattttttgttccaccgcactcgaagaacacacgcgaacacacaaccaaacaaccaaataggctttcactatttaataaaacgtacaaaacaaaataaaacaaattcggaagacgaggtgggaaccaaacaatcaatcaaatccaaacggagaacggcgaaacatcaacaaaacttttatcgaagggagaagcagtggaagaataaaacaaataatcaataaagggtcaaaacgccaaacaattaacgcactaatttaaataataacaca

SEQ ID NO: 20757 - DNA, 2694 bp, Heterodera glycines
  misc_feature (8)..(9): n is a, c, g, or t
  misc_feature (22)..(23): n is a, c, g, or t
  misc_feature (34)..(35): n is a, c, g, or t
tgcaggtnncttccaaatccannatactaagatnnctctcggaaaaacacggcccccccatggtcgctctgataagaatggcttaaatctgtattacaaaattaattaacaaaacaaaataacacataggtaaatattgcaaatcgaacaattagaaataataaagttaagatttatcaaatggaaattattgatgaataatggaaattagtgattaacaaatgactcaactgacctgttcagcgtaatttcaaaatttaatagtaaaacttctttcaatcataaaacacaatttcataaaaattcttcattacaaatacttgttctcttacaatatcaaaaatcttttcacgaatcttttacatgaaacataggtatacaaaacaaaagctatacttttcacaattatccatactattaaattatcaaatttaaatgtgttataataactaataaacaccgaaaaccaaaaattcattttcacaaaaaatttttgtggagcctagattgtcaagtataaaactacattttctaacttttgctaagtaaaataggaaaaacaaaacattaaacctttttataataaaaatgaacatataaactgacctttatcgttaattgtaaatccacttcgtaaaagtaattccttttgtcaatataacaataatcgctatcccttactatataataagcgagccgaagctccgcccatttttttggttgagttaaattggcggacttggcgggaaataatttattttttggcgaattgtcttttcgagaagaaaataaaaatttgtttacctatgtgttgtttttttgtgtgaagaataatatcaatcgatcttttttgttattatttcataatttcatctgtttttagttaaataacttcattgtatttgtttcttattaataattgaatgaaatttttttatcttacacagtttttcagagcgtttcataaattcgacaaaaggtaagaaaagaaaatgtttaaattacttttaatatgctaaatagttttttaactttgttacaataatgaatttttttcaatttatttagtatttacaataatgaattaaaaaataaaaaattcatttagctttgtttttatttgcaagaaaaacggaaatttagcgttttgagcttaaaaccggttttttaagaattttaaggaatgctgattatgaatttgataatacctaattcaagacctcataaccgatttcgaataaaactcgaataagatttagctcattttgatacatttttaaacactggcgaatttatgaaacgcaaaaaattgaaatttcaaaaaatctaatacaaataaatagttaatctcttttatttttggattttttattttatatttttgttgttatttaatttaaaattttttagattcaaaatatttttctatggtccgaaaaaagcaaatatttccttctgaagggaataaagctaaagaccaacaaattgatgcagaaagcattgaactgggttcacagctcccattaaaaagcggtttgaagggttcgaagctccctgataaaagcggtgaaaatgataattgggttcaaagctcccagaaaaagcggattgaacaatacaaacaatttattgatatgattgataaaccttcaacttctcagcaatgtaaaatgaaagaaattgatagaaatgttaattatcttgaaacaaacagatttgaaaacaggaaaagaaaaagtgatacgtttataaatttagacgaaattgatttagatgaatcatctaaaataagtatttgtgatagaagtcaaggttcaaacagcactgaaaaaacattatgtaaaaaaaatacccaaatgaatttaaaagatttagtcaaacaaaatcccattttggagggtgaaaacaaaactaaagatttgtttaaaagaaaaatggttggctttttatttaaaaaagcggaggaaaaaaataatatttcaaaattttccctgcaggattttaatattgagtgtttgttttgtaaagctcttcattttccagaagaaaaatcgataaatgcaaaagggaaatttaatgaattttatttatgttgcaattatggaaaattcgaaagattaattgggttttttgatacttatcctgaagatttaaaaactttattttcagaagaaaataatttacacaggcattttattgaaaatataaggaaatataacaattcatttgcatgtgcttctttagcatgtaatagattttctttttctacacccggaccaagttgctataaaatttcaggtcaagtttatcacaaatttaattcaactgctcaaccaatagaccaaaattctttacctacaaatggtcaactttattttcttgacagtagtgaagcacaaaatgttcgattgaattcttttgaattaaatgagcacctcattggaaaaatagaaacatcgcttagaaaaaactatccatttgctaaagcttatgaaatgatgaaaaatgttattaacgaacaaaaaacattttcggacaaatctattttaaatgaaacacaagaagtgaaaatgtttttgagttttaagaatggttttgaccctaatcgatataacattcaacaatcaaacgaagtcgctgcaattatggtatgcaatggaatgatgaagtcccgcctgcaaatttagttgttgt

SEQ ID NO: 20758 - DNA, 1665 bp, Heterodera glycines
  misc_feature (11)..(11): n is a, c, g, or t
acttatacttnagggttgtaaattatatgggactaaaaaccgcgaaatatggacattaaatatggactaaaaaagcccgaaatacggactaaaaaggccaaaaatggccaaatatggaccaaaatatggataaaaaatgccaaaatatatgttgtaaacccccaaaaatcccaaaaaaggtgtgcatatttaatatttgcttaaataaacctaaaaagtacaataaacaaccaaaaaatggggtttaaaacttaaaaatgcatattttttattgttgttcgttgtatcaaaaacacctccaagtttgccaaatttcgaaaaaattctcattaaaaaaaaagaaatgttcgcaaaaaaatgacgaaaatatttattgaaaatgccaaaatgacgacgaaaactcaaatttttcgtgttttgtggggtgtaatttttaaaaatttccaaaaagttgatctttaggggtgtatttttcgtttttttttcatttttcttgtgaaaatttccaaaaaatggccaaaatatggactaaaaacccaaaaatggcgaaatatggatttattcccgaaaacccacaaaatatggatttatatggactaaaaaccttcaccaaatcaaaaaattttaacgcagaaatgctatttttaagcccctttcttcatagcatatgcgcagaaaaaatatgttaatccatataatttacaaccctacttatactgatcattttgtgatttagaggagcctatttttaaagaaaattaaagctttttgttagagaccgagatttccaaattctcctgaccggactggtattttaaaaaatgaccggatcccggatccggtctctcataatccggtcaatccggtaatccggtcaatccgggccccccgacccgacccgagacgtttatgggacctattccccgacccccgaatcatattgctaacaaaaatcatcatttgtggtcaaaaatcagcattttgaaaaattttcttattccaactgaaaaaaattataatgtttttttgcggcgctctttttgtaaaagaaaaactttttgggaaaggggcccggcggtgccgacagtcgccgccgggggaaaaatttgaaattttgaccatttaaagttaaaaacattatgccaaagagatatttttcaaaggaaaatgaaaaaaagttatggttttttggtagagaccgagtcggaccggatccggtcaaaaattcgccggaccggaccggattggcattttcaaaaatgaccggattccggatccggtctctcataatccggtcaatccggatttttcccaaaatcgcaggaccggattgccggatccagaaaaatccggtaccggatccggtccggctcggtctctagcaaaaatcggtcataattttttgactttatttttacaattaaatttcatttaaaaatgtaaccattgcgcaacgccacaattggtgatccatttcttggcaccgttcagcacataaaatgtgccgtcctcactacgctcggcgctcgtcgacacattggacacgtcggagcccgcctcgggctcagtgaccgcaaaagactggaaattaaaaaataataataataaaaacggaatttggggccaaagggaaaaaggtgtccgccccccgggaaattactaaaa

SEQ ID NO: 20759 - DNA, 2547 bp, Heterodera glycines
  misc_feature (1684)..(1684): n is a, c, g, or t
  misc_feature (2529)..(2529): n is a, c, g, or t
aaaaaatcccctccccctgataaatttttgtaattttcaacaatatttgattaaattatggcattaggtcaataaaatgtaaatttttttctcatggttgagaattttgaaattttaggcataaagtcactatttttcttaaaaaaggagcccaaaatcgcaaaaaaaaatgttggaaaaaatccattctggcgaaaaatacaagccatttttataaatattaaccgtttttcattgcagaaaataattattttatgtccttggatttcatgaattttccccactatgtccttgcaaatcggcatacccgtccttggaaacggagcatggatgtgggagcgttataattttaaagtaatttattcaacattatctctaaacattaatagctttaaaattataattatagttattaaaaaaagccaaataggcatatttgaaaaattatataaataaattttatcaattcgatgattattgttctattattattttaaaatcggccgccaattgctccatattaagacagtcccgactctgcagtcgacgattgcaaaatttatttgattcgctttggtattaattcactatcttataatatttatatgagaaaatataaaaataaatttatacagaatattgttgagtagaaattaattaattttaattaaatcatcatattaaaaaatgccaatgtttaacaatttctgaatattaactgattatgttgatttaacatttttttctttcattatttaattttatgcaatcaacaacacaacaaaaaattaaaacaataaaattattacatataaatagctttttatgcataaaaagtgcaatgaaaaacccataaaaactaattacattaaaaaattagaagagaaaatgacagcttcaaaaaaaaattgatgtcctttatcgttccaccgttattcggtttcgttttttggcctaaaatacattagtctacttcggtataaaaaacacctattaaataaaaaacacagactgaaataacgagaaaaaatatatattctcgggattgactgccattgtaataacttaaaacagaaattatacgttcatgaaatttttagccacttcgactacttcctattaaccaatcgatctgaaatttttaccacatataccctcccataataaattattgaaagaataaatgaataaacttttaaaaaatgcatttaataggattttaaaacgaatcaagattattacattaaattatgcggtactataattataatagaacgttataatattacatatctactaaagtaataaaaatccaaagaatcaaattttataaggaaaaacatgttttttctcatcaagtggaaggggtggatcaaaaccattttttattaaaaagaggagaatatatgaaaaaaagtaatttcaattctttcgtttatcttaagctcaaaaacataaaaataatttaaatatgagaaaacaatatttagaaaattatttcaatttatttattgaaagattaaacaatccagcaaaaaaaataattatcatctaactttactcagctacatacccacatttaaaataaggttcagcaagtaaaaatgcgccattaatatataaatatataattcgaaacctattcagaaaaaaaacattttttgaattattagaaaattttcanatttgtaataattaataattaaaaaactcaaagcaagacaaattgaaatttaaacattaataacatagcttagttgctttaattttttgttacttcgtcgcaactgctgcataaaaagcagcccgtggcttacttgacttataaataatatgcaaacaaataaacaaaaataataaaaacgctaagcaaaaataaaaattaaccttgaaattgtttaaaaaaatgtagaacaaatcttaacattatacaagaaaaataaaattttaattaaaaaaattaacaaaaaaatatatatatattttaatacgatgttaaaaaccgagaaaaatttgttgcaagagtcaaatttatttctttattatgtgacttaattgtatatttttcccaaataacatttttattttttgaatccaaatcacgttctgcaccagggctggagcgtgaccgcgatccgcggccgcggcaatttgaatgcgcgatgcgcggtgcggggccgcggtttttttctgttcgcgctccagccccgttttgcacccaagaggacgatagtaaatggtagaaagaaaacaaattataacatatgcatattaaaaaatgttgttaaaaactttatcaactgtttttcaaccctgaggaaatagtatttaattgcaatgccataagaaaaaaatttatgaaaaatatataaataattaatagtcatactgtctattaggtttttatagattaaaaattttaacctaaatccagtttatttctaaaaataatattatatgccaaaaagcatctatatgaatatgagtaagcattttaaatcgggggagcatatttaaattgttcgacanaaaatattaaaaattaat

SEQ ID NO: 20760 - DNA, 1294 bp, Heterodera glycines
  misc_feature (43)..(43): n is a, c, g, or t
  misc_feature (49)..(50): n is a, c, g, or t
  misc_feature (86)..(86): n is a, c, g, or t
  misc_feature (120)..(120): n is a, c, g, or t
aaagattcatatattcctttatttcatatattatttatcgatntaaatnntaagtaaaaaccttatgcaaaaatcaaattaaaaangataaattaaattaatttattaaaataattaatntaaatctaatgggttaaaaactaaatcaattcaaatatgaaacaactaaaattcagaattagaaataataaaaatttattctacatagaccaagccgaattgtagagcagtttcgttcgaattgcatatttgacttaaaaaataaattataatattaaaaaaagacaattaaaaatttattatttataaaatgacagaataaagtcagtcaaatataattttatttttaaatacagagggatttttttgaaagaggaattgatcaattagtggaaaaatgggtgaagattgtggagaataacggagcatattttgattaaaattggttcagtatttaatttgttagaatttttcaaataaaatttttggttactatgcaaagactattttacaccccaataactaagttttagaaaattttcttgtgtttttcaaaatgttgaaaaactaaaaaccgatgggttctcttagctactttaaattttatcatctgcttatttattccattttcccattcagttttcttaggtcttatcttggattttcaatttttgtcttacgtcacagataaattttttcatacaatgtgaacattaaattattgcatcatcagttctgttttttgaggttaggtttcttcaaaaaacttttacggatgctgcggggaatttcgatacagacagtcgctttcggggaagtttaaaaattaattgtgatttgccataagaattttaccagaattgaatttttgataaaattttaaaattttatggcaattaagtgccgtttgaaataattaataaaaatatctcttcacataaaatatatttttataacttgtttgaatatttattgaaagaaaataacattccttctatgggaaacacaattgaaacatagatccaaattcaattatattaaaattttttggaaaattgaacagttttcaaaaatgcaaagtatttcaataagataaaagctattctcagttgaaaaaatatgatgaaaaaatttttagttaatgactaacaattttttggtttaattatcagaaaaagaagaattgacaaaaaaatctatgcggcagtcaaagttgcagaaaaaaaatggtaagaattttgtattgtaaaaagaaaagaaatattaaagaatattataactctgaaattcaaaa

SEQ ID NO: 20761 - DNA, 1883 bp, Heterodera glycines
taattaaatttacaaaattaaatattgttttccaatttagctgtttttagaaaatcttttattgtgacagggagcaattcatttccccttgaaaatgttttattgtttaattttcaaaatccgaatttttttaaatcacagaaaaaattttctagcgattttttaaattttatgtttattaataagttttttaaaaaattttcaaaacttttttgcttgaattttcttataattttttttaaaatataagtttggcgaattttctttttactgcagcgccattttaatattttttttcttgaaaataggcatttcaacggctgccggcattgcctacaacacatatttatacgccgtggtgcacaagaaacactacaaaaaagtgacgtcatacttgcgcatggcgacaatggtcggcaaattcttggcattctgtgccggccaagttttgatcagcacgggaattggcgattttatgctgcttaatcaggtggcataaatggacatctaaaattatatgatgctttaaagaatgataatatattttaatattttctaaataaacaatttatttagcattttcattactaataatttaaattgatttataaaaattcttttacctattaaatttgaattatttattttttcttaaaaatatattttacagaattattatcattaaaacagatgattttaatttttaatcctttcaaaatacggatcatttttagattttttaaaattccttatttcaaatatatattttatttttaatttaaaaaactcataataaattaattagttaattaattagttgactctgttggtctcctcctcgctgattcccatcgttcttttgttgccgatgccaaagaagcaacaaaaggatgcaattgttgacaacaacaaattaccgacagaacaacaacagcaaaatgatggtgatatttgaaaaaaaatttaattttttattaagtatttttattttagttttattggagcgcaattcgaatgaaattgaccagcacaaattggatggaattgatgataataaaaataataatggaaaacaatttggtgctaaaaaggcgtttgatcaatttgaaattgaacaaccaaaaagtgttcaaaaaaattggaccgacatgagaagcatttggacaaaaataaaggcacgcatggaaataattttttcaataaataatttaaaaatttatataattttttaaaaacgttcctttccctccaatcattccacggtttttttttttgtaaattaattaagagagaatttttattttatttccgaatgttaatacacagattttgttttttgtttacttatcttttagtaagataccaattaaacttttgtttcttatgtgttaattatgcaaaaataattaatttataattttcaataaatcttattatattttctacatttagaccaaatttttggctccttatcaaaatcgggttgttttccactggtcactttattccattgtcatcacagcaatgttttatcaagtgaattcaaaaaataattacttgaattagaattaattttaaatattctttttcaggtccaaaattacattcaaaatttgtgggactttcatcggaaagctgacgaaagagaatggaatggttttgttgagagcattaacacacttttaagtgagtaaattttaaaatgaaaattttaattaattcacattacatttgtctcctattaaattaatctccttgttgcactctaactgcctgctctccttgattttatttttgaaaacaaaaaaacttattttttaatttaaaaaaaaatggtataatattaatatcctaaatcccgcccaatataaaaaattgttttt

SEQ ID NO: 20762 - DNA, 841 bp, Heterodera glycines
attgaaaataaattttgacctttcctgaagaacgttgactcatttgccaatcacttgggaatgcccgcaaaggaatttgagcacacaatggtaactgagaaggaggaaatgccaaaatgaaaagggaaggcaacggacgagaaatggttgtaggaggtgagcagaccgctgagcagcacaatggaaaggaccaagcgaaggacggcacattgggaagagtcggagggatggagacgaagcgaactgcgaatggccaagagacggtcggcacagatggcgatgatcagcctgtccaaatagagggaaagtgccgaattaagagcgatttgaaaagaatgactgaccaaatggcaactgcggaacaccaattggccaaggccaccaaatggacgcgaagcgacagataaagcagacggaagcgcgggttttggccaaaagagtcgaattgggccaaagcggagggcaaaaggagcagcagaaagagaacatcgcaaaaggccaaagcgatgagaagggagtcggaactgaacaaagaaagtgccaatatggcaaagccaaagaatggcaaaaaaaatgccaaaagaaaggcaaagaatggcaaaaaagggggaaaaaggcaaatgtgcttttttgacgaaccgtctccgaattgagcctctgccggggttaagcagaaccaactgaaaaggggtagcagtaaatggaaatggaggagaagcaaatcaaaaacacttgccaagttgagaaaattgccgacgaaaccgaaaagaaaaagccaagggaaaagaaaagtgaagaagaaaccctagggggggggggggggtaataaaaaaggggaaaa

SEQ ID NO: 20763 - DNA, 1342 bp, Heterodera glycines
atagtatttaagaaaggaaaatggactaaattagccttctaaggaaagggagaagaaaaaccctttttggaattggtcagttgcaaacgaagttaaaaagggagggaaaaaagcgaaagacaaacgaaacgcccgagggggaaagggggggaggacaaatgaatgctttttggtccaacgacgggagggggtgcatttgtgggtggcaggtgacgagagccaatctcgggtgagggtgggcccaatcggacgacggcccgggtaaaaaaaaaccagacggggaggggaccaccgcttccgatcagtgaaaacgcctcaggcaactgggcggcccattgatcggtttgtcaataatacgcacggaaggccaccgtcaaacaaacaaacagccaacactcatacgacagcttaaactaattcattccaaacgccactttcataaaatcactccttcttatgacccatcgcttcaggttaaatgatgagtcattagcatttggcggactctctctctctcccactaattgattccatttattataaataaatatgcaaataattatttgcacgataacaatcaacaacaattatttgtgtaaaatgcaaattataataaaaatatcaatctcttcacagtccgtcggtgtattttgctgtctttagccgtggcactaaaagcacaaatctcaccaattgaaaatgcttttgttcccattaaattctgaccaatgttcatcccttgcaactcttgaaacagcaatttgcacgcgtaagggattttaatctttgccatggcggcggatgacttgcaattttggcaccatcccaagtagccgatcaaaccgcactcggcacaaacatccatctgacaaaagatgaggcgaaaatggagtcatttgcgaatggaattactgtactcacactgaattgatcggaggagatcattagccgttccatcagcagcatcgacgcgccatacgctatcagacagtccctttccatttcgccaagtcgaagtccgccgtccctggccctcccttcggtgggctgtcgagtcagaacagcgctgaaaaatgcaccccataaaccaattgcagtcattgtaataaaatgccaaccggggccccttcgctcgcgcgtgcattttgtccatgaccatgtgcttcagtttctggtagtaaattgggccaaaatagacataggcggccatttgctgtcccgtgctgcccgacgtgagcatgtccttgccaaggaagttgtacacgtgggcggctaattgtttgctgacagtttccacctgtagaaggggggcacattttgcaaaagccagaaaagcgctcat

SEQ ID NO: 20764 - DNA, 2149 bp, Heterodera glycines
  misc_feature (2081)..(2081): n is a, c, g, or t
gccggtgcgaccgaagtgcgacgaatgcgcaaatcgcccgctctgtccatggtcatcaccagcaaatggagcagcaccaaatccgaagagcaagaaaaagagatgacacagaatgaacgatgaaagaacggcatttgtgccaccaaaattcacttacaaattaaaactgatcctcggaggccaaaattttaaatcgacttttttttgccacccgtcatagatttcaatatgtggaattagatttcgacctggatttaggtccagtccattttttttgacaacttggatttttgtccaaaaaaatgttaatattggttaattaaacaaagactctcaagagcatcggtaattgattttattgactgactcttcaatttctaaaatttttatcaggaaattttttttattacgtttacacctgaagttgagtgccagtgatagggatatcgaagaattgagtcccgatgatttttatcaaaaaccataggggggacccttttgttttgtaattttttttgtataaaaatcgtgaatatactttttattcaccataattatgctgttaatacttaatattcatcattatgtttaaaaaaattaaaaaaaaattttgaccaaaaaaaagttgaaaaaattttcaaaaacaccaactttttcactagcgccatttggatgcaagaagattaggtcccagtaattggaatgcgaagaattggtgatgatgagttccggtgattgaaatgtcgaagaatatgtgagattgagtccaaatatttaaatgccaaggattgttttggattaagtcttgaaagatgtttaaatgccaagaaatgttttgccataagaaaatgccaagaaaaggtgcgagctcgcgaagcggccgagtcgtaccttccaacaaaaaaaagacaaagaaagtgttacaatttaccgggccccagtttactaggagcattaattctgcgaataattgatgattatcaaattattagatgcaatcactttttagcacttttataatattgcctaaagtctttttatttccattcgccaaaaataaccaaattttaaatcttaatataattgcatagtcctcctatgtgttctctattatcctgcaaaatttcaaaaaaaaatcattaagtttcaaaaaaaaagtatatatgaccggagaagctcaaaaccccaagttttttcgagtacatcacaaaatctcgccgccggaacctcgccgtttttcaaacttggaaatttttcaaggagaaaattcttagaaaattttttgtaagtttttttttttgaaaatttttcgaaaaaacagcaaattatcataaaaattcaaaaaatcaaaacgagagatgttcaattaatgttataaaatttcctatttggttggtaaaaaaccccaagaacactttaagagaattaatttttaaaaattatgtaaaaatctgttactcctgctgttaatttacaaattttttaatgaaaaaatttcaatattttccattaaattttgcaaaactaacagttagcaaacaaaaaaaaattaaaatttatttctataaaattattccattccttcccagaatttttattcacaaggcttaaaatgattcaacataatttgttttcaagcagtggcattttttgtactgctttaacatatttttgtagcatttgtggcttcagcaacctcttcccaggcccttttttatctatcgttgtcaaagttgaagaaaaggtgccctcgatgatttttttttgagaaaaataggcctcgagaagaacggcatcttcttgttggctaaattcaattccgcgctttcgatcagcagcagcagtttcgtccatcttgaaaatctggcccaattatagtaccgcttatagggataaacaaaaacaaattccattcaactgcgcgaattaattacataaatcgcaatttttaatttattaattttattataaaatcatatattgaataaaaatattttaatatagattaaagaattaaataaataattttaaatagactaaagaaatttaacaattttgtattgcccgggtactaaacttgnggttaggcgttaacccgggtttatttaacccggatttacgagcacaccaatttttttaattttttaac

SEQ ID NO: 20765 - DNA, 1445 bp, Heterodera glycines
  misc_feature (66)..(66): n is a, c, g, or t
ttcacgtccgtggttcgggattggccgaaatggatactggacacgtgaccagtgacctcgagaacncaaggagattgttattatgacagtagcgcattttccactgacggattttatggaagctgttagtcgatttaaagtgatttaatttattttttcaaagcgtagaatcaaaattggcattccgaggcggcacaaaattcgataattttatttttatttaattttcaaagcgcaaaaccaaaattggcattccgaggcggcacaaaattcggcatcggacaaggaaagtgtacgaatcactgtgctatgccttgctgttcaaatttattcattatgcattttgataccgacatggattggcaatcagttaggcagcgcgtataacgaatttttggattgtgatgcgcacccatttggacaatttgtgtattttccggcaatcactgtgttcaactcagtgtattatgtgtcagatgaggtgataaaaaaaatcataaaattttaatttaacccaacaagccagaaaaggtgctaggtcgatccaaaaaaaaaaaactcaatgattgataaaataattaaattatattaatattagagatcggaccggtcggtttttttttcggtttttttcggtatttttcgattttcggtttcggtttttaaccgaaaaaaaccgaccgagaaatttttgagtttttcggggtttttcggtttcggtttttttcggttttttaaccgaaaccgttcgaccgaaataattaaaaaaccgaaacaatcgaccgacttttttgacaaatcagttggccatttttttaacaaaattcattaaaaattcttaaaattttcctccggcggcgctctacaattttactcagaggtgatctttcgctttttctattgataaaaatggtttattgttttttttgggaaaagataaaaaaaatcaaaaaacccgaaaccgaaacggtataccgaaaatttttcttcggttatttcgatttcggtttttttcggttttttaaccgaaaccgttcgaccgagaattttttgagtttttcggtttttttcgatttcggtttttttcggtttttaaccgaaaccgttcgaccgaccctcttgtccggtctctaattaatatgtgtccatgaattttcacgtctttttgaattttagaacataaaaagttagcacaaaaaggcatatacatactacaaaacattaatattttcaaatttggaaaaaatagtaatttgaaataatgtattagctataaattttcaaatttccaaatatttttatatttccgataaaaattaataaaaatcaacaaaatttaaatgctgatcactgaaatccataaatttataaaattttcaaaaaattttcagctccttttgattgtcctatgtaaagaaatgcgtgtaaaatttgtgcaaatgaca

SEQ ID NO: 20766 - DNA, 1027 bp, Heterodera glycines
  misc_feature (13)..(13): n is a, c, g, or t
gcagccattagcncaagtgcaagtctggccattcgtcgatgagatggcaaaaacaacaatcaacaacaaaagaacagtagtgaaaatgatttgtgagaatttgttcattttttgtcttttacggttttttagcgatggaatgaaataaaattatttttaattattttatgcatttttaaaaattgaatttgactttttatatcaaaaaattttaattaaaagccaattgatgaatgaataaatgatggaagcagaatttgatatttaaagaaagaaaccatttttctaaccttttgttcaataattttttgcgatgaataaaacattttcaaacattttgtaaattgtatgaataaattgtagatacatatattattttacagaattaaattaaatcaattaaaaaaattatttccgaatttcagaacgaaatgcaaaaaaaaaaaaaaatcctttcccatccaaccttgaataagtcataagtagggatgcgatttttaggcacaaaaaatcgcgaaatagacacctaaaaggcagaaaaaaaatcgcaaaataggcactaaaataggcaaataaaattttttttattaacgtttttaggtagtaaatcacgtaaaaataatcaaaaaaacttaatttcgcttatattccaattgttttaaagttttttcgaataagtacagatttttagccaaaaatttttatcatgaaaaaaatattaaattcggtgatcaattttttgaaaaaatttgttcaattcttagaggtgtattttctgaatttttttttggggggtcattcttaggggtgcgtttttcttttttattgcatttttgttaaggatttttataaaaatcataaaataagcaccttaggcacaaaaactccaaaataggcaaagttaggcattgtaaaagtcatcctagacaccccaaaccaagcggaaaatgcgtttttcgtgtttatctctgcctattatgtgcgcaaaaattttaggcatttgcctaaaaatcgcatccctagtcat

SEQ ID NO: 20767 - DNA, 2402 bp, Heterodera glycines
tagctttgagtgataccaagatctcccaatttttttttactaaaactaatattctcaaaaaatatattaaaatattaatgctttggaatggactctaacctaagtcctgcctttactatcttaaccagaaccacaaatcaactttttggtaatggagttttttggcatgctgtgtaaaattgttaaaatcgacctttgggtcattcgtcatggttaacaatgagtaattattttaatgagtgaaacttttacggaagcaaacggactcagaattatagaattaaaacaaatcaaaaatctttttaatgtttcttagaatcccaatgtaaaaagagcggagaatcgttaagaaaatgaaacactcatagtagaaaggactttggtccattagtcaagcaattaggtaattttatttttttttaaagaaatcttaaaccatacttttattgatgatgagccatgatttattttgcgattaagcgcctgaaaatccgtgcctttttttatgacaaaataaaacaatgtttacaacattaaaacaaagttttgtttctagacatccctgttgatagaataaattaatccacgtcagttttcacaccgactttcgggtattcagtcgaaatctaattatttatgtatccataatttaatttcctatgacttcggtcaatctgtcacgttttgatgcttgattattttttgattcattccaactcaaaagtaaatcaaagtttgaggacaaacttaaggaagggtggacgtgtaaagcgcaattaatcacatccgttttatctctttcccaagcacatatccccgctctcttccattccattttccgttccataagtccaactatttaatcgggagcattctctcgataaggagtcagttgagtgggcagttaatcggcgagcgagagccgagagcaaagcgcggcggaattattattttatgtgattggccaatatttatcttatattttactccttctcgcccatccccgcacgcgtattcgatctagtgggcgcccaagggattaccaatttggggaggccatttatccagggcccggattttggcttattcctttttccccccaaatccaatcctcgttctcactcgttcccttcctcatattctgggctggacatcagcaccttcactggtagcaccggatggttgctggcacgccgccggcaatccatccccaggaggacgagtgggatttgcgcgtgttggggaacgagaatggaatgaggtgcaccgctccttcgggagatcagtcatgttcggatcaaaaaaaaattaaatggccaatttcgaaccaatttgaaaatatttttgccccaaaaatgggaagtctatttttaattacaaaaaaaaaaaaaaaattatttttgcgccagaactaattgcgccagaaaggcaagtcaagcgccgcgccaaaacgacaattctattattttgccccaaaatgggaagatcatcacattcttattgctcccaaaatgggaagactgaattttattaaaaaaattgtcaaattcattttgcgctaaaaataataggccaatttacatattttgagccaaacggcaagtctaatgttgcgcccaaaagcaggagtcttttttattgcgccaaaattcgtttctatttgctctgccccattcgccgtgaccattttataagaaatttatttattcttctcgctctcttcgaatatttgctaagaaataagaattttctgtattcctttttttgtcagcaaaaaaaaaagtttaatattgaactcctttgggagtaccgtcaagtaagaggccaaaattaaaatttgtaaatcaatccaagataatccgtcagattaaataaaaatcttcgatatgctttaattacctaattgctgagtatattttgttgatttttaattaaatttattttgttattttattttatgctgacaaactttaatctttacactttaaattgtttaatcggccaaagttttttttttctctcacagtgcattctccgagtaccggaaatccattacatccatctaaagacaagcagcttttatctattatatgtgaacgttcttgcggcaacaaaatttccttcactgtttctgatcagtgatcactcattttaaccaaacattgccgaagtaacaatcattagtagggatgcgatttttaggtaagaaaaatcccagaataggtacttaaataggtaaaaaaaaaaaatctcaaaataggtattaaataggtacaaaaattccaaaataggtaccaaaataggtaaataaaaatttttattaacgattttttagtggaaaaaagcaaacaaagagggaaaattaaaagctcatatctctttgtaaacgaaaatttaaatat

SEQ ID NO: 20768 - DNA, 3024 bp, Heterodera glycines
atcacttcaactgaacttggccaatgaagttttcgacaaactttaaatttacataacattttattccactccccaatctttttttttgcagaaaggggttagcctgtcattatttcttactaaataagaatgttttttgtacgaaacgcaaaattgaaacgttgtacgaactgctatcgatccggtaaaaatattacaaacatttcatattaacgtcgaaaaaccgacaattataaacattcacacatcattttatcgtaaggaaaaaaccggcaatggcacattacatctgtgttgagcacaagtgcagttagatacattgtgcaccactttgaaatgggctaaatgaaaaacaaaatgaaaacaaaatatgagtgtatataagacgaccccttgagtgtttgaaaatatcgctcagatgacgaaggcgacgaatggccgatgaagggacatttgttgggccagaaaaacggggccgacgatgctgctccgagaagcagtccaacacaaaagcggcactaaacagttgaacagtgataaattttcaaaatatcggcgaagctataagtcccttttaaatgaaatttgataaggagggagatacccccaggaaatttacatttcctttcccagttgcctagggttgtacacatcggagaagggctttgcgccccccccctcccgcagaaactttttcgcggtcgaccatttttttaaaattgcttttcaaaccaacttttttacggcgcgcgctttttccaaaaacttttagggattggaaggaggagggggagatccgttcggtttttcttcaacccttttttctcgaccgcccccccccgcctcgtgcgactgacgctgctgccctcctaagctcggcggcatgaccccgggaccgatccggtccacgtagggaagccgggaaaaagctaaattcccaaaaaaactaacattcttcaaaaacttaggttccttgaaatgttttaataatagttttgtcagtttaagctaggtaacggaattttaaaaccctttcccgtacaatcctatatagcctgttagataaaacactaactagtcaggtggacattccttttgaagcggaagaccacgatgggtaagacgaaaggagtcgcatatttcatcaaaggtttgctgatagtgtggttcggcgcccaaagttgcacattcccaacaaaggaccccaaacatcctgttttagttgaattgccgcattagtttattttttaccaaccaaacatcgctctctggtctatgttttgcgtttgtacggtccgttgaacagacgatttcaggcggaagccaaggaattggcagacgcggaccaaagtcaattggcaaaccaaaatcgcccaattttgcgacacatctaacaagaagaatcataatgttgaatgttggctcctttcacctgctcaaatttctttcagtcagcaaaatgtttctggctgccacgtcaccgtgagcgaattcattgccctgaaggtcacgactttcgtgtaagaaccttaaaattagtataaattgattaattttgagttgggaacacttcagagcgttgcccacttgagtcaacacgtgcacaatgtcacggacaaacacacgcggcctttctctttcatcctctttgcactgaaaagccttccggtcaaaattttgatcgtcaaacaaaccctgatctcttcccggaaaaactcagccaaactcccgccatgaagccattccattgcgaacattggccgaaaggcggagaatgatctgaatgttccatatcccaaatacaaacggtcaaaaaaacagagatgcctgccaaaatggttaattatatgaaaagacactaaaaagtcgaccggcatttctgttagctcgaatattcttcgagtcgaatagctcacaacacacagtttgcttacagcaatgatgcgtacaatattcgcatggttcaatcgtgccatcctcgctgcttcttctaataagccaatgcttttttggggcatgggataactcatctgaaaaatatttcgttgatcgcctctgtagctcagtggttagagcatctgtcttgtaccactcagtggcagacaacagaaggtcgtgggttcgactcccatcggaggcacttttcttttttccatatttacgaaaaaggactaaaaacttaaatccctcacatcccaagctgttttttttaatttaagtttccgtaccttcacagcggcgaatactttttgcttgaaccgagtttgtgatttgggaacaacgtactgaatgttgaaataaaaaagtaattatcgcggatctagaattataaattacaagctataacttttatcaaaaagggctggcgcgaaaaaatagcgccatttctcaatgtatttcgtattttacccctttgaatacaaagccaacagctccttggccgagttttatatcagtaagttcgatattgcttaaataataatgacagacaaacaatattttattcagttaaaaaatacatgtcatccaccaacaaatggtccaacgctttgaaattaaaaaatatataagagtgactcgtattataaaaaataaattttacctctctttaattgtttaagtcggccaatataaggataaattgaatcaggagttgggtgacaaatgttttttccatctataaaaacgaaataaagaaattattcatttcattttattatacgtttgcacatccacagaagtgttatcaagtaaagcagaaaaagtgccataactgtggtccaaggggttaaattttcgctgcaaaatgggacatatcgatgcaaacggttggttaaattagttgttttattgttaaaacttgttgagatttgaaggaataaaccagcagttgttatatttgaggaagtgttgctttctgatgtcaacatttcaaatcttccataattttaacaaagcaaagttcgaacaatgtcttttattggtcacagttttttaatcttttctgaaagttcttattagaga

SEQ ID NO: 20769 - DNA, 1528 bp, Heterodera glycines
ctgtcgaaaatcgctaattctagcaattttcgatgtataagttgtctatgctttcttttccgaagaacgcatagaaagggggttctctcccattggtcagcgtttcattcttttttatttttgctgaacatttaacaacaataaatttgtcttacaaatttcttgtggggagggaaaaactttccttgcctaaggcacgaaaacaacaccgagtttctgcccccttaatcaattcgaatctcggggatcggggaatagcttattgatttcggcacttcaaaattgcgggactccccctcccgctgatcggaacaattttctgatcagtcccaaaggactcaaagggacaaattcgatcaatccaattttggactgatcagttgtaaatttcgcctcatttcaatttgttgtctgattggctttttagccaggctccgattgccccatcggaaaacccgttagcttttcagcgaccggtccatctcatttgtttttcgtggttacattgttggcatttctgaccattccctttcccctttttggaatctgatcaccacgcctgatccacctttggactctctgctcttcacgccaatttgcctattgatgccttggataattttagaaaatatacccttcggcgcaaacacaactgattagttcttgtcaataattctgcattttcatgcattataaatgttatatcattatttcatttaaacaatgattaaaaaagagtttcttaactttaccataagcttaaataaacaaatatttattataaatccctttattagaacaatatgtcagcattttattttgtatatgaaacctactaaatttacaaaaccaaaattaatgcttgaaaatagttatcaaatgtttactgcagaaaaattacatcacgatataatatcggaggtgcaaaaagagaatagttaaaatatacattgctttaacatattaaaaacaaaaaatttccaaaaatctggttttttgaatgaaaataaatttatgttttttgtactaaaataagtttttattactttttccaatcttttgaaaaaaattccaagaggccggtgctttttatttcgctataaaaattgatttttcgtgcttttcttattgaattaaagctgtataaaaaaatattaaaaattaaaatcccagccctgctgatcagcctaatataaatcgtccttggtccatttattttctatgcccatcattctctcccttgctatctctcacgcgctccccctttctcttctccctcccccatcccttctctccctcccaacctctttctctccccatcgccctctctcttttaatactagctctctcttcccctcttctctctccgttatctctgtctctatctacatcccttctttaaatcaatataaaaggaagcggtgcgttcgttccattgccattgtcctcctccaattgaacaaattggttcttctccccaatgaccaccatttattcgttcgttatttttgcatagagcaaatgtcca

SEQ ID NO: 20770 - DNA, 2121 bp, Heterodera glycines
  misc_feature (2056)..(2057): n is a, c, g, or t
cttttaattgaaaattaattaaagcagtaaaaagggatctattaagagcagttatcgcaaagattgggggagcggagatggggattattaaaataaatagcctccctccttaaaatgtcaattattgaaaccaaattaaataataaaatgggaccgaaattccgagaatgtccatgaattccttggtctcctccagtctccattctggccgcgtttcctgttgagttcgtgccaatactaacgtttgtgcgttgctttgcaaggcgttcagctggatgacggctttctggaaaattaaaattttatttttttttaaattttggcaatgtgtgcctcgtaaagttgctgctcatcgtcgctctcccgctgttgggtcatttccgaagaagatttttgttggtgatttgtactatcaaatgtggaagcacttcgaagaaaaagcgctagaaaaaatatattttttaatttgaaaaatttaaaatttgaaaataaaaatggtattaattgggttgacttaaaaaataataattaataaaatcaaaaatgtttccatttattaaaaaacaatttcaacgacaaaaatttttcaacgacaaaaattaagaattttcatataaaaattgttgctcaatgcgaaaaaatagaaacatcaaataagaccaatgaaaacatcatttgtcctatgaatatttaaaagtttaattttaacaaatttacagccaaaaagttacacaaaaattgtaaagaatttagaaacaaagattttttaatgaaaatactgactttttaatagttttttatttaaaaattgtacaaattgtaattaaatgattaatggaaaaaaagcaattaatttgtgacggtcaaatcgattcaccaccaacaaaagtgaaaatgtgtacacaattttattgctaaacacaacaaataacggcaaaaaactatcagcagatttcgttttggtgtaaaaatggaataaaaatggaagagccatcgaaggaacactttgccccccccccccattaattgttaattgtcccacaattctccgataaaaatattacagcataatattttatctaaataaaaataaacattatttctcatttacttttcattttatattgtattttggcaccgtaaaactcgagactgaaacccggaaacataatcccgagtatgatccactaagtaattgcattgtgactctgtcccaatttaagtttaaaaaaacaacttattaccagggttagctgaaatttttaccagacacagcctctcgaaaaatattaatgacaaataataattcagagaaaaaggaaaaatatatgaaaaataaattggccaaatttctgccctaaaatacatatgtaaattcaaaaattcaagcacgataagtttttggagaacaaaatcataaataattattgaattaaagggacaagtgctttccaaattcattggtagcgaagcggaattcaaagttgctaagattttaatgtaatagtactgtaaaatttagtttttcagaaaaaaaaaatactaaatttccctgataggactccctgtagactctgtacagtatcctgttgtactaccgtaccgtttttcgctcgtctaagtcggcaaaagcggaaggaacaatgctgataataatgatgagaggaatgaatgcagcaacagcaggcgatggttgttgatgaaaatgctcggcggaatgctgcgccgagcacagcggcgggcgccggcgccacggggaaaacggaggcaaaacgacgccatgggaaaatgaccttcaacgttgtggtcgtcatcttttaattattgtaatcaatcaacaatcggctgttttggcattggggaattattatcgtgatgatgacaataaattatggcattatttttggaagatttggcacttaaaaggctatagggattagtgttcggcaccgaattggtctctggccggatttcccggactcgagccggaaatccgggttttgaggtccactgatttcccaggattatgaattgaggggtcgggagagagtaaccnncaataaacagaaaattggaatcctttttttggggattagggcaaagtaaagctaaatcccaaat

SEQ ID NO: 20771 - DNA, 1564 bp, Heterodera glycines
  misc_feature (27)..(27): n is a, c, g, or t
ggattagggcaaagtaaagctaaatcncaaattaattcgctttacaacggataagttcaacccgtttaaaaaaatgccaaaatataaaaaataatttgtctaattatcaaaatcaaaaagatatctgtatatgcttatgtaaaaacagaacgttccaccgcacattcccatcaaaaaatttattccctcatttactgataagaaaagcgacaattgtgaagcaatattatgtgtatgtatgtgtcgaaacattaaaattgcacaaaatttagcaaaaaataatgttttaaaaaattaattgcgaaaagctgaaaattaaaatggacggactaaaaaataaaagagcaatatggtaaatatatgtattggtaagctgtgtgtgtgtgcgctaaataatatgttgtttttgttgttgctgctttatgacatacatattgagattaatttaaggaaaaagtcaaaattatcgattgatcgctgctatggttaataatcaataaatatcgatcgattgattggcgctcatctgtcagttcatgaacattgagtgcacaaactgttcaaaatcgagcgcattttcaatggtacggccggacgccgcgtccacgtagggcttcatgcgctgtttgcagtattgcgcttgttcctgggtcaaattctgcaaaaaaaaagggagggggcaatataatattaaagataaaattagaaatctatcaaaaatttttagacaaataaaaacggtgccaggaggggcagcaacccctaaagaccccccgcaaccgaaaattttatgtaaaaatattatttttagtgaaaatctttaattttccttattggtaccattccaactttttaaaaatcactaagaatcaaaatcttgaaaaaacccaaataaaattcatttaaaaataaaattccatcaattaatttaaatattcttcctgcagaacaaaaacatgccaaaattacatttataattagttaattttaaaaacgcaccgcgaacagttcttccgcgaacacataggggcggtactctttgctgagtgcgcggaatgccatctcaatttcgtcactggaccgcacattctccgtctccttgttgatcatgaacgccatgaactcctgcagggtgacgtaaccatcgctgaaaaaatgaaaaaaatttacagaaattttttaaaagattttattatatttatgaaaatatcttctaaaatctgacataacccttacattggccttatgaaatttttttaataaaaaggaaggggaaaatgcacccaaaggaatgtatttcaaattttcaaaaaatacacctaaaaattgcttttattcattttcttttcttttaaaaatgaatataacaattttttctagaaaatttttttttttgaacatgaacgtcatgaacccctgaagggtgatgtaagtatgctgaaattttcaaaaaaatatttgttgatcaccaatcagaccttgacaacgagattctgtaaatcttaattaaaattctcgagactacaaatgcattggctctattgcactttatgagtcctaatca

SEQ ID NO: 20772 - DNA, 1810 bp, Heterodera glycines
  misc_feature (838)..(838): n is a, c, g, or t
  misc_feature (1793)..(1793): n is a, c, g, or t
tgtggccaatgcaatttttgtgagtttattccatcttttttgtactttgattaacccagaaataacacagaaatgtgacgtcgacctacgtaaaactctctatcagaacattgtgctcagcggcggttcgacaatgttcgccggattcggcgacagacttttggccgaagttcgtcctccccttcctcagggacggacggttccgggggagggtacgcgggatacgtacccccttccccccatacccctccacattcggaactcgcctgtcggcaccgccgggacgcggggacgggacaaacgccaccaaattaatcaaattttaaaaagaaattttttataaaaaagtcaagaaaacaaataatagtaattcgtcataaaatttcgaaaaccgataaaaattcttcaatttttttcttgaaatttcttataaataaattttcttagatttcacgaaaaatttcttttgtaaatttggaatgttttttaatccccgcgcgagattttgaggtaaagccgccggacaaatcctgttgctttaaaattaaaaaaaagtagtccacacgaggatggtatcccctcccgaaatcccgggactgtcccttcccttcccccccctccctttttttattcccattttccgtcattcacttccctttcgttttgccagatgaaacggctctgtccaaaggatgtcaaagtgcgcattttggcgccccaggagcggatattctccacttggattggcggttccattttggcgtctttggacacattccgcaaaatttgggtgacaaaacaacagtacgaaaataacggaaagataatcatggcacgngaaactttttgatggatgcttcggtgggaggacagccaaattcgaataaaatgatcaaatcagcaaattccttttgtattcgtaaataaattaaatatgtattcgccctttttgacataaaaaatgcttcgctttgattccattggacttttgccattgttttgtttggtcctctcaaaaatatgcaatttcctaatttgtccatttgtaaatttgaaatttgagcttttctttgtccaaaatcattttatccgacaaaaattgcataatggataattggacgtgcgcatttgttttgtttgcctttgctatttatgtgttcaccagcagcggattttgtcattgcaatgaatgaatgatggaatgaccttgggccgagggggggggagaaaaccgaaacgaaaatacaaaagaattgaaatgaattatgaagttatacggaagaggggaggaggacagacaaaataattgggcaatttgatttggattatgacacaaattgaaacccaaagcgaacgatggattgtcttttggcttttgctctgtgcccttttggcttccgtcctccgctcccttcccttcccttggctttctcatctccgtgcttctcctcccgtggtgcccctttctttggcatttgtcccttcgccctttccttccgccgtttcttccgtcgggattgcgttgtttctcgtcgtgaaattcggctcaacttttttctgtttcatccttctgttttggaaccacgttttcacctgcaaaagcctttcattcgctgcttccgtctcccttttttggcctttgtttgttttacttgcgtttcgcttagacttaaaacattcgccagcgcaatgcgttcgggagttgacagataattctgctcgttgaatttgtgctccaaccctttgggaaataaacgaaaaatgaaacgcagagtgccgaaagcattctgtcnaacgatcggcgccgttg

SEQ ID NO: 20773 - DNA, 1941 bp, Heterodera glycines
  misc_feature (156)..(156): n is a, c, g, or t
gatcaccgtgcaattgctggtccgaaaacactgtccgtgccttgcgccgtctgtacgatttgctgcccgggcctcttccccctgtgcccattcccttcgtccgccattccctctggccgaaccatcgacggatttccgctggcagccaccgcagcnggccattgtggcggctaatcggagtgtttcgaagtgaaaaagacgcgaagttgggattggccacgggggagggaaaggcggagaagcggacggtgacggaatggcgtgagggagcggaagaggcgcagagagaaggacattttggcactcgccggaggggccttaataaaggaaagcaaatgccaattggggggaaaggaaagtgccaacggagggaagggaaggcgaactcgccatggcaagtcaaacggaccgccaacgacgaaatgctcaccgttttggtgctgtttctcttctgtcccttcttcctcttcccatcgcttcctttgctcttctccgaaatgttcgcttttttccccctttttctgctgccgttgcaaaatcgtctcaatgttcaacgcacaatgcaaattcagcggaggacggagcatcagaagagcggcggaagaagcagcggagggcgggcggacggaggaggcgcagggaaaggcgtaaggtgagggggaggaggacgaacacagcgaagtgaccggcccattgggcggagggtgtgccctttggccttccgttctccgcgtctccgtttccgtgtccatcttcggcccgtcgtcctccgtcgtcgtttccttttgccattttccactttgtctggtgccattggtcagaagcagtcgaacgattgaaaatggcttcttctcctctgccgattcgcttttttccctctccgcaatttctccgccgtttcgcctttcatttttctgaatgctttcttcttcgtactgctccaaattgtgctgctgttttcgatgcttcacttcctgctgcccttcgctatgatgagtaaatgcggaggaggaagaggaggaaacggaggagccgcaaaagccaagcaaaaagtccattttgggtgagaaaccgctaaatgggattattacgacaaaattactgggcaaaatatgctaattagtgctctgccacccattcgcctgccgtgggacacgtcaatcactgccaaatggcctattggattggacatgctcaacatttatgggaagcaaatgaaaggcgtttcattcgtactgctttgagttgtcaaaagttgcgcgaactctaagcaatcatttcaatgcgatcggtgctaattgggcaattaatatgccccaggggaaatgcaagtgaagaaatacggcatgtccgccagtaaatctgcagggattatttgtggtggagtggcgcctccgcccattcactcaaataattaattatgcgtgtgccgttcgccatttcttcgcctcagcagcccatcagtgcccggaggggcggcgcttcggccgtcggttacggtaattggggcaaattggccggatgaatgggggcgatggaaggagaataagcagcgcaacctaattagtttaatttgagcatcattattgaggctctttggagatggaccaattttctcggatttcctcaaaaatatgccaaaataatcgcggtgttttcatcgccgaagggctaattgaggcggtcgagagtgtcgagaacggcaaattggagacgaaaacattgcgcaattgcaggacaaagaagacgcgaggacgtgccaatcgaaccaaaaattcggagaggaaagttgtggcattgaccaaaagggcacagacaaaatcagtgtcaatgcccaatccacgaattgtcctcattatgcaattattttttgttgtaatttgttttcccatccaatcactcagcgatgagttgctcttttctttgcggaggttttgctga

SEQ ID NO: 20774 - DNA, 2090 bp, Heterodera glycines
ggcctggcaggtcaataaaaaattaaacaaataattttcttcgtactttctccccccccgttggccaaaccgatggtaaatgatgttgtccttctaatgaagaaaacagcaattaaattctgcaataaaacgaatatcgtctggtaaaaaaggccaaaatagttgttaaaagttcgaaaatgccaaaattgatgtgaactaacccccgatataggtgtttttaagtgctaggaagtcgctaaaaatcattggtttcctttattttgaaatccataaaaaggacaataccgttaaaattaataattcaaattaacaaaaataaaaataaattaaaatggacaaaattcttattttcatttcattaagtatttttctttttttttatcacagaaatatgactaattaatttgtcaaaactttttgttagctgtcttttttagttatctacttagggtgtaacatgagtttccgcacaatttttttttgacaaattcaaaaattcataactccgtaatttctgcagttattttaataattcttattttattttgttcgtcagaaagtcttctttcatttcatgccattgtttcattttttatttgcttattcaatttttttagtattttttcccgaccatgcaaaaatacttgtaaggctaatagagcttgtgaagtgctttcgaatgataccaaggttgtttgatttggtcgacaatgaaaatgttataactagggcgcggattcttaggtttttacttattttttctgcgcctttaactcaacgagaaatgcacgaaaaacacattttttgttcggaaattcttcgttttaacgcccctatccgaccctaggaatccctattttggatattcgctcctaaaaatccctattttgagtgttctcccctaaaataactttttatccctattttggcatttcgctattttcgcccctatttcgcgaattttttgcccttatttaggtccctattttgggctttttcgaccctaaaaatccgcgccctgatttcaatatcaattataaatattttcaattacatgttatgtttgacaacatggaagacatttattagcaaaattcgcttaatgattgagcaacatggaatccattaagtgttataaatagggtcggcaccaggagtgcagctcggacagcgcattccatcatttgcggcattttttctgcaacatgcgattcacgaccgtagcaatttgattccgcgacgcgggattttctgtccgcgctccacccctgaacagctaaatcaaatcattcctaaaaaagaatttaacgggaactttgctctttattaattaatctatgaagctcaagtgcaaataataaacaaatgattgaatgtaaaaaaaaaaattagattttacaaaaattttattataataatttttcttttccaattttgcaaataatattaatattcatttgaatataattttctcgtaataacgtttaatttgacgtcaatcaattcatctgctttagattgtaattcaaatgatattcacatgcttttcaaatgtcaatgcaaaagctcaaacaataatttattttatttttaaataatactttttacgtcattgaatattatgaagaaaaaactcattattttttcatattttattcatatgcaaggaccattaaattcacgaaaaattcattttattattcatttaaaattagactttatttatttttcctgttttgtatttacaaagattaccctaattattttttccgattcttgtagacatataactgtccattaagtatctccttcacaaatataaatatgccgcggcaatcacgaagacatacaattcataattatcagtgaatcaattttaattaagaaaatgccattattcaattttcttcttccattggcattgtgttgtagtgccattttggcgattggtattccaaatgagggtccactgcgtttcggcgccgaccgtttcggcgccagctcagtttttggactataacttttttctttgtcaaccaaatctaatattgttggtatcaaccgaaagccctaagtgttctctatta

SEQ ID NO: 20775 - DNA, 1451 bp, Heterodera glycines
aaaacgctaccgaacaaaatatgagcaaaattgaagccatttcgtgtgctaattgtttaaaagaaaaggccgaaaatgagaaaattcatcgtgagtattttgcagtaaattttgaagaagcatcattaattaattaattaattaaatcatcattaattatttaattatttttgtaaatttatacttaattttcaaatgaattttctttcttatttttattaatgttattaactaaggaatgctttaggaacagctttttcagcggcaagagcaaatgttggccaaaattgacgagttacaaaagtccgtttttgcattaaaagaaggacagagctcaattggtgggttaaatgaatgcttaattgaattaatttgtgaaattattttaaattttcattttcattggggaaattatcggaagtttaaaaaatttattgacacaaaaatagggttcgagccccgtggcgcctatcgacaccgccgggcccgaatttaaccattattttttgaaaatttgacccaaaatggcaaaatctgcgattttcggcgcaaaacctctactaattcctgtttttgcctccgtcgctgaagattttggaaatattactggtgcaaaaaatttttgttggcccgaagagcaagaaaaaaaaaaagctcttcgagtgccctcgccgaaatttttttgtggatacgggcctggcccagttttaggcaataagccaatgtatcaaattggcattgaaagcgccgctatgcgttttcgtcgggattttttttgagttactaaatttttgaaaattcacacagtttaatagggaaacgaatctttattataattcctaatctgggtggttttgttattcgataactcagaatttcaggaaattcgactttctcgtgcccaactgtcccctttggttggtgccaatttggtgcggcgtttggaaaagtgtggcacggccggcgaggcgatgaccgaactgttgaacagcgtcgttaaaatgtaccacatcattgaaatgtaagtccggtgggaatccgtcacggagtacctacccccccctcccccccccccctcacaaggggtaaaatttctaaaaagaacagccaaataacgggctattaaaaagacttttccagcatttactcccccttcccaagtctcaaaaacccaaaattatgggactatccgttttttatcttggacatcttttgaagggcttaaatgcaattaaatttaaatcttcaaataagagattttataattattagaattttaacgcagaaatctttttttgagcccctttattcaaagcaaatgcgatttacaagccaagtcatcaataagcacttcaaaaactttacaggtataagaagcgaaggaaagaattggacgagcgattcaacgaagtcaaacgaatggcggatgcaattaagtgaatttgccctcc

SEQ ID NO: 20776 - DNA, 1133 bp, Heterodera glycines
  misc_feature (162)..(162): n is a, c, g, or t
  misc_feature (167)..(167): n is a, c, g, or t
aattaaaaagaaataaatattctaagttttaataattacctaattttcaaatgtacaaaattcggtcaaaaaatttattgagcccgtttattaataaggtgagctatgccattatttattatttatttatattattatctttttttccattattttcttatntaatntaaattggtttatactggacttggaaaattgattttttgacgctttccggcgctttttagcaccgcgaatttttccattccgccactttttggcgccgttgttttccggccattttttttcattgtttgcggaatccagttctagtttagcctctatatggcgttagtttttttgttgttgttgcgtattttccttttttttgcactaaaagcgcttacgataatcacattgctgtacgattttctaacaaatattacagtacgcgttttacagttgaacacgtacagtaattattgggatatcgccgcgtgtcaccccaatttgctcatctccaactcggcatcaattaatgctaatgccccactgaacaaagcacagcagctactaaagagcaatatcttcacagctggcgctgcgattttggcaactttgcccggatatgtgcgcaaaagtgtagtggtcaagcataacgggaagaacagcggtaaatgatggtgacgaatgttcgagagtcaatcccgggttttctcaattcgagaatttctcggcctttttttatctttcatagccttgacggctcgagatctgtttttgttgattagaagtgctccttatatatttctgtcgtaattacctaaattattttatcatttaaattgccaaaaatggaaatggaaaaaactttttcgacaaccaatgctaatgataatcaaagagttatttagttaaagatttttatgtttaattttgcggtttttaatttatttttattttagttgaaaattaattgtattttcttgcataatttttgattttaatttcattgttttgtttgttttaggcttttgttctgtgttttccaaaatttcaattccaaatggatcatttttctattacgaagttacgattctgcacaaacattacgagtatgttaatagttaataattaaatttacatcagttatt

SEQ ID NO: 20777 - DNA, 1694 bp, Heterodera glycines
gcttctcgagatgaatcgattgatatataatttgcgccattttttcaagggcttcactatgatatatccaaaattaagcaattgatggatccgagaaacggcttttacgacaaaaatgaggacaaagtgactctggccattgatgtcattgtggggcaagcagaaatggacagaccaatttctgctgatcaaagcaaatcgaaagggacactttttatggacattgaaaaagtgtcacaatttgcgcgagaaatcatttggagtgagcgcaaaagcgaaactgtgacgtgcttagggggacttccatggaaaatatccgttcaaatatttacgattatgggaagtgccgtcaaatgtttgagcctttttctttgttgtaccgctccaaaagaaggtgaaattcaaataatcatttgaaattatatttaaatttaagacgaaaattggagagccgaatgttcggcaaaattccgaattgtttcgcaaatgagcggagttggggaattcagaaaggaatttgagcacactgtttttaatagcgaaacgaactgttggggattccccgatttcatcacatttgcggtgagaggccaatttgacattgcttaattgacctaattatgacaattaaggaattaatggacccgggccgaggcttatacgacagagaggaggacaaagtgacgttggccatcgatgtgactgtgatgaaagagcgaaagggcacaaaacgaaaattggccgttggaaatgcccacccaatcattaatttgacataattctgtttttgtctcccatttttctctcattgaattgattaaaaataatttaaaggattgctttttagaattagtattcttggactggctaaatactaatagaaacggtgagccccctgttttcttttaaactttttctttaaaatttacactttcaatgaaattaaattttaaaaaccttttttcctcaaaattccagtccaaaaaattctgacgccggctacaacaaagaaattgcaaattttcttttgaaatagaaaaaaaaagtaaaattccgtaatggattttgaccacgtccatcatgtagagagagtaatcgatttactcataaattttcgggattttatggcccagccaagtaacagtttcagaaaaaatataaattaaaattaaaattttaaaatattttgataatttaaatcacaataaaattgagttagactgtgtattcaatacataaaaatgatcaagaaataatgctctttcgaaaatataaaattagtaacattttaaaggcattttgaaacttcgatgacctcaaacgaaaagaaaaagattcattaatattttattatttttctcctgtaagttatctctgactcattgactttaaaaatttattttttcttctctttatctcaatacactatttctatcaatctcttaatcatttttacaccgttaaataatgtcaaacactttggccgatcgaattaaaccgctgttagaagatgccgctgccaaagggaggtgatcccacaggtcttaaaaaacagtactcattaatatctaatgagtcggtgtctctatgcttttacattggattcaatcaggttaatagattttttcatatgttttccctttaatactatgtgagaaggcttttaggtcgccgcaaagaaagtgtcacggggg

SEQ ID NO: 20778 - DNA, 1250 bp, Heterodera glycines
atgaaagaataaacgaaaggaggaagaaaggagggatatttatgcaaaaataaaaaagggttaatccagggttaccctttgtccttatttgtaagatttgtacttatttagctctttgtccttattttagtcttattttttggattcagtgagaaatttagattttaaatgataatttttgaaagaaatgttttttgaagcggcgcctattagaggtgcgccgtgactcactgtcacggttaccgtgaaatcacgggttttttcgatcacggtcatggtcacgattcacggggtcaattcacggtttttcgtgaaaaatttacactggataaaattgaaaaggctcccggacatttcgacaatgaccgtttcgacaataccttttcgacaatgccgtttcgacaataaaagtaaatatatttttttaaataaaattcaaatttctgcaaaattatatggacggtgcggatttgggatcaatataaaaaagtttttttttcgtttttttcaaaatagcattatgagaatggctttagtttatcaattttcggcgcaaattgcttattattttttaattaaaaattgaaacattgttttacacctaaatagttgataatgaattaggtagaagcttttaccctgaaaaaactattcttgattaaaaaaacaatttttttttgttcgaattcgggtctggagttcggaattgggcaaacccgagttaagatccgttatcagcaccctcaaaaacgcctaaaaactggttttgagcacaaaattaaaaaaaaatgaaaattagggacaaccattcttcaggattgccgcctgggtaaaaagaggacactacattaagttaaataaatggtttcattttggatttatattataggtccgtctcattttgtcttctttcttcactattaatagggctcggatttttaggtgctaaaaattcctaaataggtactaaaataggtgctaaaaaagtgcaaaataggtgctaaaaaccccaaaaaaggccaaaataaaaaaattaactacctaattaaatttttctctttaaatttcatcaatattttttttaattaatttattattttttatattcattttgttatatttaatttgatattttaaattttggcgatatgatatagtcgtaaatggtcattgtcgaaacggcattgtcgaaaaggtattgtcgaaacggtcattggcgaaacggtcattgtcgaaatgtccagccacca

SEQ ID NO: 20779 - DNA, 1848 bp, Heterodera glycines
ctatgaaaaaactttctaaaattctttttcttgataactttctaagttagcaaatttaaaaaaaaaatttttctcggcgggaaacgatgcggggggggggacgagctgctcccgtaaaagagggaggtaattgcgagagggaggaatgaacgaggaaacgaggttgaaaagaattggtgaaatttggttatcaataaattcttttttttctaatttttttttaaaaataaattacctatttaaatgaaatttaaagtttttttttttaaataaaaatttatagatatgtgacaatattaaataatcaaaatgattaaaaacaattaacatcggaccctatcccttaaaaaatattgtttttttaaagccctgtgaaaaaaactgcgttaacaaattggggacgggacgaaatctcgccgccgaaatctcgccgccggaatctcgccggccgaaatctcgccgagagaaaatctcgccgccgaaatctcgccggccgaaatctcgccgagagaaaatctcgccgccgaaatctcgccgccgaaatctcgccgcagaaatttcaaaaaaaaaaaaattcaaacttagaaatttttcaaggaaaaaattttagaaaatttttttataagaaaattccaaaaaaaactatttgctaagtttttttgaaaatttttcaaaaaaaacagtaaattttcataaaattttcaaaaaaaaattgctgaaaaatttttcaacaatttttttatttaaattttataaaaaaatttttctaagaattttttccttgaaaaatttctaagtttgaaattttttttttgaaatttgtggtgagatttgggggggtgagatttgggaggtgatattttgtttgggagagatttgggaaggtgagattaaggacggagagattgaggaggtgagattttggcggcgagatttcggcggcgagattttggggtgcaccgtaattttaataatatattatatcctcctctaccaaaatatttttaccaactttcaaaggtgtcgggaataaatcttgaactgatttgggttaaatacggcttctcccgttttaaatttatttattacccagaaatctggttttataaagtatagccgtgcttatttcatttacaatgcattgaatagattaattctttggcaaaatttaagtccgtattttttatgtccaactcctactctgaattctatgcgaaaaatcaaacaaaaaaagatcaaaattcctcgtgccgatccttggtatgcaagatggaagcctcttttagatatacatttgtttgtttgtttgttttccctctttccgcccagcgccgattggcgtacgcttccaaccattcactaaatgcataggcttgcgtgaagctaaccaaaaccacaaacagcctcaaccaaagtctgttcgttggccaagattaaatgttcattaatttttgttttcgtccgactttcctttttttctttccgtctgtcttttcttttctctaattttccttttgcgttttctttcgttcctctcccctctctctcacctccttccattgcatttctttctctgactttgctttcaacttcattttccttcctcggcattcggcacttccaacgttggcatgtgggggaatcgcatggcatttatcttcgttgctagccaccggcagaaaacactattgaacggcacgcataggaatgtattttcctttacattctttccctttccctcccgattccaatatccctcctcaaaaagtttcaatcattaagtttgtaattttattaaatgtaaatctactgcgcttaattgcgaaccggctcatttttgcaaaatct

SEQ ID NO: 20780 - DNA, 626 bp, Heterodera glycines
aaaaataaggggggggggggaaagggagaggtccccagaatgtgggacctcggaaaaaaatcggggggggagagaaggggggggttcaaagatagagtgcccaggaaaaaggatggggggggaggggcgggggggggagtcccagggaatgccacatgatgaggaatgttgaggaaaaaaggggggggggggtgaaagagagagtgccaagatatgagggatggcgaagaatgacggggtggggaggaagtgagagtgccaagggatgagggatggcgaagaatgaagggggggggggtgaaagagagagtgccaagatatgagggatggcgaagaatgacggggtggggaggaagtgagagtgccaagggatgagggatggcgaagaagaatgacggggtggggaggaagtgagagtgccaagggatgagggatggcgaagaagaatgagaagaagaatgacgggggggtgaaagagagagtgccaagggatgagggatggcgaagaatgacggggtggggaggaagtgagagtgccaagggatgagggatggcgaagaatgacggggggggggtgaaagagagagtgccaagatatgagggatggggaagaatgacgcggcggt

SEQ ID NO: 20781 - DNA, 1351 bp, Heterodera glycines
ttgggcgtaatttaattttttgctttttatctgccattctgttatgctcctcttttttgcaaagctgccaaaatttttatgtcatacaaaaggcggccccaactattgagttgttataagcacattttttcataatcagagcattgatttctaggatgagcattttataattgaatattttgctttttttatgcatagaatttttgatttttcattattaatcagaaagtgcttcggcgctttttaggagtgggaccctcccccactgcggcgctgttccctggttcgccattcagtgtccacatttgggcactgaaatcctcacttgcatttttttcaacactgtccccgttggcagtactattagagagacgagagactgtgttaaagagagagacagttagagatgctagagtaaaagaaaaatagtttagagattactctaactgtctaacctattattcaacccatcatactttcccaaaccaaaagtactatatatagcccatttttcattattaatcagaaagtgcttcggcgctttttaggagtggaaccctcccccactgcggcgctgttccctgtctaagggacaggtaagcccaaggtcaaggggaggaggtagcgcttcgacacttgtggtcctggtgggagtttaagactgccttaacaccattttgccattctaaggtgcaagtggctgggccggtgtgccaataaaggccgccttggaagatcactgtgaccctgatggacgacatcagtgcctcttgggtaggctatgagacttgtgtgggtggctttattaaccaagcccccacacgccagagtcctttacgttttttttactattttaaaaataatggatccattcctttacagggactaaaagaatggatccatcctttaagattgactaaagggatggatccaaaaataatgtctccatccctttaccagtgactaaatggatggatccatccctttaagattgactaaagggatgcctaaagggatggatcaatccctttaagattgactaaaaggatggatccatccctttaagattgactaaagggatggatccaaaaatattgtctccatccctttaccagactaaagggatggatccaaaaatattgtctccatccctttaccatggatccatccatttaagattgactaaacgtcttttttactattttaaaaataatgtctccatccctttaccagactaaagggatggatccaaaaatatgtctccatccctttaccagtgactaaagggatggatccatccctttatgattgactaaagggatggatccaataataatgtctccatcccttt

SEQ ID NO: 20782 - DNA, 1771 bp, Heterodera glycines
aaaaacctagcaaaagtatgtcactaattcatccaaatgcatacaaatattgccgcgctgccaatatggaaaaggtcattgcggagtcacaggccattcgatcaaaactcaggtccgcaaacgaaaattgcaaacgtcaaccctttgtaccccccccccccttaattgtcatgaagaattactatcaaatttgagtaattaatggtaaaaaaggatattaaattgttattttggcaaattggaatccgtaaccatgcattcggcatttatggttatttgagaacccccatgactatcgaaataccaccaaaaactcggcaattaaaaagaatggggatttttgctttggtttaaaattagtacagagggttttcttagatgctgaacacaaatttgacatattttatgaccaattcctagtccataactcagaactcaaacaaaaatccaaaactcttggctttttataaattaaatttattatattttggtaactttttgccatgctcctgttgtcacatacgtgatccagtgggttgtgaccttggttctgttccgtattttttgcgttgaatcagttccccttcaagtagttgtttttcttttaatttttcaaaaaatatttcttttccaatggaaattttaaattaattcaatattctgttatattttttcaatttaaatcaagaatcaggtaatatttggtcaggtttttaaacaatatatattaacaatcacacccaaattaaaaaaaaatttcccgacggcaccgatcgtcaccgccggagccaaaattctctttgttttcaaattaccaattgttttgttagtttttagctcttgataaatatgtacctaatttcaaaactcggtctcgaaattatatttgtgaaaaaataaatgcgtttatttttgagaattttaaagaaaatgaaattattactattattttattcagttctaatttttattatcctaattaatccaattgaattaacaaataaaaaagttggtggtttgatgaaaaaaatgggaagaaaaaagagaaataattggcaaattctataaaattaaagagaaaataaaagaaaaaggaagaaaatactcaacaaaagaatgaaaccaaattaattcgaattaatcattattttaccaattggcaattttttggagagtagaagtaaaattatcaacaaaaattattataattgtttctttgcaattaagtgggtgggtttccttattttactcgttaaatcaatagaattataatttctttcaattattaataagaaaaataatttatattcatttatatgcctcaaaaaatattaccatttaatttttaaaaaacttatagatcattttaagacgacaaaaatgaatttattcctgctattctttttcatttagtttttaattgtcaaaattgaatcagcgaatggaaaattgcatcaaaagttatttgatgcaatatttggagaaaaatgggaagaaaaagaagaagaaaatttggaagaaaaaaaagaaataattggaaaatttaataaaataaaagaaacaattaaagaaaaaagaagaaaattctcagcaaaagaatggaataaaattgaaggaaaaatagctaaaaaattggggacaaatcgccaatatattcaaaaatggattaaagaattagggcttaatcaaaaaatactgaaaagctacaagtcgaaaacagatgaagaaaaaatataaattgtgcaaaaattcattaaaatgactaatgaat

SEQ ID NO: 20783 - DNA, 1541 bp, Heterodera glycines
acgatttcatctgatgcttattacatcaaaaccgacgtttatggaaaattttccattttatttatgtaacttaagaagccaccggcatttttggattcaaaagcaaagctcttcttccatttttgcgcattggtatcaaatttcattcatagacaattaggcggtttcataattgattggaatttcaaatttaaaaaggaaaacaacaaatggcaaatggccgaaatcggacccaccgatgcgacgtgcacttcgccactgtacggactctccacgacggacggcacgccaagttcagtcaacgacagctgaacagaatcaacacattggcaaacagttgaaagaatgaatgagcaaatggcaatgttaaaaatggcaattaattaaaaatattaatgcgtccgtttataattaattcatccgcaataatttgtcagatttttccactagcaaaaagtaaaatacgagattttacttgcttttgaacatcggcttttcctttcgcccacttacggcggcgtttgctgctccgacatttgcgcatccgccggcagcgtacgtttgctgagcagcgggcgaagcggcggggttcagcagcgcggtgaccgccttcaaacacgcggcaacgtccggggacaaatccctccgattggcggtcagcaaatccatcaaaatccctcgtgccgaattcacttggctttgaagaagctaaaatggggaagaattggagttaaaagaattttaaaaaagttaaacaaataaaaaggaagaaattgtaaaactaaaatgaaccaattctatttatttatcatcgttaattgaatttaataaaatattctttgttctttgagcgtaaaatgtccaaatggacccgaattaaaccgccgacacaaacgaattgcgcaaattaattaaaggtaaataatgctcaatgatcggacaggtcaaaagtcgaggacaaagattaattttggatttcacaagaacaaataatgcgaaaagtgaggagaaaaaggcggacaaaatggggggggggggaaattgacaatccatcaaaaacggaggtaatttatttggacagggcgacccagccgaagcgcgcgacgactttcaaccatttttcatgttaaactctgtcccccattaatggaatggcttttaaagagtaatcagacgcaatttgcaacgaaattacagtaatgagcagagaaggacaaaaattaatgattaagaaaaaggaaaaaggagggagagagagagagagagagaaaaagaggaatttaaaagcactgactgaagagccgtgtgatccggggaaaacgaaatgccaaaataaatagatatgatttttaagaaaacaaaacacatttaaaatgaaaaaaaattacttccctgtgacttttaacacaaatccgctctttgactgatcagaaaagaaaacaaatggctccgcttctgaatgatcgccggccgacccgttcttccattaaatggtctatcatttttttggtttggccctccgccctcacattccctgccat

SEQ ID NO: 20784 - DNA, 2792 bp, Heterodera glycines
attttatagtaggatatataagagttgagctgatgacttctgtactaaattctttttgtctaaaatgttccaaaaaatttcttggaattttttcctaaattttttataaatttttcggggaagagatatatttattttaaaaaatttttccctcaccatttgagccaacggatgcgtcccgttggggcaacagatagcaggtgagcactttgacgccgttccgcgggtcggtgtccggctgaaggcggagcagtgcttgggactggttctcggacagccacaacgcttgcaactcgtgcagcacatttagctgcaaaaaaatgaaaaaaaaaatttttttttttaaatttgggacaaacaggggagggggggggatttgaaccgaatggcacaaaaaaggcatttctatcacaggcacatcgtaaatcaggggaaggggaagattttgttttttgttaccttgaaaattttgagtaaattctaaaactatacccggacgacacctatcggagtgcatcaatatgccttcgctccaaaaaaaaccgttaacctacccagtgaaaaatttaaaaaatgaattttttagttttcggaaattttctataaattttttaaataaagaattttttgctaataaaaacattaagagaattcgtataaaaattctctttttaatctttttttatactttccgtgaaaattttttttaaatattttttgtaaaatttttaattttctttttagaaaaaaggttttagaatttacaaattcgaaaattttctctgcaaaaaatgaatactgcttcccaattgggtccaactgttagcaattctcgacatatatttaaaaaaaataattaaaatttgggaattttttttccaaaattcagggggtgggagaccgaccaatcgccaattccatcgaaaattgaaattgatcaacccccatttccccaaccaattaatcatcaattgctggctgaccgtgtagggcaaatgcgggagtcggttgttgcacacgtccatcacccgtagacgtgccaatttgccaatttccatgggcaactcgtgcaactgattgtcccgcatggacaacacggtcagcgaggcacattcgcccaacagagcgggcacacggcgcagttggcaccggtccatgttcagtgtttgcagggcctggaatgggaaaaaaaatttgtataaattttttggagagggcggatttagggtgggttcttcccccctcccggattagttttcgctcccgtatcgttccctcaaccctccccaacaatttttttaaatttaacctataaatttttcaaaaaaaagaaatttctttataaaaattgcaagaaaaaaatctttgaaaaattcttcagcgattttttggaaaaatatttgaataattattaattaagcataaaattttgaaaaactcggtgaaaatttttcggaaatttattcattttttttcataaattttctaaaaatttcaagggtgatcgctagaactgaaacgaacttctcccacttttaattgtccagaaaatttgtgtatcaattggcattttatttcaaaaaattttttttaaaaattaatattttaattgtcggctttttttcttgctttggcgtctgacaaaattattttttcataaattacggcactttggaagttgaaaaattttagaacttttttttttacatgccttcaaattgccgacagagctgggcaattcgccgatcaagttctgctgcaggtacacctcggtcaggcttgtgcagccgccaattgctggcgttagggtgtcgatagtgttgtcgtcggctctaaaatttgtaaaaaaaatacatatacaaaaattattttaagccaattaatccaagaaaaatgtcagtgatttaaaattccgaaaaaaataaataaaataaaactgacttaagaatcatcaaccgcttcaggcgacctgaaatttattactgttaatttaatgaaataaaaaatttttttaaataattttctgacaaatattttgaactgacagaagagcagacctagtttgtccattcgaaaattcatcgaaaattttttgtaaaaaatcgctcgaaaaatttttcaaataaaaattttctattgataattttgaaaaaaaatatttttttttttaatttttcgaaggggtgaggaaacgaaacaggacaaaatttcgccccaaattttttctaaaaaaactttcaaacttagaaatgttcaagaaaaaatcttataaattttttataagaaattttcaaaaaaaaaattgaaaaattttgcacgaaccaatggaatttggcaattcgcgcaaacagttgtgggacacggtgatgtccacaagtgcgccgagttcgcccagctcgtccggcaacaggaagagcttgttggaggaggcgtccaactgttccagctttgtgcaacggagcatggcgtctggcaaccgttccagactgttctcgtccacgtacagctccaccagcgagcgcagtgcgccaatttcggggggctaaaataatgagaaaacggggaaaaatgagaaatttgaaaaatggaaatggaaccggccgtcgctttttttttgaattattttttgccatttttaacagattttcagtccgtccaaaaacggaattggctaattttataatttttggaaaaatttttagcgaaattatttggaaaactttcgggagggaagaagccttggagagggtaaaaaaaaggaaaagcgaaaattttagcaaaaataatatttt

SEQ ID NO: 20785 - DNA, 1395 bp, Heterodera glycines
  misc_feature (197)..(197): n is a, c, g, or t
gttttaaaatatcctttctgacttgacttggttcttgatatcgaagctgtttctacgctattctaaaacggtgatacccaaacccccagatttttgaatccggttttcagaaaaaatgcctggggtgaaaacaatatttcacattcactccataactttgtgagttcggcacggatcgagaccgggataagaccatnggaaagagcagctcgagctctacaagaaggtatggaaagaaaaaatagttatttctgggactttttcagaaatcagaattaattctccaatgtggcccaaattttaggcccccagccacagccccttgcttctcccagttttaagtcttggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccccttgcttctcccagttttaagtcttggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaatcagaattaattctccaatgtgggccaaattttatgcccccagccacagccccttgcttctcc

SEQ ID NO: 20786 - DNA, 1753 bp, Heterodera glycines
atggtgctattggatagtccataaaaaacgctaaaaaattacaaaataaaactttttaattcactttcatttttcattggttttaaacattttatatagtgagtgtccgtacacttatgaccatgactgtattttaaagccccaggaattcctaaaaaataatttaaaaggtcatatgtttatggacaaatgataaatcgagaaaaatagttgcccttttgcttgaataaatctgaaacgaactaatgttttgataggcatagcgcccattttaggtggtcatatgtttatggacaaaaattttatttcgcttaactaaatattttgtggccaaaaattctgaaaaaattcctgctaaagctaacccttgatgctgatcaaaaaagtcattacgaatgcacaaacaaatggtgcacgtgtcttttatctctatgcttgtataggaacagaaacctttaattgttttatttagtgtacgtattttattggaatcttttccagaaacctacaaaatttgaattgtgaagggaaataccaaaaatatctgtctttttaataattagcagaaaacaattttcatttaaattatttttttatttttaccataatattctgctaatatgaagattgattgcataaatttgatgtgtcggccaaaagtataaactaatgaggagaaaaaactgtttgtgaaggaattctaaacccaaattacattctgtagccccaattcttcaccgtgacaaaaaggtgagagattaataaaaattgtacatattacgaatgcacaaacaaatggtgcacgtgtcttttatctctatgcttgtataggaacagaaacctttaattgttttatttagtgtacgtattttattggaatcttttccagaaacctacaaaatttgaattgtgaagggaaataccaaaaatatctgtctttttaataattagcagaaaacaattttcatttaaattatttttttatttttaccataatattctgctaatatgaagattgattgcataaatttgatgtgtcgccacaaagtataaactaatgaggagaaaaaactgtttgtgaaggaattctaaacccaaattacattctgtagccccaattcttcaccgtgacaaaaaggtgagagattaataaaaattgtacatattacgaatgcacaaacaaatggtgcacgtgtcttttatctctatgcttgtagaattgtgaagggaaataccaaaaatatctgtctttttaataattagcagaaaacaattttcatttaaattatttttttatttttaccataatattctgctaatatgaagattgattgcataaatttgatgtgtcggccaaaagtataaactaatgaggagaaaaaactgtttgtgaaggaattctaaacccaaattacattctgtagccccaattcttcaccgtgtttccctccatttcttttctttcctctctttcctttttctctccccctccttcctcttccctctttttaccctccatttcttttccttcctctctttcctttttatctccccctcttctccatccctcctagatagtccaatgatcatttctctttcttccgtgtcgtttcccagaaattaattattatatttctcgagagtgcttattaaataaaatttttgccagcacccaattgctttcctttcgcttttccttacttataagagaaatgaaacggcgccgaccgacagagggaaacacaaaatgaat

SEQ ID NO: 20787 - DNA, 1030 bp, Heterodera glycines
aattgagcagaagcgttccaacctttccagggatactccccggtaaaggaataacttacactgaaatgagcgccgagctagctggctcaaaaaaattttagaaaatctgagtctttcgtttttatttattttttgcaaaattaattcttaaatattttctcagaaagggttctgacacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatcttagccccccccccgtggttgggtctcttccaaaagtcccccaacccccaaaggctgccgttcattcgcttaatccaattacaatgagaagaagtgcagaaacattcacctaaagaggcaagggaagttgagaaaagccggcagaattttcacgtggcctcggcaaatttgggcggggattatcagagtccctaaataagcgaacgaattaataagaacagattccgaaaattgccgctggaattcgtcgctaagttaaattaccattaattctaaaaatgcaaaatcattgtccaaatctccggtagccttttccacgtttatccccccccctcccttactttcccacaaacacatacgtatgtacaatgctgctccagcaatccttgtggccattctttttccgactaattaccattaatggatgccactttaccctccccccccctccgctcgtcaatctttcccccgctttggtctttcttcggcgccaattccatgcgtatttatttatttatttgtccacgccgtctcaaccttttggtgagctttgtttggccataattgagttagtccaatattcgcatccccgcctttgttcataggaatgaatgaacgaatgagtgaattgaattgaatgagt

SEQ ID NO: 20788 - DNA, 2083 bp, Heterodera glycines
  misc_feature (1931)..(1931): n is a, c, g, or t
  misc_feature (1975)..(1975): n is a, c, g, or t
  misc_feature (2025)..(2025): n is a, c, g, or t
aaattcagttcggtctgtgaatgtgcgaagttatggagagaaaagtcattttggacgggttggtgcaggtcaccgccctggtccttcgtttcgtggtcagtcgtcgtctcaattccatacctatcagcgcatgcgcggagggcccttccaccattcgactccgatccaacgccgttccgaatttgtgccgagacgctgaagctgagaacccccagacgagccccaccttttgacagtcgaattcgggtttttctgttttgacggcagggacgccgctcataaaggggcgggatgtgataagtgacctcattattaatttaaataattataattttgacgttctgtttaattatttttgatcttttctaaattttgtctgtccgtggtactggttgtttttttgtgatttttggttttgataattttgtttctcatcatcgcctccgacttttccttttattatttgcttcgattttaataaatttgtttgttttggcctcgcttaatcgttggtcttcgagtatcaatttgtgtgaagcggtggaatcgaagtttttatcacttggcgctcctgcagttctgggtaagcttcagcggaaaatttggagtttttggattttgggggaaaaaaaagttgggaattgtgaaggttaaatgaaattggatattagtgactcacagattgagcactaaaaattttttgataaataagctaattattcaaattaaccgtatgcttttattttttaattagcatggcttgactttcaaaaaatgttttaagattatatccctttttaatgatttatcattttataaaattactgttacttttgtatcacacaacaaatcgtgcaaagtgagtccttttttgaaggtttttgttgatatgctgttaggcaccaaatatgaatcttttttctcgaaggagcgtggtaatcgatgatcaacaactgttcatttcacaattaaaaaaattaaataattatttaatgacctttcaaattggcagccgttttctgaatttttcgttcaagcgatttccgctcaagttccttcattgaaagattctttgttgagggaattttctgcatttaaattgaacacccgaataaattagaagtaaaatcgttctaaaagaatttaaactgttaggtaatcaaggtcatttcgtttagctgattgcttctcgcttctcgaggcttgatcagaaagcgccagttgaaaatttaaactttattattacttttaaaacttttggcataatgtcttttttcttttagtgtttccttttttccagagccataactagagaccggacttttaggcacaaaaatttttaaaataggcacgaaaaaggtgagaaaatgcataaaatgataaaaaaaaggcacaaaaaattggaaaaaggcagaaaaaaaggcatgaaaacacaaaaaggccaaaaaaggcatttaaggcagaaaatcccgaaaatggcataataaaagtcaacgtagaagcttcaaaccaagtggaaaatgtgttatttatgcttaatatatcgaaactagtgcgcaaaaaaaaggcatatgcctcaaaatgcggtctctatctattcatcaaaaatgcttttgtatggctggtgctgaatttaacaccctcccatttttgcgttatccttctgcccatttattttcgccaaattcatatgaaataaaaatcaacgtcaatgttgatattttttaaaacaatgttcgttaagtgaaaaatgttgatttgtctttcactattaggcggaaggcattcgctaattaactcattaagatacatcatttgacaaataaggccgggacttcgttatgggctcactaacttatactaattaccgatgataccaaaggatgggggggggcaaccgttaattgaattactaaggtacattaaatatnggggagagtgtccgttaattgactcactaattaagacacttcanatgaggaagattgcccaaaaatggcatgcaatatatgctttgatgacatntaaattgatcagctctgttttttgtgaagatccatcatgtaaaactgataaacctgat

SEQ ID NO: 20789 - DNA, 2153 bp, Heterodera glycines
atcgagagggcgaatactccgcgcacaaccaccccgcaacgctccgccgctcgagttagcacacgcgctctcgcgcaagcgctagcaagcgcgcaaatattcgccaatcgccgcctctgtgcaaacgcggcgcctgtctcgccgtgttgccgccgctcgctagcggccatcgtgacaaaagcaataatatgtatatatgtttcgaataaatgctaaatgtaaaatatgatctaaaaacagcaaatctctcataatgctagcaaaaaatcgattgatcaaagcatttttgatcaatcgataaaaggggagagaaagagatgaagcgttggcaagaggaaatgaatgatcaatttgaacagctgaatttttattttaccggaatatcataattgataaatttatgattattattggaaccccctcatccacttcatgcccctcacccatccccattagtccccactcactccctccccctcctgcctccctcatcccatccctcccacctccccttctcccggtctccctcattccctccctttccctatcccacatttcctccgttcatcctctcctctcgcctcttctctctcccctttttcttcctcctccttccatactttccctttatcaatatcatccactcttattgttagctttatttcccattcccgcttcttctcctcatcccttccgccgtcgtcttctcccttgggatttagagatttccccttccctcgcttttccgcttttcactccttccaatttgctcatcccaaattcggacaatttttccatctgtcctattcattattactttgtacgaatgctttcacttctgttcattcaggctactaaatcaaaacaaaccaaagtattgagaaaaaggtgtgtaatccttcggggcatttctcaaattccctctcaaatgtcctccgctactctctttttttttatcaatttcattgcttattctttttcccattggttttcgcttttcaatttcccttccctttcagtaaaaagttttcttcctcctcttcttcctcctgtttctctttctcttcctcctcttcctatttttcttcctcttccgtttgccttcctcctccttcttctcttcattcttcttcttcttcttcttctcttccaatgtttcgtcgttcggtcaccaattcgcttcttccttcctccggcaatgaccatcgacgccattctcatcagacaatcacagttgttgagaatagtcggcaccgacgacaacaaaaggaggacgacgaccggcggatggacgcatcggaacaattggcaaaggaaaagacgtgccgatggagcgacattttggggggatggagcggaaatggcggaaaagggagggacggacgaagggaaagtgacggcggagacagcgcggaagaggtgggaaaagaaagggacggaaggaaaagtgccaacggaattaccaatcgaaattaattaaaaaagcatcgtttgggcgatattttccaaattcggaggggggggggagcagctgctaattgctgcttctgctgctccattagtagtccgattgatcagcagaaaaagcgtttcagctaatcgctgcactgaaaagcctccaaagcaccggaaaaatgacagaaaaagcggcggaagcgcagacgaaaggggccaaagcattggcaaaatgggcgagcaaaagcaaaaacgaagcgatggcggacattgtgggaagggtcagcgaactgatggaaatgcacgcggagagacagcggacattcgccaaagactacggccattacctcaaagtgagtgggcggaggaggagaaaactgacgaatttgaattggaaatgaaacattttgccaaaattgaatcgaattggcacaatttgaatggaaaatagaaaattttgccaaaattgtcaatattgaatcggaaatggcaccttttgccccattctttggcgcagcaattgcaaaaggtggcggaaacggagcgtgaaatgcacgcgcagtgtcggaaggtggagaagctggcggaccaggaaaaacgggttggcaaaatgttggccaaaaggggcgaggacgacagcgaactgagggccaaattggagagggtaaagcgagagagagaatgggcggagagagaga

SEQ ID NO: 20790 - DNA, 2404 bp, Heterodera glycines
ttgtcggaaaacattgttcgatgaacggttgagaacaatgagacacaacgaacgaagggacggaccaatgggcacagcgggggggggggagagaagcattggaaacacactttttgatattttaggggaatttggggggggggggtccaatcagtaaaaattatggatggaaaatgggtaaaaatataatttaaattaataaaatgataacatacagtagaccaaaagaggaaggagtcggaagtgttaagaagaagtgaatgattggtactgaattgggctgtgttcggtgccaaaactgaaaggcaaaagcatttgtattagacctaagcagcataaagcagctttttaacaaaaaaaaacctttttcagcagagtttaagccaccgcctccgttcaatttgccccattttttggtcgaccctaaccaaagccacgcgaatccgttcattgaaattggccttctcagtggccaggtcatttgggcacacaatgatttcttcccaattacccgcttttctcttcagattccgcttatccatccttccgccgctgattcgccattttcacatcgcaattcgctgcagggcgaagatggcagtccggcggaagagttcgaatcagaaaatgaggagaataacgcgaaagaggtgcccaaatgaatgaacgaatggccaaagaccgtcccttaaattttgtgagttaaggtgagcgacgaagagggaacggcggacgcgggggacaattcgccgaacggagcggacgattcgctgtcgggaaaaaagaaaaaaacgcggacggttttctcgaggaaccaagtcaatttaaacaaataaaaaatcagcagcgactgattgaattgtgttgacattcgttaaggtcagtctgctggaacaaacatttggggccaacaaatatttgagcgcaaagcaaagggagcacttggccaacagcctcaaactgacggagacccaagtgaagatttggttccagaacagacggaacaaatggtgagcatatcaaatgggacggagtgccaaattcgaattcgaactctaagctacaccctcccctagcatttaaatgctaaattgaaaaaagcaatgccaaaagtaaattgctttaggaaacgtatgggccaagacgatcaaatggtggcgggccattccctggccaccaacagcgggtgtgccgcggtgtccgctctgccgcttcaccacgctgttccgcctccgttctcctcgccgctggtcgtgcagcagttcaaccaacatcgccatcagatggcacttgcgctggcaggcatcaatgccaatgttagacattttttgattacattggctgatcattatggaccaattagaaattcaatcgtttgtccttcattatctcatttaattttaaaatagctgttttctgttttccaggcacataattccaatgcctttgacgccgccaccgccgcagtgccatttcaccaacagtccaaccaaaagcatgaacagagttgttctactgaagttccagcggtacaacagcaaattatgagcacagagtcgaaacaaaggcagccaaattcaattggaaatgtggtaattaaataacaaaacgtttcgccctttgaaaatgaatcggttgtttttctgttaaacagcaaaagacggagcagcagcagcacttcttcgcctcctccccgtgcaattcctcgtcgactccgccaaattcgtcctccgcctcttccaccgcttctctcactcgcttaattctttctttccttccaaacaccgtttttccgccgccaccttcctctcatgcttaataaaatacgattgaaatggcagacaatgcaacttaattgttcaattaaataactttacattttgttgattacgcaattttttcgcgggcaattgcctcgaaaatggataaaatggtacatatataaagtaatattcgcgaatttcgttttttctgtatttatgtggtccgcaactccccgcaccctcatattacggtacctaaactttatcaagcccctcccccccccccttgagtggatgaataaagtctcccctttatttcacatcgccagaatttcacgttgatatgtatccgcattaaattactcgaaaatgaaaagaaacccataatgttaagatttagtaatatgaattagggacttgaattgaaatgaagtaggtaaattttggttctattatttgatatatttatggattagtggttagtgcttcaacactaacagtattttttgttatgagttcgataacggttgacgttttcttttgaatttatttttttatgattaatagacgaaaacatccataaaaattgaccaatcttggcataatttgttaacaaattgaactcaacttttcaaaaaaaa

SEQ ID NO: 20791 - DNA, 1605 bp, Heterodera glycines
atgtagtctaaaaagaattttttaacagacgcgccccactacgacacagtttactcacgtggagagtagatttgctcgttacatacaaatgccacgttcatcgtctggtgtaggaatgatgtagtctaaaaagaattttaacagacgcgcccactacgaaacagtttactcacgtggagagtagatttgttcgttacatccaaatgcaacgttcaacgtctggtgtaggaaggatgtagtctaaaatgaatttttaacagacgcgcccactacgaaacagtttactcagatggagagaatagatttgttcgttacatccaaatgccacgttcaacgtctggtgtaggaaggatgtagtctaaaaagaatttttaacagacgcgcccactacgaaacagtttactcacgtggagagtagatttgttcgttacatccaaatgccacgttcaacgtctggtgtaggaatgatgtagtctaaaatgaatttttaacagacgcgcccactacgaaacagtttactcagatggagagaatagatttgttcgttacatccaaatgcaacgttcaacgtctggtgtaggaatgatgtagtctaaaatgaatttttaacagacgcgcccactacgaaacagtttactcagatggagagaatagatttgttcgttacatccaaatgcaacgttcaacgtctggtgtaggaatgatgtagtctaaaatgaatttttaacagacgcgcccactacgaaacagtttactcagatggagagaatagatttgttcgttacatccaaatgcaacgttcaacgtctggtgtaggaatgatgtagtctaaaatgaatttttaacagacgcgcccactacgaaacagtttactcagatggagagaatagatttgttcgttacatccaaatgcaacgttcaacgtctggtgtaggaatgatgtagtctaaaatgaatttttaacagacgcgcccactacgaaacagtttactcacgtggagaccccccccctctccttcccctttctccacccccttttataggattacccacaaatgtcaaattatcccttattcccgcctacccctccccaccctttcaccaaagtttaccgatttttttttaccaatttagcatgctaaaaataaataaaatagtaaaaaaaattagtgaagtcattatgctgtatttattgtttttccctaagatagcatgtctaaaagtttggtacaaaacgaaggttttcctcctttcctttttatttttaaagtcatctaaaatatgttcccatgagctgtattcgcaaaaacttcataacttactacttttccctttttggttttttctgcatttgaaaacgagcttcccaccttcccactgttgtaatgactgacggcttttaaaatatatatttttttatagtatacctagtatgtatcaaggttctgttttagaattcaaataggtaagtttattaaatttgactaataatacttaaaataaacgaaaataattatatgtaacacaggaaggtgaggagggggggggggtgattcgacgggaatgcttatttttttatttaaattctgtttcggtcatcctctg

SEQ ID NO: 20792 - DNA, 2862 bp, Heterodera glycines
tttgttttcctttttccccaaatgcctttttcctccactttttttctaattgcccaccctcatttcactttccaaatgctccttctcgagttttttcgcttcattctctccccctttttgtgccgagttgacgcctttgcgcttaaaatttgtttccaaaagggcccaattgtgcgcgtcaatttttttttttttttttggcaattttccattctttgggtttcagttccaattttattttgttgtttttggccctgatttttcctttttttttgaagccctttttttccttccttttttccagggaagacgtgttggaaatgcttgactttttttttcgccccccttttcccccgtctctttttttggccaaagtcattttccgcgtcggctccgttttcagttgcgttcaatttaagacgtcatgcgacgctttgctaaaaaacgcggaggaaagcggcgatgaattgtccctggctcaatcggtgggcgattttacgtaatcagcagactttctgtttgatcaccccctccatcggtccgtttgccccccccccccctaatccatccattccacgatcatttccaatttttgtttgatccggttccttcctctccctaccatttgtcgattaaatttacttttttgatcaccttcggtcatttgccctcccccactttaattttgtttggtccatttcaattttagtcctatcaatttttgtgcttttgttcagcttttggtactgatttgcctcgtccttttgttttacctccatctgacgacaattctcaacattttttatgtttttgatcaccttcaatatgctcttttaagctttctttggtttctatttacggtaaatattgttaagggtcgaataatttcaaataaaagagaaattaattaattaaaaagatatttggtaattaagaacgaccgtaagggccggagaatattcgcctttctcaaattggacggcatcactttgctcagagtgattggatttgacgaattgctacaaactgacaatgagcatgtgaaaataaagcgaaaaagacgaaaacactcgatggaaacggaagaagacagtggaagaagtggaaggaactgatcagaaagacggtgagagggataaaacggaaaggactgatcagacagatggtgatggataaagcggaaggaactgatcaagcagacgacgagaaggatgaagcagaattcagtgatcaggcagacggcgagagggaagaagcggaagagactgatcagacagacgacaaagagaagaagaattgtagaaatggaaagcggaacgcgaaataagaattcataaacactcagaattcgtcccataccaaattgacactgtcaaatcgtcctatatttttgatcccaattggcttccatttcattacgggaagatcagttttattgtgcatttattggtcagtctgctgcttttctcattttacagtgccttcgttcttttttgtataaattcgtgcttttcactgttcgttcgttactttgtccgtttttctttgtctttccgtcatttcaaagtcgtcccccgctgttgtacgcctgaatgagccgttgcagaaccgcctgttggtccaccgattcgaacactgtcggcgcggacaacagcacgccgattgtgccgccgaaggtgacgccgaaaaacacccaaaacggaaaaggggcactaattagggagggggggggaatcattttgggagaaatcgttggcattattcacccattccaattttggcattcccttacaattctcctcgaatatgcaaagccgtggctaatttctcccatttttgttcgtgtttattagttaaatttatgaatgtccagcagcaggacaaacaaatacttcatgcaattgcttatctctaaatgtccattgactcacgtaaagcaaaaagcgatcgatgaccattgccacatatttccaatcgtcgcggtgctaacagcgaaatgggaactaattattaattaaattattaatttcggaatacataaaaaataaaataaaagggaaaaaacaaactaactcagaccaatccctgagtttttgtcgttttttgcggaatttacagtagctttgcgctgggtacggtatttttagttttcgttcgtgcgccaccatatgcaattgtttttaatcgcttcggctgactcaccgttttatgcttctcctcccttctcatgtgctccgtaatgtactcaattgaatggactgcacggaccttcattcatttggtatttatttttggcattttgccgttttgattttaccgcttcggcactcaatgggatggctttggtggcttttccccggtcgttttcctccgtttgttcctccgtcgcttcgcctttagccgactcagcttcattattgtctaaacggaacattagaaaattaaaaacggcaaaattccaaaattgtaattgttcgccggttgtcgcccccacccgccctctcattaccacgagaaaatgggcacaaatgctttattgtcccacttttttgctccattttgttgtcccttttgccggccgccggacaattcgggtggtgtgccgatgacacatttagcggcacagtgaattggccaaccccgggaagggtggtgagaccgtccgagtcggctccgtccgtcgcgtgccacgccaaacgattaattgcgggcgacggccttttcatacaaagcaaatggggcataagctgaacagagcaaaagccaaacaaagcattcattggccatgtgatcaattgaaatttgaatttgaaattgcgaaaaaagtgccttaaggaaaacgaagcgcacccaacggggcat

SEQ ID NO: 20793 - DNA, 2229 bp, Heterodera glycines
  misc_feature (918)..(918): n is a, c, g, or t
tttctcgaccgtttagctttttcctgctctcctcggcttattctccactattttgggccatgtcctggtcatcaacttcgttcaaatcagccaaaatgcacgacagactatggccatgttcagtttggtcagcaaccgttttcatatcactgcattggcattaaacagagcacatgcagttttcctcccaattcattacagaaacaatgtgacaaaaaagtaataattaattaattaattgattgtgtaattaaaacactgtttaatagacaatttcattatttttagaattgttctgatccaatgtgtgtttttgcattcgttgtccattcttttggctccctttaatgcttgtaagtgtttttctgctccatttcatacaatatttaattcatcattttcatttagttttattagattttacgtggacttatctgatcgtttcttcctcattttatgtggcaatgcaattcgtttggcctggattaagggtaaaagaataaaaatattccggattaattaccactaaccatttttttaaagcgaataatcgcagtggcaacaactcccaatcgtcggaaaaagacagcggacggttcactacgacttgcttcgcaattcaaatcattgcatggatttatatgtcgcaaaatgctgccattaatacaaaatggtttattgactttaaaaactgtcacccaatcggacaaattgtttattgtccgctccaattcattttggcattttatcccatatcagacgaggcaaatgatcaatttcacaattatttaccttaaaattaaatctttagctctttttgctgctgatttgtaaggacatgagaactctttttgtgcgaatgcttcatcatatatttccttgcaaaaagaaaataaaggcgatagaaacaaaggcacncaacaaagttgtgtactgtaaccgagtacagaaggtctacccaatacaatgcattaatcaaacatcgaatcccaacccagcccaatacggtaacaaagcgcattatgccaacacaagcccggtatacagtatccaaatgctgaatgtcagcacaacaccgtacagtggaagacacataaaaatgttcggtgtcagtggagggaccagtcactgaaaaggccaacattcaactaacagaatcatcgaagataatggatttcacacatcaagataatgctaataacaaagtacttttctcaatgcttggatttagaaaaaaattgctttcaaaccattgctttgatataattcattttaaacaaaaaacatttattttattaacaatcaaaatattgattaaaatcttaggctccaattttaatatacttttgttttttaaaaatttctctgtactgtcgaaatcaatctctgtcgattcactcactgtcgaaatcacacgcagagagtgaaaaaaagcgaaatagtttactgtcgaaattactcactgtcgagatcaatcattgtcgaaatcacctcgcgctctcatcatgagctctcgaatggtaccaaagtttgaatcgtttcaaaaacaatttaaacgctttacacagatttttaaactatttacaattgtttagcattaaaaatcctaaaattggcgatcatttcggtaagctatccgaacaacaattcgcggcattctcttacgaattgactaccttgaaaagttgcttaaacatctttacaagctaatggaaaagataaagggatataaaaggaattgaagtgatcaagaaaaaacgaagcgagcagttgttgagcgcctgccggagcacctaatgagacagaccttgtttaacaatttgttgatgaatgtggtctgctgggcgaaattgaatcgacaatgttcacagacatccgcgggcggttgaggaaatgcaaaaaattccctttacatctcaaaacgcccgcattttgttcctttataactagagtgccacgggaccgggccgggaattcccggtcatccgaggtcccggtcccggattttgaaaagctcaggtcccggtcccggtagggcaaccgggaaccgggaaaaacaagcactggtaagaatggggggctaagtgaaaaatttgtgatgaaaattagagtcaacggaaaaaaaattaaaaaaaataattaatatattctttaaaagtaacattgctaagtgtgcaaatgggcacgcctacatttcgcctactgggacatttcgcctactaagccaaa

SEQ ID NO: 20794 - DNA, 1779 bp, Heterodera glycines
cttcgcggcgtcggttttgcgtgcaggatagaaggagttcaagtagtatttgaggacggcaaggaatctgaaaaattgttgattcaaaagcgttgtcgtcaaccaatcgggaccgtttctcagccgtattctcgtaggcgccggcgatcagttcatcaggatgagctgaaatgagataagattgaacttggaaaaattttaaaaagcaatgtattcaccgaagaagtcggcgtacatttcgaggagagagcgtcgttccagcacgaaggtgggcagcgccaaattctgcagagtctgagtggtgccgagctgaaaagagaatttctattaaaacaattcatcgaacaacgcgtcgtctacctgggtcactaaatgtctgaacacgccggcctgctcgctgttccagttgtcccgttcgtccgagttgttgtagatgtagtcgtagtcggttccgttggtgtcgtagttgccccaatctggcgcttgcattttgaaatccgctgccgctaaaattgaaggggaaaggaaatcattaggattgattgaagacatatatgaacaaaaacaactaaaaaaagaaaaaaattttacgaagaggaattgtggaggtggagagaagaaatcaacacttttatacagaaaatccgactgaactcacaaaggaaggtccccaggtgtccgtgggatttccaaatgaaatttggtgggtgtatagagcacccatgggttcttaagaaaagtgtttttattttctgcgaaatgagtctgagtgccgagttatgacgtgccaaacttttttttattgcaataaattaaatatacatttgcatgttttgtgttggtcggtggtgcggaggttgtgctccggacttttgtttttgcccccataggttcgaatccctcttatgtaattttattttcctcattttatatttgccttttatgcaaattaatcgccattgaaatcaattccatcgggtcaaaaatttttattcctcctccaagtcattcctaaatatgtccgtaaatccccaaaatattattgtccttttaaaaaaatatttttccaaatataatgattagggttgtaaattatatggactaaaaaacgcgaaatatggacattaaatatggactaaaaaagcccgaaatatggactaaaaaggccaaaaatggccaaatatggaccaaaatatggataaaaaatgccaaaatatatgttgtaaacccccaaaaatcccaaaaaaaggtgtgcatatttaatatttgcttaaataaaccttaaaagtacaataaacaaccaaaaaatggggtttaaaacttaaaaatgcatattttttattgttgttcgttgtatcaaaaacacctccaagtttgccaaatttcgaaaaaattctcattaaaaaaaagaaatgttcgcaaaaaaatgacgaaaatatttattgaaaatgccaaaatgacgacgaaaactcaaatttttcgtgttttgtggggtgtaatttttaaaaatttccaaaaagttgatctttaggggtgtatttttcgtttttttttcatttttcttgtgaaaatttccaaaaaatggccaaaatatggactaaaaacccaaaaatggcgaaatatggatttattcccgaaaacccccaaaatatggatttatatggactaaaaaccttcaccaaatcaaaaaattttaacgcagaaatgctatttttaagcccctttcttcatagcatatgcgcagaaaaaatatgttaatccgatataatttacaaccct

SEQ ID NO: 20795 - DNA, 1121 bp, Heterodera glycines
  misc_feature (1113)..(1114): n is a, c, g, or t
aaaaattattcgaatttctccattttgtttccataatttccgaaagttattcggtatcataatgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccccttgcttctcccagttttaagtcttggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccccttgcttctcccagttttaagtcttggatttgtcaaataaattcaagacttcaaattaataatcaaaaattctcttaaaatttttttgaacccaattcaaaaaaggaaaaaaatttgcagtcaaaaaattattcgaatttctcccaattttgtttcccataatttccgaaagnnacctgca

SEQ ID NO: 20796 - DNA, 3051 bp, Heterodera glycines
ttgattttttttatgtgccacataagagcactaatgtgcctgtggtttgctcaataaataaataaatctttaaatgtatgtgccagagaaaatatatgagcatagatttttttgtatttgggcaacattttgtgcgccttatttttgaaaaaagcttctataatcggatatataaatttctcaatcggtatcaaaatttttaaaaatctttatgaaaaaaaaagttctacagagcgaagtgaattctttgttttttggcacgacgacatttcgcctattggacgtttcgcctactaacccaaaatcggacatttcgcctactggacatcttgcctactgacacttcagctactcgactctttgcctactcacctaaaatcggacgtttcgactactaataccaaactacaacggtacattatcatagacaaaatgtgatgttgatccttgacgaggccgacatttaatcggaaaaagtagggttgcaaccccaaccccgccccgaccacgaaccctgatatttttgaccatttttcggggttaaccccgaccccgacgctttaaaccccgacaaaccccgaccccgacccttaacccgactcggggtcggggttaaatatacacccctaagaatggcattttgtgagagaaaagacaaaaaattatacaaaatttgaatttttttttaatattttgccaatttttattaaataaagtaatttgcattttgttaacttatatgtattgtgatgtagtggttagttcttgaacactaaaactaccttggtcataagttcgaacacggtttactgtttcttttttaatttattttcatttgattaataggacttttttaaacaaaaatacccatgaaaatcaatcatacttggcataatctattgacgttgaaaatcaatcatacttggcataatctattgacgtattgaactcaattttccattcgttgaaattaaattcaattttttgactaaatcatgaaatttaatatatttcaaagtaattttgacaaaaaaacaagaaaaaaaaacaaaaatttatcagaaattcataaatttttggtgaatatctgttacaaaatagaccttaaatttcaaaattcgcgcgccataagaaaaacctatttattcataaaaaattttggctcaaatcgaaaaaatttatcattttttttggacaaaatctgttaacagacacatccaaattttcaaatttttttcccggcggcgcctatcggcaccgcgggacctctttctcctaaaaatctttagaaaaagagcgctgcgaaaaaaagatgatttgaaaaacaaaaaaaaaatataaggtgatcagaaatttttgggcatttttttgaataaaatccactatttttatttgggggccaggcgccttaggaaaattttgaaattttgactatttttttacagattttgactgaaaattggccattttaaaaatgccttatgcatttttaattaattctatacaaaaatatttatgatgaaaagaaataaaaaagcacataaaattattattatgaataataaaaaaaaatttaagctaaaacaatataaaattttttgattatatggtgtaagacaaaaattgaaaaaccccgaccccgaaccccgaacgatttggcaaccccgacccgaaccccgacgcttctaaccccgaattttccaaccccgacggtcggagttgcaaccctaggaaaaaggattggcaaatgccttgcatctgtttggactcgtaaggcagagcttataaataaaactaaatactgatcaatttggaatatatatatatatgtatgtatatttggtgaaattcgttttcgaaatatccattttaggatagtagaacaaaaatctactagacaaaacgtccgattttggcttagaaggcgaaatgtcagtagacgagatgtacagtaggcgaaatgtccgcacaccgttttttatattaaaagggataaagaaatgggacgccaaaataagagataaatttttctctgcactctctatttattggttcatctctcgttttgggactgtgaaaaagcacttgaatttgtcgaattttggactgaatacttaaatattttaaaaaaaaaattttcattaaaatccccaaatgccgttatccccccaaaagtgggctagcttaattatgatggtaggtagaccaatatattaattgagtggaaacatattttatttttgaccctttattgtaaaattttaaatttcacatagaaattattattattcacccgtagcttgcttcaacagcacgcatggacggactgaaacatttgagcgactctgtgcaagcctaaattgcagaaaaaatggcctgtttccaagactaattatcaagtagttgaaataaatcaattataattagtctgccatttttaggcaaatgcctaaaatttctgagcacttgatacgcacagataagcacaagaactttgttttcagcttagtttggggtttttacgataacttttctaatgcctattttggaatttttatgcttaatgcctaagcgcctattttttatgcccatttcgtcatttttggtgcctatctgatccccaaattttgattgttttattcttgataaaaatttttggtttaaaaattgccttatccgaaccttttttaaattttcataatttcatttaggtgctaataactcgaaaagtagcttaacaacccccaaaaaaatatgtttttcatgcatttcgaccatagggagctcaggaaaaaagtaggtaaaacctaaaaattgcatcactattcctaaaaaaggagtgaaattatacgcggaattcattaaattttcctgaactgtgaatttgaataaaaatgcaccaaaatctaaaaaaataatatataaatttaaaaaaaaaaaaaattaattttcatattttttgtgattaattattcaatttctcacattgaaatttgtgtacagtgcgcacaaatggcggaacacagcgccgccttggagcgaaaagtgttg

SEQ ID NO: 20797 - DNA, 1558 bp, Heterodera glycines
  misc_feature (94)..(94): n is a, c, g, or t
tagcgcctgatcagagaatggtacgatgcagaaaacctcctggacacacacacatttttgttgtaagccaataaaaaatatatacgttatgacnttacaattttatgatcaaagagcagactaaagaactcttgtggtctggtgatgaccttgttgcgccaagttcgtttctcatactgaattttcccctaaaaataggctgcaccttaatcggctggacatatatacaaaccagagactgttaagcataagcttcgcaatgaatcgaagccccggattttttttcacattctccaattcaatgtttacttcgtaaatgcgccgatactcatcagcatagcgctgtttctgatccgcgctgctaactccctcggggaaaccgctagactcaatcttaacaaaaaaacacatgattaaacagatgggtcaaaagtctgcagacaaaccttcaacttgatgagcagtctaacataatctttaaaaatttggtcgctcctatagagaaaaaaaatatcgcatacaatttaaacagaaagacaattaccattcatcatagtgccaagctctccaaagacgatcaattttgtacccgtgttcaagtgctctttccagttcaatatgcgtgtagctgccggtgaaggatctttgtgcatccgtgtgtggacatttatgtgggcggcgcgtgctttttttgcgaaacatcgttgcacaatgatgacaacagcaaaacaaaagtcgctcgtcaatttttacaggcagcaccgggacgcgcagaccccgtggggggacaactcgaacacgcagaatgccgcggtatggcaactgctccggccgtgtccaattaacgcacatttcatcggccattggccgtatgatggtcggtataccaaccggatattcgcacgtataattcacaaaaggatacagacttatgatatcaaaaactgatattttttcgtcctcctttggctctgcaaatagcttcaatgggcccgttcttccaccaaaataggctcctctgggttcaataggccctctgtccatccccaaatcagagaaaaaggctcgcatttcggcattgcaggccaactgcgcatttatttcgcattcccaaactgcttcgacctgcaagccttgtccgtccacatcgccttcacgaagctgcatcaatcgcaggttggtctcctcattcagttctctgcatgatttggcgtccaccagtttgtcgccgggatcaaaacagcgctcacagccgtgccagtagcagccaagcactttaatacagcggttttgctcttctatccaaccgtccaatttaaactgtctccaccgcttttttatcccgtttcccgcatgttgaattttaaccgcatccgttttagcacgccaatccaaatatttaatagcaaacacactggctctgtcgttccgctcataccctcgttcgggtacaatggccagttgattctcacaaaggaaattgggccggaaagatgctcatacagatgcttaaaacatttcttctccttttttcacatgatcacacaatcaatggttt

SEQ ID NO: 20798 - DNA, 3106 bp, Heterodera glycines
  misc_feature (3068)..(3068): n is a, c, g, or t
atcgattgcgcaccgccctccctatcatgctcgagagcatttgttgtgtataaaatttatcaaaaaaagagatagccatttttctgggatagagtataaatgtaaaaattccctcaaaaataaaaggtctattgcgcaccgccctccctatcatgctcgagagcatttgttgtgtataaaatttatcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttctctgggatagagtataaacctgaaacgggcgtggtcccaaaaattttatatcaaaaattaattatttgaattaattggaatcaccggcgttttgagcctttttgtctgctcccaaacttggcaaattaatggtcatattttatggtatttatgttttcataatttttaattttgtatatttactagcatttaaaaattaatgtgaaatttgtccggtaaattgcaaaagtacatcaacccaatttttgatgttttccggatggaaagatatcgatttgggtgaaaaaatactaaaaacaatgagaatggcggacggttatcgatttctgagtctaaatgcttacagtgtatgtaataattgtgcgaataatcgaacaatctacctaatccttcacacattctctgcgataaaaccaaatatttcattggcatatccaaattttggtgcatattttatgaaagtggtcctaccatcggcaattaccatttctttttttttcgcagaaaccaaaacactgcactattgctaaaataaatcccaaataggtgcctaattgtaattgtgtctcatttctttcctcttgaatttgtgtaaattggaatttgttttgaaatgattgacgaggaaaagccattttagaaaatggaaagtgattcgaatccgcaacaacagtctgtgcctgtgcagcaattgccgtccgacgcttcgccccaaccgcagcaaaacggcggcggagattcggcggacaaaattgggccggaccaaatgcgtttgttgagcgcacagatcgccgcatacaaaatgttggcccgtaatgagccggtccctcgtgcactgctcagagaggttcgtacaagtccaaatcattcatcgtcggattggcacagtgccaattttgcgggtgtcgaaaccgcaatttctccgattttgaaatccatttgttttttaatgggtttgtttaattaaccacgtaaagttcggcacttaactttccggattgaattacatctgggtcttggttttgccggtgatttctctcaaattccgaatttggctctaatttgccggtctacgattcggagtaaagaaagtcgtatggttggagacccaaaaacaatcgaaaaacagtattattttaaaaaacggatttttcttcctttattttaacccaatttctcagcttttaatggcactcaatccccacaacaaaactttgattatttggatgtgtaggggggtacaaaaagcgatgaaaaacccataattttgcaatttttaaccaaatgtttaccattttttgcacaggtgagcgaccggaaacgggacgacacattgccgctgccgtatgagtatccgtacgaattgccggacgggcgcaaattgccgtacgatttgtccaaaattttgctgatccaccagcagcgtacaaacacacggacaacggacattccgacaccgcctggcattgacccggaagtggtgctgcgcgagcgcgagaaccggtgccgtttcattttttcggacaaaacgcttttttgaatttcgaaatgtgcaaaattagttttcataatttttgtcgaagtcaatcaaataaacatttttcatgagggaatgaatgggttagcaattctgggctttcacctttctcacttgtttaatttttcagtaatttctaaatttttttgtggaattttcagcttttgcacactcttcaaaatgttcattgtttgtgcacattttgcaggattcaaaatcgcatcggcctgcgcatccaggagttgcaatgtttgcccatggacatgccgccccatttgcgcatccatgccgaaattgagttgcgtgcactgcgtttgttgaacctacaggctcaggttggcttttgccgggttaaatttcgacagggggttggatgatattcaaaaagggcaaaaaacagccattccgattcatattactttaaaaaggggaggaggtgaaagttgtcagcggtcgcagtcatgggaaaattggaaatttttgggaaattcgggtccgtccgccccaattgatggcaaattttgtgatttttaatgaatttattacgaaaaattttcactccctctgttttttttgttgtatgtttgggtggaaaaagcctaattcaataagttttcgtatttaaactcgaaaacggggtgtaaaatacgaaaaattcgagaaattgttaccatggatagcttttaatttcataatttgaatttgcccccaggtccgtgccgaggtgatggcctgtctgaagcgggacaccacgctggagaccgcgctcaacccgtacgcgtacaaacgcgtcaagcggcacacactgcgcgaggcgcgggtcaccgaaaagttggagaagcaacaaaagcaggagcaggagagacggcgacgccagaagcaccaggatctggttgcaggtctggttttgatgacgaacattcacgaacaaatttttttttttgaaattcgaggcagcttcatgccccctccccgaaaatttgaaaaaataaaaaatttttttcgttttttactttcttaaaaatcagaggttttttctataaaaaaaagaaagaaactttctcaattntcaaaagtctatgtttttcagaaaaagctctaagaaag

SEQ ID NO: 20799 - DNA, 2599 bp, Heterodera glycines
  misc_feature (2468)..(2468): n is a, c, g, or t
agataatctgtcgatgtatttggcgccaatttcccttctcctttctctgatttccttttttaattgtttaaatcatttgacccaccgctgtcgatggccaaaacgtaaagaattttgtgagtgccattagccgaaaatccgaaattgggctcaatttggttcggctcatcgacgagacaatggaaagggtcgacgccttaaggaaggcacttaatggccaattaatttgccaattatggcttttgctgtgtctcacatatccatcgtcgttgctcctcgtcccaatattcgttccaatacgctgtctctctgtccgtctctctttcgccctttgtctctttcgctttcgtttccgtcctcccttttcgttttgtcctccgattttcttccaatttctcttccaaatcgcttcctttttgctctttatcaatcatttttttaatttaaaattccctctcaaaattaccttttttcaatttcccttttccttccttttcgttacatttgttgattttctttgcggctttttccgtttcattaagctaaaataaaataaataaacattgttctttttcctgcactttctcactgattttggcatcggattgaacgcgacacaaattctgacatgcaaattcatcaaaaaagaacaaagcgcgaaaaacagctacaattaaaatcgtactgggagattgaaaatgtttttacgaaatttaattttacgagtgaaatttctctgtccgtgtcaaatgcgccgcgttcggtaagttcaagcaaatggcgaattaatttttcttcactgacacaccatttggtcgactcattcctcaatgtgtcattttgagaccggaatttgcttcggaattccttgagaagaaattgtcccatttgggcgggtgaaatcggcgcagaaattggaccaaacaaaacagtgaatggcgtcaaaagagtggaagaattgcggagaagggaatgggccataaagcgaagatgggcaacgaaagtgaggaaatgaaagcgatgaagaccttcctaaaggaattaaggaaaggtgagaaaagagaaaggaaaaactaaatcatagagacacaaaaagaagaggtcggaaaggacagaaatcggaataggaatctcaagggttcaggttttgatgtttttgaaaaatgcaataggacattgacatgagttgattataaaacaggaattttcttacaattagtccggatcaatcctatccaggtccaataccaagtgcctggttcgggtttttttcaaattccgggccctaataaaaaaaggaatatgccttaacaattgcgtattaaatgcctgaaattcacggcgcttccgcatgatttccagctcaatttcgtgctcccattttgccctttcctccgcttcttttgcgtctctctctttcaacggatttatctgcagtttgaacaaatctgaaaaatcaatcagataattatgctaattgtacgacattgtttttcacttgcctgagtgtttttcatcaagttcgacctgaaaaattgtatttatttgatagtgacaaattaacatttattttccgttacctcaattacttttttctccgttttgtccgtgtgtaataattccattgccccccattcgtcctcctcgccatcgtcatccgaagaaagaggtaaagtcgccttcgaagttccttcaccgagctgagtagatcaaagatcaactaatacttatttaaattcgaaaaccgattgggcattttgaatatttgttgcgttaagtctctttgtaagggaccgattagaagaaacagtcgcttcatctgaagacaatttgatgggttcaactgatgaagtcaaataagaattgaaaggcgaagtgaaagaagccgaagagacaccgaaaagagcatccgttccaaacacctccgattttgcggttttcgtcccttttccatgaacaaaatcttcagccgaagccgacaaatcactcgataaagcaggttttgaaattgcaattaacctgaatttatatttggttaataataaatacgaggagtttccattttacctcgctgaacgtctccttgggggatgaataaattcatcgtcattttccttgttttggttttcctctctttgtttcgaagttttttcgggatttttggatctttttgtaccttttcgctttttattttctttatccatcagcaggattcatggtgataataaataataagcaagattaaataaacaaagggctttaaaattgagaagacaaaataataaagtaggcatatttcatacttataaaatattcaataattgctctaaaaccggaactggacatggatatcaccggaaccggtatgatttagcagggcacgcacgcggtcccagtcaactagctgtccaatacgtattaactatactaatttgatgtgtgactatgtatgtcacactttgaatggnacatttttcgaagcgaaagtcctttgaaaaaaagaaagcaaaaaatggaggatttatgtaaacaaaaaaacacaggagatagtgttgagaaaagataaacaaaagagaaaaagaaagagactaaaggaaaa

SEQ ID NO: 20800 - DNA, 1367 bp, Heterodera glycines
ccgtaccaaacatcatcgaccgcttcaaaaaacacttgttttgtcatggtgtggcagaacatggatggacaacgacttgacgacggagtacttggaaaaggtgcagaacaatgacaataattcattaatagaaacttcttaaattaagattttcgggaatttccatttcggtgcccgtctcttggtttgggacagtttccgttgccacatcagcgaggacacaaagaagacgcttcgtcgcttggcccttcactccgcggttatcccgggtggcaccaccaaatacattcaggtcaaccccaaaattttgcttattgatacagacatttttaggcgccagatgtctgttggaacgcgcccttcaaagaagcgattcggaagctgtacaacgattggatggcccatggcgaaaaggcgacgacatcaggcggaaatctgaaggccccgccaatggaggtctacctggaatggattgccaatgcatgggactcgcttccaaagcaaatgattgccgactcttttttgacgtgtgggattagtaaggaagaaaaaggccgacacgacgacaaaattcacgtttttaaggtcctcaagaatgttaacattttttgaaattcttatttttagccggacggagcaattcctaatgggctcgctattttgaagcaacgccgacaggaagaagatgtactgaaactggtggaagaaatcgatttaagcgaagacgaaagcgacgaagaaattgatgcagaagtttcctaatattttttttgttaatgttttattaaaacaaattgttcaatagtttttgcacgtttctgacttcaaaagttttgaaaaaaaatttttttttgaggggggcttatattcgaagggggcttctactcgaggggggcttctatttttcaacccccctacaaggggggcttatattcgagggggggcttccattcgagggggggcgtataatcgagtaaatacggtatatattttttttaaaagaaaatcaatgtcattatttcggtatgtttaacaattatattctaaaattaatttttgattttaaatgttaaatataatgtattgagtcaattttctaccaagttaatacaaatataattctttaaatacttaatcatcgataaaatttctaatattttttatttacttattccaaaaaacacaaaattaattggctgtttaaaattcatacgtgaaaattggattatgcatcgcaaaaatgttgcttcagatttttgcatttaaaaaaatcattgaaaataaataacaaaacataaaaactagtttttttttcttcaaggaaattaactgatttttatgtggtgaattcatcccttcctccaaaa

SEQ ID NO: 20801 - DNA, 818 bp, Heterodera glycines
ttgtacctcttctaatcactttctgttcaaattttaatcactgttgtatctcttctaatcactggtgtacctcttctaatcacttgtacctcttctaatcactggtgtacctcttctaatcactgctgtacctcttctaatcattgttgtacctcttctgatcactgttgtaactcttctaatcactgttgcacctcttctaatcactgttgcacctcttctaatcattgttgtacgttttttaatcactgaagtacctcttttgaacaacaaaatttaaaaaacgggcgcaaagcgcccgtccaaggccgcgaagcggcctaacaagctaaaaaacgggcgcgaagcgcccgtatgagttcaacgaatttaaaaaacgggcgcgaagcgcccgtccaaggccaacaaaaattgaaaaaccgacgcgaagcgcccgactgaggccgcgaagcggcctaacaagctaaaaaacgggcgcgaagcgcccgtatgagttcaacgaatttaaaaaacgggcgcgaagcgcccgtccaaggccaacaaaaattgaaaaaccggcgcgaagcgcccgtctgaggccgcgaagcggcattaatagcccaacaaatttagaaacgggcgcaagcgcccgtctgaggccgcgaagcggccttaatagcccaacaaatttagaaacgggcgcgaagcgcccgtctgaggcctcgaagctgccttaatagcccaacaaatttagaaacgggcgcgaagcgcccgtataagcccaacaaaatttaaaaaacgggtgcgtagcgcccgtccaaggccgcgaagcggcctaa

SEQ ID NO: 20802 - DNA, 871 bp, Heterodera glycines
  misc_feature (19)..(19): n is a, c, g, or t
aagggtggggagccccgcnatgttgtggtacacgcatcgattatggaagccgcgcatgcactagcaacgaagtcctttgcgcaaagcgctcatgtaatgcatattcttttcatctctcacaagtatactgtctacaccgtgcaatcactgtgcaaagcatactgtctacaccgagcaatcactgtgcaaagccaactgcctacaccgagcaactactgcgccacacgctagttatatatatatagaacaacagtgcaactcatttccaaaaacaaaatctccttacggtttgccgggaggggttcgaaatttcgaccttgggggtaacttttgacggcgcattcaggaaaactatagattttccgatccgagggccaactgagcgccaggcgccgaaaagtcacttttttcgaagcagtttttgcagtttttgggattcaaaaattttttaaaggcctaaatgaaaaatccgctcccataggattttaagttggaatgtttggcacattttttgcttcttcaccgaacccctagggcctaccagtttttccgaaaaactgactaaaaattgcatactttttggggccatttcagcgccggtggaataactccccggcttttgatgggaggaggtcggtgtaagcggcttttttgtacagcctgacgagctctatccaaccatgtttttggatttctgaaattttcagaaattttcgagctaggccccctcgaaaattttccgtttttgaattttatgattttttacagatttttccggggaaaacggagaccactttcaagcaaccgtttttcatgctctatcgattggtgtcattttcagaaaaatttttcaaaaatttttggaaataga

SEQ ID NO: 20803 - DNA, 430 bp, Heterodera glycines
tagaaataaactaaaaacagtttgaaattaccttttacatggttaaaaatttagcctattaaatatttaaaaaaaatttattatatttttttttgaaaaattccgacttccgagttccgacttccgacatttttggagtcggaattccgacttccgaaaatttttggggcctcggaattccgagttccgacttccgaaaaatttttgctccccggaattccgacttccgaaaatttttagtgcctcggaactccatccctgctgtttacgactgaaattggtcggatatgttccaaacatccatttttcgaatcccgaacccgaattcgaaaattttctttacttttttttgtttttttatttactgaggctggtactttctttaataatttgtcagcgatgaacgaaaaaaaataaaattcatttttca

SEQ ID NO: 20804 - DNA, 792 bp, Heterodera glycines
ccccccccccccgatttccccgtttttccttttcttccgttcgttttcccatcagctcgctgcgagttttacggcgtttgtctcttccgccgagctcttctcctccttctcccttccctacggcgctgttggtccatcggaatgctcttagctctgctgacacttcccttttgtcctttgcccccccccccccgctcgatcgttcgcgtccactgtcactcggccatatctctccgcttcatcgccattaaattgttgcgttagcgccagccgaagcgaaagtgactgcccttccccattttccttgctcatctcatttacaattccgttcggatgtgattgccccccccccttaggcaattgaataataatcggaatttgaaatttctttgaaattttcaacccctctcttttagccaattttgaaaattcaaattctcttccctctcgcctccaccaagaattctgttccgtgccgaaaattgccgaagaaacgccaccaggtttaaacctggacctccctccttgcgcttgagcccttttgagcgatcccaatttccctttccagcatcctaaactccgatcacttcagcccgcccgctccactcaattcggaagcatctctgctccgatcactttggcccacttcacccaccactccctgaatttgccccgccccaagacgagaagctgccccttctcttcctgtttttcctcggttagagaaatcattttggggcgaattttggcgcccaaatttcgttctcaattagatatcttggtccgttgccc

SEQ ID NO: 20805 - DNA, 2366 bp, Heterodera glycines
gctttttagcttttctttgttaaccataataaattgattgggattccgattggaaagtggcaaaataaaaatatcaaataaattgttgcattttaacaaaaattaattactaatttttgcaaaaaataaattaaaaaaacaaatcatgaaaaccggaataatattaacgttattaatcataaaaaattcatttcatcaaacttttttctctaaattagaccaaataaaatcatttaatgaaatatttggccacggatggtccgatggagaagagcaaattggagaaaatcagactgaactggccggcacaagtcaaagtcgtcgaaatgatctggaaagaaatgatttacaatcgcgaattgatcaaagccaaataaatggacatcgatacggtaagcgattttaatcggttgagccttggcccgcaacagtcggagggataatctttggacataaggtagatgctcttggatcagcttgaatttaatggattgatttgcatgatcaaatttaatgcttgatttagcgcattcggttttgaatagggttggcaccatgggtatctgtcatccggcacccggacagatttggaaaattgagatattgggactccaataaatcgtaaaattttaatcattcaataggaccaacggaaatagactaaatttgttaaataaatggttgtattaaatagtgaaaaatggcctttagataattccttctccaatcacttcgaaaatgtaaagcaaaaatattctgacttggaaaaattggaaattgtaaagaaatttttcgaattaaaagcaaaacgagtagcagcgaaagataaagcaaaattaaatgagcaaattaacaaagaaattgccaacgaattgggcacaggagtgacaacaatttacaattggaaaagagaatttaatattggtgagttaaatggaaaaaaaatcaatttacttagtagtaattaatgaatacattcgatttatttagattaaaaatatttatttaaaacaaataaataaaaagttaatcaaaaaaagaaaaaattgaaatttctttcatattgttaaatatgtaaataccaaatgtaatagaaaataaattaatcctttaaatatttattaataataaaacaattcttttctccgtttgaataaaattatttaaggcatggaaaattttgatgaaactgagaaacaaaaggaaattgttaaattgtttaaaaaatataaaaagcaaaataaagaaaaaacgaacctcgaaattgctaaagaattgggaattcatcaaaataaactgttggaattcagaaaaagatttgacccaacctataaaagtaaataatttgagtaaaataagggaaattatgggtaaataaataataaataatttttaaaatgtaaaaaattaaataaataaatattaaatttaatttaaaaaatattcccaaaaaacagaaaagcttcttgcgaactcagaaaaaattgcattagtgagaaaatattacaaattgaaaagaaaattcccagaattaagccaaaacaaaatagccaaaattttgaagattagtaaaaatgcattaattaaatggaagcaacaatttggcaatcaatttgaagaacaaggtgaccaaatttaaaagattacgatgaatacagtaacataaaattacagtaaatgcccgggaaaatgacggtgaagcgaattccgaagaagacaggcattttttttatttgacagcaaaaattatgtaaattttattttaaacaattttattttttatttagtccaaaaaatgtctcatccaaaaatgctgatgagacaatttgggcatggaacaatgaaacacaaaaaagaagtcgaaaatgaacaaaacttattgctaaaattggatgaataaaaaagaagggatttaaaaagggaaaaaatgagagatattttttcgttcataacaaagtattttgtcgaattatttcatagacggtaaaaaagaaaaaaaagcgacaataaatctttttatggataattatgggaaaaaattggcgttctgtcacatttactttttatctttatttctctcacttttacgtactatctcttcatccttaataatgtaaagaacaacatttacttcatcctgtttaacttttttcctacttgttaaatccacaccaaattttgcatatcgatagagaaaaaaatatagaatttttcaatcgctttttaaaaaaaaacaatcgtttttatttaacttaaattttaattttaaggcaaatttaattagatggcaaaaagaaaaattatgtgcaagcttaatgtaattaaatcggcacaaaaacgggtgagaaatcgagaggagcgacaag

SEQ ID NO: 20806 - DNA, 1184 bp, Heterodera glycines
attttgtgttaaggacggacggacggacgaacaaatgttacgacagagtcaaaaaacatttacagttcggcgaagaacaaatattatccgcgcttaatctcaattgaattttaatttttaatgccattgcaattagtgggaaagggcaaaagaaatgggcaggcatgacggagagagaaagaaaagagagaagcagatagtgaaagggtgggaagagagagagagaaagcgtgacacagtgtctctctgttcgaatttaaaataaaaagcgaaaaaaaactaattaaaaataaattaaaaacaaaaaacaaacggcagagaattaataagcggacaaaagctgattccgccaatatttctctcctttttttgtttatttgttcttcacttttcttttccatcccttttcaaatggccattcatttgcctaatgacaacaattaattaatgaaatcgttcattcattaattagtcaccgttttcccctcatttgtcagcgatttcttcgtcgatttgctcccttccggcgactcttcccccattctctccgttctcttccgtttcgtggactgccaatcggcggatgacggcgaagcctttcttcagattttcgcctcctcctacggccattggcgtcccagcggttctgtccatcacttttcacttggcgaggcaccgctgcggctgcatgtccacgtgcatcagcagttttacgcgctgcaaatgaatggaacggaggtggaggcggtcattcacaagagaccgttcagccaaattttggtgtggacaaagattggggaagagaaggagacggagacggacagagacgaggagagaaagcattaaatggagacagagacgaggagagataacgagaaaaatcagttattttcgatttgaaagacgggtgattaaatgatctcaaatttttggctattaattaatttcaatttttgttttatttttatgtcactgtttctttacctttttttgtctttttaattaaatataaattcatttaattgtataataaataatttttgtgttcagtttcgaatcgctttttcacttctcctctcttttgcccttttctcgctttgattgacaattaattttaatcctcttacgatgggaaagtcaacactttaagcaaaagtgccctttctttcatttaagcagcttat

SEQ ID NO: 20807 - DNA, 1114 bp, Heterodera glycines
  misc_feature (31)..(31): n is a, c, g, or t
  misc_feature (38)..(38): n is a, c, g, or t
  misc_feature (77)..(77): n is a, c, g, or t
catttaagcagatatatcagtgttttatganctgaaanataataaaatgacttttctttatcatgaaaagcaaattnaataattaattattttatgtatttgcataaaaaataaatatgacaaaacgacacaaaaagaagaagaaaggggtatcagagaaaagagagaaggcaaaaatacacagaggaataaaatatggaaattattaaaaataaataaataaataattatgtttgggaatgataagaaaaggagaggggaggagaaagaggaagagggtccttcctcattatgaggtacggacgaagaacgaatggatattcattattaattagttagtgttagcggaaggagaaaaagcaaggaaatgttggcgattaaatgaatgaatttgaataaattgcaaaaatcaaatggaaccaatgggcggggggtgggagaaacctttgaaaaacgcatcaatcacttaatgaccatcatcataagaagcgtggccaattggcattccgtcgctgtaccaaattcggtccttccatcggcggtcgttcgtccgtccctttttcactgattgtacggtggcagaaatttgtacaccttttttggtttcgtttcatttttttgtttgattgtgccaatttcccctttccttaacgaactgaccaatcgctgcttcttctccggcttttggatgatgccctttttgtaatattggcgaagtgatcgcgacaactgatcagacaaaacaattgcaaaaggtttcaaatggcaaaggcttttcccactcactttgtcgtaattcatcgccgcccgatttttgcgcagcccccaaaaacgcgccaaatggtgggacgactcgattttgaaggtcccttaacggtctctctcaaatttggtcccatttcaaattatcattgctctttttccaccttcctttctgtccacccaacgcacacagcctccgtagtccctgggctggtcgagcaattcgcgaatgaaatgccacaagtgaatggtgccgccgttgccatgcccgcaaacggtgcgctgcggttgcatttgctgcgtttggtggaggacagcaaacgcagcggtggcactttgttgttgatggaca

SEQ ID NO: 20808 - DNA, 3199 bp, Heterodera glycines
cgccgtgtatcgtcacatatccatgtcaatggttgtggcataatgtgccaccaatgtgccataccaatttgtgccccgggcacatacacatacacacacattaaatcattcattccaattaattttccaattaagccaaccacttattggctccagcctcgcggccaattaacccccggtccctctgtccgttggcattttgctgatttcaccccctctcatggcaaattgggtgtgccaattgacaatgtgtcccccaagcggtgtgtgacaaacggccacaaagcgttccaaccgcctccccctggccccgggggcatttgggggcgacgacaactaagtcgtaattagttattttccatggcaattaattaatgacagccaattgatgatgatggtgggtgaaggaaggaaagcctgtgctgctgctaaattggctgggtgctgctgctgatgttgacaaaaaacataattttgtttgaatgagtgtgtgaaaagcgcgaccttttgcccccggcacttttggcaatccgttttggcgcaaaaaaattttttagtcaattgctacatattttaacaattgttagaaattcgccgctaattagtgatgtccgagagtcttggcatatcgagtctttgactcaagaaaggtctcaggtttttggtttcgagtctctgtcaactcgagaaagttctcaggtttttttgatcgcgagtctcgagtctcagctagagaaaggtgcccggtattttcctcttcgagtctcggtctcaaatctgaaatctcgaaaagatttttggtctcgaaaaagcactatcgctgatggcaccggaatactgctgttggttatggggttgagttgatttttgggcaaatggcatacttgatcagaccccgacagaacattaaccccgatcgaacggccattcgtgggcaatttttcgcttttagtgggtgagactccgactttcggcactattaagccttcgaagccgagcgagcgagcatttattagcatttcgattttttggaaatggtggccgaaccccggagctctattcgaaagccctaagtgtcctctattagcctgcaaaattttgaaaaatttcgttaaggttcaaaaaagttaaggccagaagaattcaaaaaagcagattttccaacctttttggccataaattgttcaaaattgacaaaattttttggaattttgtaggctaatagagcatctgaagggctctcaaatgataccaagattattagatttggttgacaaagaaaaaagaatattatataattctcgcaaaaattttaaaaaaattgaaaaaaatcataaaaaatttggaaattttggaaaaaaattgtttacctattttttttgaaaacagttaacatacaaaaaaatacaagccaatttctgattgttcattgatcatccatcccattttgatggccaagcacttatgcaaaaacatattggcctaaataacggcggaattttttttgcacattttccacatttttatccacccgaaaggcatcagcaaaattttgcaaatgttaatccttatcagcctatcaccgaagccaggcaatgccactccacactcataacaacagccaacaaacaacaatattgttgctgtcagcacaagcgcgccgcggaaggcttagcgacgaaattgcaaagttcatttcgtctttgtgggtgaactgtaagccaaaatccgcgggtgggggcgggattagcttaagcgcgttcagcgaaagctaattttggcaggcacaaggtgccagtgccattttaatcatttttatgacaattttgttcgagtgccgaagcggtgcccggggaggtcaccaaatgtcatggaaaaacatcgcgtcaattggataaggaggatgaagccgatgtcccctacccaccggaggagggggaaggcacaaatgcttcttctccggattgattttgccccgggccagccaccaccggcccggcccaattggcactccaacactcattaaggcgcctcgcaggctaatgagcggcacggcacacacacatgggagcagaattttttgtgcggcatgggctgcttactggacggcatttatgggaagcaaaagttttgttttggagacagcggaggactgctaattgccataaaattggaccgccgcattggagacacacattcacacacgcacactaattagtgctaatgggtagcttaatgggagggaggccaacagaagggcagcggatggcttttttatgccgcagggagcaaattttaatacgaaattttcgtagaaagaaaaagggctacagactgttttgcaaagaaagcttttaatctgaaatgtccattgaatagttggatttacgatacattcttatcagagaagggagaaatttttgaaatttttgggctaaaaataaaataaagtttttaaaaaaaatttacgacaaaatctggccgagatgaaatgaccagtctgacgaatttgtcagctacggtattcttatcatagaaaagaagaaatttttcaaatttttaagcctaaaaaaattaaaaaaaaatttttttacggcaaaaactggctaaatcgagaattatatctgcacacggccaattctcgtcatttagccaattgtgaggtaatgaaagagtctgttgctgatcaaaagtccgccgcttttataataccgtaatttgggacggaaaacaaatatacagtaaccaaatttgcttctttgccagccgatcatcacgtttaagcgatctaataaagacaaatgaacaataaatgccggacaaaactcatcaaaatcatcatcatcatcttcaaatcagtcccgcctccgaagggccatcaaactttgtgccccgggggcacatcatttatttgtttttggctctttttaagtcgaccgccactcaattggccatatggccaccgaaagtgtggtgcccgggtggtcaaatgtgattggatttaatgggatttatgaagcagatgaagccggtatgaaaataaatccacagatgggcgggtaaattagcgtatgaaaggggcggcacaataaaatttattgcgtactacttatttgttcagcgatggaatggtggcggcgccgcgctctttcggcacggcaatgataaaaaagaataaatttaggaaaaaatgcggggt

SEQ ID NO: 20809 - DNA, 929 bp, Heterodera glycines
  misc_feature (6)..(6): n is a, c, g, or t
  misc_feature (822)..(822): n is a, c, g, or t
ttcccnttcggcataagtcaatttgcaccgttaaaatgccataaaccgttttgatttttgcttatataaacggccgcgtcggcctttgctgaccaatcaattagtgactgctaattgtttgcttagttgcagtgccaccgaatgcacctcaaccaccaccttttgcagcagcggggggaagtgccgtcgccgccatcttcgcctcctccggcgccgcccattgaagcggaaaatccattcacttcgccgtcgtatgactgtaatgtgcagcagcaacggcatgaccacgacgaagttgggaacggtggtgttgctgaccatcgtcattcgccaaacgacggcgttggcatttcgtcctcttctgccacttcctcctcgtccgcctccaaaagttcaatgtccacaaatccggcacggcgtgcgcccgacatgcaaatgggcagtgagtgttattctcgccgatcacttattatcaacgaactaaaatgttcacagaatgcccctgggtgcgtgtgtacgacaacgtcacttacattgtcagtgccattgcgttgcgcgacggtccccgcgggcgcgaagtgttgttgatgagagaggcgaaggaaaagtgccgaggcaaatggtacatgccggccggacatgtggagccgggagaaacgctggaggtgatcagacggattttaatggggttatctatcggttggaattcgatggggaaaaacgatcggaaaaggcaggggaagagtgatcaatcgtagcagaaggggagagagtgatcggaaagggcaaaaagggagagagtgcgacaaattttggatttanaatttatgcaaaacgaataaaggaggcgtgcagaagagaattgcgggaagagacgggcttgcactgtgcggtggagacactttctgtgcgtggaagtgcgcggctcg

SEQ ID NO: 20810 - DNA, 1223 bp, Heterodera glycines
tttcgattcagtaatcgcctcgaatgtcttgtccaccgatgtgttcgtgatcagctccaacttttggatgagctgacccttccggacgcttttccctctggtcattcattcattcaccaattaattaattcattaaaatttaaaaaccattcccaaaatggtaaatcatttgccttttcagtcgaatttggcttcgaatttttcctcccctcggtgatcaccaaagtttatcgccatgtgttcgaagatggggtcgtccaattggtcctttgttggcttaaagtgactgctttctttaagcattgcgtgttggaattgcccgaggctgtcactgccctttggtgtctgcccgccccggtcagttcagtacggcacggaattcgcctgaggttgttgtgtcggcataaacggagcgcccaaaggggccaaattttggcaccgcaacgataccgatggattgaggtggggggtgggggggggaggagaacggattaatgtaaatgaccaccaaaaatgaggtttatcagttgatcaattgagggggaaagcaatgcttttggttttgccctcccaaaaaggggtaaataaaacaaaatatgaaaaacaagcgacgaattaagtgatcaaatgagtttgctatcattttaaatgatcaaattgtatctgtaattggcaacttttggtccgatcagttcattaattcattcattcccctggctttagctgaaccatcccgaggtgctttccactttgtatttgctggacgaacagttccgtcccaaattgtttcttctctgatcggtgttcaagaaagaaagacaattcgatgatcaaagaccaaattaaaattatttaatattttacgagtttttgaatttgggtgattactcccaaattgccaaaatgtgtccggcaattccaaaattcatcctaaaattatttgtataatttcatgttattatttaacatttcgctttatgtaccgtccattttttgaatttgtgttgtaaaatttgcaatgtttaaaattcattctcaaattattcctaatataattaattagatttttacactcttttaatattaatattaacgaaataaaataatattaaattaattgaataattaatatgcttcttccgtttgattctttttttccttcctattttcattttgcttctcattttccactttttctttatgtaaatcggttgacataaact

SEQ ID NO: 20811 - DNA, 2797 bp, Heterodera glycines
  misc_feature (74)..(74): n is a, c, g, or t
attaattgtaacgaaaattcacaaattggagtccaccaaactttttcaattttatgtattcatccactaccaanagtatgaggtttgttgacacagtttctaaattaagaatcgtatctgggctaaaaataataaaaggtgaaaactttcattggggaaggagaggaccgtcagtacgagcgaaagtccttgggggaattgtttctttaaaccaaaatgctaccaatttggccgattcgtggcatagtttatagctaaatctgtgttgaattatggcaaattttcaaaaaatataaaagttctgtcgtaaaactccgaattaaagaaattcggcaaattaatccgggttcgggcctatcattcattaccttatttcatatagacaatttctatacaaaaattgttccttttactttattaatatggacctatttttgattagaaaaacccaaaagggtagggctggttgccactcaaaaataccaaaaagagcaaatttgtgatttgttttgggccacaaatactaaattctgtcttagctttgaattatttgtttgtgaattttaaaaataaatctcgttaaattttgaaaatcaaatgataagcacaggctcttatacattgtagagggatttgcgattttcgaattctgctgtaagagtctgcatcaggggtgggacaactctcgcctctcgtctctcgcctctcgccaactctcgccatttttggtactctcgcctctcgttttttcggacgagaggcgagagttgaaaatacacccctaaagattgaacttttgagcagtcagaaaaatctgcctttcattatttttctcttgggttcaattcctcaacggtacataatttttttttataatttctttaaattatttttcaattgaaatggttcgaatggcaaaaaaaaaatggacaaataataaagtttgtttataaaaatatatttcattaaaatatttattttattctcatgaaaaaattttagatttttttggatttttcaggacctggactcggtttaaaaactaggactctgacccggcttttctggacccggcaataccctgacccggtatttgcccaaatacccgggcccgtaaccctaattttatatacgattttgaagttttttaaattaaaaaataagactacagaaaaaaattgaaaactctcgcctctcgtcctctcgcctctcgcgaactctcgtgtttttggggactctcgcctctcgccaaactctcgctctcgtctttttggggactctcgcctctcgccaaactctcgctctcgtcttttctgagacaagtcacacccctggtctgcatgttctcatcttggcactcaaacccggcatttgttagcaggattttcccacgtgattcgagaatcttctctaggcaatttgttgtattttgagtgcagtctaacggagatgtttgtatagaaaaagtgaaagcgatacttttgcaaaattctatttttatttattattaaattaattttatataccgtattttctctaattatccaccttcttggtgaacgggggggggggtgggttgagggctggcggtgccgataggagccgcctgggaaaattttgaaaatttgagtgtaatttgttaacagattttgtcgaaaaaatgtccaatttgtgatttttgagccatttaaattttagattccggcttgccgataggcgctgccgggaaaatttttggaattttggctagtttttaaacagatttttttgtacaaaaatgaccaaatttgtgcaaatcttatattttcttgataaaacaatgacattatgccatacaatttcaaaattatgatttaagaaatcagcacaaaatttgatcactaccctcaaatcagaacatttttattttctcagatttggaccctccaaatcaggacatttctgataataaggacagatcgaagccctgggataaatagagaaggggttattatttttcgacagatttttttttgaacatgtcgccaaaaaacgtcatcacatcaaagaaattttttttatttcgtttctgttaaagaatttctgaatttaacctgaaaaattcgaaaaactagggaaatttaagctaacttttgaaaattcataacgcacttcagatttggaaaatgttagtgttataaagcataaaaataaagaaaatcgggagaattttatatattttatttggtttttctaacttatgaaaaaaatttttccagaaattctggaaacattcgatttttcagaaaaaattcagaactccgttctgaatatagaaaaaataatttaaaaacttttgtcgaaaacacatggcacggcacgttgcgtttttttgtaatatttggctttgtttattttttaagaattaaaattaacactcaaaagaccatctcgccaatatttaccttttttttgtttggacaatggtaggggacgaaaagtgcaagtaacagaataggctcttaaagttctacgggatttgcaaaattctctagaccacccacaaattttgtcctgccaaatatatttttggtctccgctttgcatatggcttccttcatcagctttcccttccgaagaggtactcatagcctccataagtgatcagctgacgctccgattcgattttctgacagaaaaccaaacaaaagcccaaaaaatacaaattcagaacaaaaacaaatttattaataagcatttaaaggcgaagctcaagaataaatgtaaaagaatgataatggaaagtgcgaccatggag

SEQ ID NO: 20812 - DNA, 872 bp, Heterodera glycines
acgatcgaaccattgtcgcgcgtgggcaattccctctcggatttcgggatgatctcccttctccaatgagtgcctttcgaattccaacggaaaacgcaaaatttgtgcaagacgaaaggagaaaagaaaaggattatcatttgaggaaggaaaaagccaattaatgtattacctgctaattatcacagtgtctttttgcaaattaaacgccgacccattgccacgagcggacgaagtcattcgacaaaacaatgaatagagacattttttaaaatataatcatgaaacttttggaattgatccacgatttcaaaatggcaaaggaataaatgcacaatttgatagtgttgatgatttaataaacaaaacaaaaaaaacagatagcgattggtattatattaaattggatgcgcaatgtcatacagtccatttcaaacacctgaaaattaaaccctttggactgagtgagatcaaaaaaagaggggggggggggggggagggattccggcgtaacccaaaatatcgttgttgttttagccgattccttgcattcggaaggaaaaactttcattcttttccctttttctcataaaataaacattctcgttattaatttgggataattttgggccaaaagatatccttgtctattggccttcgcccaccgaccgcgtgtccaaatgcatgtccttgcagggaatggagcaaaagcgggcggaacagcgaacgcaagtgtaaccggcaaaaagaccacacacagcgcaaaactttcgcgagggcactttgctgggagatgaagcgacctgaaaatgaaaatcataaaaatatataagattgtctcaagccaacggccatgcgatttgacgatcgat

SEQ ID NO: 20813 - DNA, 1802 bp, Heterodera glycines
  misc_feature (164)..(164): n is a, c, g, or t
  misc_feature (1016)..(1016): n is a, c, g, or t
cacttcgtaataggtggcaaaaggagttctgggctggcttctttccgcctctgtggagtttcttcctcgcgctttcgcttaataaaaataaacatttggatatgggctcactaaccaacatatttaggccataagaatggtcttgggtccatcatttttgaaanagtcatgaaaaatgctccctctgacaaaagatgacatttgtcaattaaaaaacccttcatccaaacttaaagaaagtccaaaaatcgccgaagttctaattcatgattttttattttaacaattcgcgcccctattttgccttggtttacctgcgcttcttccaaaagttgagcaaatgtcttcctaaatcgcgtctttgtcaaagcggccacaattttctttccctttttcgctgaatgatcaaatgattcatttctcttcccccgacttccattcacttgcttgctccgctccgctgacttttgagggtgacgcaattttccgttttcgccttttcttttctttgtctccaaaaaccatttcatcgtcaaattttggtgccgctttgtgccaagtgatattcgcgtggggatcctcttggaaattatcctgaaaaacgggaaatgcatcattttccgccaataaacggactttctcaagtgactccaattgttgctgaatgcgccgtcgtttagccgcttcatcaaagcatttcgtgggttgttgagaaatgatccgacctttaatacattaattccctaaactaaacaaactcctaacactaatttactggattgtcgacttgaacgctgttgaaattttccaaagttactttgcgttgccatttaaatttacaattctgtgatctgaataaaactgaatttatttacctacaataaaacagggctcgcagatctgaggatttatcctcattttgtggctttttgataggtcaatgaggattttttttgaaatgatgatctgacaatcatttaatttgaatttgggtttttaacacagcggcccaattntgggctccaagtacaactatgctggatttttcgtcttagtggtctgtgagttagtcaccaaaagaggggtcccaggttcaagtcctccctatgttgtgtgttaatttcaatttcttcttttaaagaagaaggcagacaaaattgctcataacgccaaatagcgcatttggcgtaaatttttgcgcgttaattcaaaatttacactggtaaaagccttttttgtattgtttattttaatcagacgtaactcacttcattcccaactaaactgaacaaatttgttacctaaaaaaagtttttgaaaaggagaatctttttctaagcgaaaactaagcaatttgattttttagaaaaaagttgtgggagtttcaaatctttattacgttataactcaagtcttaaactgctgatttcaaccaaaatgcggaaagtaatcatttttctattgattctaaatgtccaacagattttgtaccgtatcaacaaaaattaatagaatttgcgaatttcatgatttttaatgtgttagagacatgaaaatagtacgccaaaaagagaggaaaaaaatgcaaaacttttattattccataacttttcaattcgacctattttaatattaattgacctattaaccgatgcagaatttttttctctatcgatttgcaaaatttggtgtggatttaacaaacagaaaaaaaagttaaacaggatgaagtgagtgttgtttttacacacattaaaataaagagatagtacgccaaagtgagagaaattataaagaaaaag

SEQ ID NO: 20814 - DNA, 3625 bp, Heterodera glycines
ccaggcagtcaattgattaattggtaattatgtattatataatggggacgattttgtttatgcattcttcaaaaaataccaatgagagaaaatttgatataaagcggtgaagaaaaggaatacattctttaaaattaaaaagcgataatcgtccatatccccgcccgtcggttcggtctttgggcccccatcagtcagtgtaggaaaagctccgcttccgatggcatgtcaactgtggcaccgtttttgcggcaatagtcgatcatcctgtaaaaggataaaaaaattaattcattttggtaggaaaaatgatatttcaaaacgatccaagacgagtccctcatcatcactttggcatttccgacgatgatcaaaagctcttccgcacgagtgattattgtgttgaaacgctaagcgttgaaattaacaccaagtttttagaactggattaaacaaccttgtccgacatcaaaaagccaatgtcctccttttcgttgttccgaacagtgctgacaatgatcacccgacgctggaaaccctggtaacgctccacggtgtccacagtcactcccttgtgttcgttgctgagtttatggcgcagccgacgcacctaaacgtgaatcaaaattaataaatgatgactgacgatacgccaaaatagtgatttctagtgaccgatagtgacatcagaatcgaaaatttttaatgcagaaatgcgttttttgagctccaaatcgtttaaaaatgggacacttccaggccaggctggtccccccatcccatctttccacttttaaatcacaaaacattttttgaatcaggaactattttagttttaacaaaatatttgttgtaagtttattctaaaatgttaaataaaaaacaccaacaatttgctcatcatttaaagcaatgcttcattttaattcttacgtgcatgaacatgttcaacggattgcccgtccatttgaacgtatgaccctcgcgagaaaaagcactcggtcgccgaattgatctctcaaatggtctaggtcgaacaacgcagcactaaaaaacacataatgggtttatttttgtccgaggaatgttattctactcacgggtcattttcattgacccactggtcgaaagggcggagcacaacaatatccttggctgcagacgcacatgcttgtttgtaagtgggtataacattcatgagtccagtggttttgttttttgcaaatgtcacaaaacatttaaaaatttggagaacagagaaatttctattttgaccgcttcgtgtcttagacgagcgctcgcgccagtttctttgggtcggtggtcagtttggcgctgccaacttttaatgttctattcaaactaacgcgaaaaaaaccataatgccaaatatatttttttgtcaatgaaggaagccgctgcccgtcaaaatcccgctgcgtcaaaagtatttgtatgtatattttatattatacatatataaaaatatcagaatagattattctaagcaaaatgggtcgaaaaaattgaaattcttcataaatgttgtaaacacagatttctgaacaacaatgacggcgaaaatgcaaaaaattctgatcattgtgagcaaacgacaacaacaatgaacgttatgaagactggagaagaacaagacatcaccaatttcaaacttgggaaaactcaaaaggtaggcatttgtctaagtcttccgatatgtgattgaaaaaatctgtggactgccacgcgtgacagtcattgcttgatggcgtcaacgcgtttggtgttcgttcggcgagtgttttcttgccccaaataagctttcaatgtttgttctaataatttttttggtattttacggttatctgtactcagggcattttttggttatacgagtcgtcgtcgtgtcattttttggttgtgcgggtcatcctcgtgacattgtgaagcgattttgtgtataaaatgtgaattttttgaaaaatggattttgagttttttcaaatccgggtttggggttcgaattgggtcaaaacagatgccagaatcggtttcaccgaccttgaaaacccctaaaacaagtttatttcaaaaaaatgtttttttttcaaaatctgagtacagataaccgtaaagtaccattttttataatttcctctttgattatttgcattttaagcattcgcggggcatcattttcaatccgttgaacccgaccatacgtattcacggcagccgttgtagttcggcatcaattcacccgccccctcaacaacaacattggtctcgaagtaacccatcttttctgtattttttacttgtaaacccccaaaaaacttaacaaattttataagtgtctgatcgcccgaccctttccgacttaattgttgaagtcagcagaaacatcgaccgacaagcggacgcagcgaattgagctcggaatttcgtgcactatgaaaattttgaagattcgatcatacaattctcttttttcgattcattcaatatttaaaaatatcattatttttcgtgaaaattgttatttatttatgcgattctggtaaagtattaatgaatttcgtattttgaagccttaggaatgtaattttaagactttttcgctaatttttatttggcgggatttcgactcattttggctttggcgggatttcgacgcggcgggattatgacgcggcgggatttcgacgcggcgggatttcgacgcggcgggatttcgacgcggcgggattatgacgcggcgggatttcgacgcggcgggatttcgacgcggcgggatttcgacgcggcgggattatgacgcggcgggatttcgacgcggcgggatttcgacgcggcgggatttcgacgcggcgggattatgacgcggcgggatttcgacgcggcgggatttcgacgcggcgggatttcgacgcagcgggatttcgacgcggcgggatttcgacgcagcgggattttgacagcgcgccaaaataattcttataaaaataaaataaaaccaaactttttcatttcttcatataatatgcgccgttttcaaaattattaagtcaaaaatttgatttctgcacatatagaaatctgaaaaaattgagttaagatgcactttatgagtccaatcaaatgaccacccttgcttttgtggaccatatctttattctagagtgccacgggaccgggaatttttgccaaaaccgggaccgggacttgccgggacctgagaagccgggaccgggacctcgattttttttcgggaccgggaccgggaccgcaagaaaaaccgggaaccgggaccaaccaagaaattttaaaaattcaaaaaaattttaaaaattaaaaaaaaattcaaattttaatttatatcaagtgaaaataatacaaaattatttggttttttataataaattaaattaatgaaaattttcaaacaaattttcttcaattatttcaaacaattaatcatttttggactaaatcatcgaatattaatagaaattcagatttgattttcacatcactttttttcggagcgccatatataaaaatatcataatagattattctaagcaaaatgggtcaaaaaattgaaattcttcataaatgttgt

SEQ ID NO: 20815 - DNA, 1953 bp, Heterodera glycines
cagatcatttataaaaattaaaaagagtaatggccttaagacacttccctggggcactcccgaaaatatgctgaaactttctgacaatacttcgccgattttaaccttaaaactccgattttttaaaaagttagttaaaaatttataaatttttccttcaattccaatctttttgattttttgaagtaataaatcaattggaactgaatcaaacgccttgacaaaatcaatatagataatgtcaatttgttgatccttttgtagagaattatatatatcgtccattgtttttaatatttgggttgtagtcgacctattttttaaaaacccaaattgttctttatcaaaaaatcttataccgttcagaaattctaaaattttgctacttaaaattcgttcaaaaactctacagacagtgctggttaatgacaccggcctgtaatttaatggatcagttttttcgccttttttgaaaattggtaccactaatgatgttcgccatatttccggaatttgaccggaatccaaagcaagtcgaaatatgtcagctaatatttttgtaattggctcagcacaattttttaataaaatgtaaggaatgttatccggtgaagtggaatttcgcctggggagctttcttaatatattccaaattatgccagcatttaattcaatatccgaaagtttagtcttattttgtgctgattgagtcagtgaaccattaacaactgaattttctaaaaaagatttttgaaatatttctgctaatatttcgcatttttgctcattactggaaaacatatttccagcactatcaattaacgtagggatttcgttgacttttgataatttatttcgaataaatttgttaactgaattttgcccctgggaaataatttttgactcttgttcatttcttaatttgtgcaattgttttttcatttccctagaaataattttgtaatttaaaatgatttcacttttttcaggaaattttcttacaagcttatgtaaccgtaatttctctgaaaataaatctcttattttttgaggatacgattgttttattatcgattttagaggtctatttggtataaaagtatcatataatttcagtactttatttaagaattctttatatttttgatcaacggtgtacactgagtttattgataaatcaatacgattttcaagaatcgcccgacttaatttcgaaaaattaatatttttaaaatctcttctataaacattagaattattacggctgaatttttcttttattttaaatccgaccattttgtgatcggaagttgaaaaatgttccaatacaattaattcattaattaattccgattcattagtcattactaagtctaaaatcgtattttctctggtcggttctttaacatgttgtttcaattgtctttggttcataaactcaatcagcatatttgacataggatcatttatatgttttaccttatttccatcccataaaatgtttgggatgttaaaatccccacagtatatgatattttcggaatcgctttgatccgaaataaatttgagtagcttttttgtattgtgaacgttacaatttggtggacgatatatatttaaaatttgtattggctttttgaaaagtaatttaatgtgtataatttcgctttggaattttgtccctgagaaaagtgtctggtaagggatcattgtttttattaggattgccgatcctccgccctttttttcagttcggtttgcataaataatttggtatgaccatttattgtaagttccgcgtctaccgtatttctggagtttaaccaggtctcattgattagaattattgaagggtcatatttttgggttatatgttctaagtcagttatttgatattgatcgggcatttattaaaaggcaggaaatccagggattattttttatagtttttac

SEQ ID NO: 20816 - DNA, 1106 bp, Heterodera glycines
tccttcctccttttcgctcttcccttccctccctctcgcttccttcccttttcccttccctccctcgccccttctctccctcactcctttccctctttctccctccctcgccccttccctccctctcccacttttccgtcttccttcctccttttcgctcttcccttccctccctctcgcctccttcccttttcccttccctccctcgccccttctctccctcactcctttccctctttctccctccctcgccccttccctccctctcccacttttccgtcttcctccctccttttcgctcttcccttccctccctctcgcctccttcccttttcccttccctccctcgccccttctctccctcactcctttccctctttctccctccctcgccccttccctccctctcccacttttccctcttccttcctccttttcgccttccctccctcctccccgcccccttccttttcgtggcttgtcgctttgtcgctcaccaaatcacaatcaattcccttcccccacttcttttcatggagcatttgttcagagaaattctttatttattagaatagacatttcgcatatgttttaaaggttaattatttgcataaatttgtttgtgcattattatttatttatgtacatatgtatgtgttacggagtttataacacttttcgacaattttttaatcaaaaataataaataattttggtaatacatattaccgatggtaggaccccttttttgaatgatgcaaaaaagaataaaattttcgtaaacaaaaaatttttggaattttgttttctatttttagtgcagtatttaaaaaaaatttcggcacgattcttaggggctgtatatggaattcggattcgcgatcactagggcccggatttttatgtgctaaaaatcctgaaatatgtaataaaatatgtgctaaaaaatgctgaaatatgtgctaaaaacccccaaaaatgccaaaatatgtgctaaaatatgtgttaaaaattgaaaaaataagtgtgtttttgcataaaaattcccaaaaatctcattctttatcataattagccccatacaacgcaaatcaaatacatttcga

SEQ ID NO: 20817 - DNA, 961 bp, Heterodera glycines
  misc_feature (932)..(932): n is a, c, g, or t
aaatcaaaaatttgttcggagataatgctattttgggcttctctcgccataactaagccgcaaaaaaaatatgtaaaaacataaaaatccgggccctagcgatcactgatctgcaacgcataaaactatagtgaacaaattttcacgaaaagatgataataagaccatatctgggacttagaacttgtatcaaattaatagattaattgttggttaatctctattacgactaacttcaatcgtttctcagcaaaatatgaatgtaaataaagaagaggaacgactggaaaagaaagtcaccaaatgggctattatgctaaccagtgaagacaaggtgagcatgggcattcctcagtatgggattttgggtaatacataatactgaaaaattgcggtaaaaaggtaaaacagaaacccataaataattcgatggttttgcaaaatctaagtcagattcgcaatttagcaattttttttactggatttatttcagagaaagttttaacttggaatcgcaattctgcaatactaccgggcccattctgcaatattaccggattttgaatcttttcttatagattgaacatgccttgaggcgattggatcatgttgagattaacttacaacttttgtcttcgactggttggagttttttaaataaatactggtattaaaaaatcgaaaaaacgttaagtacattcataaaaaattttttgttttgttaatttgagcatagaattttgaatattaaaacttccatagaatttaagcgttcgattataccaatgtatacattgacaaagtaagaaaaaaaagttataacctaagaaactgaagatagtcattgatggacgcgtaaactgcggtagagttttataaaattatcaattattttttcactgttttatctgtatagtttttaaaggagttgngtaaagccggtgaatgctctgagaagacc

SEQ ID NO: 20818 - DNA, 2863 bp, Heterodera glycines
cggggtggcggaatgggtgggaggacggggaaattgggagggagagagacagagaagaaaaaaagaaatagaggaacagtgagagagagagatagaaaggagaaagagagactgattgtgagacagacaaaagaataactggtcgagagcataacgccaaaatgaggggggaaggggatgatttatttttgtgatggcagaagcattgcggagtttcaagcctcggttggggagattttttgacctccaaaatttggggagagctcaatgagactggtaactatttcataaatcctggatatcagaattttagctaataaaaagcttttatcaatatataaatatatttaattgaaaagtattacgtaacagtcaaacaatttaattgatttttaatcataaaaaaatttacactcttattaacgcgcatttaaaaaaaaaattctgttagtaataaatttggcctttttattttaaataaaaatgaaagaaatgaaaatcgaattttaaaatttttattttattctctaatgaattaaaagaattttatggcaaatttacggaaaaaaagaataataattttgataggaattttaacagcaaaggttttcacaaacagtgaattaatggaggaggcggaggagaaaacggacaatttgaacaaaaaaggcaataaattcgccctggggggaaatccacggaaaagcgccgaaacgcaaaatcaattgaaccaacggacggacgaccaaagaaagaaaggaccaccggcggatgacccaaaaagcgaaagcagcgacgcatcatcagcagaagaagaagaaagagcgaatggaagccgcgggagaaataaattccatcgcttcgctttttagcggggaaccggcggatgtgaaagtgaatttttatggggcgattaaatgtggcatttttcgagacggaactgcgaactgtacgaagtttttgatgagttcaagaagtgtccattttttggtaggcttgctcgatagatagcggattagctctgctgtcctgtcttttcaaaaactgaaaaattgtggactgatttttcaaaagctttttccaccagcgaaaaagaaaaatcgttaaaaaatcgaatgttcagcggaaaatatttttttttcaataaaaaagattaacaattttttcaaccacgagcgagtcgctgcggaccgaacggccatctcaggcgttctcgatgagcttggcatcgagagcccgatcactgtttacagaatgggttccccggaccaagcaaagacaggtcaaaaccgcccgcggttgatgaaagtaattttcggctgctcaaaacatcagagacaaacctttggctcaatggaacaaactgcgcgctcaaatcagtcaaaaactggggatgagcaacatcaaaattcgcccttcactcagccaagaggaactcaaggcccgacgtgtgctgcaggaagagtgcagcagaaaaagaaaggaagatggcggcgagtgggtggtttacgctgacaaagtgatgctgaggtcagacattgcggcatttaaaaataacaccaattggcttgctgttttaccaaatcacattcataaaacattaataaattcgcatttttccggtcttaagcatgttaaacctaataatccaataagagaaaaaggggacgttaaagcctatttagttaatattagatcaatttacaacaaaattgatgaaatatctttaaatttagtaaataataacatgaaatttgtctgttaactgaaacgtggacaaaggaggaaaacccaatcctctttagtccatggataatcgaaaattataactttattttttgtcatagaaaatctcaaaaattaacacgtgggggtggttgcggtgttttaattaagaaagaaattgagttttttgttaaattttctgaaacaaaatataattgcgaaattttggtttttcaattacaaaaactaaaatcaattagatttgtgcttgtttatcgaccacccaagacaacatatagacaaaccaaggaacttttaaaatttttagaaacattctatagccataattgtgttgtgttgggtgattttaattttccgaataaagacctggtatggaaggaagggcagcccatttctatgagtaaatttggtgaacacgagtggacccaccaggggaaattcgtggttggacttagttttgccggcgaatgatcaaattgtaaagcaatgtactgttgaaggtggtgttttttcatcggatcacttagcgcaaattttcacattgactattccaaaaacactacaaaaaacaaacttcttttacactcgacggttttttccgtcgaatgtttcgctttttaatattatggtttcttctagaattagcgctttatctaacgagcattttagtgtgaacgaaaaatacaacgcctttaataatacattgctagaaaccttaaacgagtgtattccaatgaaaaaaattaccaaaaaagatttgacccctaaatatccaacgcatttattggcctccatcaaagagaaaggcagactgtataggcaatgtaaaactgacccaacaaaaaaagcactttatgatagcattagtttacacataaaaatacaaacaaataaatttcactcgcaaattgagaaaaaggctatttcaaagggaagaaattccatttttaaatacctacaaaaatacaatgttaatccctttgaaataccgaatttaatctttgaaaacaaatgctatcatgatggtgatgaaagaatgtgaattatttgccaacttatttgcaaattcgtttaacaattctgatgttgaccctaggctacctaaacttgggccata

SEQ ID NO: 20819 - DNA, 2403 bp, Heterodera glycines
catagagaaaggaaaatcagcatttttctcttagcgaacattgttttaataaatatcaacatagacgttgatatttatttaatatcaacatacattatgccatcaacgtaatatcaaggctatttttaaaatttagatttttttaaatttaaagcaattttttaaaaatgatttttggcggaaaaataaattaggagagagataacagaaaagtgagagggtgttatattcagccccagtcatacaaaagcatttttggtgaacaaaaataaagaaaaattaggtaattaaaaagagagtgttatgggaagagatttaagacagagagagaatagagaacatagcgagaaatctgcgtctcttaccaaaagaatcagcgaagaagagacatgaactactcccttcccattgcgctctctattgaaattgttttctctacctccttcatcaaaaatgttttgtatgactgggactgagatccagcactctctcatttttgcgttatctctcgcactaaaattataaaccgctcatataaattttaaaaaattttcgcaaattttaaaaattacgttgatatttgcgttgatggcataatgttagttgatttaattaaatatcaacatttaaattgataccccgcaaaaactaataaaaaggttgatttgccattctctagtaattagtctttttttcatattttccctatatataatttattagaatttaaaggcacttttcattttgttgcatatttatacgcaaaactttgtcaaaaatataaaaggctatgttccgatccatgcactttgttcaattttgacctcaacacttaaaaattgtagtaaacatagcagtcgtccttcttcttgctcttctttctccgtttgtcctccgatttctcctcattttcattttcttcgtttttcgctttctcttcctcttcccccatttcctcttcatcatccaaaatctcaatgatttgtgccatttgcttctcattggcagtgtgttgctgcgtaacttgagttccttcatttagtttctaaagattaaattattattttgaatccaaagattgggctaatgaattagcggtgattaaagagagaaaagagagtgagtgtgggaaagtagagggtagagggcagtcaatcagggaagcggtgagagattgattggttccctcaccgtggaatgctaggcaaaatgcagtgacaaagggtacacagcagggctggccgtgatcacggattttttcaattttccgtgattttgatctgtgattggcattttaggtatatatggaatttttattgaaacgaaaacaggaaattggcgtgaaaagagaactttttgagaaaaaaattaaataaataaatatatttctgttaagtaactacgcatatatatgcgtgctgacgcgttttataaattccgccacccatgcgcacccccaccatgcacgttttacaaatccgccagcgcgttttataaatccgccaccatgcgcacccccaccatgcacgttttacaaatccgccagcgcgttttataaatccgccaatataaatcaatatgctttatataaatttattatttgttgtgaggacccttgtaagaaaatatagcaattatttaccaactttaatactggataaatccttatataatattttatctgaataaagcatccgaaaatttttttaattgaatttgtacgacattagctatcacaaaaccttaataactatgctaattaataaagtgttctatggaattaatttaaaaaattcatatcaggtgatggtgcaaaaattttaggagatcagatctcaaaaaataaataaataccctgaagagctgctggaaaatttgataaaattggattgtaattaccctaaggactttattttagacattttgtataaaatatagctgaaattattgcataaaattttaatattattaaagatatatgcaaaaaaatgtgctggcggatttataaaacgcgcatgggtggcggaatttataacttcctttttttattttttgatctacgaaaaataacaaaaacctcaaaaagtcaaataaatgcggctttatattcaaaaaatatttaaaaaaataatttctttcattttttacaaaaaaaaattaataattaaatatacttattatgatatttaaacacttatatttaaatacttacaaaaggtaactagtacatttttttaatttaaaaagcaattatagagaattaaaagaatcataaaaatgaattttaaagaaacaatcgcaaaaaattcacaattatttaaattgcttcttatatatgcgaaagaaagaaaccaattatcttaaactagcaaaaagtaattactattaaacctataatctaaa

SEQ ID NO: 20820 - DNA, 1532 bp, Heterodera glycines
taggacggatttttatatccatattttccatatttcgcgatttatgtccatatttccatatttgtccatattttggcatttttatccatattttggcatttttccaaaaaacctctattagaacggcccagtagataaattggcttttttgaccccgaaaaaccggaaaatttccgaaaaaatcattttttaataaaattttcccgaaaatattgaataaattttaattttcttaaaaatttttaaatttaggtcaaaaataagcaaaaaaaaagtaaaatttcgttttcgggttggtttttcgctaaaaatgaataaattttagctttacagtgttttttcttctaaaatgctttttaatagcatatttagccatttttgaaagttttactttaatttagcaagtatgaagaagttttgagaaattataccctaaattttgaaaaatttatttccatatttttgccattttatgtccatatttcgcgattttatatccatatttttttaacgaaacgtgaaattcataaaaaagcgaaattgcgaaacgctaaacgcgaaaacgaactccaaaatgtcacccgaaacggcagaacagtttatttttctgaaaaatctcttccccaaatgaagtacaattattcaaactttttattgttcatttttgttaaatttgttatataatttctacatacaattgttgaatttttttgggttttttcccaaattaacatgtgaaaattttaatttttaccaacccggaacccgggtatgaaaacccgggttgaccgggtttccgggttgaccaggttttaagaggccgggcccggaacccggttgcttctgaaaatatcagcccgccccggcccggcagatttggaaaatccgatctctaattttgagccattttctaagaaaaaataggagtttttgggggcccgcggtaccgataggcgcagcgggacccacctcctccattataaaaataaaagtgattttgtgatccgttaccaaaggggtgggggtataggttttagagtggaaaatttttttgatcaaaaatcgtcccaaaacatgtcattatgggttatttaagctgctgatcacgaatacgtaatcagattttacttctgacatcgttaagacctcagaatccctgtgtgattggggattctgaggttcatttggagggggggggggcgaagttcgaacccgggcggtgtacattattttctatgtatttttagcatattttcaatatttttaattaatataaatagtattattttattaataataaataatttttttaatttaaattctattattttaaggtgagtacatgttttaattacaaaagaaaatttttaattaaaaatttgaatttgtcaaaaattaatttcatttcaattaaattcatttcaatttcaataattgttcaataactatgtccacttcaaagtttatttttaataaataaatcactgttgtacctcttctaatcactgttgtacacaacaaaatttagacac

SEQ ID NO: 20821 - DNA, 1490 bp, Heterodera glycines
atcaaacccaaaaaatgaaaaatctaaaattttagttcctttttttttgttttctcctttttgtgctaatgcaatttacactccaccttcaccaccacattagccccaacacaacaacaataacaactgtctgttttggctggcctctttaatttcttgttttttgctttttgttttcgtcctccgatcatacgcattttttggcctatgcttcatcccccccccctacttcttcttttgttgtgtgggggtggatgagggtggatgagattgagattgggcttaggtgtggatgtgggtgttgatggttgatcaatacaaatcggataataaagagtgatcgaatggatgaatgaatgaactgactgatcaacagcatgaggagaaaaaatgggagaaaaatgggaaccgatcgtttcggattgtttataatgaactgctggctgatcagtagcactgaattcctagactgattgatcagcagaaggattagcaaattagtgagagtgaggcaattcttggagcaaatttatttgtttattgtgacaaaatttccagtgattaattaactttttattatttcgtaaatgaactatttccttttaattatgcgtatataataaatggatttactctaaaataataagttaaaagattactaaatattaatgctcttgggagcaactattagtcacaaaattgtgatctttgcaatttttatttatttttttataaaaattaatattttttaaataaaattaatataataaattaaaactaaaatttttatttggaaatggatgtttaatggttcaaacattaacacggcgattcaattttgggctccaagtacaattaagttggttttttcgtcttagtggtctgtgagttagtcaacaaaaaggggtctcaggttcaagtcctccttatgttgtgtgttaatttcaatttcttcttttaaagaaaaggaataattattttttcattataaaagttttcgtgtcaataaaaaattttattcaaaaaacgttggttacgtacagcatcgataattttgatgagatttatttagcttataactttgtaaataatagatcaaataaaaccattttatgctcattttgaagggaaaattctggagaatctgtcccagttaacctcatattttaagaaaataatttattagctgaaaaatgatagaaatttaattaaattttcactagggtcaaaaattttttcctatggtcagatttccttgaaattttgcataaacacatattttaacccaacctataggatgatgctttgttttttatcaaaatgctttttaactcgagatcggctcttccgtttttacaagggaaaatccccaaaaaaatttaagttttgcaaagttttggcgttctgaactaaataaataataaacttattgcactgggagcccctcaattgaatcgccgtgtaaacaaagtatttccaaagaaaaaata

SEQ ID NO: 20822 - DNA, 1977 bp, Heterodera glycines
tcattcttggtacaggcactcctggaacattttggcaacgatttttcgtcaagaatcatcgttttgtgtatgtacacataccaaacttcggaaattgaacgaaagctgagacactacggtgttcgtgcactcacagttgatgcctaccaggcacaggagtgcgatgtcatcatcatagtgacaacaagatccaagtattccgagatgggatccggaagaacggacaacatgcacttctttgaagacgatcaacgggctactgttgctctctcaagagcccgccacgctgtcttcatcattggagatttggtttcaataagtgcaggacaagtgtggaagcgcttcatcgaaatggcgataacaagaacaagcgtagtccgagccgagtatgttttggcacttttgggacgaacactcgtgaggtcgtcgacatgcctatttgattcggccaaaagagaatcggtggaggatgaaggctttcttgaaagttgggcattgaagcatgggttgcgcctggaccgaacgaatgcctttggacaacaacaatcacagcagccgcgagctccctcattccaattccagaatcgccactttcctgcactacagacgacagggccctcagatcaagccggtccatctggcagcggtggtcaacaaagaggtgcgcctactttggcaccacagtatggaagaggtcaaggaagacgtggcccggacaaccagtggatgcactacggcggaaacccgaaacgacagaagggtggcagacgctgaactcacatgacgtcctgcgggtctcacttctctccttttcttcaatcagcacggtatgtctttcggtcataatttttattattaattagttgggtaattttccttttttgacccctatcatttaagcactttattttctttcattttctctgcactcacaagcttttcgatttcacccctccttagcttccggtgttcgcaccatttacactgtgattccttgactgcaatggcagaaagtgggatgattctgaaaaggtggcacgcctcaaggcatgccttgatggtgaaccaagacgtatctttgataatttaatgcctgcccacaaagcaacttcttcggaagccattcaaaaaatcaaggaaaaccttgacactccacaaaataaagaactcacctatcaggcactaagcatgtgtaaacaaagggaaggagaatctgtagatgagtttagtgcacgactgattcctctaattgaggccaccacggcggaccttacaactaatgctagtgaggaggtactctgtcgagcatttttggaaaaattgaatccaaatctcaaatttctcactcgaaccctgagtgggcccgtcagaagggattttcaaatattgagaatgaatgcacgggaagcagaaatgatgcatagagagattcctaaatctattccagcacctcttttcccaatttcggaacaacaaaatccgagattcaacaacaccgagccgccgaaccacccggaaggcaactttagaacatgggctcccacaggctctaacagagagcctataagtcccagacagaggaaccggaacaattgggataacaatgcccaagcctcaagaggctcttttaacagatcaaataatcatcctcaaaatgacagaagatggaacaatcgcacttccagaaatgacagacgatggaataatcaaacccctcaaaatgaccgacgctggaatgctcggccagtttgcaactactgtgggaaggttggtcacctcgcgtttaaatgttttaaacgtcgtgacgaatttacccaaccatctaaaaaatttgaatttcatcagagcaattgatgaacaaacagaactgaaaacgatctatcacctaaagttaataagtttacctttaagaatgacccatcccctgagggcgcctctcaaaaaaaaaccccattcaaaaaatatctaaatctagta

SEQ ID NO: 20823 - DNA, 1374 bp, Heterodera glycines
ttaaaaatcaatttaagactagttggcgaaattagttggcgaaacgtcattttttggctgagttggcgaaattagttggagaaacgtcattttttggctgagttggcgaaatgaatgttggccagatgtcggttggcgagatgtaaagttggcaaaatatcagttggcgaaatgtccgattttggctgagttggcgaaatgaatgtttttggctgagttggcgaaatgacaagttggcgaaatgtcatggagccccttgtcgctcgccaaagaagtcaggcccgaagaatcgtcactcgcccgccggacgtggaggaggacgctctcagacgccgcgcaagaagaaacaaccgctgaagaaggtgccgggcccgagcagtcgcactcctggtcgacgcgtgaagaaaccgtcaacgaagaagtcgcctgctcgccgtgccactgagacgaagaagaagccaacccgcaagactgccggtggacgtgccaacaaacagacgaagtcgcgtgggcgcaaaacaaccaagaagacggaccaggaggaggagcgcgccgactccgaggcggaagctgcaggatctccgcgcaacagtggacgtgagttgaataggggtgtgggaatggcacaatttcaattgtttaatcctaatgaaattgaattttcagattccgaagagagtgcctcggggacgaagaacaaaccaactcgcaagagcgctgctgctggacgttccacgaaacagaaggcgtcgcgcggaggacgtgcgggcaacaagaaggcgcaggaagaacgctctgaatcgccaactgaatcgggctctgatcgcgaggaggatgaagaatgaatgagccagccggagaaaatgctgcttcacgagaccaccgcgataataacactaacccccatttaaaaaaagagaaattgtatctctatgtatgtatgtatatattgtatgtccatatccctgtggcattgtcttgctgaatgtaattctcccacaaatggttgttgttctatttaaatatgccatatatatgtgtatttttaataattgtaatatgtttgccctgtttatgcatgttttatggtcatttattctcattgctgaataaatacatttatatgaatgagtacattttccatgtcatcattagtaattcctctaagaaggtcaaaatcggttttcaaaaaattttatgtgctatatccataatcatttttttgggcttttacatacataacaattttaaaatcattatttaaatttacatggtttttcttttttccagctcggctgttgcttctcattttcatttgccacgtcatcattcgtgtctctcctttcgctctgttttcattcatttttccttctg

SEQ ID NO: 20824 - DNA, 1977 bp, Heterodera glycines
  misc_feature (1150)..(1150): n is a, c, g, or t
aaaattctaaaatttagttgtcaatattattttcctccggtcgtgtgaactgcaatagagccacatcttttttgaaggggttaattcctttaaaaaattatgttattcacctctcagctttacaccatgacgacaaagaagaatttgatgcagtaaatgggaattttgtaagtgcaaatttgcgaaggattccggtgataagcaaagtcataatgtttccttaaacccaaaggttacaaaaaattaaattaattaatcattaattatggcggaattttatttacattgtattgcttaaaagcattatgaaagaagctcaaaaaacgcatttcatttgaacgtcaaaagctgcgtcaataaaaaaagaaaaaaaaacaattttttcggagtttttgaaaaaagaattttggcaattggcattattaatattcagaatgccaaatattttttgtgttttttcaaaaaatctgtggcaaaaaatatttagaaaacaagttttttgaagttttctggccataacttttttgaaacacaacgaaaaatttttgaaattttgtcttctaatagaggactattttggctataaaatgataccaagaatgtttaatctggatgattttataaaaagttatggtcgattaaaattgttaaattattttatggtcctgtgaactgcagtaaagccaaacgattcccattaagatttgcttgtttgaaaagataattcaagaaacaattatttattctggcatcaatcaattgtataatggcaaaagtgtgctaattgcagcaaaaatgaacaggcggtaaagaaatttaaaattaaccttaaaaatttttattttccaatttttacccatatttcagttggatttgtagcgacgtgtggatggacattcttccatcttttgaccgtccccaactcgggctcaaaatggcactgctttcttatcgtttcgatgcgctggtggacacgcattttgatggcaaaaggacggaattaacgctttggagaccaatcgcaatttgcaaagagaagaatattggactagaagcgagactgtgtgtatgtatcgatggcattttgtggaatttccgatgccggaccgtccgctgcgcaacaaaatcccgattaacgaccttcggatgnagtaatttctagggagtccaattatatggaaatccatatttttttcctggactgtgggaggcctgaaacgcatgaaaaacatgtttttagcttggtttgaagcttctaggaaggatttctatatccatattttccatatttcgcgatttatgtccatatttccatatttttccatattttggcattttggtccatattttatgtccatattttggcatttttcaaaaaaacctctattagaacggcccccagcagctaaattagcctttttgagcccaaaacccgaaaaatttttcaaaaaatcattttttcgccaaaatttctcgagaatattgaataaatttaaattttcttaaaaattaataaattatgtcaaaaataagcaaaaaagcgaaaatttcgcttttgttgttgattttgcgctaaaaaattaataaattttagcttttatgttttttttcttttaaaatgattgcacgtaattgccgaaaaaattcgagaccaatttccgagtgttgaccgactaattgcaaaacgaaagccttcaaaaaatttggaaatgtatctcatatgcaatttcaaccaataaatttgaagaaattttgcactcaattttgaaaaatttatttccatattttgacatttttgccatttatttccatattttgagatttttgccattttatgtccatattttgcgatttttggtccatatttttggactccctagtaatttcaattacatatttatttgtttatattaaagcatttttatttattttttcagctacattgaccattccgtcattaaatttctccgtccaaca

SEQ ID NO: 20825 - DNA, 1139 bp, Heterodera glycines
tgacaaatccaagaacttaaaactcgggtagaagcatgggggctcggtgggccggggggcctaaaattcgggccacattcggagaattaattctcgatttccgaaaaagtcccagaaataactcttttttctttccatacgttcttgtagagctcgagctgctctttccaatggtcttatcccggtctcgatccgtgccgaactcacaaagttatcggagtgaaatgtgaaatattgttttcaccacaaggcattttttctcgaaaaccggattcaaaaatctggggtttggtataaccgttttagaaatagcgtagaaaacagcttcgatatcaagaaaccaagtcaagtccagaaaggaatattttaaaacgatttcgttttgttttggcattatgataccgaataactttcggaaattatggaaacaaaattggagaaattcgaataattttttgactgcaaatttttttccttttttgaattgggttcaaaaaaattttaagagaatttttgattattaatttgaagtcttgaatttatttgacaaatccaagacttaaaactgggagaagcaaggggctgtggctgggggcctaaaatttgggccacattggagaattaattctgatttctgaaaaagtcccagaaataactattttttctttccataccttcttgtagagctcgagctgctctttccaatggtcttatcccggtctcgatccgtgccgaactcacaaagttatggagtgaaatgtgaaatattgttttcaccacaaggcattttttctgaaaaccggattcaaaaatctggggtttggtataaccgtttttagcgtagaaaacagcttcgatatcaagaaatcaagtcaagtccagaaaggaatattttaaaacgatttcgttttgttttggcattatgataccgaataactttcggaaattatggaaacaaaattggagaaattcgaataattttttgactgcaaatttttttccttttttgaattgggttcaaaaaaattttaagagaatttttgattattaatttgaagtctagaatttatttgacaaatccaagacttaaaactgggctgtggggggggctgtggctgggggcctaaaatagggccaca

SEQ ID NO: 20826 - DNA, 2089 bp, Heterodera glycines
aattacttgtttatatctgtttttaataacccttcaattttaacaggcatatggcattgaactactttttttcaacgatttgaacgaattttccaatggctaatgagcaaataaaattaatatattaataataataaataatttgagaataaagtgtttggtgacaaaattaattgattcatattctgttacgcactcataataataataatgtttttttttatatttgccctttatattttattctgatataaaatattgcgtatttttcttttttataaagctaaaattaattccgactttcaagtattcattaaatatagagaaaatttttttagcgcaattagtgtccatatcccgtgaaatcccatgtttttagcctgtacattgcagatttgtgaactgcgaatttcagctccctcatcttttaattttttaaatattgactaaaaaattctaaagaaatcgtttaaaaaacttctttacctacaatctttaaaacttgagtatttgcttccccggtatcgcattgcataatttttaagaatacttatttcgccagtgcatgttattactagggcttatatttctagttgcaaaaaactgcaaaatagttagtttttagtttctaaaagacccaaaaaagtagttgctaaaaatgggtaaatagttgctaaaaacattcaaatttagggatgtaaaatgacaaaatttattcaaaaagtaaaaaaaattaggccaaatcagtattgagctaaatatttttaaaatcataaattcttgtcaagaaataattaataaataaataaatattggagattgatttttcatttgttagggtgcatttttgaaaaatttcgggtcgattcttaggggggtgtatttttcgctttttattgcatttttcataacaaatttttattcacaagtaaaaatagttgaaaatagtttttttcaaaaattttatagttttttagttgctaaaataaaaaactagaaatagttgctaataacaaaattttatttaaattaaaaaagtaaaacgcctttgggaaaaaagaatgtagacaattatagttagaaattttatttaaataattaattatgtaaatttacaaactgataatctgctggtatgataatgccttttggttataattaaattaaaaaattatattaaataataaaaaaatttttaatttatatagcgcaaaacttcttcggcagacctttcccattaaaaaaaattgttttttttttgaaataatatggaaaactgatggtaggaaaaataaagtgtttgcccaaatcaaagtccactaagtttttctgtttataattttataaattgttgattttttggctctattccaatttacacgtccaatcagtgactatcctcacttttataggtcatacctttttttattacttggtcaatacaaacattcttggtatcattcgagagcttgaagtctacagaagtttttctgttgcaaaattatgagataatggcaatagacaaacaattattcgtgattatacgcgtaaaatgatgcatttccggttttctcattgcagtatttgctcttttcttgtatttataaattccctaatctttaagctttcgaatgataccaagaatgtttgtattaaccaagtataaaaaagttatgatctaaaaaagtgagggtggtcactagagaccggaaatttcaaatttgcggattccgctgcaggactggaactcaaaattttttgcgggacgggatcccgcgggattaatcccgcaaatcccgcatttaaaatttgcgggatcccgtgcgggattgcgggattttggaaaattcgaaaaaatttcaattaaattcaaaaaatttccaaaaatcaaaaaatgctgaaaaataaatttttaggggctggcgggatgcattaaaaggggctgatgggtcgactaagatttttcgattggatccgacggtaaaaagttgatcggaaatcaaattattaacggttcataaatttgactatttttttcttttcaaaaccacttttttacggtgcaagaaatcggaaatttttcaaaaaa

SEQ ID NO: 20827 - DNA, 937 bp, Heterodera glycines
  misc_feature (846)..(846): n is a, c, g, or t
  misc_feature (901)..(902): n is a, c, g, or t
tgtttgccatgacattacaaattgttgcacatattgaggaaattaaaaatatttttgttgggcattttcgcgtaaaatattaattagtctaaatggaatttttgatgcacaaataaatgtcagattaaaaaaaagtaaaataacaaatgtaaagatgttttaaattaattagattccaacgaaaatgtttttctattttcgaatttaattaaatattaaaaattaaaaatttcttttttatacatgttttaaatgaaaagccatttttaattaattgagatattttatctaaatttaaaaattgtgacaatagttttcgagtaaaacccttttccgtcatttcaactttgcttaaaaagaatagttgcaaaaaagggtcttttttacaaaaataagggcaggacaactaactaaaaccaaattcatttcataaaattaaaaaaaggtggacataaaattatttggcaatgtttatcattggcgccggtcattgggcaaataattcaaaaaatgccatggaaattccttcctgcactgcataaataaaccgattaaagtacatctgccattttcgtggcattgtgggaatcatcgagaaaaatctcgagaagaaacatacatcagctaaaataaggctttggcacaaaatgcacagagattaaaaccacagcgaaaatgtgccaaattaaatatctttggcattctctgtgaaattttcagtacattttcaatgcttaaaaaagtgcgtgctcaatctgttgaaacttgaataattatataaagtgaaatatgtataagcactaattgtaagaaactttttgaagaaaaactcaaaataaaatattnttaaagattaaagttcaattaaaaacaacaaaaatttcatatttttcatttaaanntagcaaccgcattcagaaattggactttcattttt

SEQ ID NO: 20828 - DNA, 1111 bp, Heterodera glycines
gtaaaaaaaaataataaaatatttgtatggcttttgttttttttccttataaaattgcaaatatacgaaaatggcacaaaacaaatattaaatttgactttttaaaattgtaattttatcttcttcatccatggtggaggacaattttttaatttttttcagtattttaaaattcaaagaaatttattcgagaattatttaaaaaaaattgtataggttgattaaaattttttttttgttttttcctaattaatttaatttcaaaagtatgaaaaatggcaaaataaatgcaaatatttcaaatttggaccttttaattctgtgattcaatcttcttcatccaacgaatacagaagcaaaccaacaatgtttacatatgaaattggaattttaagtggcttattcgaaaaagcgaatctcataattaattccgtcatgaaattcttgcgaaaaaaaaatcgaacaaaaatttggctaaattcttttccttcaaaaatatttaaattgcaaatttattttctaaaaataattattattattatttaaaatatactaattatatttgcaaaatgcttatttagccgattagtataaattatcaaatttgacaatgttataggcagatttagaaactttagaactaggcaaaaaaaattgccatcgccttggtgttgagaaaaaataagtttttttaagttttgaaaaattagcgcattttggctggcgcctggtgcctggcgcagaaagttagcgcctgggcgccgctggcgcaaagaaaaaactgaaatttctcttctagttgaaattttaaaaaaatgcaaaaatgaaaaaaactatatattaactgttgcagttgaaaattaagtatattttaagcatttccgaggtaaagaaagcacagattattttcgacattatttgtgaaagcccaaaacattttttgaatgcttaaacgaattatatttcggctaaaaaaagtttgtgcatttttcatcaaaataaagctgcacaaaaaaaatatttaaataaataaaaatcccaacccaaaatacaagtaatgacaagctaaaaaggaaaaattcttctttcatttatttcaatattttccaat

SEQ ID NO: 20829 - DNA, 1372 bp, Heterodera glycines
ccccgattttcattttgaaacaagtcgttaccatgctggttcagcagtgcgtcgaattgttgctcatctcgcggtccgttctgaactccagcagcattttctccaattccagacatgagcaggcgtcggcgaatttcagttgggtccaaaagtgatgaagcaactgaagagacagaattatggcgagcctcgttttccaaacgtcggtctgctaggtgctgtggttctacaatttgttgccccccctgctggtttgcgttgttatttagacgaatgccgaggttgagtgctctttgacgagtaagcggaggcgaccgaagattaggcattacttcgcccttttccacaaaatttcacttgtcgaattcggtgagaagaaaactgatgaatttcacaaaatttccgttctgtagaagatgaaatgtcgatgggaattactttaccctttttgtcgaatcagctttgtagacggaattactttaccgagctgacaaatcgttggtgaatttcttttcacttttttgtcgccgcagtagttgaagactttgtagaatttcctacttctacaattccccgtataaaacccgcgtcgaccacacctttttgcaggagcgccacgtacaaataatttaattttactcagcagcacgtcgaacagttcagcacttgcacacaattaaagcacacagaataaagccttattattttatgtcaggcaattccaaattaaagtctgaggacaaaaaacgaaaacaaaaacgaaatcacaaacattaaaacaaaatgccaaaaatatcataaaatcaaaaataaaatgaggtcattattaattacgacaactcaacccaccagcatttcaatctctgggactcaaatctccggcattccaaacaatgggactcaaatctccggcattccaaacactgggactcaacccaccagcatttcaatctctgagactcaattctcatgctttccaatcgctgggactcaattctcaggctttccaatcgtgggactcaacccatcagtatttcaatctctgagactcaaatctccggcattccaaacactgggactcaacccaccaactttcaatgacattccaatctctgggactcaacccaccagcatttcaatctctgagactcaattctcaggctttccaatcgctgggactcaattctcaggctttccaatcgtgggactcaacccatcagtatttcaatctctgagactcaaatctccggcattccaaacactgggactcaacccaccaactttcaatgacattccaatctctgggactcaacccaccagcatttcaatctctgagactcaattctcaggctttccaatcgctgggactcaa

SEQ ID NO: 20830 - DNA, 1905 bp, Heterodera glycines
cttctttgtaaattcggctgtcgctactcacaaacataaaatttcaaacctaattacaataatattcatttaatttccatcaccactttttccatagcattagcagcacgctcatcttctcattttgatgacggccgacaaagattaaaagagatcagcggctccggcagagattaggcaaatcttctgacaccgccgaccccaaccattgcaatttcaaataattgtgtaatttttgcttttgccaaaggccacatattagtgtcttcactcattcattcggccattttcatttaatttttgtcagtcccaactgacagctgctggcgaattgggcatgccaaatgcattggcttcgaattcccccccccccccccgggggatggccaatgtaaagacggcgttgtccattccctcccctcactttagcagtgtttcattgtgagtttatcattcccttttaagcccttcagaaaagggtcactctcccgcagaattcgtcattctcattcatttattattcgtaaaatcccatcaaaaccatcaatatttctaaggttaattaaacacaccgtccgaaaaaacgagatgtgtaccaataaatagagagtgccacagaaaaacattatctttttttctctaattttttgtctccttttggcgtactatctaatatttttattattaggaaaaacaacatttacttcgctatgtttagcttcttttctatatgttagatccacaggaaattttgcatatcgttagagaaaaaaattctgcatcgattaatgctgaatttatttttgttaatgctctatttcaaaagttataagaaaaacaaaattttaaagcctcatagcttttctctggtacaccaaatcgcttagcatttgcttagaaaaagcttctcattatcaagagctttcgaaagataccaagattatccaatttggttggcaaaaaccttcaaaaataattcccaaatatcgtgattttttaatattttggacaaaaataaatgaaaatattcatgttgcacaacggactcgaaccaccaccctttgtccctttactatcttacaaaaaccactgagccacacatgcaaatcttttctggcacaggagctcatttcccggacgctgtgtttaataaaccctccaaattaatgaaaatcaactatcaaattgagatgaatctgacgaatgcggggagtttgaagaagaatacaacggaagttctgatgccgttttttgctcggacgaagcacaaaatgcagaaacacaaatcaagcagcaaaacccgatcgaaaaaattcacaatatgtgtcaaacttatttttctttcgtacaataaaacaaaagctaatttcaacgattaaaatcaagggcgtatctagggggagggggggggggaaataaaacagccaaaattggagcaattgtcatggaaaaacaataaaaaaatgcaagtttgtgtccagcagcggcaaaaaatgaattattactgggtgaagagcaaaaaaaaaaagcccacccccgaaaattttttctagatacgccactgattaaaatacaatagcagtgactccattaaatttgacaattaattgcaaaattcggaggaaggaattcacttggcaaaagccagcaaatatttctgtttgaggggttgctaagcaaccgaggccgaattcggtattattcagtctaacaaagcaaatatttttttaaatggaagaattgacgcataaacgaaacggaaattgtttcttattaatggtaacgggtcaaatagaaacagtcgaggtgcttattcttggtttattatgaaaaacagaaatttagtgtatttcattctcaaatgttttacggcagtatttttacgtttatggacccgattggagc

SEQ ID NO: 20831 - DNA, 2849 bp, Heterodera glycines
caaaggcttaaaatttatgagtcaaacgcaaaaaaaaaaaaaaaaactgaataatatcagcccatgcttttatatttatttaggcaaatttttgccaacaacagcaacaacactttccaaatccacgcgattcgtcaacaccaaaatcaaacagcaacggatcatcaccatcatcaatcacatccaataaaccattttcatcatcaaattgtcttggaaataaaagtattgaaaatatgaatgacatttgattattttaattgagtttaaattaattataaaaaacaaaaccatgagaaagcattaaatttttaaaaattcaactcacaaaatattttattaaaaaacaattttgttccaaatgaattaaaagaattttgagaaaaaattaataatttaattataatttaaataacaataacactccttggatgtgaagccaatttttcaattttgaaaatctcattgatgccttaaaaagcttaataaaaaagcctcattataggtcataaaaaattttattttcggcacataaatttgggattacatataagaaatatgttattttttaagcagatcgccatcataaaacttaaaataacttattttaataaacacacatttattacagtatacagcacacagtcgtccagtaatactgtggtggccaacggtagtggtgccaaccgttcaacagcgactacagcggcatttgtcgccgaagatagttgttgcaaccaaatgcgcggcgagttggtcgcgcgcaactcggtcgccgagcgagcggagaaggcgtccagcgtttatgagaatgtggcgaccggcgagcgtcgtgaagctgctaaaccagcagctccacgagaagctaattatgatgctaatgatggtgctaatgaccataattatgagcagcagcagcaacatggcccgccacaaaatgaccagggcggtgaacggagggaaggcccaaagggggagatttggtacgaatttggatgcgtctgatcagtgatcggggggcatttttttacaatatgaatcgaatatttgaatttttgtattgtacggtaattttcaaccttgcttttaatttgaaacatttttcgacagcaaaaatcttaatgtgaatttaaattttttgataaatgcctttttccattgttgaaatttgaataatttaaataaaaataaatattaaatttttgaaaaaaaagaaacaaattcaattaccgatttacggataaataattatttttttatcactcattagcaccagtaataattagggagcgcgaaatagcgcattaaataggcacaaaaaatcgccaaataggcacctaaaaggcagaaaaataggcaaataaaaattttaattaacgttttttaggtagcaaaacacataaaaacttccttaatttttttttttgataatatttcatttgtaaatgaaaattattaaatgttttaaattatttagaataaggacaaattttcaaaacaaaaattcttgtaagaaaaaaaaataaataaatttataaatttttaagcaaaaataggcattagaaaagtcatcgtagacacccccaaaccaagctgaaaaagcgtttttcgtgcttctcagtgcgtattaattgcgcagaaaatttaggcatttgcccaaaaaaaggaatcccaatataataattatatgttacaaaactgtaatgtttattaaacattaattggtgaaatttttgaaatacttatagttccataaaaataattttatttatttatttaatcttcggtcatttttggcaaaattgttccaattttcttagtttcatccatttaatttcgcattacatattctttcccaaattgtttcttccaatatgcaattgttctactagtaattttcatcatttttccaatttccttgtcactcattttcggcttttctccttttatttgccaatacattttcattttctccgttttttctttttccattgttatttttcggctaattccaaattgattcttccattttttaattatgaaaaggccaactccgattttcttacaaatttcttcataatttttgttccattcttttttcgaatatgttcttcctttttccttaaattcatttttcatttcaatgaatttcagtataatttcgagtttttcttcgtcagtttttgatttgtaaaaattcttttgatttaatcccaattctttgatccattcataaatatatcggcgatttgtgcccaatttttttgctatttttctttcaattttttcccattctctttttgaatattttcttcctttttgcttaattttctcttttattttataaaattttccaattatttctctttttttctgttcttcgttttttttttcttcccatttttctccaaatatttcgtcaaatgattttttttccaattttttcttttctgatccaacataattaatactaattaagatgattatcaaaaacacaaataatgaagaagttaataagcatcctttcatttttatgcaatgactcagtctaaaaaagatttatgtagaaaatatttcaaaatctctgcaattgaaattatttattttctggatttttaataataattatttcgtgaaaaatattacaaattttgtaattattatgcgaagttttatagatttatttaatgtataaataaaattcttaaaaatcttatgacaaaacttagcaaatcgttcatttcctgtgattggctattttaaaataaggaattttatgaaaattcaactcagatttcatgcttttagataaattatgaaaaaacattacatctttaatgttttggatg

SEQ ID NO: 20832 - DNA, 1376 bp, Heterodera glycines
tttagcactttgcctcgaaccctttgacgaacatttgctcgacgaatgcgacggaaatggcaattggcgacggcacttttactttgatcgttcccagagggtaattaaaagatgactaatggattatctgtgccttccattagcgttgtttgcctttttggttcgatggctgtgcttccccctgcggcaatcatttcgaggatgaaatttcttgcaagaaaacatgtgggagtgtctcagctgaaaatgtcgaaattctttaccaaacatacgggaccaaacaaacaaattttgtgccggcatggcgtctgatcagcacgactttaagggcaccgattgggacaaatgagggcaaaaaaatcggtgggaaattattaatggtcagttattggaattagcatatgtttgcaaaagtttgttatcagtaaaaaatttgcattcactgtcgtaatgtccactgtccaaatgtccacttctgtccaaatgacttcactgtccaaatgtccactgtccaaatgtccactgtcgtaatgtccactgtccaaatgtccactgtccaaaagaccgcgagcctttaattaatatcattcaataggcctaaatgttctctattcgaaaattttcgtcaagtttcaaaaatattatggacaaaaaacttcaaaaaagcggttttccgaatatttttgtgcataacttttttgaaacttgaccaaaattttcggaatttagcatgctaatagagaacatttagacctattgaatgatattaaatacattcagttcggtcaactatgaaaggagttgtgcctcaaaaagcagggtggcgcccaactggtcggcgcccaatcgacccccaccgttaattaattgagcaagggactaattcaattaattaattgaccataaaaagcatgggacagtatcgggcctaaattaatttctaattcaaggaaatcctcaaatcacttatcaaaagatgaaaaatggtgataattgagcctacaaatttctgtgatcaaaaatctcaaaacagtttgctaaaatactgaaaaaaatgaaaataatttttaaaagatgtgaaaaagtccgaaacagatgtgtcaaaatgttgcgccaaaaagcaactaaataatcaaaagtttctttcttaataaatgtttattgttggtccatttaattaattaccaaattcaaaattaccatatttattgaattagaagcccccccccccccggagggctcttaccggcttttttgccaattagaaaaatcaatatttctttgggtagctttcgataattggcggtaaatgaatggttaattttaacggtatttacgacaaattactacggtaaacgatcctactgtatttgtta

SEQ ID NO: 20833 - DNA, 1720 bp, Heterodera glycines
  misc_feature (1630)..(1630): n is a, c, g, or t
  misc_feature (1649)..(1649): n is a, c, g, or t
ccaaaggtatgtcagaaattaagttttttgtccgatccgttttagtgggacaccgataaaaattccgccggattttttttcaaacgaaaatttcaaatcccgaaaataattttttttttttttgttctccttctaaatgacttattcctaattcaacgataaaagattgttcaagactgatttttgtctgtccaaccgcttttttaatgaggagtttacggggttagaattttccttaaaaatttacgcattttttccttcgagtggaaactaactgtctcaacttaggagttttccactataatatcccgtatcaccggccatatgcttattcatttcacgtccatttcagcatgatccgttcaaagaattgatggcccaagcgacacaaaacgatgccaccgcggtggagcggctcattgagcagacggacgaagtcgccagcgcccgggagcagcagcggcaacggcacaaagcggcggtggcagcgcgaaaagcggcggcggcacccgaggcggaggtgggcgtcagtgccggaagggaactgacgtacgcggcggcggcacgtgagcggttggcacgccaacagcaggaggaacagaaggagaagcagaagcggttgagcgccaccggatatcggtgggctttctttcacttacaaatacatttttgggggtttacgggaggtaatttaggtaggaatattttggatttcattgtccaacaaatgaaaattttgtgaccaacctacggtaaaatgaaaagtgaacccatttttatggggcaaaattttataatttatgttcttttctggtttaaatgctacgaatttgtcccttcgaataccccaaaattaatttttcccgaaatttccgagttggaattgagatgttcgtttttttctctcattttttgcttcaaataccaaatttttgcacagggttcttccatcgcaagggtcggcggacccaacaccgaagccgcaacaaaaatcatcatcaaaatcatcagtgaatgtcggcggtgccggaggcggaagtggtcaaacaaaagttgcaaaaattggacacaaccaaacacaacaacaggaacagagggagaggggagcccatcagcagcagcagttgaggtgcaaatatttgaggggaaaaagtcaaaaaattcaatttaaaatcgaaattctgacacttttgcattcattttgaggaaaaaaatagttaatcccgatttagcatacttacattagaattttctattgttggccacagttgttttttgttcgagtccgaattaatttaattttttgttttaaattaattaaaatttcaattttttacacaaacattgtaaatgtgttgcaatttagtcgtcatacaaatgggaaattgtcatcagtggcatcacaacaaaggcagcaacaacagcaacaaaagatgttgccaccgccaccaccaccatcaaatgccaacagcaacaaaatgcccaccggggacaacacaattacaaagagcagcaacaccaaaatgccaacaactgcaacaaatgccaaaaagtcggcggtgccaaaagagcccaaacagcagcagcagcaaagtcagccggcgccagcggctcaacagcaacaaccgcnaaagcgctatttgcccggngacattcgctacaagggacaagcaacaacagcagcagcagcaaacacaaacgccaacagcagcggcgaatc

SEQ ID NO: 20834 - DNA, 1345 bp, Heterodera glycines
caaacgcgaggcacagctccgacgggagatggcattggcacagcgtcataacaggtgggtgctgtggctgctgggttgggtttgtgcattgtgacaaggagcataattttccttaaaaattaatttgtttttattggaaaattctaggaaatttctaaaaaaatgaaaaattgttactcactcccgtcaaagattcactagcaattttttttaaaattaaattttattatttttgacgatgcttttccagagatcgtccgtcgtcgtcgtctcgtaataaatatgccaactacagtgaaacggacgaagacgatgaggaggatgaggacggcggacgttatgatgaggacgaggaatatgacagtgacttggccgacttcattgacgacagcatggtggacgacatgcagagggaggactttgaggagacactcaagtgggggcaagcccaaccatttgtggaatttaccaaaacataaaaatttagcggatttaacaaaaaaaataatcaacgattactttgctttgtgcctaggcaaaaactaagcgggattttttaatttttgccgtttttacctttttataacccctaacaaataaatgttgcaaatgttccaggatcatcaacccgcgctacaacaaggagaaatggttggcccgcgagcggatgattgacgaccgtcgcatggacgcgcgcttccgcgacgtggaggcggaggagcggcactcgtcacggcttggccttgtcgaggacttgcgggaggccaagcggggcagcaaagcgctcggctaacgcactcactgactgactgttgctgcttgtgtggatttggcacaacgaaagattgcgggcacaattcgaaccaaaatttaggcccatttgtttgacattgtaattttacgttttccccaatgtgcctgctcttctgctgctggtgattgttgccactggtggcaattagattgtgatacgttgttgttttttttgttgcccttttttcttcatccaatttgtttgtacccatcctccattttttttttttggtggtggtgttgggctccgttccgtgtgtttttttatgcgatgtgatacagtcaattcctacttttttcattgatcatttgttatataaaacattttattgtctaatcatagcaattttctttcatataaaaatgtcaaagtgatgatgctgatgtagttgattaattacaatgactaattactggtttaaataattaccgtatttccgcgattataagccccggggcttctattgttcaacccccctccaaagggggcttatattcgagggggggggcgtataatcgagtaaatacggta

SEQ ID NO: 20835 - DNA, 1798 bp, Heterodera glycines
tttgaaaaaattaattatttgcttagaagcatctaaaaatatctaataaataataataatgtgtttttaaatttatttaatctgtttttgaaaacgtgaaaaaacatcggtcacttgaaataataaattctaaaattttgtccaggaaaatccaggtttttcgtgttttgcctggacctggacctggatttttttcacatttgacctggacctggattttctggacaaaaatccaggaaaatcccctggacctggatccaggaaaaatccaggcctggatccaggtccaggtcaaactctactaaaaacatttgtgaaataccttttacttggttaagaattaaaaaatttagcctattaaaatatttagaaatttttttattatattgtatattttttgaaaactttccgatttcttgcaccgcaaaaaagtggttttgaagaaaaaaatagtcaaatttatgaaccgttaataatttgatttccgatcaactttttaccgtcggatccaatcgaaaaatcttagtcgacccatcagccccttttaatccatcccgccagcccctaaaaatttatttttcagcattttttgatttttggaaattttttgaattaaattgaaattttttcgaattttccaaaattccgcaatcccgcacgggatcccgcaaattttaaatgagggatttgcgggattaatcccgcgggatcccgatccgcaaaaaattttgagttccagtcccgcagcgggatccgcaaatttgaaatttccggtctctattagtcactactcttttttcaccattctctgtgcaaaattgctcctcctccgcaattgtcatggcataaattgcttttctaccacgcatttatctcctatagaaacccttcgcttttgtcatttcttcagacttaaattggttgataaattctctctttaatattcactgatttctgctctccttcccccaccctctcgagccattcgccactgccctctgccccgagcctccccggactcaacaagtggtgccgctaacaaatctaaagatgtcttcagctcgatgccggatggctttggggcccgcgctcccgacttcggcaacatgtcacagcggccgaaaattttcttgacgaggccgtgaagagatagaatacttaagccataaaataatagtaataatgttaagtttattgtctttcaattatttttttttaaattttattactagagcccggatttttttatggttttaaaaatttttctgctgcttagtcatgactagggagtccaaaaatatggatataaaatcgcgaaatatggccataaaatatggaccaaaaatcgcaaaatatggacataaaatggcaaaaatctcaaaatatggaaataaatggcaaaaatgtcaaaatatggacataaatttttcaaaattgagtgcaaaatttcttcaaatttattggttgaaattgcatatgagatacatttccaaattttttgactcggtaaggcgctttgacaaagacggctttcgttttgcaattagtcggtcaacattcggaaattggtctcgaattttttcggcaattacgtgcaatcattttaaaagaaaaaaaacataaaagctaaaatttattaatttttttagcgcaaaatcaacaacaaaagcgaaattttcgcttttttgcttatttttgacataaatttattaatttttaagaaaatttaaatttattcaatattctcgagaaattttggcgaaaaaatgattttttgaaaaattttttcgggttttgg

SEQ ID NO: 20836 - DNA, 412 bp, Heterodera glycines
  misc_feature (142)..(142): n is a, c, g, or t
  misc_feature (144)..(144): n is a, c, g, or t
ttcctttgttatccgagcagaaaatagtccaatatcctccagttacaattggaaataaattttaaaaaattgaaccgtggaaggtcggaagaaaaagtgggaaaaaacagacagaaaattataatgaatgaatggaatgagngntggtcacaactttggggaggaattttgtctgacacaaataatgggagtaaaatatgaaagcataaaatattaaatttaaccgaaatttaatctacaacagtcaggtgcaaaagtatggaagcaaaacattaattttatgtggtgaagaaacggttataatcgatttttaattgacgataatttatttagaagaattttgaatatcatgcaaagtatataccaagggcgtaggcaggggggggggagggggacggaacgggccaactcc

SEQ ID NO: 20837 - DNA, 1527 bp, Heterodera glycines
atcaattttttgctcagattttagggaataattttcgaaaaattaataataaatatttattttttaaaagatgattctacactttgtttgaagcttttaacttgcaatttttgtgctttttttttacttttttacactttttgtgctttttatgactttttggcgttttatgatttttcgtgacttttttcactttttacggcaagatttgcctttgagcgaagaaaaattctgaaaaaaaaatttatcttcgagtaggtaccgaaatttccgataccgctagggctcaaatggcgagtcaaagtcaactttttggggatttttcctgacttaaattcccatacctaaccatcagcatatgattttttcagcaaaaaaaaaatatatttcttcatgattttttggtcatttattaaatttcgcctataggcgtttcttacttaatttgccgttatttttaaaatatgaaaatgtttaatgtaatgcaatatttttgcctccagtagcagaacgacggcgtaacaactcatatacaatgagcaaaaatgaagaatgtaaaatttgagaaatttttcgttttattttaaacgaaataaaaaatttttaatttttcagtctcaactaaatgcattttatagaatttcaaattatgctttttgttcaaagtttcaacacccaaatttatcacaaatattggtctttccttttgtattttcctttgctttttctttcaacttttctttaattgcatcaaattttcgccagggcatgcttctaaaaatttaaatcacgctttaatttaaataaaaatgaatagatcaataaaatggtttccattttttgtcgttgttaaaaattttgcttccatatccttttgttcttgccccgtcccgaatcgttcgctcccatatccctaatgggtaatgaggctgcaaattcaaaaaaaaataaatctccaaaaagtcacaaaaaatgtaaaaaaagtcatgaaaaaatagccaaaaagtcacaaaaaagtcataaaaaacgccaaaaagtcacgaaaaatgtaaaaaagtcatgtaaaaatagccaaaaagtcaaaaaaaacaaaaacaaaaaaaaacacaacaaaaaaaaaaattcctgaaaaattaggcaaaagtttaaaaaatcccattttttaactatttattgcattttttagtgctttttttttgcctttttcataactttttggttattttttattgacttttttacattacatttattttcggatttttcttcgctaaaattcaaattttgccttaaaaagccaaaaaagtcacgaaaaacgtcaaaaaggtgcaaaaaagtcataaaactccgaaaaagtataaaaaaaagtcaaaataagtcataaaaaatgcatgttagaagctgcaaacaaagtgtagaacactttttaagtcatttaaagtcagcatttgacttaaattcccagccctactcattaatatatatataaaaaatttaatcatgctataaattttaaaattaaaataa

SEQ ID NO: 20838 - DNA, 1908 bp, Heterodera glycines
gggggggggtgaggatgatcactttggccagtcgcacccaattacgcttatctataagggaggaaatggtcttgcctggttcatgtcccactgttctggccgattccccgcgtgaattgcttttgtggcaaaggcaattggcctccgccggtccaatgaatcatttggtgtattttgtgtcaaaatttggtcattttcctcgtccattagttgttttttgtgcgggggactgtggccaatgaattggtcggtgtcgtccatggaatgcgctgaacgttttttggaagacgaaagagtggcgggacggagagagtcgacgagcattttgagggtggggaggagcagaaataaattggcgttttggaaggaaattgggcaaatttaaaaatgaaaaatattttaggaaaagcgatgaaatgctaaattaaaaaaagagagattaaatgatcaaaaaaggaggacaaattgaaaataattcagaaggaaaaatgttgtcatcacccaatgaatttgtcacttaaatactctccgcttttattttattttattttagagtttgtgttttgtgcttttccctcgggggaaaataaaagtggcggcgaatggaaggaaagaacaaaagacaaaaacgaaaagagaacttttgttctattttgtgttgaatttgtcgaagtaaaatttaaaaagaacttatgatataatttattttaaaaacgcataaaatagaaagtgattttgagtttaataataataacccctttttaattcatttaatttgttaatcccaaaatgaaaattattggtgctttaccgcttttataggagagactcacaaaatgaatgatgcaacaatagaacaattttcttcattattttccaatggggggagggggggggggcggaatgacgcaatcggacggagacattcgatcattgggaagagcgagcgaaggaagaaaggaaaagccgaaaaatgagcaaaagcaacccaaaaaacaaaagtgaaaattaaattattattattattattattcatttaaaggattaattaaagcatttcagtctattaaaaaaactaaagaaaatagttttatcaaaagaaactgaacaaatatttgagaaagcctttatttcttttcatattttaaaaataaaattgtcaaaaatgttttgctttgtcatttttaataattaattaattattgcgtaaataattgatcggtgatataaggtcgtagagccataatctttttatcctttaatttattttcttctctccctttttcttctctcatcattgtttgggcttcttcccgcaacatgcccacacgtaatttttgtcgcaacaattgctggccgcgtagccttccgactttacacatttggcccaacttttgccatccctaaaaagggaagtgaagtgccatcgtcgtcgtcctttttgccaaatcagccttgacccacccccccccccctcccccatttccatgccaaatcatttttagcgcaattgcccactttttcgactcacttgcatttgcaatttgccgctgttttgcatgcttgtttgccgatccaatcccaaggccatccgcgtttatcacgtacagccctttcgactccgaagccatcggtggaaggaaaagcgatgaaaaggaacaacagtaggaaaagggagagggacacaaagggtacggtaggacgaagaagcattactgtggaactgtgtgaaaagaggaaaaataacagaaaataaaatttatttggaattttcaatgggaaaaagaaaaatgtgaggggatttattttgtttcttggtgaaataaattgtggatttgcagcactctgatttttatacggcggatttggtcggcgattggtgcggcggcgttccccccgccccccccc

SEQ ID NO: 20839 - DNA, 2183 bp, Heterodera glycines
aaaaagggaaaagcaaaaggaaaagccgaaaaaagacggcaataaccagaaaagtaaagccaaaaactgatcaaacaattacgaccaatacccagggctccaatttttgtgccaaatcccttaaatagggagggccaaaaattaaggatatatttagaaaaacaattttttgtgcaattccaaatgaaacccgttttttataaaattgttcaaaaagtattatcagttttgataaattcttatccaatcaattccaaaaatttgttttcctccctgcaaaggaagtaattttttgccaactttatattttgatattaactataggcttaaaattatgtggacataagcaatggctcaaaagttttaaaaacaaaattgcaaaaaattgtcataaatttttttttcaaattcataaaatgctaaataaaacaatgtttaaaatagtaaatttctttgaaaatctgatttaaaaattggattttcatttaagattctcaatgcttccatggattaagaaaaaaacgcattcataatttacatccatattgtaacattagaaagtatttgacgttttgtcagggttttacttgaaaaaggcaagattaagacccgggaaaatcccgaagtgaccccgggtcgcgcaagggctttgctgattagaacacaaaaacactgtaatcccatcatcattaattcactaattgtattttgccaatttgttcccattctctcattcattttgcatttcgaccatcaaaactagggttgcgtccccgacgtcggggttggaaaattcggggttcggggttgtcggggttagaagtgtcggggttcggggtcggggttgccaaatcgtcggggttcggggtcggggtcggggtttttcaatttttgccttatgccaaatagtcaaaaattttttaatattttttcggaaataatatttattaatttccataataatatttgtattgtttttatatttttttatttcttttttatcagaaattttgtatggaattaatttttttttcttgaaattttaaaattttttattacttttttgttttccaaaacatcttttttcacgtcgctcttttctaaagacttaaggagaaagggtacggcgtccggcgtccggcggtgccgataggcgccgccgggaaaattttgaaaatttggttagatctgttaacagattttgtccaaaatatgctaaatttttgcgattttgagccaatttttttaataaggtttatgactttttgggccctgtgatgccgataggtagcgctaaattttggaattaagctctattttctaagatttttcaccaaaaaaatttatgaatttcggtaaatttttgtttttcttcgataatcatgaatatcgcttagaattcatcccaatattttttttattcattttttgaaatacctattttttcctgcaaattttattatcttagttatttaattatgctattctgataaatagttagtgaattatgtgttgtgcagccttaaaaatgtaatttttcgactttttcactaattttcggcttggcgacattttgactcattttagcttgggcgacatttcgacgcggcgacattatgacgcaacgacattttgacagcgcgccatttctatgagtatttaattaaaaaaaaacaatttgtcacaaagaaaataattaaagaagaaaacgtcaaacggtatcgaactcacgacagaaagtaatgacaatggcactaacctctacaccacattccaaatgtccgaaattgagcaaatcttctttatttaataaaaatttggcaaattgttaaaaaaaattcaaatttcgtctaacttttttgcattttctcccacgaaaatgccattcttaggggtgtatattttacaccgaccccgatcggggttaagggtcggggttcggggttgtcggggtatgaagcgataaaaatttggcaaattgttaaaaaaaattcaaatttcgtctaacttttttgcattttctcccatgaaaatgccattcttaggggtgtatattttaccccgaccccgatcggggttaagggtcggggttcggggttgtcggggtatgaagcgtcggggttcggggtcggggttttccccgaaaatggccaaaaatgtcggggttcggggtcggggcgggg

SEQ ID NO: 20840 - DNA, 989 bp, Heterodera glycines
taatcaaaaaatgagaggtaattggtcgggagagggggtccatttgatcatgcagttgttaacaaacaaatgaatgtttcttaccttccttcattccctaaccaatcacccgacattcaattcattcattactcgtcattaatccttccattaaaagagagggggccgagaaaagagttgccctgcttaatcgatatatttccatcaatttgttcaaacaaaattgtttttattgcccatctaataacaattttggaatttgaaaatatgaatttacatttattttaccttaacaaccttcttttttatcttttcatcttggattttaatcaactatggtgtgagatcacgcttttgcatattatttgttaattgcagtcctcaaattttttactcattctctcggttagatggtaattaacttcttttggctcttttgattgattgataattcatttacttatatgctttcattgtttttttaatttgttttccatttctcactttttcaatgtttttactgtttagctgataaagaaagaaaagtgcacaattattgttttcgtcgccggcgtcccttcacgaatcgctgttcattcatttattacaaaaaatttctcatttaaatcgtctgcgttttaaaccaacgtcctccaattgctgatgattttctgccgttcgtctctctcttttttcacggcatcaaattcgattttgacgccgcggtagcgaccggcggatgccaacagtgtggggcggcgacgtcgactacaatcgattgccccattttgccgccctcttctttcccccattgccattgtcaatccttgcggcgcccgcgtctgttgctggacgccattccccccaacgttccccgacatttccatgaccgtggatcgtcgacgcaattgcaacggaacaaacaatggtcgagtccattttcacaatgttccatttgcgccgtgtgcaatttcaggtggcgtctgata

SEQ ID NO: 20841 - DNA, 1520 bp, Heterodera glycines
gatcgattggttttttcagggtagacaaacagacaaagatcggacgcaacccagagttggtggacgtcgtcctgcattcggtgatccacaggtcgtcctttgctacttcataaatttgaccaaatgccaattttaaagtaatatgatttctcgcgatcactctgaaataactggcgaaacagacaacaaaggcaatttacggtattacattttggaccgttctttgaatgggacatatgtcaacgacacgagggtaacattacaatttttctttttcaattattcctttctgttcaacaggttaaagaaaaagttttgctgaatgagggcgacctgatcaaattcggccatgtcaatggggcagccataaatccgggcgaacacgcgcctcaacaatcggccgagttcatcttccgcttcgaacgtgcgctgccaaaattcgcctactttggctactcacaaaagggcgtccgagtccatccgcaccatcaaaatgagcacactcacaatcagcaacaacagcagaggagggcgtatatgcaggtgcagaagcgcaaatggcagggaaatggataaacaaccgctgggaagaaaggaacggcacaaattttaacaaaaaatacataactaatgaataaatattaaataaattcttcatttttcaatgagtttagatcaattccgaccgcattttgcccaccgaagtgtacgggtcattggctccaagtggtggcgcgagtgccgccgccgccgttgggggtgccaatggcccaacggtgccaagaccaatcgcgcctggcggtagctgtctcgctgctgtcactagcagtgtttcggtggttgccaccaccacggcttgcccctcctcgaccggtgctccgcccacttgcgctgccccctccttcccttttctcccctcctcttccaatggtgtaacaacatccgcttctgcaactgttattccaaggtgtttggccaccacttctgttcacaatagcatccaaatcgcccaattaaacgccatggcagcagcgacgacattagcaaacactgcggcggcatccgcagcatcaaataacgcggcgcaacaacaacagcagaggcatcagtccactgggggatcggccgacggcacgacaaactctgctgctaccgcctcagcattgaacgccttgaaccaattgggacttacatcggccactgaggaacaggtcgagttgatgttattttgttgattcattaaaaagaggcggggagggggtcaaccaaattctattaagggttctttggagtggggggtgtcattagctaattttacgaagggatctgtatatgcaaatagacgaccttttaaaaaaggctttttttttgtggcgcctttcaaaaaacttttggcaacaagggggctcggcggaaccgataggcgccgcctggatatgatggattttgctaattgtaagaaattcaggtggcagctgtaaatgctcatttgcgtcagctgatggcttctcatgacgcaa

SEQ ID NO: 20842 - DNA, 2655 bp, Heterodera glycines
  misc_feature (2635)..(2635): n is a, c, g, or t
ttacgaccacttacacttttataataaattcaactgatacaaggattagattattgatattgctgaaaatgtatttatattttttataacattttttatgggctttcgaatggtatcattcattaaccgttataatgcttgtcacatggtttaacttaaagaaattaattatatcccattttggggtggtcatatgtttacgaccataaactttattcataaaaaatcaatattcacgtgatttgatcacagcctcaatacggcgaggcatagagtttatcaaattgataattgggtcaagcggaattgagttccaggcctccaaatgccaagttggggctttgactgaaagtgccttccggcgattttccgcttgacaaagtgccaaagattttcgattggtgacaaatcagggctcaatggaggggtacgaaggagggtaacattgttcaggctgaaccagcccggcaagcgcagacgccgaccgccaggaagtcgccgatccatattttgtgggttttcgggaataaatccatatttcgccatttttgcctttttagtccatatttcggccatttttggcaaaatttcacaagaaaaatgcaaaaaaaagcgaaaaatacacccctaaagatcgactttttggaaatttttacaaatacacccccaatgagtttttgttgtcattttggcatttttaattaatattttcaccatttttttgcgaacttctctttttttaaaaacttggaggtgttttttatacaacggacgacaataaaaattttgcatttttaaatttgaaatccattttttttggttgtctattgtatttcttaagtttacttaagcaaatattgaatataaaatcaatgaggatttttttgtttgaaatgtgatttgaggatttttgtggcgttttgagatgttttgaggatttttgaggcttttgggaaaaatcgtcagaatcttttaaattttgataaattgacataatgtttgacaattatttaatttttgggttttaatagagtatcaaacggaaatctcacccaaatttagccagaaaattacaattttttcgaaatccacaaaattatgaatttttttaaatgaaaatctgctaaaaatatggtcaaaattctcaatttttcccccaccggcggcgcctatcggcaccgccggcccctcaattctccaagtttttttggaaaaagcgccgcaaaaaaaatcaacttcgatttttcatgctcagaatctcacaagatgcttatttcgaacaaaaaaattgctcaaattgtcatggacaatcgaagatataacatttgatcattttaaacgtgttttgaataaattttgtaaaaatgaggctttttgacccaaaatgaggtttatttgcatgccaaatgagttccctctattacaaaacaaacaaaaaaaatagaaaatggcagaaagaaaatttattaacaaataataatgtttatgaaattaatggattgaaaaaaaaacagagagagaaagagagacagagaagagagagagagaagaggagagagagagggagagaaaagaggagaagaaggacagagagaaaagataagaggagagaagaagagagagaaaagagatcgagactgggagagagagagagaaacgaagaaagagagaaaattgaggagagagaaaaaagagaagagagagagaaagggggaaagagtgaatgagagagagagtgaaagtagagagagtgaagagaagagagagagagagagaaggaatgagagaaagagagagaaaaaagagcgagaaagagggacgtactgggaatgacaatttaattatttaaaacgatgacttttcgcgtttatttttgtgtttaaatttcatttttgttttgttttttgttcatcagttgttcttgagatttctccgatttttgtccttttttctctcttcatgttttaaaaataaattattctccaattcaaattgtcattcgtttcaaattgtcattcgtttcaaattgtcattcgtttcaaattgtcattcgtttcaaattgtcattcgtttcaaattgtcattcgtttcaaattgtcattcgtttcaaattgtcattcgtttcaaattgtcattcgtttcaaattgtcattcgtttcaaattgtcattcgtttcaaattgtcattcgtttcaaattgtcattcgtttcaaattgtcattcgtttcaaattgtcattcgtttcaaattgtcattcgtttcaaattgtcattcgtttcaaattgtcattcgtttcaaattgtcattcgtttcaaattgtcattcgtttcaaattgtcattcgtttcaaattgtcattcgtttcaaattgtcattcgtttcaaattgtcattcgtttcaaattgtcattcgtttcaaattgtcattcgtttcaaattgtcattcgtttcaaattgtcattcgtttcaaattgtcattcgtttcaaattgtcattcgtttcaaattgtcattcgtttcaaattgtcattcgtttcaaattgtcattcgtttcaaattgtcattcgtttcaaattgtcattcgtttcaaattgtcattcgtttcaaattgtcattcatttcaaattgtcatctcccanaaaatcaatcgatggcaaag

SEQ ID NO: 20843 - DNA, 1364 bp, Heterodera glycines
ttcataaccctttttgcgggatgagctttttgaaacaattttataaatttttgtttaaaaacttaagttttgtagtttgtaagtatcaaattcttagatttattgtaactgttgaccgatttccaatttcttaacagattttgcaccagaatgggttcgtccgtcgatgcacccttaataatttgaagcaccccactttctcattgttccctatctcgccatttcttcatgatttctttcaaattgcaactgtttaaattatttaattttaattttatttaattttttgattttttgtcaattttttgcgatttttgggtttattttctttcatttttcattataaaaaattcaaaagaatttgcctttttgtcgcaaaataaaacccaaaattttatgtttcctaatgaataaccaaacaatccaacgaaaaagcgacaaacttagtcataatttgaatgagcaatgatacaacaaaatgacatttaaaaaacagagtttggaatggaaaaacggagaatttacggagcccaagaaagcatcgttattaaaaaacataaaaattaaattgtcgaaaatatttttgataaaattcagagaatgtccaatattattttttcacatttcccatgggaaaaattgaaatttgtttttgttgttttgccgtctttgatgtttctttctgttatttataaaaattacagtttttcatatgacaattcgacgttattcaggtcattcaattaaaattattcgtgtttaatacctttttaaaattctaattaaaaattattaattttataaattaattaaaagtcaataattaagggccccactaacaatcttttactttttggtgccgaatgtatctgttaaaaaatggcaatattctaaattccttaaaaactggtgacttttacattccttttattggattttattaagaatttgacagaaattaaatatataaactttagtttatttttaaacttaaatataaaattggccaaattaagtcaaaacactcaccgaaagattttttgtatcataaattttttttttggtttttatccaaattaagcatttatagtatgttcgatagctcaatgtgttattattattctgccaaactttttccaacgcccggaggagcaaaaattcattcttataattcatttcataattaataatttagctttgcttatttgcaaaacaatagcggtcaattatcatcagaagaatgctttggagaaaaggtatttattaattaaaccaaatattttccaataaatatttacattttttagatggtttataatttgaaaatgaacgactcgcgaataattcgtggcaaaaagtttaat

SEQ ID NO: 20844 - DNA, 1082 bp, Heterodera glycines
ggcttcctgacgattctccttcagttttcgatttttcaccatcgtcatcagcgtcggcttcagtagttggtacaaatacggatgaaatgacccaatcatattgtggcaagctgctggcttcacctccccaattggcgtctttttccttaatataatttatatgattaacttttgtaagtaaacgataagataaatttagtcgtttatattatagagtataattaataccttagtaatagagcataattaataccttaataactattttggctacaatcttcttgcccacgaaggaacctaaaatcttagcaaacccttccccgtctccgtccagttccatcatccgcatttcgcttgctttacgaccgatgaatttttcaccacagtttgtaaacattgtagtagtttgacggcactctttatccatcacatcttgaagttcaagtagaaaaaggacggcatcaatcgggtttttggcaatgtgaccgcaacttgagcatagtctctgctcagatagcttacgcttacacaaaaacccgcttggagttttggccgggcatgcctaatgtattgtgtaaattacaagctgctgatgtcgtagagtctaactcacttcgtatagtttatactgtaggcttagtatgcatgcgcgtacgacaaaaacacccgcaccattgaacatttttacgtctacgatatttttagggttaacaaattgcccttcattatcgcgcttgtatgttgaccgaatttggaaacgggaaagcatttttatatagtatatatctaaattttattgaaaaagttgacaaaggagtcagtcttgagggccgcagcgttgggccaattcatgaaacaggacatgcaaagcataccgcgcaaaatgaaatatgcaaaaaaaagcgaaaaatgtgaaccaaaaatataaaattggcctattcgaatctgtcagattgacttatcggcggatatacataatgggcggaagcctagcttaaacctcggctttgttctaagggacagtatagtgggaaatagatgagccaaagcctgggctagggttatgcaaacgtctgggatat

SEQ ID NO: 20845 - DNA, 832 bp, Heterodera glycines
atgactcgcaggaattgaagggccgtcaccattaccaattccattgaacagttgaaactgtaaaaaaaaagtgaaatacgttatttttgtaaaaaggtcttaaggctacagccaaaaattttcaaatttaccctaaaaataaatttaaaaataagaattataaaattaaatactacagagacttttttgtctatgaatttgtttgtattttatcaaagttgaaaccaaaaaacaaaagattaacccaaaaattttagggagctatttgatatataaataaaaaataatttcagcatccaaaagaagcccaatattctttgttgttatttaattgtaattatccaaataattaactcaacgttcagtttacctgtcattgttgtgccaaattacattgatatgtgaaaacaacaatatttaagcgttctcctaaagcaaaatcaaaaatgaattaagaatttttaataaattgcactattatttcattgtaaatcattaaattaacagaaaaatatagaaagtggaatcatgtcaaaaatagaccaggaataaaaaaaggccaatatgtcaattgatcttagtgtaaaaactgccgaaatataacataaaaggcaaaaaaaacccaatgattaatttgtttttaggcaatggtaacaaattttcaatcaccaaatttttgcaggaaaatatttgaaaaagaattaatattttaatccatttttagccaaaaaaaaaacttgttatgaatttgtacacaatgccaaaaaaaagactaatatgtcaattgatcttggtgtaaaaaatgccgaaatataacataaaaggcaaaaaa

SEQ ID NO: 20846 - DNA, 2237 bp, Heterodera glycines
ctttcatttcttttctcttatttcttttacttttccactttctctctctttttcctcactccctccctcttccacacacacgcacgcctccaacagactgctgctgcacaacagcacgcgcctgttcactgtctacccctcccacccgccgctgcccgcatcacagacagtcagacagtgcactatctccctcctccctctacctaaccacaacagcctgcctgggaagagaaatctttttgctttaactatttcttttgcttttttcttttcctatactatttcttttaccttcttctttttcaaaactatttcttttcatctctttttcttttcactctctcctcacagcaaatacaaaacgccacattcaaaccatgttacatagccacaaacaatcaactttattatataaaccgctctgtttaatttttttaaatgatattaaaattgtctaaagataacttttttccatcacgccttccattttcttctctcctattctcattcagtctctctctttctaactcattctctctcttttttctctctctctttctctctctctctctctctcttctccctccctctttctttgtttcactctctccctctctttttttctctctatctctctttttcattctttctctccctccctctctctttctttgtctttctctccttctctatttctttcatcgctttttctctctcttcttcactctctctctctctctatttttctttctctcactctctctttctttctttctctctccctctatttttctttctatgtttcctcaccctctttttctttctttccctctcactcactttctctcattttctctctctctctccctctctctctccctccctctatctttctttctctctccctccctctctctgtctttctctctcactcaccactctctctttttctttctctcactctctttttctttctctctctcttccctctctcacatcctttctccctttttcttaatctcttatctctctcttttaacctcctcaatcactttctctttctctctctttgtctttcttctctctctctcacgctcaaatttctctgtctctctctttctctctctctctctgtttttcactctatttttttctctctctttcaatcccgctctctcatttcccttctctccctctccctctctttaactctatctctctctctttatttctcgctcaaatttctctgtctctctccctctatttttctttcactctcctttgctctctcaatctcttctctctttctctctttcagtctcgctctctcatttactttctctccctcttcttctcttaatctctctcttttcacactctctaactattttcactcctctccctctctttatctctctctctctatctctttctttttctctcaaattttctgtcttctctctctctatttttctttcactctcttgttctttctcatctcttctctctctcttttcctttctctctctctctctttcctcctgttctttttatcacgctctctatcgttcattttccctcatcttttaatttctctctctctctccctctctcctttcttacttctctctcactgctttcttctttctcacttttttctctctctcttgataattagagataatacagtaaacgtttttaattaatcgcgcaaattgtggttgggtgtcataaaagagactaaaattgtagcagaactgcaaataaatcctaacaaatgaaaaaaggttttttaaaattggagtaaaaatttaaaaaaaatttaaaactattaaaaaaatcattaaaattacttttataatattttcgatcaattggaaatcattacaataattgaaaaaacaaaccgataataaaaaaatcggcagcaaacccaacgaactaatcaataaatgaattacttcagagattttaacatttaagtctgatttttttgttaaaatgatactaaatcgacaaaagcctttgattgatcgcgaaaattatgattggtcatgtaaaagttgattgaaaataaaacaccaggagaaacgcaaccgcagcctaatataaaatcaattaatgaaaaaaggttttttaaatacataggggattatacatatttcaaaaaagcattttagtgtacacaaaaatttttaaaaaaaattattgtacacattcaagaccattaaaaattt

SEQ ID NO: 20847 - DNA, 1965 bp, Heterodera glycines
ccccccccccccctccccgcgccgtttcgatgggaattggggcgaacgacggatgaagaacagagtccgtccgaattgcctcattatgttttttcggttgctgctgcatccgctaatgaatcactaaaccatggccgtttttggcattggtgttcgttagtccatgcccattaactttccctaatgatcttcgtcctcaccttgctcttccctgagcacactcatcagttttgtcggtgccattggcggtggtactgacggggaagggcactcctcgccacggcatttttcagccgttggcactttgcaactgtcctcctctttgccctgcttggctcttccgggcgatttttgtgttgccaatgttgagatgatcaaccgttttgtcggcactgatttagccaatttggaccttttttgcggagattcattcggaaaaagtggcgtcggcgacggagttttagtcgttttcgaattgccctttttggactgatcgtgtgggttttcgaccggaattggttcttcattctcagatgttctgtctgaaattgttcactgatcaaagccaacggtgccatcctaattgcctttgtgccgtttctctccgatcggctgatcattctctgctgtttctcctccctcttcggtacaattcgctctcactgttccttccaacgtcgtctcctgttggtgctgcatcggactgaccacgccgaccaccgtgtggtgattgcgtcgcgattcgccaaccattgatgatgacttggcactctccgagtcggagtccgccgacaacggacgccctccgccgctctgagagggccctcctttttgtgccggtggcgtagttccgcccgaaagcactgaaatgcctttgacggccataattggcttcttctcctgaacaattaaaatgtgtgatgcactgaagcttcgtcacaaatctcatgctttaccgtcattagcggagaattcgccgcttggcatttcccccgttcttttgctgttttctgtactttctcctcctcctcctctttctcctcctttttcaccgctttcatttccaattgttgttgtgccgttgctttcttttcagaagcactgcttgaaaatttcttgtcagaataattggccgttctgccggaggctgccgtttttatgccggaacataaactgcttgaacttgtggtcatcagttgcagcggaggttggcatggcttaatttagaattggttgcataacccaaatactgctacagtatcaaatgggtttctccatcaaaatccttctccaccttttttacttgtgccgccgtttttatccatcccccagttgaactgctcgaactttgcgacgtgttcatctgctgttgtttgctttgacttagtccgcccgtccttccgttcgttgtgctccttttcgctgctgctgtctctccgcttcgcactgaacaatccgaacagttgctggtcacactcatttgcatttgttgccgttgctgtgtcccaactcttccgctcattgactgaaatgtgccaacagtcgtcaccgaagttgcccttctgttggcggatgaagagggcgccagcagaagtgactttgagacgggcgtcgctttccttaaacggacaattagcctaaaaacgaccggcggtaatgacattaattagccctactaattagactacaattattcccacttgttggtgctgttgtggttgggtttactgctgctgtccccattttgttgcttctgctgctgatggtgcgtgccgtccttcgctttgggcggtgttggcattatgtagctttgatctgccgccggcgatgaaagggggccaatgggcggaattggcacggaaatctgtcggaaaatggagatttaattgaattctacacttaaatgaattattttgttgtgtcaattgtatttgggaaagcatcttcccaaagtgttgtttattt

SEQ ID NO: 20848 - DNA, 3441 bp, Heterodera glycines
gtaacgcaaataagagagccaagaatgtccaaaactcaaagtttacagaagagctgcctttgtagtcagtttcttaatatataaattttattggacgctgattgcaaattggtactctttgaattttattaaaatcaaagggtggttggaaaattttgtcatgaaaacttgatcctggagtttttcgggatcaatgatcacaaacccagcatcaagttcacaattccaaatccctaacctaaatttgagcaaaaattcaagttctaaaaatttgaatttcgactttttgttcgagttcggcttatagtgattaggatttggtataaaaatgatgttaggttcgagatctgcgaccacgataagccagggaataagttttcacgataaaatcactccccttgggtttaataaaatttaagacacgaatttacaagtagcgcttttctcgtaattgttaataaacttggcataaaaaacattttaattattcaaaaagacacgtcttaacatagattcttttaaatgacatttgtaattacttactgagtgtttcgatgagcttcggaatgacccgtctcacacaaagaaacatttgagtggttatggatccacttggaagttcattgagcaccgtcttcagagcgatggagctgacgtcgcgcaattgctcattttggctcaccatattggcacaaagtgagtccaccaaagtctccaactgagccaacttaattttgtgcacaagtggtccttaattttatataatttattttttgaaaaaaaagatggggatgaggggtaatggtaatactgccgatagttgcctcctttattttatgttttaaaattacaaatttctgataacactaaaatgattttaaaaaaacggcttcaaattcgacctaattcaaataaaaatttattcaaaaattctttcgagatataatactaattaatttagttttaattgataattttattaaaaaatctttcgaaatttaatactaattagtctattttaattgaattgataatatattcttactttttcaatttgcatgcgaatttttgttccgattgagggatcagatgaaattgttcaataatttccgccacattttgttgatttgcccagccaagcaaattttcacggattttgctcctttgataagcacaaaatttcaaaaattcatcaaattcatttcccgagcataaaatgatcgcaaaatgatcaaaactttgtttcattttccttttttggaaaatgtttttccattttttaatgtcttccgtcagaatttcgtttgctaaacgaagtgcaaatttaattaaattaataataaaaaaaattattaacccatttttaattcgtcaattattgtttcaattgtgtaagtgttcacattgaatgttgaattttgttcaggaaactttggcgttataacagtcattggcgaaatgccaaaaaggggtggccattttcgcacaattttgttcattgtaacgggtgtcaatttctttaaaagcactgcttgagaccaatccctaaaataaaaaataattattattttatttaaatacttttgaattagaaaattcactctgacctaagaatgtgatcaaattaattaactatctaagggatcgcgataattaataattcataatatttcaataaataaataattaaaaataacttattcaaacgcaaattccttttgaaattaaattaattaaattttaaaattgtttattattgtccttcaattgtaataataaaaaaaatttataaaattatataaaaataattctataacaaaataaattcgtaccaattggcaaaatgtgagaaaaattgatataataaaaaggtcaacggtgcgtcggggaacaaaatgcaaattttagacgccatcactgacaaagtggcaccatttaagtagccaaaaattcccgaatatatttgtttatcttaaaattcaaaagattaaaattaaaattttgtttattactttttgcccacaatttgactgcctttaaaagtgcagagaattctttatgatttgggataagcgataattggtattttgatgatctgtagcctaaacttgatttattgaaataaaatcaatttaattgtttacattgatattttgtgttatttgcaataaatttttttaactatatgaattaagtagcatttttttttattaaattaactattaatggattttgtttatggaataaatttatcttattttaatagttttaaaattaatttttctattatcaaaattaatttttaattgatggtggcccattttttcatttattatttttaaatttatttcacaaatcttatttatatgtttttttgtttaatattttgtcgttttttacctgccaaagggtaaatgcttgtttcttcggtcatttgcttaattagttgatcatcctcaatatgaatgtctttttctaataaatattttccaggcacaataaccggcaaaaaatcaacttcaatttgttggtgatcaattcgcaaaatgttcactttgccctgcagccaattaacgctgatgacgtcatttaaattctaaaaaataattatttattattttttcaaacttaattagtggtaatttgtgtggaaaacaaaagtaaatcactcaatatatttttttcaaaagattgaagaataaatttatttaaatataattttcaaattatttttagccaatatatttaaaaatttaaattaatttatttctgtagtgttttttataatatttttttaaatttacttttttaagaaatttgtataaacatttatcttcttcaccaaataattggtcaaattcaatttcgtctggtaaaacacagagcaaatccatatctgatccatccacaaaaccattcattaaaagtgagccaccaacaagcaatcgaggttctaaaacaaataataaattgaaatatcaattagctaattttaattaataattattactaattgctgtaaattgagctgtccacttctctactgatgttttgatatttagttttaaatgatttattgcttcttttttaatcggattaattttgggagaaacaaaattttgaatctaaaaatacaaatatttaaaaattattattttcaatttaaattaacctccttagaaatttgtttttctatttcgcgatttttcatctttgttcttatcatactgtaatgaccaaattcgggatcagaaaaattttgggtttgtaaatataaatctaaaaatagatactttaaaaatgaataataaaaagtttcgagtaattacataattggcaattatttgccacaaaagttataatataaaaattttgattttgaataactatcaaaaaacattaaattagtgaaacttaaaaaaaaatacccaaatttttctg

SEQ ID NO: 20849 - DNA, 956 bp, Heterodera glycines
aaccgcgcctaacaacaccaatgggacgccaaaaacattaactgttaaaaaatgatacaaagatcgcaaatgtttctcttccaaaattttaatcaaatttttaaattttttccgaaaaaaattattatgaaataatagatttagaacaatcatacaattaagagtcttttaacaaaaaagaaacgcgtcaatacataaaatagaggtctaacttcaaaaagcccccccccccctcctaccttttggttttcgttttctttgtagaagggctatggctataaaagtagcataatttaattcattattcataaatattatttttaacggattaaatatatgaaaagcgaagcatgaagttttttttattaaaaaattctaagatttttgaatcattctcaaaatttaatcaatcaaataaataaacaaacaatttattttcaaattttgtttttatctaaattcttaaatttagaaaattattattttttaatttgaaagtgctcaaaaatccctaaataaggtgtaacatacaaacactttttcaattttttttgccgtattattttcctaaattttgttgggcaggaggggcggcggtgccgttagacgccgccggggaaaattttgaaaattagagtgcaatttgctaccagattttgtccttaaaatttagcaaattttgcaattttgagccatattttttaatcaaatttggaattttttggtctgttagtgccgacaggctccgccgggaaattttaaaattttgttaccatttttaacaatttcgcacctaaataaaatttttatttttagacttgattagtagggatgtaaaaaatatggaaattattttccatattttttcatatttcgccatttatgtccatattttcatatttgtccatatttttgggatttaagtccatatttaatgtacatatattggcattttt

SEQ ID NO: 20850 - DNA, 1018 bp, Heterodera glycines
  misc_feature (955)..(955): n is a, c, g, or t
gacgatcacttattgaagcgtgctttcgatcgctgatgcccaatgctggcattattgctcagctgatcaataccgctatgattattatgtttgtggtgtaccaattgtttgaacgcttttgccgtatttgaatatgtgccagagagtgagtcatgaacgcactttttccacatctgcatgttcagcttcaatttcaaaggaatcagtttgtcgccatacgacgctatatagcccaactttggcatcatgccacatttttggatcgcaaaatctgatgcaactcgcttcaaaccgcctctagatttatgtagtttggtttgtcttccggtctgatcactgaaactccgacgcaattgtggatggcacaaatcattttcagcacattcgtgatatccaatttcaacaatttctctgttcatgtttggttgattgttgttgttgtcatcataatcatgaccattttcttcataatcataattagctgggacaatttctttgccggttggcacaccgttgctagcattcaaatcgtggccagtgttactgttatagtttacaaaaggtgccggtgtgcggcggccaagtggacttggtgaatattggtaagatgatgatgattcaccacgtgtataaatgctgcccaggaaatttttgcctgatcgcttgggaggagtccttaaaagtaagcaatgttttcattaagatcgtaattaaaaagataacttattattttaaaaaatttcataaacttctaagtgattttgcattttaggctatcgatgattatctttctctgaattgtcaaacatcagtagggctgggattcttaatttttgcttatttttttcttcgactctaattcaatgaaaaaagaatgaaaaaaacatttttatcacgaaattcttagttttaacacctttatccgtccctagaaaacctgactttttgcccctanaataggggcgtcactattttgacacatttggcatttcgcccctatttcgtcatttttgaaaaa

SEQ ID NO: 20851 - DNA, 1028 bp, Heterodera glycines
ctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgtttcataaatatttttttcagaaagtgctctaaagcgcaccaaattttatttacaacttaattttagcactctgatgctttagtatcaaaaaggaagatggagaaaaaattttttaaaaaatttttccttatattttggttatatcgttttgcttttggtggggtgcttggaacagtggaatcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcaattgctctagtcaatttttaaaatttttggtgaaatatttgtcgtgctctgaaggggggggggggggggggggggg

SEQ ID NO: 20852 - DNA, 3267 bp, Heterodera glycines
  misc_feature (55)..(55): n is a, c, g, or t
  misc_feature (64)..(66): n is a, c, g, or t
  misc_feature (68)..(69): n is a, c, g, or t
  misc_feature (71)..(71): n is a, c, g, or t
  misc_feature (77)..(79): n is a, c, g, or t
  misc_feature (121)..(121): n is a, c, g, or t
cccccatataccacttctcacaactaattgagctagttcaataaaggtaaatganatcaaaaannngnngngcaagnnnctctttgaggaagaaagaaattatgaaaattttccgcttggncaatccgcaaaaaaaaaacaatatggtaaaatggattactgtaattttataagattttaattaatttttgttggtttgattaataaaatcataaacaccttcacgtcatacaggaggattttaaaaaaaagttgataattaaggcgcatttcgttaattattcattgtttgcttgaggtgcaaaaaggcaggcctcttccaaaaaacaataaaaatttactctcgaatttttttttggcataactcttataaattagtgccaaaatggaagaaaaaaaaatattgtcaccgattttgtgccgccatttcgctgccaatcgccgctgaacaattgccgttggccatcgttgctgccgtagctccaacttgtcgttgttgttctgcggattgatcagcgccaaagtccggtgccatgatcaacgaggatgacgtaattgttgctggtgatgaggacaatgctaattggtgtggcggaagcgtcagttcattgatgtggtggtgatcagcagcatcagccgccgatgagacagccggctggaagccgccgatcagcgcctgtgccatcgtcaatggcggatgctgttgttgttgatcagcagtagtagcaaaatcgggcgccaatgttggttgttgatcagctgcaggaggttgttgctgctgctgatcatcttcaaccgctgctgaacatgatgaggaggagaacaaagaagtctccatcagctactgatcagagcagaaaagttgaagcgaagaataattggaatcggtcaagtgatcgcaaatgatcagatcagccggagggaaggcggggctctgatcagtagtagtgatcaagaaaatgtttgtgatgattatcgaccagcagctccatcaccatcatctgtaacggatggatgatgattgaatgcgcaggcagcatcatcgatcagtgaaagattttaattgggtcggatgtggatttagaggagagagcggatgtgtgcgttcactgattgaacacaaccacagataggtaaatcccggcgaatatgtgagtttattgttcccacaaatttgccccctaattaagctattaattggatcactgtttgatcaaagaatggcggaaagggtgatcagaagaagaactaagaataaagaaaaattttaattttgtgattaattcttttaagcaagtttttcaatttttatttaaattaatcccaccaactcgttggggtgcgattattgaggctgggataggcataaaaatgccgaaaattcattccccttggtatttgaattaatacaaaaggcctaattaggaaacagagctggcttatggaaaaaatgaactgctaattaagagttttaatagttcaaacgctacgctaattaaggttttcatattaaaaaaaaacacaatttccttttatttaactgtaaaaaaaattaaaatagttatcaaaagaatcatggctaacaaattgctctcaaaaaaacaacaacaccaaccaacttattatttatgcatttgtgcataacatttttggtgtcatgtagtggtgacgaaacaaaaattattattatttgttattaatttggttttagtatttgcccgcaggtggcaggcaaataaatgaatgaatagaatgttaatgacaggcgcgagaaaatataccgtaatcccctgtaattgatccctttgatgcccggctaattaggccttgtgctgctttctgaacaacaccaccgccccgaagctgtgtatgtacaacaacgacaacaaaaataataatgatgacttatttttacttgaaaaattgagtacgggaaaaaggaattaatgacccctgagaagaggaagaagccatttatttaatagccccctcattaattggggatttttattcgagattctcgagatcagccttttgccggtgaagaaaagaaagataattgttgagaaggaaaatgcttaaaatgtatttaatagatagaaaataactaaggaaaaatttataaaataatatttttaaaatattattattattaaacgaaaaatcgttaaaaacactaaaaatgccaacatcagaacaaggattagagtttttttaattagttagtatagtcccaagttttttttatccaaatttaggacaaaaaagttaataaatttagattttggccaaaaattcaggtttgatttcagcacaaatatgaaaatcagcaggaccaccttctctggactctgtttattatagagcgggtttttagttattaaaaaaacgaccaaaaaattgttggaaaaaaatataaaataaaaatagaaattaaatagaaaaaataaaataaaataaaaagtgcgaaacattacatttttattcaaaacaattatttaggcgtctaaattaatgcacaattttgtatttaaaaagaaataaatgaaacattgaaattttacaatattattagattatcaaagttagataatagaaaatcgaaaatacatattgtacatagcaacattattgaattgaaatttttaggaagaaaaaaaaattaaataattttttttttaatttttcccccaaaatttgggggatttgagaggcaaaaacatctaaaggaaaggaaacagagcaaataaaatatgcaaatgagcaaccctctccaacaaacacacatatgtaggtattatgtgtgcaatgaaattgattggctcccaattcgctgcccctcgggggaaattaatatgaaaaatatgcaaaaaataaaaattggcggcttcgattttaaataaaaaataaaattttataatttttaattttttgaaagaatatgtattataaaaatacggcatttaagtccccaccttgacaagtcaggatttctcctggaccgggattttttccggaacatacaagtttaaaaaaaaattatacataatatctttgaaaaattcctagaattgtttgtttaggaactataacaaagtttcattgaactgaaaaaatttaagcccatgtatttcgggcagcaaaattttttaatttaaaaacaaatttttaaaattttgcaggctatggctagtgcctacctagcccggcagcaggtggtggttctccaagcgtataaccatggcaattaaataaattaatattaat

SEQ ID NO: 20853 - DNA, 1922 bp, Heterodera glycines
tttgaaattttacaagctaatcgagaaaaagcttggctatcgaatgataccaagaatgtaaaatttgattgcttttaagcaaagttatttcatcttttgtcaaaaaattcgctaaaatgtcggattttactaaacaacccagcaagatcattacgcaaattcacccttcccctctcatctgttcgccctttggcgacaattggaccggtcagcaacattatatcaatcaggcgaacggcaaaaaatatgcacaatttctctttacggcaaatattaccctaacatatatcatcattttgaataaaaatgcgtatcattataaaaaaaaatgagtattgaaacgaaatgtaaaaaaacaagaaaagtgaagaaacagcagacactatataagtcagacactacattaaaaattattgaaaataaaagtgaacaaaacgccaatgaaaaacagacagcggaattagacactatatgttttatcattgattttaactaaatttctaatacttataacttggtgaagggtaaaccaaacaaaaccattttgtgctcattttgatgggaaaattcttaagaatatttcaaagttaaataaaaatttgaaaaaatagtttattagcaagaaaatgaaccatgtgttatcttatatgttagagacatggaaatagtgcgtcaaaatgagagaacaagaaaaaactttgccaagttgaaaaaatttttctacagttgagaatttcttgaaattttgcataggcccatattttgaccccctctagtgattccaagtttattttatggaacttaagtttttaactcgagatcggctcttccatttttacaagggttaatctcggcaaaatttttaaattagtggggttttttggcgttttgtctgtgcgcacttttggtcaaattgatgatatatgccctaatgaaccgaaccttgacataaagaattaactttttttatttgattatttgaatattttatttttttattatttttgatttaatacagttttaacgattttctcatttgttaaacatttattattctgtgtttatttaacacacgtatgttttgttttttctatgcttattaacaaacaaacagattgctggaataaatggacaatgcctttcatcttccaaactggcaaaaaaaaaatcaatcccaacctaacatttctttttccattatttattaggaaaacatcataatagctttgtctttacgcgtaagatagaagaaagatttggccatcataaatagtcgtgccatacaacgaacggcaaacattccgctaaaaaaggcattaccatcacaaaacaaaaagaaaaattccatctgtttcacttatttttccactctatcattattagggctgccaattttatgtaaatacatattttttcctggcttctccttgctctaaacagcaggaaaaacactttcttttttgtgtttgcgaacaaaaaccgggacttttatttacatatttttacatatttcgggattttcttacatatttgtacatattttggatttttttcatatatattttcatttttttatatattttgagtattttttacggaaatttttggaaatcctcaaaaaaaaaataaaatttcggcaaatatttttgtacatattttcattttttacatattttgaagatttataaagaaaaaataagtttgaaaatgttgcctaaaaataccaaaaaaagtaatttttatgtcattttgtggctatttcatactttacggggaatttctttcccaaaaaataccattaaaaaaatttttatttacatatttggggttttttgtacatattttggaatttttcttacatatttatgtacatatttggatcactttttgtacatattttttgcagccctaatcattatgaa

SEQ ID NO: 20854 - DNA, 1611 bp, Heterodera glycines
ctctactccctaagaattgaatatttttcccaaaaactgataccctaaaatataattttttttttcttgaaaaaatttttcgtttaaaaattgtccttatccgaaaaaacttttcaattttttaataagtttatttaaaaatgaaatataactgaattaaattttttgattaagttttcaccaaaaattggccgaactttcccattcattttacacaaaatattaacagataaaatttattcagtttttatcatgaaaatagaacaaaaatgaaaagataaaaatcttttccaaaaaaaaataaaattattataataaatattttttattttattatggaaataaaatttaaaaaaaaacaggagatttggcaaaaatcaatcattaaaagaaacaaaaaaattataaaattttctttatttttttaacaaaatatttaatattatatcaaatattattaattatattcaaatataatttcctggcatttttggtagtgcatctcgagagtctcggtctcagtctcggctcgagaaaatctcgggttttttggtctctttctcgcgtaatatttttcaagataatctttttttcaaaaaagaaattattttaattatatatttttttatttattatggaaataaaattttaaaaaaacaggatttcctggctctctttaatttttttctttttggcaaactattgcattaattttatttgaaatgctagagatgtattgcgtcatattttctttcgtaatcataaaaacgaagagataattatacagtaagggcttccatttttatgtaaatacatgtatttttcctggattctctatagcctaattagtaggaaaaacactttcttttttgtgtttgcgaacaaaaattgggacttttatttacatattttgggatttttctacatattacatatgtatgtacatatttttatacatgttttggacttttttgcattttttcgtacatattttgcaatttttgagaatttttaaggaattttttattaaatgcccaaaaaaaaatccaaaattacacaatttttttcaaaaattttgagaatttatagaaatttcttgtgaaaatttaaaatttttcttgaaaatgttccccaaaaaatagttttttttttcaaaaaactgataccaaaagttaatttttaaaataataaatgttgatttctaagcctatttaggtcatttttatggcattttgtgcgtatttactctttacaaagaattttttttcaaaaaaataaccatttaaaaaattttatttacatattttagtacatatttcgtacatattttagcattttttatacatattttatttacatatttcgcgatttttcttacataaaaaaagaagccctgataattattattatttattttaatgtaataaattactcagtaattttcgaatgaaattttaccatttaatttctttgttattattatttattataaattcaaccgacaaaactttctcatttaataaattatgtgatttgaatggaaaaattcggccaacttttgctgaaatatttggccactgggaggaaattgatcaaaatccaaattggcaa

SEQ ID NO: 20855 - DNA, 2429 bp, Heterodera glycines
  misc_feature (94)..(94): n is a, c, g, or t
agtcccagcggctgatttctcattttttcgtgcatttgagggcccctaactttttttctaaaaccctgaccaaaaagtttccgctggtaggatnttaagttgaagtgttggctaaaagtaaaaaaaaattccaggcctctacctataataggaagggctatagaagcgcggacaaattcagtaccaactttgtccacttcagtcccaggcgaataactcgccagggtttgaactgagcgagggggtgcaagcagacttattgtagagcttcgaaagctcgatttttccaaattttaaaatttcgaaaattttcaaaatttttcgagttaggcctaaaaaacggttttcgggtttttgaattttaggattttttaacgatttttcccagagaaacggagaccacttccaaaacatagtttttcgagctctatcgactggtaatttttttggaaaaatttcgatttttttccggaaatagaaaaaatttttggcctgagcgggacatttgagtcccgggcccataactcgttaggggttggttttatcgaaaaaacgcattagggcaaaattgtagagttttttaagctctatcgaatggtgtgcatatggccggaaattttcaaaaattttcgagctaggccccctagaaattttcggaaattttttttgggttgaaaatgggggtcaaaaatatttttctggggtattttgatgtgctgagcacgaatatgatgtttatttttcgtttcaaaatttttggaattttttaaaaattcaaaaatattttccaattttttggcccacgggattttgggcgaatattgaaaaattcatatctagcctaaaggttgaccaattttgagcaaataaagcccttaaaaatagagaaaaatcaggagaattttatgggatttatttgggttttctaacatcaatatgaaaggaagttattccagaaaattttgaaaattttagatttttcagaaaaaaattcagaactcgcttctgaaaagtcattctgtaaaaataataaactacaaaaatccgcaatttttttctctataatataaattttattttacatttttatccctttttaaaaaaaagctcccccccccccccccacaatgttcccaaaaagttttttggaaccgcccacaaaaacgcgatttaaaaaattaatagattgttaatttattcaaaaaaatccagaattttgggactcagaaaatccaagattcccccccccccgcatgaaaatttaaaaaaaaatttctatataatggaaaaattcttcgaatgcctcccccaatgagtacatattttaatataggcaattttcgtaacaaagtgcagtcaaattttcaaattttttttcaaaaaaactttcacttgggaaaattttattgattaaattgaaaattttgaaaattttgtttttaaatgcgtggtccgcggccgcggcaatttgaatgcgcgatgcgcgatgcgcggccgcggtttttttctgtgcgcgctccagccctgctttgcatgcaaattatcgcctgcagcaatttgtttcgtggaaagcaaaggcaactgaatcatggcttgccatcgctgtaaaaaatgtggcaaatggaaaaattaatttaaagtttaaatatttttttaattccaggaagttgccagcgattcagaaatttttgatgccctcttcaaaataacattttacgcggaagtgaaaaggtaaaaatgatcgggccattgttaaagtgatcactgaccattgatcagagccaaaatcatctgaaaaaagtgatcaaagcccttagggaaagcattgcatatttcgaaagtttgaacaaaaatccctaaaaattccatttctatgctaaattccgatgctttgtcaaatgagaccttttctcgttcattcatcagtcattttggaatagcttttcgatcacatccaaaatttcatatatttctttttgttaataaaatttccaacaaaatttttcaggtggccaaatgggttggaagtatacaaatttcggcatgaaatggccacaatgggctggtcgctgcaaatcaaacaactcgacgtggacgagtggcgctaacggagcagagaaaagtggatatgagaatggaatgggaggggattaatgggaatgagcgatttgtttaaccaatttttttttttcacatttaacactttttgttgaaaaaacctttgcttttcatttttattaataaaacgattgtatttgaatggttcgcctttggaaatgtaattttgtttggttttttcgaagttaaagatgaattgatttaattttaatgagtcatttaattacatatgtctatgcttactccataatcaattagtactggcaataaaagaaattgacaaaatgcgacggtccccggatttctgcgtt

SEQ ID NO: 20856 - DNA, 947 bp, Heterodera glycines
tggcacttttacgaaacgaccacagtggcacttttacgaaacattcccaaggtggcacttttacgaaacgcccatagtggcactttttacgaaacattcccaagttggcacttttacgaaacgaccacagtggcacctttacgaaacattcccaagttggcacttttacgaaacgaccacagtggcacttttacgaaacattcccaaggtggcacttttacgaaacgcccatagtggcactttttacgaaacattcccaagttggcacttttacgaaacgaccacagtggcacttttacgaaacattcccaaggtggcacttttacgaaacgaccacagtggcacttttacgaaacattcccaaggtggcacttttacgaaacgcccatagtggcactttttacgaaacattcccaagttggcacttttacgaaacgaccacagtggcacttttacgaaacattcccaaggtggcacttttacgaaacgcccatagtggcactttttacgaaacattcccaagttggcacttttacgaaacgaccacagtggcacttttacgaaacattcccaaggtggcacttttacgaaacgaccacagtggcacttttacgaaacattcccaagttggcacttttacgaaacgaccacagtggcacttttacgaaacattcccaaggtggcacttttacgaaacgaccatagtggcactttttacgaaacattcccaagttggcacttttacgaaacgaccacagtggcacttttacgaaacattcccaaggtggcacttttacgaaacgaccatagtggcactttttacgaaacattcccaagttggcacttttacgaaacgaccacagtggcacttttacgaaacattcccaaggtggcacttttacgaaacgcccatagtggcacttttacgaaacattcccaagttggca

SEQ ID NO: 20857 - DNA, 998 bp, Heterodera glycines
aatgagaattcatgcgagattttctggaaataagcttcctttggcctagttaagctgtaaaaaaatttggggcgatttgaatgagaatagaaagagccaggttcgatgaagttttggtaagccaaaaaaaaatccaaacattttttataaaaaatttaaaaatgagaattcatgcgagattttctggaaataagcttaatatggcctagttaagctgtaaaaaaaatttggggcgatttgaatgagaatagaaagagccaggttcgatgaagttttggtaagccaaaaaaaaatccaaacatttaaaaatctataaaaaatttaaaaatgagaattcatgcgagattttctggaaataagcttaatagggcctaattaagctgtaaaaaaaatttggggcgatttgaatgagaatagaaagagccaggttcgatgaagttttggtaagccaaaaaaaaatccaaacatttaaaaatctataaaaaatttaaaaatgagaattcatgcgagattttctggaaataagcttaatagggcctagttaagctgtaaaaaaaatttggggcgatttgaatgagaatagaaatagtactcactcggccgcttcgcggcctcgtggggggccttcggcctcccccccgtgaccgcgagtactacgagatcggccgccccttcttcgagaaggccggtgtcgcgcacaaggtggacttccgcgagggacccgcggtggaccacgtcgacaagctcctcgtggatgaggccaacgtgtgggcgttcgacttcgcgatcggcgacgccgtcaagcccaagtacgttaagtaacacgagcagatgctgcgcctggtgtaggtcggcggcaccatcgtgtatgacgacacgctagtggtgagcaccgtggtgatggcgcccgacacccccatgtcggacctcgatcgcaggttctccggcgtcatcagggaccgtcatcgtccgtctctccgccgaggaacgcatcgagg

SEQ ID NO: 20858 - DNA, 2298 bp, Heterodera glycines
aaaaagtatcaatgataataatatttaaatttaattattattttaaatattatttgctaaatatgaatcataacttagcttaaacttagtcaaattaatgaaactcttggtatttggcgatagctctatatattctttgaattatatgattaaaaaatctagcaaaatttttacaaaaagttgtaaataaaaaaatttcgttaaaatttaaactcaataattgaaaactcattaaaaaattttattttaacaaaattatagagaaatctttgggctatccaatcatataaagaaaattataataggttgtttattaaaaagttactaaggaattcacgctcattattcacatgtcaatttacgggttaaatcacgtgtcaattcacgggttaaatcacgtgacaatttacgggttaaatcacgtgtcaattcacggtcatgatttacgtgttaatttacggtcatgtaagtttaacttacagtcattattcacgtgtcaatttaagggttaattcacgtgacaattcccaggcatgatttacgtgttaattcaaaatcatgatttatgtgttaatacggtaatgattcaaatgttaattcccgggcatgatttacgtgttaatacacggtcgggattcacgtgttaattcacggtcatgtacgtttaatttacagtcattattcacgtgtcaatttacggcttaaagcacgtgtcaattcagctcattattcacatgtcaatttacgggttaaatcacgtgtcaattcacggtcatgatttacttgtaaattcacgggcatgatttacgtgttactttacgggcatgatttacgtgttaattcaaaatcatgatttacgtgttaatttacggtcatgatttacatgttaattcctgggcatgatttacgtgttaatacacggtcatgattcacgtgtcaattcagggtcatgtgcgtttaatttacagtcattattcagtgtcaatttacgggttaaagcacgtgtcaattttttatgtaacaattctttattaaatatatacaatagcatattaaatcattaggagtatgtttttagtgaaattaaagagataaaaaaattttacttttaattttccaaatttttaaatttatttgtctacaacccaatatctgtcttaagttaaaaatttaaaataaaatttaaatgacaaaaattaactgtgaaatatttttaaaaaatttttcaaaaatatgatgccattgtatattagcaaagtcaataattattaaagttaaaaattttaaaataaaatgaatttaattctgtttatttttaaaatatttctgaattcgaatttttataaagatttgaaccaaactttagtgtctattgttacagaataaccattatttgaaattttctattaataaaaatttttttatttaatataaagaaaataaaataaatataagaaattaatttttgttatttttatggtaattttactaaactaataacgtctaattaaattaatttagatgaagtctaaaaaagcaacctatttaatagataatatttaaataatcaacaaaattcgaaattaatttattctctaatttttttattatattataaatttagtaaaagttagattttactttatttattttactaatttttaatgcgttccgattttaattaattcttagaatggccaattaaataaaattttaatatctttttttaaatttaaaagactttacaataaatttaaaaaaatataattattttacaaatcaaaatgaataaataaaaaacttagaaattatcgaaaaattgagatgcgaaaatttaataaattaaatcttaacaaaaagaatgcatttcatttacttgcatttttattattctgattaaaatgctattaaataaattctctttataaataaatacaaaatttaggaggagtgactgagaactaaaaatgaaaacaactaaatgcaatttatataatctttaggaatatataatcacaaaaacaaggttttattacaaaaaaagatatatgcaaaccgattattttgcaataacaatgaccaattaaataaaattggttagttattcctttataatgtttaattttaaatgattttaaaaatttatatattaaaaaacaaaaagtttatttattttttaaaaatcaaaatgaatcagtaagagcatataaattacagaaaaaaaaggaatttaagaggagtgactgaactggaatttgattgggtgccgacaatcggcaaagtgccattgtacaaata

SEQ ID NO: 20859 - DNA, 1979 bp, Heterodera glycines
aaatatgtacataaatatgtaagaaaaatcccaaaatatgtacaaaaaaccccaaatatgtaaataaatttttttttaatgttatttttttgggaaagaaaatccccgtaaagtatgaaatagccacaaaatgacataaaaattactttttttggtatttttaggcaacattttcaaacttattttttctttataaattttcaaaatatgtacaaaaatatttgccgaaattttagattttttttgaggatttccaaaaatttccgtaaaaatactcaaaatatgtaaaaaaaaaatgaaaatatatatgaaaaaaatccaaaatatgtacaaatacgtaagaaaatcccgaaatatgtaaaaatatgtaaataaaagtcccggtttttgttcgcaaacacaaaaaagaaagtgtttttcctgctatttagagcaaggagaagccaggaaaaaaatatgtatttacataaaattggcagccctaaacataacaattaccgtgaatgggtatctcgggactaaatttttatgcgacaacccaagtttttctccggctcctatctttttttttgcttttcacactactttattttttgtgacctttaaaaaatcttaggggaaaaggagggcccggcgtttggataggcgccgcatgggaatttttttataattttaatgcgatttgttaatccaaaaaatgactgggtgggctgtctcgagcaccccttttatatgtatgatttatttcaataattttgcgcagtgttcgagtaaaaatcaaaaatgcaatttgatgtggacaaacactcacctcagcactctttcaatgcgacaactcaattcatggtaattaaataattttggaaaccatcgaaactgtgattattttcctttgtttttaggcaacgcgttaatcattttccacggagttggatactgaccagaaaagaccaactttacgagagcattgagcgtgcctccgttctgtacggttccgattggttcaatttcgtatgtttcgaacaaaatcatttgaaaaagcattcatttttcagattcccgaatttttttgtactccgatgagcagcgctgcgcgacattccatgggccaaaaatttcaaggggctaatttaggatcggatgccaagtttattgtgaagccggccgacggcagtttggggaggggcatttacttcttggacaatggcaatttggttggagagcaatgcgagtgcccgtttagcagtgctttttcagaacgaaactctcgagactgacaagaaattggtggtgtcccgttacatcgaccgtccttttctaatcaacggattgaagtgggatttgcgcgtttatgtgctcgtcacttcgttctatccgctgattgcctacatttacaggcaaatattctattcttttgattctgtgaattaattaccaactcaaaaaatgaatcgcatttttaagcgacggattggcgagatttgcggtgcataagtacgacgaaaaagatgaaattgacaaggtggaaggaggagtggacatgaacaagcatctgacaaattattcactcaacaaaatgtctgccgaatttattcgaaacaccgactgtagggaggagaatatgggtaaaacgcgattttggaatttccattttttctttctttaaaatatatttaaaagcattgtttatcgtcttcgtttcgaatttattttaaaatttccacaaaaattcttctcgatgcatattttcaggccacaaatggactctaagcgcacttctgagggaattggagaagcgtggcgaggacgtgggtcttctgatggttcgaattgaggacattgtcatcaaatcgctgctttccgtccaaaattccattgctgcgatgtgccgaaagtgtaaacattctgttggagaagagtaaatgtcaatcgataagtgaccaggagcaaagtacatttactcttctccaacacattca

SEQ ID NO: 20860 - DNA, 1064 bp, Heterodera glycines
  misc_feature (30)..(30): n is a, c, g, or t
tcaaaaagcgttttattgatttttaaattntggaataactttttaagaaatgatttttgctttatgattttaactattaacattttgtagaaaaaatttcgcttttcgcatttcgcattttcgcatattttggcttttcgcatttcgcttttttttcatttcgcatttttcagtttcgcaaatttcgcttttcgcatttcgctttttatttttcaatttggcccatccctgatgccgacctctgaccttaacaaatctcacaaacctgctggtccttaatttttgcttttttttttactcggataaccaaatgcgatcagcaggcaggctttacaaaaaaatgtgaaagaccacacataaaatatcccatcagagaaaaagttacggattttaaagagcctttaacctaaattggtttcgaatgcgtttccttttgtttggtttttttgatctgcatttgatcattcagtcagctcatattatcatccgatcgtttaagagtcgattactctcatttagtggtaattataataaattttattatttgttggaaggagagaccaccccataaaattggtattgattaaaaaattttgaaatttaaatttcttggcatccctacccctctctcaggcggctaagacagaccccaatcctgaaaaatttgaccattactattagggctgttcgagagctaaaattttccgagaatcgagaagcgagattgacccagtttcttgagagttgagacgaagacttaaatctcgtcatatttctcaacatcaaaaccgagactcttgatcagtcctaatttgcatattttccaccgctaccgtatcaaattttggatatctgtttcaatttctaccaacaaattcctttcaagtagcaatttgtcgcccatttgtccatctttccctctccccccacccttttggcgttgtttgtgtctcatgcgcaactaactcactgaggtccaaccaacaattcattcattcatacaaattcccagccaccggtcgctgtcctctgcccgttgccccccccccccccctggggggtat

SEQ ID NO: 20861 - DNA, 1367 bp, Heterodera glycines
  misc_feature (1321)..(1321): n is a, c, g, or t
ctcctgagaccttctcagtcccggtcccaaattcccgattaccaatcccagccaatttccaattacaaatcccaatttaccaatccccggatttctgcttgtgccttttcttgatttactatgtgtgtccaatttcattaaatgccgtattcctaaaaaaattatggattttcctggatgactaattaattatcttttcagctatacatttattttcattttgctatggtaacaccaaatgggggaggaggacggtgccgacgaattcggcacctttggctgtccatgtttctgctgttgttggtaattgcaaccactgcggcactgttgggactgttgacacccaggtgaaaagaaaatctcattaattcaaattaaaataataattttatttatttatttaagttggcaagttgtttatttggaggtaagaaaatttaaattttagaaaaatgaacaaatataatactttaaatttaaaatattaagatgatagacttttgaccttcaattgcattgattctctatatttttccaacaaaatcttaaaaaaattgtgtgaatagcaaattttcatccattttattaaaaataaattaattaaatttttcaatgtttcattaaaatatttacgaaattattgtttattgtaaatattttggtcaaatattatttttataaattttttcgtcttttttggtctttttaaatattttaataaattttggtatttttcgtaaatatttatttaaatatgtatttaggaatcaattaatttaggatggtcgtactgaacatcatcatggtttgtggttggattgtaagcgcgacttttcatatgactacggcagacctcgtgaatactatgagacgctacacaggtaaataattaattagacgataacaattgggtaattaatttttttaaatttgccttaggcgcttcgatttggccgggccttttgaccaattttggctgcccccattattgtgtgtgtttaaatttgattattggctggatgatgaagactggtgagcagcagcacaaaaaattggaaatatattttttaaaatcattttaaatttatttatttttatttaaaaccgaatatttcggcataaaataaaacaatataaaaatgtttttgaatttatggtgctataaatactcaacaaataaccaatatataaaattttattaaaaatttgctccaaaaaacaaaattctcaaaaacaaaaaattatttaagaaaattatgttaaacttttcattttgatggtttttgagtaacaaacaattaatttatagcatttttaatanattttattcaattttataggtatgaatttggctatgatgaaaatcg

SEQ ID NO: 20862 - DNA, 1453 bp, Heterodera glycines
attgaaatttttttttcaaaaagggggggggggccatcgggtagtttacccaaaaaatattttcatttgatggttttttgactaacgtcatagcaccatcctttcctttccttcacttaatctctccctctctcttaatcttttatctttctcctcttttctcactcctcaatcacttccctctcaaatctctctctccctctctctttctttctcaatctattctctctcttttttaatgaagttagctaagcagaaaaatttattaaaaacaaaatcaaacaaccaaaaaaaatcatttgaatgactaaggaaaacgataatcagatcatctgctgttttcaattaaattaaataagcaatcgatcattctcagtagggatgcgatttttagttaaatacctaaaatttttgcgcacttgtaacgttgagataagcataaaaaacgagtttttagcttggtttggagcttctacacccacttttataatacctatttttacctatttcgggatttttctacctattacctaggtacctatttttatacctatttcggcattttggttacctattttaaggattttcaaaaaattcttaacaaaaatgcaataaaatcaaaaaatatacccataagaatcgaccaaaaaaattttcaaaaatgcaccctaagaattggaaaaatttctcaaaaatttatcccaaaatttatttattttttctattgacaaaatttttaatttaaaatgtcaatacatattatctaagaaaatattaatatatttaaattttcgtttacaaagagatatgtagaaccaaatttttccctctttgtttgcttttttccactaaaaaatcgttaataaaaatttttatttacctattttggtacctattttggaatttttgtacctatttaatacctattttgagatttttttttacctaaaaatcgcatccctaatgatgatgggatacgccgtggcggggattgtgaatgaataataaaatccgctacgccaggagggatcgaacttgaagttcctttttgttgtgaattttcattctccttttcctataattttgctatttttagttttgctcaattcgcggaatttttcaatcactgaccaattaactgctaatggtggcagccgttccgtggctttaaggtgcagtttttgtaaattgaaatataaaatagataaaccgatttttaaaaataaaataaaattaatattataatttaatatgtattaactttttccggaacctttgcttttgtggccaccggatatttctgggtctagaaccggttttggtcgcctaggattcgagtttttcctaagttatccctgaaaccaaaacagcaaattttgaaaatgggaaacccgatctatagaatttttcccaattcccaattttttgattcaaaaatttttaattttgggca

SEQ ID NO: 20863 - DNA, 1594 bp, Heterodera glycines
tttaaggatggatttatgctataatttaatcatttaaatataaaaataaaattaccataatgtaacggaggacaaacaattggtttatttatttacttctccaatcatttaagtaaacaattgctttaagaattactttttattatttcaaatgcttatcctttttaaaagtctcttctgctgccgttgccgtcgctttgcatttgctccatccttaattaattaattaatgccttaattagcattttttagcgattaattgcgttaattaattcatttgtaagcaattaattgcattaattaatgcatttttttagcatttctctcatttatgtccgattaattaccttttttgaagtgtttgtccctccgtaaaaaatgaatccatcaaaaattgttcaaccgattgttgtgaattggctaaatcgagtgtataaattggcaccaaatgcttatcatcttctccattttgcgctttcagcgaaagaccgacgagccaaaaagtgcaaaaagcgggcccttggctaaattaattaattaattagcaatcccaaacaatttggggattaatgggcacactttggtaacattttgcactttgttttctgctcaaattgcggcatcaaatggtaattgtccaattgggaggaattcttttccaaatttgcccattcaaataatttttggcgaattttactcttttgaaaggcacaatttgttgagtaccgtttataatcaacagctgaacaaacgattaccgcaaagtgccggtatttttcttctatttttatttcctcaaaaactttgctccaattttggggattttccgctaatatttcattggctaaataaaatttcaattaattaattaattatttttttgcattttcccaccgttctccaattcctccactatttttctgagagtgaatttgttgacgttgaaagttgcgttttgttgagggaatgtcggagtgatcactgtcatcgaactccgtcccaaaaaggggcgccaattgcgcacgtttttgttgagagtcgccggtgccaattgggccaattttatcggctcattggcccaatccctccaaaaaataaaattaaaattattttattttatttaattttaattaccatttcgaataaatggcgaagaattgaaatagcaaaaaggacaaaggcgcatttgggaacagaacgcaaatttgggtggccataagtgacaaagagacgccgttgaaaaagccgaaaaggccgccataaatgagacggactgaacagcggggaatggcaattagcagacgaagcaatgcaaattggcattcattaattagttaattagcgttaattaatcaattagactgtgccaaatgttcgtctttttcaaagtttacctttagcccagatattcagacatttgagaaaaacagaaaagttattttcgcttgggactatcgccaattgaaatttggcacatcggtagcctaaaagtgccggttttgccgattttcctaccatttcctcctccccccctccagccaaagaatagacattcttttccaagctcatttctgccattagcttatcccccagc

SEQ ID NO: 20864 - DNA, 1192 bp, Heterodera glycines
ttacttttattaaatttttaatgccaaaatggtaatactctcagggatcttaaaaatctgttccaatacaaaacacaatgtgaacgaatagaagcaatgaaggaaatgaatccaaaatccgggtccggtcgggaacccggacccggccaaccctaggagttttcaaattcaaaagttatttaaaaaaaactaatttaggctgaggatgctttgttgtccgaatttgtcaaaggactggcaacaaattttgacaagtttttacgattgtttttatttgagaaattccaaaaaaattattggcaaaaatatgcggcacattttggcgttgtgtatttgatgaaaaagtattggcaatgtgatgagaatattttaaatggatctgacgaagaatgtcaattctatggcaaatatttgcatattttgtacgaatatttattccgacttaatcttgaaggtttattttttcattattttagaaagaattgccattaaatatgataaaaccaaatttgggatccttcagtggaattggaactcaattttttttttttttgcgggacgggatcccgttgagattagccaatatctcgcaaaaacatcaatagtgatgagaattatatttattataaaccccgaaatatttaaataaaagcgcagaagtgcgttttttgagctcctttcttcaatgcatataagcaaaaatatttaaataggtaaatataattatcatcactatccatccgtttctaaaaaagcggataccaaatagatttattagtagggatgggaatttttgtcaaatgatttttttttgctaactttaaatgaccttaaataaataaatatggaaacctggcaatcttattattgtatttagtcaattctcacatctaatgaaacattaaaaattattggctggatattcgttaaaaataaattcctaacgtgattaaaattactttatttagatggtagcattatttagacaattaaaaatatatttttattttctaaaatccttaatatggtggccaaatttctggtgccaaaacttcccccgcgttcagaaacgtattttttcattaaaattaatcattttaatttttcgtgatgactttttggcctttttatgactttttaagtcgactttttggagatttttcgtgacttaaattcccatcccaatttatta

SEQ ID NO: 20865 - DNA, 1299 bp, Heterodera glycines
cggggacctctagagtttacactgaatttgcatatggcattgaaagccgtggacccatgcaaatgtggcactgatggaaggccaaaaaatgccaggattaatcagatttaaggacgaggcactttattttgagcaaatgaacaaatggaacagctggctgactggctctgctgaggactctgttgaggaagaattgtcgaacaatggcacaactgatgccgatgattccccaaaaatggcgcagaccagtgccatggacatcaaaaatttggcaccaagaaaataggcaggctaacagggatgcgattagcctgtaagcaagaaaaaatttcacaacctgccaaaaggaaaaccggaaaattcaaaaataaccaaaaaaattttttgtaatgtttttaatttttcaaagattttaagacagaaaagttgaaagaagttgggttgaacagtgaaattttttaatttttttgacaattatttaacaaaaatgattttgaaatgccaattttagcaattcattaatcgcatctctgcagcgaagcctaaacccaaaagacagagaatgtgattacaaaaatgagagctgttagttagcccatgcattcattagttttattgcaaccatttttattgtttccattgaaagagatttgttgataaaacaaaaacggcattattggacatcttaaaaaaattgtgcatcctttttggttttttgaaaaattttgagaaaaaaataatgatagttacgccttaaattttgaagaaaaatttttaaaaatgataaaaaaaataaattatgcatttaaaaaatcgcagttttttatttatttattttctctttttttaaatttattttttgattaaaaaatgactacctgacaacttatttattttattattttcaaataaattgaaaattccacataacttaaatttgaattcaaattttttaggccgtgaaacgaagtttcgaatttgtaattgtttttttacggctccaacgtgtgaatttgaagatgaaagtttatttaaaaaaataatttttgtgaaaatgcgcgaaatttttaatatagcaattttaatttaaatgcaacaacccttttggctttttcaaaaaggttcaatgtttaaatggtgtttcaaattagaggtaaaacagattttgcccagaatcatgaaacatcttaaaaatctgaccaaaaaactaattgaaccgagggaactgccacatttgcgcctccacaattgcgcctccaacatttgcgcctggaacatttgcgcctccacaattgcgcc

SEQ ID NO: 20866 - DNA, 1128 bp, Heterodera glycines
atttcgcttaataaaataggaaaaataaaataataatggaaaataaaacaaaccttcaacgtaaattcggctcaaatattcatacaaaatgtcgaaatatctacggtatttttggcattctctctgttcgtattcatcaaattttccatcaattttgtcacattgccaattcattttcatcaaatacaaaatgccaatatgtgctacttttgactctgaatcttcttcatcattcttaaaaaatttgtcaatacttgtcgtttttcctataacaaattcagtaaataagcaatcatcaatctaaatttaaattaataaaaaatatatataatttattttattgaataactttcccaattgagcgaatcatcgaattttgaaagggcgataatcaaatgcttgttatttctcaggtccttggctttccatcgaccgtcctcaattgtcgtgatttccgttttttaagcatttcctttaaatttttgtcaaaattttcttgtattattctttcggcactttcatttgtttgccattcattcgctgtgtcaattgccaattgcaaaatcagctcattaattggcatcttttgttcatttccaaattttatttcataattcaattgctcattatttaatagaattggtgcaaaaaaattgtaatatttttgatttaaacggtattcaaaaatattccaattaaaatgaaaataaaattgcgaaatttgcaccagacaattgaccgcataaattattggcccttcaatttcaatttcatctttaaacacaaattttggcttcactgttggaatttgggcatattctctgtacaaatactcatataaaatgtccaaatatttgcgatatttttggcattttgtatgtttattttctttaaattccttcacaattttatcacgatggaacagatttatatgtgctaaaaaacgccaaatatgtacatatatatgtgacaaaaaaaaacccaaaatatgtgcaaacaacggaaaaaactgctttataaatacgtgaattttgcataaaagtctcattttttacccgtttcgctagcaaaatgcttattttcggaattttttggctaaaattaaattttgccataaaaaatgaaaaa

SEQ ID NO: 20867 - DNA, 2770 bp, Heterodera glycines
gaatctttttttttaattttctggtttttcgtttatctcgaaccaaattaaatttttttttaagtttaaggcaagagagaattcattgaatgatacgaagaaaatgttaaattggatgcttctaaaaaaagttatgaagcatattgtaacgatatactaccttaaggacgacattgtccgttaccacttggccacggtcaaccacatcgaccaacggctcagtaatggcaagctgacgaatgctggacatgttgaagccgtacacgttatcccaccagtttatctaaactagcagaataaaacggagagtaatagatcaaaaatgtggcagagcagattttcgggacaaatgaatctaattttactggttctgtctcacccggactttagtcgccaactttttttaaacaaatttacgaagccaattgcaagtcgaaccttctcatctttgtactgacggtcttcaatggcacacaaaaacagcgtggctttgtccgggaagagaatgccgtcggatgccaaccatttgtctctggcatagatcacagtgttgagcatggactcgtagaacaagcagtagcccatccactcggaaacaatgacgtcgacatgttcaattcccgcctggcaattgctcaatgtcctccaattttgctgtggatgacctcaatgactccgtccatctgattgtctttgatgatttttttcgattgggtggccatttttcgagtattccaccctgagcagggccaaaactcatcattaatgtgtcgtccattaatcaaaagcgtaccgcaaaaactttctttgccccggcgcgagcagcaaacatcgaaagaatacccgtcccggaaccgacgtccatcaccactttgttcttgaagaggtgacggttgtggtaaattgcgttccgataagtcactgtccgaacttcgtctttcaacatttcctggagtttgctcaattatattttagtgacttaaaaaatgagtcaaaatataaatccacggccaagtaaatacctcgtgaattccaaaatgtgcgtatgagtcaaagtagtagtctttactcgtcatctcattgatttgctgcgatttaacagccgtcgacgttgaaacgccacagtcaccgttcagaatgtgttgttttggctcattcaaaatatgatttgtattataaacttcctctgtagtcattgttgttgtaaaagagttatgaaaagtgacagtgttttcaaggctgaaaataaatttatgtttacaatattttccaaaataagttaagtttaaacccaagggagttcattcccaaattagaaatggccgaaacaactgttcttattaataaaacatcaaagttaccttacaaattaggtaggtaggtacctattctacaattgttagaatttctactttttaaataaaaaaaaaacttgtgaaccgccaattacaaaacgccaaagttgaaacaattgaaattttgccgaccgacacacggcagtaccagctgaaaactttttttttttacttattctaaaaaatttacaaaaaaagaagaatacaacccattaagataaaatatacataactttctttatttaaagccttttaatgggtaaaaaacgaaagatccgaactggtgccggtgatgttgtccccgttcctgggcctcttcttaaacaaattgaaaaagacaaatttgcaaaaccaaaatcacatcttcaccttggcaacaatcagaaaaaggaggacgaacagggaaaggtggttttataaattaatcattttgtgcattaaaatcagtttttagttcattgatgctgcgctgagtaccaaaattttacgcgaagcgtccaaacaatggaaagcggaggagaaaaaaagcggagaagaaaaggcattggaaattgaagaaaaatcggacgacgaagaagacatttgcaagcaagcgcaggaattggcagaacaaattgcagtgagttttctttaatggaatttaattgaacaataatttgcaatggaataaactgaaagatcaactcggaagaagaagccgatatttgcggatttaccagtgaagctgacaatgagcgacgtaatattagcagaacaaagaaaagggagaaagaggcgaaagcggagggcagcacaatcactccaccgattgaggcaattgtcaaatcgcatttttatttgtaaatttaattttgtattgtcagattgacggagttaatccggctgtggttgccctctttactgaagttggagctgtgatggcgaagtaccgcagtggaaaagtgacaaaagccttcaaaatgattccggcaatggcaaattgggagcaaatactcgagtgagtcacttgttttgtattggccagtgaaaaaataaatatttttatagaatagcattaaattaacgttttgttcatttaaagattgacatttcccgaaaattggagttcagcggcaatgttccaagcaacacgtgcttttgccgcgaccggaacaccgacacaatgccaaaagtgtgtttttcagtaattaaaattaccaaaaatgcttatcaacaagattcaatgatttggtgctgttgccccgacttcgtgacgaaattgacgagtacaagaagttgaacttccacatgtaccagtgcatgttcaaagcgatgttcaaacctgccgcctttttcaaaggcattcttttgccactttgcaaagtaattaattctaactgtaattttgttaaacattttatttttctgtgctcatt

SEQ ID NO: 20868 - DNA, 1235 bp, Heterodera glycines
aattattctgctgatgaattaagcaattaattaatgtataacattttgaaaaaaacaatagaaatgaaaatgaaaaatgaatctttacttaaaaaaataatttttttttaaatgctaaaagttttaatgaaatagtgaatttaagaaaatgtattgaaattttttagagcatttttttgaccttccgccaggaaatgaaacgccaaaagggcgttgaagacacaaatctttggcacgtcctcctagggttactgtcgtattcgagaagggctacggtagtttctgcgagttattgacactgatgagtagagaacaaacaaaaggcacaaaaaattctcaaaaacgcactataaaaggcacgaaaaaattgtaaaaaaggcatgaaaaaggcacaaaaattctcaaataggcatgaaaaatgcatttaaattaggtgttttatgaggctttgcgactttttgtggtttttctgaaataattttttttcttttcctgttattttgggaaatcctaaaaattgccatttcttttaaacaaatcttattaaaaactacaaaatttttaattcttccgatttttcgaaagttgagataaaaactcaagtgttgcggtttttggtcaacatttgattcggcttaattttttaaatgtccacagcggcgcatttcgcacagtgtaaaataattgccgggaatcccggttccgtttttgtgccaaacgccgggaccagcaggaatgctggaaaaacaaatacataaatgtttgtgaatggtattttttgttcttttctcattgaattaaaatctgtagaaaaaaataaataaaaaaccaaaaaaaaatccgaacccttaattgattaaacataataaaattgatgaaccgagacttcgtaaaaagtaaatttgttcatattaaaatatttcaaatgaataaaaataatgcaaaatgaacaaatagaaataggagggatattaaaaaacgatggcacaatcatgtcattagtagggttataagttgtatgcactaaaaactgccaaataggcgcataaaatatgcactaaaaatccctcaaatatacactaaaaacccgaaattgccaaaatatgcactaaaatatgctttaaaaactgccaaaaatggcttttaaccctcaaaaaatgccaaaaattatgtataaattaagaattgactttaaaattccaaagcaatggctaaggtgctttttttagagaatt

SEQ ID NO: 20869 - DNA, 1322 bp, Heterodera glycines
  misc_feature (1259)..(1260): n is a, c, g, or t
gactatgatcaatattttcctaaatcgtgaaagcccgcttccggatcaggaaaacgaattttgcataacgttttcacttaaattaataaattttctcgcttttagaaaatgaagcccgctttattactgatatttatttttcttgtattttatttccaaatttattctgcaaattcgactgaatgcggtggcattccgacgggtaaaatgaaaacatttaaatatacttggcagaaactggaaccgaataaaccagtggaaatcaaatattctgcttccaaattaaaaggaaaagaagtgattttgcaacaaaaaaaatgccaatttatttcgaaataattacaaaagagtataagtttgtttaatggtgccattcttaggtgccatttttacagatttactggcaaaaatggtgaacccgagaacaaatgtgtgatcatcaaaatttatagcaacgacagggttcgccaacatttgcggaccgactttttgcgggtgaacctgttaaataaagataatttatgaatgcctaattaaaaaattcaatattccaaataaggttatatgtcaattcgcaaaaaatcttcccgtttcgtgttcccaaacacaaacagggcaaaactccgagtttcgaactccaaaaccccgctttttggcttcaagcttcgacttcgggtaaattacccgaagtttcgggaaaaatacacccctaacgaacgagttttcaattgtgaaaaatgcaccctaatgatggaactgagaacttaaaataacagttttttctacttttttcgagaattttttgctaaaaacctgttttttaccaacggggaaatggttcaataaatgacaatccaaaaatgagtggagctaactgataattgtggctgcttttcggttcgccgacatttgtggacagacttttgcggaccgacatttgcgcaacttttgcggaccaaatttctgggttgaattgtctaaaagatttttccgagttaaacatcattcttgaggagtgatctgaccaacttatgcaacaacatcgaaggtaataaacatatattttttcctgaattttggttttcattgataaatacatatgtattaattcactcgttttataattttggttagacatttttgtaacaacaaattataggaattttctacataaaggataactcaatttagttttgtttgttaatgttaattgtttggcatgcctgataaaaatttcttcaggtaagggtagaagtganncccgaaaaaatttctccatgaatgatttttgaacatacttttaaatgtataaaataaagcga

SEQ ID NO: 20870 - DNA, 2531 bp, Heterodera glycines
  misc_feature (66)..(66): n is a, c, g, or t
ttataagcaattccttgattaacagaacatcgcgaaaagtttcattcatttctagaaaattttcanttatatttcctttaaaagttgatttttaaaaatgttcttaatttcttaaatatttttaagtcttcaatatttttcttgaaaatttctgcctgagcaattgcttttatagggagcttaagctggccagcagcttggtggtctcatatttttgtcctcttaccttacctctttattctgtcgatttctctttttatttattcagctcttttcacgttttcgcacattatttctcattgaatctgcttcgcaccattctcttttcccctattaatttaaaattctgaaatattaatcttaaaattatcaattaatcagctcaagtaatgataattgttgcttattagttttccagaaaatcagctttacctaccattattggaatgcttattgggctgtgagtgatgcttcaaaatattagtttcattaaatacttttatagtttggtcttgttttcaattttaccaaaatttaatatattgtatggcattttagtgcataattttatgtttgccaattttcaggtcaatggtaaaactgggctgctgaaaacacattgacatattttgatcatcaaaattacttgtttaataaacaagaaaaaaatacaaatgaattttacacccaaaatatttctatattacttaatattaatcaattatattaacatatttaaccaaaagatttacaaaaaaaaaaattaattatataaattatataattcattaatttgatcaaaattattaaaaaagccgattaatacaaataaattaaagaacattaaatttttatttatatttttattttgagaaagattttttatgaagaaagttttataatataatcgctgataaaaacaaatgaacattattattcatttgactaaaacatcgtctcccaacaataaaaagaaaaaaacccccaagaaataaaaaaatttcaatgacatgagcactgtgaaattaaggccgaaaagataaatattttaattaattatcaaaatacttaaagaactaaaggcgatcggtgtcggcctgttattttctaaaattacaaaatctttgatggcatataatttttttacatttattagaaatttagaaaaaatatttctaatgtacctttcgatgcagatcagcaaaactcaattgcaaaccgtagtcagacataatattattttacaaatatatttaggcaaaatcatttcaaatttaatttaagtttgattttattgataatggtggattttaaaatagttgactttcatatttttttgcttactttagcatcttatgcttttttgtgcttattgacattatttttttaatttaactaaaacatcgtcgcccagcaatgaaaaaaaaacccctatgaaataaaaaatttccttgaaaacttcaaggacaaacagcacgtgtataaaaggcatgataaatatttatttaatacgttttaaataattacccaaatgattaatgaattaataaagtcaaatacttttaaaaaaacttaaattatccagaatcttggtccttacaaattagcgtttaatgttttaatcaaataattttctaatgatttctatgaaaacttttcaaatgtttgtttctgagttgacaagcgaactgtgagaatttttaattttttaaacgaatccatagtcaaatcttgagaaagttgtgagcgtttccgtgaatcgttatgtcagtttccctttctgattatttcatattcgccattagccattataagacacgtatccatttttcttttgagaatgactaatgaaaaagtccaattatttccctattaaatttatttacaattttatgaattaaatacaaaatatttgtgaatgtgtttactttgcttttaattcatttaattttaacttttttttaaatttgctcacttaggggaaactgtcaagattacaaaaaaaatttaatttctttgcatttgcttttcttaatatttgaatattttacgttttacataaactatttatattcgttatttttattggataatcaatcttccgatgtttgatcaacatatcattatatttggctgaaaatcattcttcaaaaaacaaccattcgtagacggagtaccaattcattttcccaaattgcctttttgctggcaaaaatatcggttaataaaaagaagcattaacagtttttaatgagcgtcgaacagctatttcccctctatcactttcggagtttgaccggaaagggccggtggaaaatgcgtcagtgaatcagaatttcatgaaaaacaagatagggtaactgcaacaatgctacaagaattacagaatgcgttgtttatgcattttggtaaatctttataattattcaatgttttaatttaaaaaaactaagttaccaattaaaaatgaaaactcttattcaatcctcggtaggagtactagagttaagcaccgacgctgacaaaggaag

SEQ ID NO: 20871 - DNA, 1781 bp, Heterodera glycines
ataagtaccgaatttttttccaaaaaataaccattaaaaaaattttatttacatattttcctacatatttgaggatttttgtacatatttcatacatattttagcattttttatacatattttatttacataattcgcaaattttcttacataaaattagcagccctagagataatgaaaaattctagcattttctttcaacagaccaaaagcaaatattttaacatttttatagttatgcaaaatttgtcatttttgctgctttgcgatgtgccaaagtgtgatcgagaaggtgcactcaaaagcgaaattgagcaaacggtttattatttatcgattaattgatataattaattccaatcactaatgacttggccacttttcagtttcccagcctcaaatgccagcacattcactgctacaaaaaatggcctggccacaagttcgacacgttcatgcacgtcactgtagccgaacagcaaaagcaacaacattccccaaaactatgtgctgcttctgagcatggaacaaacaaatcccactgcttttgtccaccattgacggatttggattcactgcacaaaatgttgcgggtgaaaggcgcacgccgagtaaccgtacagccttggctagcagtaaacggagaaacggagaacaacacgaacaacagcaacaacagagtatcaggaacaattgcagctgttgcgtgagcgaaacatgccgagaaaaacaatgctgcgaagcagtggaagacgaggaggagaagaaatatgaaatttaacatacaattttccttttttaaattgtaataattgggaaacagtatgtctttttttatacagtatacctatggttatcgctctgtttttttttcattttaaacgcaaattcattttgtttgattaataaattaaaaaagcgtaaatgatgacaaaaattgatgcaccaaaaatgcattttatggttcgaaattgaaaattaactcaaaaatcgcactttcctccagttttggcatgcctttgccattgacaaagtccgttcagcccatgtacgaagtgcggcggtccaacacgcgcggaatgtgaaagtggtggctgctcagctccgtgctgaaagtgcttcaaacaacgcaatcagagaagagagatttgtccggataattttgaataaaattgattaataataataaaaaaattaattttttattttctccgaaaaaattggacttcatttttaactataattaagccgcgaccctcgtggattttggggtcgggacttaaccctgattcgaacattggagattaagcccgagattggccatcccggtacccttaaatgacctgggggccgggtaaaaagtgtgggaggagcgtcgcccattcttccgttggcaccaatgggcgagcaatgaaacaattaatgaggcaacggtgagcagtagcagaaccatcagaaacagcaacgccaccgggttcagacaaaggtcacctgacgctgaacaaaacagtggtggaaaacgggaaaactcagaatagaaaaaacagtgtttctaaaggaatgaaatgatcggatcagcagagggagcttcatataaaagaatttaatcagctttaaaataatttatctgctggttatgggatttaaaaaggatgtaatggaatgaaactgatatcattcgatagccctaattgttttctgattgcctgcaaaattcgtaaaatttggttaagtttcaaaaaagttacgaccaaaagaacttcaaaaaattgcttttattt

SEQ ID NO: 20872 - DNA, 1327 bp, Heterodera glycines
ccctttttagagccaaaaatagccaataaaggcttgtggtccgtttgtaaaataaattttcggccgtacaccatgcggtgaaatttttgaacggcaaacacaatggccagtgcctctttctcaatttggctgtaattttgttgcgctgctgtcaatgtgcatgctgcgtgttctaccactttttcctttttgtcggggaatgtgtggcttaatgtggcgccgattccatctttggacgcatctgctgatacgacgattgggcgtgccgggtcgtaatgggtcagcagaaggtcggacgtcatcgtttcctttgctttttcaaaagcattttgctgttcggacgtccaattccaaactacgtccttttggaggagtttgtcgagcggtgcacgcaattcacgcatgcatttcacaaatctgccataataattcaaagctcccaagaatgatcggagcgtgcttttgtcgatcggtgcgggcattttccgaatagcgtccgaacgcgatgggtcaggacgaatgccatttgctgacacaatatgcccaaggaacaaaagttcgggctgcaaaaatttgcatttgtccagttggatgcgaagaccatattcttttatgcgtccaaaaagagtgtacagtgccgtgatgtgttgatcaagcgtttttgtggcgattaatccatcgtcaagatacgcgaatacacctgggataccggcacaaatttggtccatcagatgttgaaatattgccggtgccgatttgactccgaatggcaggcgttggcattggaagagtccgcgatgcgtgttgatggcgcacaattgcttggatttgtcatccatttccatttgcaaatatgcatcgcgcaaatccaaatttgagaaaaatttcgcgccattcagtgaagcgtagatgtcgtccggccttggcagtgggtgccggttcaattccaatgcattgttgaggccagttgagaagtcgatgcagactctcgtcttgccgtttttcttttttacggccaagatcggtgcggcccaatgactgaaatcgattggcttaattgcgccaatttgaagaagacggtccaattcggcattcacagcttccatggcgccatgtggaattgggcgggctcggcaaaatataggctttgcatcagaccgcaaaatgagatgcgcctttgcctttgagcagtgtcccagtccttcttcaaagacttcagggaaatctttttggagtaccgctttaagcagggacacattattgatcgatttgtttggcggcttcactagaagaaaattgtcgatcatttttgtcgcctgatccgatt

SEQ ID NO: 20873 - DNA, 1918 bp, Heterodera glycines
  misc_feature (26)..(26): n is a, c, g, or t
tcagaaaaatttttcaaaattttttntggaaatagaaaacttttggctggtgagcataaatttcagttatgtgaccataactttgcaggggttgattttaacaaaaaatcatcttagagcttttttgtagagaattttaaaccctatctattatgctttgtcttatctttttatcttaaatatgcaaaaagttataaaattaattgtgattttgaaactcaaaaccaaaggggggaccccatggttttgcatttcatgaaatttttttttgcttctaaattagccaaaatgcatttttatggcataatttgaggtgctgaatacgtatatatgctttattttgcgtttcagattttttgaaaggtgtttaaaattttttgaaaaatcgtcaaaatttgagccccggaaaatccagtgaaatttcgaaaattcataactctcttcatttttggtcaaatttagtggaataaagctataaaaatagagaaaaattgggagaattttatgggatttatttggtacttctatcttccaaaataaaaaagttattccagaatttctagaaaaattcgatttttcagaaaaaaattcctaactcccttctgaaaaagtattttttataaataaaatactacaaaaatccgcaattttttgctctattttataaattttatttggcatttttatcacttttttgaaaaaagttatagaaataaaagtcattttgtaatttgggaccacaggggtgtgaccatgatttttgagtggaaaatttttttcaccaaaaatcttccaaaaatatgattttaggggttatttgggccgctgatcacgaatatgcaaacatattttactttagacatgattaagagctcagaatccctgtgtgattggggattctgaggggtggggcggcatgttcggacccaggccgtgtttattattttttaatttattaaaaaacgggcgcgaagcgcccgtcctgaggctgcgaagcggccgaatgttccccacaaaatttaaaaacgggcgcgaagcgcccgtcccgaggccgcgaagcggccgaatgtcccccaaaaaattaaaaaacgggcgcgaagcgcccgtcctgaggccgcgaagcggccgaatatccaccacaaaatttaaaaacgggcgcgaagcgcccgtcctgaggccgcgaagcggccgaatgttccccacaaagtttaaaaatgggcgccaagcgcccgtcctgaggccgcgaagcggccgaatatccaccacaaaatttaaaaacgggcgcgaagcgcccgtcctgaggccgcgatgggccccagcgcccatggcctttgagcttaacaatgggccccagcgcccttggcctttgacttccagatggccacagccaggctcgtagtgtagaacacaaagatttcacccggtgcggactcgaacccccgacctctccaaagcatggagtgctctgtccaactgagctacgggcgccacttgtagaggttctcctttttgcgcctgcttttgcttcagtctgcgccttcgattgcattttcctcagttgcgcctgtcttcgatctcagtttgcgccatcgttctgtttgcgcttgtgttcaatctcagtctgcgccctcgctcagactcagtttgcgcctgcaattgatttgcgttcccatttgcgttcctcaatgagcgttccaatttcgcctcaatttgcgcgctgtctttttgttcctgctcagacagttgctcttccctttcgtctcggtttgagcttcctcaattttgcgcttcctctgacaattttccattccgcctcggtctgcgcttcctcaatttgcgcttcttaaatttgtgcatctccaattgcgcttcaacaatttgcgctgctccaatgcgcttctccaatgcgctttctcca

SEQ ID NO: 20874 - DNA, 835 bp, Heterodera glycines
gaagagaaataacctattttaaatattatctagtcagtccttttaaataatttttattcaaaaaaatttttttttgggttttcggggcagtccccctgaaccgatgttaggcttaactttttttcagaaactgatcagaagcgcagcaaactttgcagggatactgaaaggaagagaaataacctattttaaatattatctagtcagtttatttaaataatttttatccaaaaaatttttttttgggttttcgggcagtccccccgaaccgatgcgcccagatttatggggagaccgaatccttcgggaatagcttccctatagtctgtactttaattctgcgttggatttttgctccccataattgtttgagtaccccaaacggacacttgaataaatcgatttttttatttcataaatattttttcagaaagtgctctaaagcgcaccaaattttatttacaagtcaattttagcactctgatgctttattatcaaaaaggaagatggagaaaaaattttttaaaaatttttccttatattttggttatatcgttttgcttttggtggggtgcttggaacagtggaatcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtctgttagcgtttgattgttctagtcaatttttcgtgaaatatttgtcgtgctctgaagggcgggagggcggg

SEQ ID NO: 20875 - DNA, 1469 bp, Heterodera glycines
  misc_feature (1375)..(1375): n is a, c, g, or t
  misc_feature (1403)..(1403): n is a, c, g, or t
aaacgcaccaaattttatgtacaagttaaataaagctctctgatgcttttactatcaaaaagggagatgaataaaatttttaattgctttttaaacatgccaaaaagtttaggcttaaattaaaaaaattttcttcggttctagctctttcaataagcaataaaatcgtaccaaattttataggcatactccccggtaaaggactaacttaacctgaaaaaatgacaattgtaattggttttaaatttttttagaaattctgagtttttaactgtttattattttttgcaaaattaattcataaatattttttcagaaaatgctctgaaacgcatcaaattttatttacatgctagtttaggcactctgatgcttttactatcaaaaagggagatgaataaaatttttaatttgctttttaaacatgccaaaaagtttaggcttaaattaaaaaaattttcttcggctctagctctttcaataagcaataaaatcgtaccaaattttataggcatactccccggtacaggactaacttaacctgaaaaaatgacaattgtaattgattttaaatttttttagaaattctgagtttttaactgtttatttatttttttacaaaattaattcataagtatttttacagaaactgctctgaaacgcaccaaattttatttacatgctagtttaggcactctgatgctttttctatcaaaaagggagatgaataaaatttttaaaaatttttaattcctttttaaacaggccaaaaagtttaggcttaactttttttcagaaactgatcagaagcgcagcaaactttgcagggatactgaaaggaagagaaataacctattttaaatattatctagtcagttcatttaaataatttttattcaaaaaaatttttttttgggttttcggggcagtccccctgaaccgatgttaggcttaactttttttcagaaactgatcagaagcgcagcaaactttgcagggatactgaaaggaagagaaataacctattttaaatattatctagtcagtttatttaaataatttttatccaaaaaatttttttttgggttttcgggcagtccccccgaaccgatgcgcccagatttatggggagaccgaatccttcgggaatagcttccctatagtctgtactttaattctgcgttggatttttgctccccataattgtttgagtaccccaaacggacacttgaataaatcgatttttttatttcataaatattttttcagaaagtgctctaaagcgcaccaaattttatttacaagtcaattttagcactctgatgctttagtatcaaaaaggaagatggagaaaaaattttttaaaaatttttcncttatattttggttatatcgttttgctntttggtggggtgcttggaacagtggaatcatgcgcacccgtccgatctggcagttaagcaacgatg

SEQ ID NO: 20876 - DNA, 2722 bp, Heterodera glycines
agagtcaataaaaaatgtattttcattaaacggataaaatactttccataattgcaaaattacattataaaaattcactcactgtcgtaatgtccactgtccaattgtccgcttctgtcaaaatgtgttcttgtccaaatgtccggtcacggtcttcgcatgctcttttttgcgtagttttttcttttatatttttatttcccgtttgttatttctttgatactgagcgtctatttcattgggactcagttgtcccggagctcagatggcctttgttcgacttcatccttgcttttttagacatacatcgtcaagagctttcgaatgatacctaatttgttctaaaatttttatttagtgtttttatagttgatttttggtgcaatttttctgattaaaccagttcaaaaaccgttttttgattttcccgcacctaatgactcataaattttgctatttttagtgtaaagataaatataataattaatgcgccttataattaataaaaaatgtattttcattaaacggataaaatactttaaaaaattgcaaaattacattataaaaattcactcactgtcgtaatgtccactgtccaattgtccgcttctgtcaaaatgtgttcttgtccaaatgtccggtcacggtcttcgcatgctcttttttgcgtagttttttcttttatatttttatttcccgtttgttatttctttgatactgagcgtctatttcattgggactcagttgtcccggagctcagatggcctttgttcgacttcatccttgcttttttagacatacatcgtcaagagctttcgaatgatacctaatttgttctaaaatttttatttagtgtttttatagttgatttttggtgcaatttttctgattaaaccagttcaaaaaccgttttttgattttcccgcacctaatgactatttttcatgatgattagagttcattagagatgattggaagaagttttaggcaggtttttcgcaggcccaattctatattacagcccggggattccttttatttaattatttttttcataaattttgctatttttagtgtaaagataaatcattaatttttaatatgttcgcatttgccacctttcgtctttccttaattatgccttaattgttctaccatcgttcgcctcctttttcttccctccctttcccatgctttctttgtttgccgtgccattccacgacgctgccatccataattatatcttaattgtgttcacctttcggtctgccattgtttcgccttcctttttttcctatacttccttccgtgccctccttttttgccgtgccagaatactttttgctgacgatctcccaattaaacattgcctaactttgaccacggaaattttggtctttttttgcccttttattaaaaagattcaaattcgtgaacacgccacggaaagccctccagcagaagcctattttaaatccaaaaattaaatttaggttatagagtaaatgagaaatttgaaggattaagcaaatctaataaaataaaataatatgaaattggagagataaatgaaaaaaccaaatttttcaaagaaaaaaactcataaattaatgggttaaattgaaaagcaaaaaaataatgatttttaaataataaataaaaataaaatgcatgaaatcaaaaaatattaccaaaaaagaataaaaaactaataataatagttatacatgaaaaattaagcattcttacttataaccgaacacacaattatagactggtacaatttttgccgagacatcaagaaaaaaattatatgtaaatatttttaacttttaatgaagaaaaatttatatgtaataaataaaattattgaattgataatcatttcaaaaatacttaaaacaattattcgataataaaataaactgaatattttttatattcacaaatggaagaaaacagcaaaaaatattataaataaaaagtaatacattttaattaaaataggcacagttaatcatctaattttttaataatttcaacaagaaattcaaataatttataaggcaaaaaatatgattatatttcattgatacattatcattcagttctaagtttatgtttaaaataaataatccaaaagaaataatattttttcagccgatcatctaaaaaacgaaaataaacataataaaattaaaacaaaatgatacaaaatttaaatgacattttataaaattttgttttgaataatttgtttcagctttattattttgtttataattcacatacacccattccaaaacggaaacgggagaactgccgagaatttaaaaaagaaaagttgatgaaataaaatgatgataaagcattaaaaatatacaatttaatgaaaaattatttatttgcaaaatgtcaaaaagaatataatttttattaaaatttatatatgtttttaataattgaaattcgattcaataaaatatatttattcaaggtaaataatcttgaagtatataaaaattagattaaaacttgtttaataaaatgaaaaagtaaaaaggaaatcggtctttaaaaaacccgaaatgaccaaaagaggcaccggcggaaatatcaaatttttttaatcttagaaaaagacttttaaaaaaggtttcataacttacaaacctgaaaaaagagaaatgcaaaaataaaagtaaaataataaataaattaa

SEQ ID NO: 20877 - DNA, 1591 bp, Heterodera glycines
cataaatatatttttaaaatatattttttggcacacattaaaagttatacgcttttatttgcagttttttttataacaattttcaattttttgtgacggttggatgcaaaatgcttctaaaacttccgatatttttgtactcttcccgtcagtttttccgtgccgttgcttttgtgagtgtttaaaatgccattgatttttcttttaatttcccctatttcttcaacaggttcggcctcagcagcgtcttctgtccgtccgtctctcgtcgaccgccgccaaaacgccggtccaggagttcggctttgagtatctgaagcggcagatgaacctgggcaggccgttgtcgccgcacttgcaaatttacaagccccagttgacctgggtgatgtccggcgtgcatcggatcctcgcctgcatcatgtccggaggtgatgggcaccatgtaatttgaacatataaaattgaggcgtaatgagtacctggggtgtatatatccccaaagggtaaaaattccttaaaggcaagtcttatgtttttgtaaaaaaatttggcgctatattaaaaatggtcaattttgaaaattttttcaatttttttttgtttttttacacataatgatgaatattaagtattaacagcacaattatggtgaataaaatgtatattcacgatttttatccaaaaaaaaatttacaaaacaaaagggtcccccctatggtttttgataaaatacaaaatctatcactttataactagcgccaaatttgcttaataggcccaaataattgtcatattcgtgatcagcgacctttaaaacccccgggtatttggtttcaggactttttaaacaaaaaaaaattttgaccaaaaaaaagttgaaaacatttttcaaaattgaccacttttaatatagcgccaaaaattttattgtacgagtgccattgactcagcgcacccaaccccatttagtaaaattaaaacttaaaatcgtggttgcgtgtcgaatttgataatttttcccccaatttaagcgcttttggtcggcgttttcgtttttggcatttgttcggtcgatttcacttcgttcgcggaacggcttaactcgtggaatttgtggcgaccggtgaccaattcagtcaaatttgtgatcgcctttcccattgtctaccacatactcaacggaatccgatttatggtctcatttttacatttaaatacacataaattgaatttttactatccaaattactatcattttcaggcttttgacatggccaaaggcaccgaattggcgtccgtttaccgctccggctatttggtgatcggcttgtccacgctcatttccctgctcattgtggccaattcgaagcatttgacgaaggaacagttccaacagaagtacaagaaggaagcgaacaaatagagagaggagacaaaaacataatgaaattgggacacaccgcctcaatgtttatgtattgctgaacaacaaacagtcaatgaacgcgcataaggcaaataggatgtttagttttgcacggagagaaatattatttaaaatagaaattttggcattttttcatcggct

SEQ ID NO: 20878 - DNA, 1601 bp, Heterodera glycines
gacaaaaatttaccccatactatttttctaaaaatgcaatgaaattcctttgccccctccaccaatttccattcatccgtcagacgattgttcctcattggcatcaaatgatgagcaccaacaacagcaacaacaacaaattgtgccttcgcgctcaataaatcgacagcagcagcagcagaatggcaattcacttctgccaccaccaccaccgccgtcggcattggcacaaatggtggcggagggattgccggcggatgatggtgattacaacaacagtttcatggacaccagtgaggacagtcgggacggtgttggtggtggtggtggtggtcatgctgcaatggtgccaatggatgctgctgctgacctgttgatgatgtccaacggtggtggacagcatgcaaccaatgggaacatgttgttggttggcacaccgccgactagcacaacaatcattgatgaaccggtcggcgaaattggtcggtttgatctacataaatcagggaggtatatgggggaacgggggtgtcagatcctcaaatcacccgcgaaaattgggaattttggatatatattttttggcaattgggccgaatgacgcggcgatatcaatgaaaattgagagacttttgattgtgatgataaaattgcagatttggtcatcatcgatggtgtggtggcgggtgactttgcggatgagcaacaccaacaggaggacgctgtggcacagcatggtggcttcacaaatgcgaaggaacgggatcaggcaaatttcccaaaaattaattgtatacatgaaggaagatatatggctttcatatctccaaattttgaatttcacttttttttttactttcagtttgagcgctaccgaaatttgttggaatttggtcatcacatttcacaatttgcgctcaaaacggatgccgaggaagggccgtgccaaggctcggcaccactccgacagcgaatgaatgtatgttatttttgatgttggaaatactgttattgttttcgtcattatcaaggcatttgtagtcaagccggccaattggagtttaattcatcaaaaaataataataaaaattaaaagaaacaaatatgaattttctatgagtgtttcaaatattttaatgaaattgtatattttttcaaaataaaatttaaatggtttctttaatttttctagaaatttttaaaaaatcctaaattcggaagtgttttttacagcaactttttgtggtgcggcttaattggacctccatccccctataaataaaaatttttgttttgaaaattaaaaaagtaggtatacctatgtatggtacggtacgtttggatccaaaatctttgatatttactccgtatacaataatattttactgtataatcccgcattttcaggaggccttttcgttgctgtgctatcctgacccaactcaatctgctcatgccaatctgtttgatcaaatccaacgggatttggttgccaaggcgttgaatgcggctattttaggcatattttttttgccttcctaattgtaaaaactaaaactaacgaaatttgggttccattttacggtcgaatgggaaggaag

SEQ ID NO: 20879 - DNA, 1515 bp, Heterodera glycines
ttgctgttcttcttcttcttcttcttcatccagactgaactgatcatcattcattcctcaaaataaaatttatgaaataaaatttaaaataataattttggctctattttaaataaaaaagttattttctaaatatttttggccattactttttttgaaacaaaacaaattttatgaaattttagcagcaatagggccaaatttttcgctttcttttattaataaatttcaaaataatttctttgattttaaaaatttcaaaaccatttcttttattgtataattttcatactgtatccactcaattatacaaaattccctaccgtatccgtcttgtccaaacacttcagaactggcaacagatggctccgttgttttggctcgattcagctcagcaattctggcaatcagaacactcatttcctccgatgtgctcagatttggaaaaattgctaaaaatgaaaaattaatttaaaaaaaaaaaaaaattaattttagcaaatttaattattgaaaaatgtttttattattgtattttaattatgaattttaacaaattttttacgttggagaggagaaaattcgtccgctgatgaagaagtcgtgaatgatgacattttaattttaactaaaaatttattttaatttatttaataaatttagaaaaatatgagcaaatgaaggctaaattctgctatagccgctgtaattgtgcacatatttataggccaaaaagtaaataaatttatgggcaaaacgatgacccaaaaatggagaaaatgcgacggcaaaagataggaataataaatatttgaataactcataattttctgccgttttcatcttttatttatttaaattgttgccttttggtgttgggcaaacggtgacccaaaaaatgggcaaaactgcgggggaagaaagaggtgggaaaagggcaaaaaaagttgagatgaaaactttattaaaaataaaaatgcataaaataataaaagatggtttaattatggagaaggcttatattttttggaaatgaatcataacataattggccaaaaacgggaaaatgttaaatttctgctcttttcacgcgtcaataaatgatatattcaattataaacattaaattttcaaaaaaaaatcttaaaaatcaaaggtttggcggacaatgaaacattttttgcgccagaaaatcttaaattatgtttgatttacaatcattcaaccaaaatgggtaaagaatgagtcaattttggaaaattcatttactgacatgttttccaattttttggcaacttatttccagtttttagcaactttttagatacctatttcgcgatttttagcacctaaaaagacctaaagcggggtttagcatctattttggcattttcgaactttagccctattttccttttcacagtaaatagtgaaagggactaggactgatgagcgaataacagccgataatatgaaagagtaccgaaattggcgtaacaaaggccaaagtggaca

SEQ ID NO: 20880 - DNA, 3014 bp, Heterodera glycines
  misc_feature (641)..(641): n is a, c, g, or t
  misc_feature (1331)..(1331): n is a, c, g, or t
gagactctgcttaatgtaattgaagaaaaaaattgagcacggctccactatcatgtcagatggttgggctgcattgtagatttcatgccgcccgcctgatgtttgaactttacattttttaattttttttgcacgtaaaatttcacgtaactcacgcaaaactcatgatggctaaaaatgaacgtcatattcgtgttcagcgcataaaaatgccctagaaaaaattattaaaaaaaaaaatttcagggggggtcacaaaagggataagaacccaaaaaacacctgaaaagggtccaacttcgtcctcattactgctgcaaattccgaccgttccctcattttttcgtggcgcaattggcctaaatcttttggcagcaagaatttgctgatttgtttttggttgctgaataaaactgcgctttctctgaggtttttggccgaaaaaagcagcggaatttgacgtgccagcggccgacgaaggaatattttggcgaatggggcagccgaattcggcacttctgaagtcggattcggtcggtcgtacgtcgccatcgtatgctggggaatggttaaacattgccttttccatttcccctgacaaaggagggatgtctcccctcccctaattatttttcccgtcncattcttcgaaattttttcctaattgtaagattaaatgtttccacttggggtaaaggaataaaccttctgcaaatatttgctgcgacgaattcccagcggagttttcctcacgaatttgcgttgtcttttccccctttttgctgctgttttcctggcgttgttccgtgccattttcgttggcttaaatgaccaaaattgtttatgtttttgtcagtgtccaatcacccgaattgaaaggcacaaatcgaagggtgcctttccgtgggtttgtggcgtttggcatttttggcacatttggcgggcaatgagtggtggtcagctgaaattccaaaaatactgacaattgtggcaacacaacaaaactgaccgtttgtgaaccaaatttgtgccaattaacgcccgctaaagatgactccgttttttgttgcgtcgtccgttctttggcgaagaaatttccgatgggttgcgaatcggcacgcgaattcccttcacttttttggggttcgctgctgtcatccgccaccattgtgttcagaacttgcaaagattcgtcggacaatgactgagaggagagagacgaaggggtcaaacgccgttgggaagacaaattcgaatgcatttcttggtgacggtagtcaagcgaagaaagggagtcgactttttgaatttcatttggcttaatttttctnttaaatttattaattctttgaatttgcttacaaaatgcattttgtgactgcgcgaatccgtcccaatttcgtctctttggcaattcgatggaatttgcctttgtttgggaattgccaatttcctcttcccgtccggactcagtgccaacacagaaattccttggattttgaatagtttctcgacaacgacgtccattccagaattcgctgtgatgttttgcgttcatgggtcaaaattccgtccaaattccctccccaaaaaaatgcgtcgtttctctcacctggcgattgctccgtcagccgatcctttctgtttccatctgtcattttatgttatgttaatgaatttgccataaaaaccgcaatgtttccaaccaattgaatgttccgccgctctgtcccgagagtcatcgttctgttgtcgtgtcacatcctttttttgttgcattttgtgtataagagccaagttatttgacttagacggccgttcggccgcatttcgtgggttccaactgacggggcatttctcccgcacaaaatcatttggtaaagatgaataaggaggctcttcaagcagttctccacccgtttcagtgcactgctgatcattctgttctatttcggaatcactcgattccttagaaaaaattttagttaaaaattttgcagttttcgcaccgatggcgagtggtgtagagggatgctcgactgttcactttcctccaaatcagccatgaaaatttcgtcggttaattggccgttcgaccaatctttgctattgtcgcacttttcattcgcatttaaacgaatcgatgcatttcttttcatttttcccgtgccaattgtctgtttcgatgtcaaattatgctccgctatttcgatacagttgcgattctgtccgctggagtgagtgaaagaaatgctaacgagaggagcggactggcttgaacagacgccttccgctttgtgcgttctcgtcctctgcaatgcgacatttttcagtctttttgctggtgtctaattaccgaaattggactacgcctcttggtaaggaccaagcgcagatcattcctccgctgaacgttgtaacgtggaggcgattgacgcagtgttttttccttttcatttcttgcatttctcccaccaaccgtcgaatggcttttgcttaaataacctaatgctagctctaattcccactcaagaactaacagcgcatccgaaagtgtccattttgtctcctctacaaatttaaggtctagcattgtttccgaagaggatggcagaagcgttggatggtggggcggctgaaaacgcaaagcagcttataaaattgtacgatgaattaacggacagaattggaaagggtgtagataaactataaattcctgagatcaataccacgtaaattcacaatttgcatagacaacgaaccgatagcaaaaagccttggcaatcgtcgtcagaatccgagtcactgctgacagaacgacatgtcggagagaagaaatgactatgatgaattttctgatgatgaccaaaagcaacggttttaacgacaagaccacaattctgtgttgattgaattccaatgctttccttttcatttaaagggattcaaacctgacacttcactaattttggtgtttcagtcacagaacaaaaaccataacaggttgcttctaa

SEQ ID NO: 20881 - DNA, 1935 bp, Heterodera glycines
  misc_feature (15)..(15): n is a, c, g, or t
gcattctgaactctntggaccaaaggtactgtaaaattatcttgttacggtatgctttcaaatgccaaattacggtatggcatagtttcactactataccgtataacgctacagtatgaacagacaccgtaataaattttgtagaaacattttctcatggattattgttgcccattccttctttcccattgaaaagtctgtgcctggaattggatgattttgtcctggctcaaacacaggtagaacagctccgccccgttgctggccacgtcaaccatttggaaggcgcatttgtgcagctgactgaccggctcgcccttgaggggaaaatttttcataattttagctaaaattttcgtcaaaaaataaatttttttttttgtttttttggtcctacctgtccagcagggtccaacaacacgtgctgtttgtccaccttgcgaattcgctgaaatttgcattaaaaataaaatgtttggattaaaaatgctcacactctttagcatagaattacgggatgcaagaaaaaatattcgatttcagcaggtattcataaattttgactcattttttttttgttttaaaatacaggggtcttgcaaaatgtttgaccagcgaaaaacccgactttttttcacaaggatccttcccgttattcctttcctaaatctccttcatgttttttgagaaccgagaaacccaaagaaaacagattttggcacacattttcacaggaaatttaggcattttgtgtttgatctgattcagctccatgatcaaggaaggctctgatcggcgggttgagtttttgggtggatattttttgatcaattttggatcaatcagcagattacagaccaagcctttcacaagcaagatctgatcagatcaaaatcggtgtgttggactgcttgaaactgatgactgactgactgaccatcaacggaagtcgcatttccgtttggctgtccaccaactgaatgaccgacccgtaggtgaccgtgtgctgctgctgctgctgctgggactgttggccaccaaattcgggctggtcaactgaacggaaaaaaaacacatacaattttaaagaaatttatacaaaaaatagagatgggtaattaatttccttaaaaatttattaaaaatttaaaatttttccaagacggcgccaaaaggcaccgacacggaaaccccccctaattgccctaaattttcaaaatttgactcaaaaattggtaaatttttgctgaaaatttgttagaaacagtgtcattttttccctgccggtatcgcctggcgctgttttgatttttgtcacaaatttcaggcaacggaataacggtttttcaattttttaaaaattcgctatggatggcttccgcaaaaaatttcaggaaaccaattaattacacccacccattaggccccaaatagcctcattttcgctgatcaatcaatcaatcactgaccaacattgatgtgaaatgcgccccattttgttgagctggccacaaacgcaggcggttcatgcatcttttggttggtgctgattttctcatcaacatgcagataacgggtggacactgtttgggaacgcaaacggttgaacagggcaatctgagggggaaaaagaaataataaagttggcaaaaatggggacaaaatgccacttggcccaaaaaaaagtgattaaatgggacaaagtgcctaattaattgggcagtaaaatggcgacaaaattccaactgtgaatgggcaaaaacaggggcaaagttggaaacacatttaaactggccaaaatgggaaaatgccgacttggtcaaaatggggacaaaatgtcaacttgctccaaaatgcggacaaagtgacaaattggcaaaaaaaaaacagggaaaaagctggcaaaaattgttaaagctggccaaaatggggaca

SEQ ID NO: 20882 - DNA, 1413 bp, Heterodera glycines
atttagtagaaaaaaaccaataaaatgccgttgtctaccaaaatggcacaaatcataatgactcatgttgcccccattaattaatgaataaatcaattaatgtgtcaattaataatttgcgctttttcatgccttgcttttgttcccgacacataaatatttacaatcggagcttttcattgactgtttcttcttggatggttttgaaataatctaaaaaataatgtaaatatttattttattattttaaaaattcatttttttactttaattcgctgagacgcaaaagtgcccaactccaaagcgccgcaggcgtacccaaaatgtgcctaattaggaggggaaataatttaaattaaaatttttcagattttctcacattgagatgaaaatatttgcgtttatccgtgtcactgatgtgcaaggctttggccgctgaataatccttaacatttttttaatataaaagtgataaatattttaaaattaaatagttaaattaaaatattttaaatatatattttttttttgattcaaataagatttacaggaattttctattttcctgtaaatttagaagttagtcatcgtaatttatgtatgtatgtatgtatgtatgtatgtatgtatgtgtaaagtttaaactataccctttttaaacttatttttaaagatcggaccggaccggatccggtaccggatttttctggatccggcaatccggtccggcaattcgaaaatctggattgactggattaccggattgaccggattatgagagaggatccggaatccggtcatttttgaaaatactagtccggtccggtccggcatttttgagaattccgatctctacttatttttaaaaaattgcccctttcacatttaaaatttccaatttttaaatttaaaaatatttttggctttctgttacgagccaaatcaaaaagcaacccaaaactcgaaaacccagaggcaataaaaattatgtgtgtaaaaaatcaagtaaaatggtatggagggacgggggtaaaatttcaacaaatggtataataatttgctattcctattaattaattaattagcacactaattagcactaattacctttccattggaaaagtccaacaggtggtgttgttttgtctgctcattttgctttttgtcatcagctgcagttgttgctgactctgctccaaccacaattgacgcgcacagttcgacgaacttttcgcgctcgtcgatatttgccaacgacgaatcgccagaggcatttggagaactgtgaaaaaatactaattagtagagatcctcgacctgggtgagagcccagagcaagggtggcattccgaggcgccgaaaatttcggaaatcagagtccgtgcccataaaaatttcggaaatcggaatccg

SEQ ID NO: 20883 - DNA, 1008 bp, Heterodera glycines
agatttgtccctattttgagggtccaaatcttacaaattttaaatgtccttatttgtaagatttgcccttatttaagctctttgtccttattttcgtcttattttttggatttagggagaaatttagtttttaatgataatttttgaaagaaatgttttttgaagcgaattaataagcaaaatcttaacaagattcagttaatattcaaatttttctctcggcggtttcttattctctttaaaaaattggctcaaaatcgtaattttgtcattttttgaacaaaatcgttaagaattcgtattaaaaattacaaaaatttttccggcagcgtctattagagctgttgttattatttctaagaaatgttctgatttggggcagtgccttattttcatttaaaagaggaaatttctgaaaaatttggattttttggacagaacttgttaaaaaattgcattaaattttcaaaaccgcggcgcctatcgacaccgccggactctcttccctcacctatacccaaaaaattaattaaatttctcatttctaagtcggaattgcgcagagaaatagttggcagtgagtaatgcttggttttgttgaataaaaatgcattttaaagttttggaagcgtgttttaaaaatgtccttatttttgaccctaaaatcttatttttgaccagcgatgttcttatttcgggaaattttcaagggtaacccttcgaagttgtgccgatgattcccacaaaaattcatttggacggacaaacccttaaaactttggcggaatgaaaaaaaactcacttttgaccattgatttgattggtcctcattcattttgttcttaggtttttacttattttttctgcggctttaactcgacgagaaatgcacgaaaaacacatttttgttcggaaattcttcgttttaacgcccctatccgaccctaggaatccctattttgggtgtttgcccgcccctaaaataagtttttacccctatttggcgtt

SEQ ID NO: 20884 - DNA, 923 bp, Heterodera glycines
  misc_feature (34)..(34): n is a, c, g, or t
acaaagagcaaatcacaaaaactctaatcatttnggtagcatttccattttccaaataacgccagaaatgtattttaaaggaattttcaattttgccttcggatgctcttttaatgctgacattaatttggtccgaattggaacgcccggcggtggcaagaaaattcgaggcttatttgagctgcccctctccaacaaatgagacggaagaggactacaaaagaacggatgagcagttccatcggatgttaaacgaacatttgaagcagtatgagcacgcagcggcaaatgagcgcaattggtcgggccgacactttggataaatttgaggattttggcttgctttacgcattgctagcggttttacgtcaaaaactgaaacttaaaatgcccttgatcgagaacacatcatcacttattttcttttctttcttaaaagtcaaaaatttaggaaaattcttttggaagattacgtcaccgacttcaagaaagaattcgaacaatgttcagaaaatgcaaacagaatcagggccaatttgaccgagattcaccactcaattgtacacttattcacaacagtacctttgaacattttttaaactttagtgtaaactcccacagctccaagtcgaaacggttgtgtcggactcatcgaactcagaagaaaatttagaagaagtttgtaattaaataacaaaacaacaaaaagaaaaaattaagtcaaactgcgaaatttcaatgtcgacgaagaagggactgatcccaaaatgggccaggaatgagctcagccaggcaaatttggaggatgaattgcgcattcaaatcggacaattttgttttgcaccgaaggacaaattgtgcaaaagcaaaacaaaaaattgtgaatttggtttcgtgaaatgtatgcttaagcgaaaatggag

SEQ ID NO: 20885 - DNA, 292 bp, Heterodera glycines
catctatgttactagatcggggatcgatccccgggcggcctctcgagcaggacctgcagaagctagcttgatggggatcagattgtcgtttcccgccttcagtttaaactatcaagagagggaggagagggttggagaaggaaaggaaaaaaaaaatgaaggaggagaaagggtggcggaagaagaaaagggtggggggagtaggagtatgatggtcaatatggagaaaaagaaagagtaattaccaattttttttcaattcaaaaatgtagatgtccgcagcgttattata

SEQ ID NO: 20886 - DNA, 2060 bp, Heterodera glycines
tttataccttgtgccaaaacctcctttatgatcatcgtcatgtcgtagcggcccccaaagtgtgcaaaggctactgttgagtactttttggtgtgttcaaaaaggagccagccaacaaaatcacgtagagggttttgagtgatgattttttggtcaactgttgtctcagtatagtcaaaaggcgaaaaggtgattgtgcggtgaggaccgcaaatttggcattttttcccccgcagtgaatttttccattctccattgttgatgcactctgtgcagatgatggtagccgcagcaaagttgacctcgtgttcgaaacgattccctacttttttgtcctgtgtagcttcaaagtcgtatgcaatgatccggtatggtttaattcgttgttgcttcaagggctggatgaagcagctttggcaggggttctccccatcttcctcttttatatgaaactgtttgcatagtctacaaaatttttccccacatttatgcccaacattcccatgaacctttacgttataaattaccccacactcttcgcagcgttgaaatttggagcacaaatccttgtgtaggtgacgttcatagcaatccttgttgtaaaaattgttcttgcagtgtaaacattttttgaagtagccttgttgggcttcgcaggggtagtcaacgcccacctcccggcagccgtggcatagtgacgtgcagttcatggagtgtctcgattttcgttcgtagacactttcgcaagagaggcaataataatttttattgaagaatttggaaagggttttgatgccatcgaagtgtttgtcatggtggtagagcagaatagggaattggtaatcggtgacgtctgattttgtgattggacgagtttggtaatcattgaaaataaaaattttatattcgcctgaaaatttgtaaaaatataaatctatttttcatttgaaaataaataaatttttataaatgcctttttaaaaataatcaccgggatattttgtgctccacaacccctgcacttgatggatgtaaatctcggcatcgtattccggttcagttgtcggaatcccagcatcacggagtaaaagttgaactttttgttggagaacagtagtttggttgttgttagtccatctccatttgttccgcgtaataattccacgtttgtagagcgaatagtaccgcatcagttccaaggcataaaaaagacagtagttgtcattgttgttaattttgaagatgtgggattgtgaagagtgaattggaggggcatttcctttggtcgttcgtcggcggggtaaaccatcagtattcaggacagtgacggttacaacaaaaggggcaccgtaaaggttgacgtatttagccttgctctgctccactttacaaaatttgattaaacactgcgtcgacgacatttgacgtaatcggagttattggcagtatgatatcaccctggtctaaaagttgcgaggaaattatgatacctaccttatttgctcctccaaggatgttttgtgcatcattaatactatcctcaaccgaattgtgcacacatgaacggagctccgcagcggggtcggtacatttatcaatttcatcaataacaaattttgattttgagcggatgaaatgatgtttaatacttttggaagtaaattgctcaacgttatcattacatttattggtctgagatttcatgaaagaggaagacgtttgggtatttgaagctcccttcatagcacaacaaatttagaaacgggcgcgaagtcgcccgtatgagttcaacgaatttaaaaaacgggcgcaaagcgcccgtccaaggccaacaaaaattgaaaaaccggcgcgaagcgcccgactgaggccgcgaagcggcctaacaagctaaaaacgggcgcgaagcgcccgtctgaagccgcgaagcggccttaatagcccaacaaatttagaaacgggcgcgaagcgcccgtataagcccaacaaaatttaaaaaacgggcgcgaagcgctcgttcgagcccgcgaagcggcctaaaagtcccagaataatttttt

SEQ ID NO: 20887 - DNA, 2286 bp, Heterodera glycines
aatgtaggagattcaaatgtcttgcaccctttgcccaattaattaattaccccttttctacagcagatgatgatgttgctgacttgcagcagccggtcagccttttctcctttacaatcctttcgcttttcacatggaattgttggcgaaatgcacgcgcagctgaaaaaatgtccaaaaaggcggcataatgtgccaaaaaattcattaattggataaaaaaaaataaatatgtatttattaatatttggatttgcaatttgtttcatggcaattttggatacaatcagccgatgatttattttgttttttgatcccattttatttgtcttttttcgtaatttttaattttgtttgccctccccccaccccaattaaatgaggccgtggacatttggcctggtcaagcccgacggggtggccaacccaattgccgtccgatggcttctcagcgcaatgcattgtgagggctttgtgatcacaaacggtgtgtgcgtgggatcagcaccgtcttttgaccaattcgtccaagttcccccttcgttttttgcaggttgtcgtctgacgctgacaccggacttggccggcgagctgtactcaagccatcaggtgaggaatgagccgggctcgtaatcagcaaaatttctgggtcatgtcagttcgtacaaagggttttgtatggaattttggctcttccagtttacgcgtccacaatgggtttaacgccgtccaatgagtgaccactctgacttttttagatcataacttttttcatacttggtcaacccaaacattcttggtatcatttgaaagcttaaagtttaggaaatttataaatacaagaaaagacaaatacttatactatgaaaaaattacaataagaaaacctgaaattcataaattttcacgtatattcaagaataattttgtgtctgatgcctttatccgggaattttgctatacaaaaaatccctaaactttaagctttcgattgatactaagaaaacttggattgaccaagtaagaaaaaagttattgtctaaaaaagtgagggtggtcactcattggacgcgtaaattggaatagagccggaattttttcaaaaaatttgagagatttgacaaaattttacaagtgtgcgagaaaagtccacgcagattttttggaagaaaattctgaaatttaatttaaaatgtaaaaaatgtacgaaaccccaaagtacgcacacaacgccgctaggcacactcggcaaaaatttaaaaattttttggaaaactccgtaatataatttaacaataaaaagattggcggggtgggtcctcaattctacattactctgaccattttacataatacaattgatactgacttgttttttttctaggctttttcccccgatttttaatatttccttgcacctttatttccatccagttttttttaaggatgccttttattacggacgtctcatccggcacatttgcagtggaccgtcggtggcaatgcgaatggaattgcgcaagttgaacccggcacagaacgcatttgatgaagatgatgaagaaggcgacgagcttcacggcttttcctcctcctcctccgctttccatcggtcggcgacggaatgccaagaaaatgcgaaaaaatttgacccattggaggcgatcaatcggtggcgcactttgcttggcccgtccaaactgttcgccaacatttatttgagcagctgtgccgagtttgatgagatcaaatgcaaaaatttgcgccaaatgttcgcagtgtcggacaccagaaatctttgtgaggaaatttttattatttttttacattttaaatttggggttggaatttgacatcctcacaaaattttgaaggccatggctccgactcgttggactcgctgtgccgggaattcagcctttttgaagtggacatgaagccggttgagaggccagaaattgaactgtttgcgcttgatgactacacattgacggaagcggactatcaaacagacaacaacagaaggaatcaagatgaggaggaggaggaagaaaagggaagtttttgaaattcaaattgccaccattttttattattttaaaataaatttgtttatttcattcgctttaatttaatcattcaccattcaatatacatttggttttgaccacattttatacatattacacattttgtttgttatattactcatttgttttgggtgttggttcgagtccgttgtgcaacatgaatatttttatttatttttgtcgaaaaaattaaaaa

SEQ ID NO: 20888 - DNA, 2783 bp, Heterodera glycines
atattcttatctgtggtgatctgaatttaccgggaatcgattggattaattaccgaatagagaacaataatcattcgaaattatttattgattttatagcacaaaaacaattggttcaacatgtaaaacaaataacacgtggtaacaacattttagatttagtgctctcaaatcctaagcaattagtttatgacagaatgttacagaaagtttttcaacatcagatcaccacatgattgaatttaaaattaatgggagcttttcgatcaccaaaaaagacaaaatttatattagagagtttaaaccaaaaaattttctaaaacttagaaatatgcttcagcaaaaacgcattgacctacatttactgaaattatttaaagttgacgacaaatacaattttctcgttggcgaactttataattcctttgatcaattatttcctaaaaaaatattaagaaaagttataaaaagcaattacccacaaaaaataaaaagattatactccgaaaaattaaaaatacacaggcttattagagaatgccctgatcacggacaatataaaataaaatacaaaattttaagtaggaatctgaaaagggaattaaaaaatattaatgataagaaagaaagccaacttgttaataaaggcaatttggctatttttaaatacatcggcaacaaatttaattctgacagagaaataagattgcttttcgatgaccaaggcagaatttacactaaggataggcagaaatgcatgctttttggtaaaatatttcaacaaaattttatgcaaagaaattataacatgaattacgcaattaataacaaaatagatagcctaatagatatcgaattaaatgctgccttggtctggaaagcacttaggaagttaccaaacagaaactcgacatatccagacgggttaccttatatattgattaagcaatgcgcagatttattggcacctatcataagtgaactctttcgaataatcttagattatggggaaatcccaaacttatggcgtacatcttttatcattccaatttataaaaaaggagacaaatcgaatccaaataattaccgtcccatctctctgacatgtactttatgtagggtttttgaacgactattagcatggaacattgttaaacatcttgagaaaaataaaattttaactgatgaacaatttgggtttttaaaatccaggtcgaccaccacacaattgttggtctcccttgattatttttataaatcaatagaaaatggacaaaatattgatataatttttatagattttgaaaaagcatttgattcggtgccaataaatttgttaattgttaaacttcagaacataggtatctgtggaaaaattttgaagtttctccaaaattttcttatatgcaggtcatatcaagttaaaattggagaaaacttttccgaaagctttagaacttattctggggttccacagggcagtgttcttgggcctcttcttttcttggtttttataaatgacttactaattatataccagctgcagtcggaattaaattatgccgatgatgttaaaatttacatttcgcatgataatgacacgaaaagggatttactctctttagcgttggctaacttagccaaatagactaaagacaatggcatagccattgcgcatgagaaatgcgcagcattatatttaggaaaaaataattctagacatgagtataaaattggcgagaaagtaattttaagcgtagattgtgtccgtgatctgggggttttggttgatcaaaagctctcatttaacaatcatatttcaaaaattttaaaggcggcctattacaaggcatatcaaattttaaaaatattaaaaacaaggaatatcaataccttaatcctagcatataaaagctatataaggcctcacctcgaatacgcaagcgaagtttggaatatctccttaaaagaacagagtaaaagaatggaaacggttcaaaaatttttcacaagaatcgtatacaaaaaatgtggcctcaaggctgcatcatatgaaaaaagacttgagatttgcaaattggagaaattaagtaatcgaaggtcgctcactgatatgaatatgactttcaaaataattagaggcttaactcatttagacccaaaaaaatatttcgaattttcaacaagatcgcaacgaaaaacatttaggattcaaaataaaagattcagtaataaatctcggaataacttttttattcgtacaattaatccgtggaattgcttacccaaaacagctatagaaatcggaactttagctaaatttaaaaattttgtgaaagaattttatttagaaaataagtcctgagtggtaattcatccctttttattttttattttatgtatttttactgtattgaccatatcatattttcttacaatccacttagaataagttaaaatcagatatttttatagagataaaaccttaaatttgatcggggattttcttcccatgaggtcggtggccaaccctagttgaattatagtaaacaaaaaacagtgaagtccatcggcatacaattataattttatttttgaaaatgaaaagaaaatattttattaaatgtttttttaactgtggatcgtacagaacagaagaagctcggctaacacaaatactaaaacaataaacaacaaatgcttggtcagagagtgttcattttgttaattaatttatgttccaacttcgccggacccttctcactgggatagataaagaacat

SEQ ID NO: 20889 - DNA, 2183 bp, Heterodera glycines
aagaaagttacaaacgaaaataatcaataattgcttaattaatcaaatcttttttggtaattgcctaaacgctgcgattttattcattttagctttgttagactttgtgctttcgaatgataccaaaaagatagaatttgttcgaacatgaacaaaattattgtataaaaacccgggattgtcagttgattggactcataaaaatacctttggactcataaaactcgattggactcataaagtgcattagagccaataatttttcatttaatttgaaaaaaacatattagaaaaaactatcaaaaatataattataaaaaatgggaaaacctcttgaaattaataacggaaaattgtttgaaaaggaaaagtgcatttcctcaggaatgaaaggaacgaaaattaattaatattaaatggcgaattctgttaaggattgttcgtaaacaaattaataataattaataaaatattaaagaaattggattgtaaagggaaaacggaaaacgaacaattaatgggaaaatggcaaatccaaatggattcaacaacaaaaacagattttaattaaaatgagaaattatagcgtactttggtgcaaaaaagccgtatttaaaggggtgggcttttccggaaatttcagattcaacacgaacgattccctccgaagtttccacagcacccgcccaccgccattcagcgcacccggccctcactgctccctgtccatgccatcgtccgggtgccctccccttcccgtgccttgcgcctccctcccgtgccgtcccgagcgtttccgtccccattgttgattcttttgtgatatgccgtttttttgttccctccgaagtttcccccagttgtcgtcgccctcccatttttcgtttcgttgtgccgtccccttttgtccattttttttgtgtagatttcgcttttccatcgatcacttttttgtattgtttcagccctattagggcccggtttaattacccaagtttgaggttgccacaataaataatttgaaattgtgcccgacttggcgtattctgaaaaaacccaggcacggcacatcgctctccgctcggtcccgaccccctacgtccctcccaacggtccctctgcgcgcctcgcccaattcctctcctttccgtccccaccaccccgcagagcccgtcgtcgatttttttgtcgtcccgacaatcgcatgttttttattcaacgatgcgatgtcttatttttctctttagttgggatgtgcttatataatggtggggaggaaacaacggggcacaaatccttaatttaaacgtctgcagatgaaatggataggcaaaaaaacatttcaattgaaaatgtcaatttttatccgttttgaatcgcatgaatcaatctaatgtaaaatgataacaaacaacggcgacacaacagaaaatggtcggccagcaaaaaatggtgtaaaatgtaaattggcagaagctaacaattgcgaacattcgccgcttctcccctcatcagtcgccaatcagccaatgagcagtccgatgccgaactttccctgcgctttgacgtgatcgagcacgccactgatcgccagcgagaagggcaactgcttggacagcttcttctccagcacagcaccgaccttccaatttgtgtcgcagcaggccctcagagtcagagagtcgggcacttcaatttgataggcgaaggtcgtgttcacctcctgaaattcatgaaaatatatgccttcttaaaaaaagtaaaaatttggttggaaaaggacctgaagcttgaaattcgcctcaaattcaacgccgaactgcaagtgttcactctgtttgtggtagtaacacaaatggagttcggttggcgcaagagttcccgaaaatatccaagtgggctgaatgtagcgcaaggcgtagctgagagtgttcgactgtttgcctgccatttaatgttttaacaaattcgtttccagttttttcaaccaaccaggaaaccgttcgtccctatggtaaatgtattcggcgccaaggtcgagatttttggtgacacgccgcaacatttgcgcaaccaaagtgccctgggcaattgttggcactcaccgacgggttggcaatgtcaatccgtacgtggaaagtcgtcccacgtgctccagtgaaaattgagcagctgccaacatg

SEQ ID NO: 20890 - DNA, 1533 bp, Heterodera glycines
aacaacggtggaaaaccagaaattaaactgaacaatttctggttaggctcattatttttctaaccagaacaacggtggaaaaccagaaattaaactgaacagtttctggtttggctcttttcttttgtctaatcagaacaactgtggaaaaccagaaattaaactgaacagtttctggtttggctcatttcttttgtctaatcagaacaactgtggaaacccagaaattaaactgaacatggtttcgtctcatttgttttgtattggtaactttatggttgtttttctggtcatgtttctggttttgtcttttcttttgtctaatcataacaacggtggaaaaccagaaattaaactgaacagtttctggttcggctcatttctttgttaaccagaacaacggtggaaaaccagaaattaaattgaacagtttctggtttggctcatttcttttgtctaatcagaacaactgtggaaaaccagaaattaaactgaacatggtttcgtctcatttgtttagtattggtaactttatggttgtttttctggtcatgtttctggttttgtcttttcttttgtctaatcataacaactgtggaaaaccagaaattaaactgaacagtttctggttaggctcattctttgtctaaccagaacaacggtggaaaccagaaattaaactgaacagtttctggtttggctcatttcttttgtctaatcagaacaactgtggaaacccagaaattaaactgaacatggtttcgtctcatttgttttgtattggtaactttatggttgtttttctggtcatgtttctggttttgtcttttcttttgtctaatcataacaacggtggaaaaccagaaattaaactgaacagtttctggttcggctcatttctttgttaaccagaacaacggtggaaaaccagaaattaaattgaacagtttctggtttggctcatttcttttgtctaatcagaacaactgtggaaacccagaaattaaactgaacatggtttcgtctcacttgttttgtattggtaactttatggttgtttttctggtcatgtttctggttttgtcttttcttttgtctaatcataacaacggtggaaaaccagaaattaaactgaactgtttttggtttcgctcatttcttttatctaatcagaacaactgtggaaaaccagaaattaaattgaacagtttctggtttggctcatttcttttgtctaatcagaacaactgtggaaaaccagaaattaaactgaacatggtttcgtctcatttgttttgtattggtaactttatggttgtttttctggtcatgtttctggttttgtcttttcttttgtctaatcataacaacggtggaaaaccagaaattaatgaacagtttctggttcggctcatttctttgttaaccagaacaacggtggaaaaccagaaattatattgaacagtttctggtttggctcatttcttttgtctaatcagaacaactgtggaaaaccagaaattaaactgaaca

SEQ ID NO: 20891 - DNA, 2066 bp, Heterodera glycines
  misc_feature (21)..(21): n is a, c, g, or t
accttcattaatgatagcacnttttcgccaatcccatgccaaacaacaaatgccaaaaaaagagagaaactaaaccgggtttgacgaagttaccatggccacggcactgctgcacccatccccaacaacacaacgatgatggtgattgaaatggtaataattttgttgctgaattggtttgttgctgttgttgtagtaatgaaacagtgccgaagatggagatgaagcggtggtaacagcagtggcggaagaggcagaggaatcggcggatgaagcgacgaactttggcacttttggtgacgaccaaatttttgagcgctgaattggaggtggcagaagcggcgacgacatttgcaaattgttgaagttgacgtcgcctaattgtaagggttaggtaaaatttggaaaatgccccttccctccccaagcggaggggggggggggtgtaaattggattttttcattcaaaaaattatgaaaaaattgttttttagaaggggagggggaatctgcacccgaaaaatagaaccacatgtaggcaagaaatactataataaacttcaaatctagaccaaaggctgtcaaatgaaaaaaaattttttgtcaatttttcatttattttaaaattcgtcgaaaaaacttaaaacttattaattttatccttttttgtagatcacaaattcaaaagcaaacctccatcatagtacgagccaagcgttgttgttgttgggttggcattgtcctgctgaccgtcaaaaatgtccagtgcggcagtggaggaggaagtcggctcggctttgtttcgacgatgttttgggtggaaattgtcgaaaacatacggtcgatattcagcggagggcttttttttaagtattcctttcttaaaaaacaaaatttgcaatttaaaattgtaaaataaaattttatataaaattggaaacatgaaattgtaaaaaaaaattcatttttattaggtattgtataaaggaaaatgggccaaaatttgttggcctgtgcatgtgagaggttattgggtttggggcagagtttggtgcccgaattccataacttttcagtcccgaataccaacccgaaaatttttggccgtccaaactcaaattcagactttattttttttttctcttcccataaaaatctcctgtttgcaggtgagttttggcttttttgggatttattcatttttctcaataaattcaatcactttggtgtgtgagcaaatcactatttaaccaaaaaaatttcaaaatttgaaattgaaacaaaaatgtcaaacctttttgggcgtggtgatggcacacatttccctccgtttgtactccgccaattcttcacggacctttttgagttctatttccaaaaattcttcacgccggttcgacgacgattccattggcattgcttttgcggggtaaattccaagacactgcaatttgttgtattgtattgttagcatcataataaaaaaattaaaattttttgttccaaaaactcattataatgcgcattttcggggttcattgaccacgaatatggcataaacattggctaattgtgaatccgaacccagcaggacccaattggaacaacaacaacaaaaaaagtggtgggtggaacaaaacatttccgaactcttcttgctacttattgttagtctaaaattgactaaaataagcgaaacatttcatttcccctcccatgtcgttcgtgctccgcccacaccgaattttttaaaatttttcacttcaaaatttcttcaaaaaaatttcggcgctagttaaaaagtcaccacttttgaaaattttttcaaacttttttttttgataaatttttttgtttatttacacataatgatgcatattaccatcacaattatggtgaataaaaagtatattcacgattttttatcttaaaaaattttgtaaaacaaaaaggtccccctttggtttttgataaaattaaaatctgtcactttataactagcgccaaatttcttaataggcccaactaattgtcatattcatgatcagcgacctctaaaacccccg

SEQ ID NO: 20892 - DNA, 1462 bp, Heterodera glycines
ccccgggtggaaagaagacccgtagaaaaacagcctttttattcttttttatgggaccagtaaaagttcagtattacctgcaggatttgcaggattaatccggccggatccggtccggcaaaaaattttgaattccaatcctgcaacaggatccgcaaatttgatttttgtgcgggatccggcaggatccgcatacattctttgaaaattttataagaatgccaaaatttttgaataaatttataataaaatcaatcaaaataaattcaattttcatctcaaatttcacctagaatttgcaaaaaaatttcccggcggcgcctatcgacaccactggatcgacattaatcctgtagaattgagtcaaaaggtgtgacgtttggtcattttttggtcaaaatcagttaattaattgataaaattttcaaaaaaaaaaattcagacggcgcctatctgcataggcggacccctttgttcctagtttttgaaaaaataggcgccgaaaaaaaagcatttttgaaaagcaaaaaatagtcaaatttattgaccattaacagatttgatttccgatctctttttaccgtctgacccattcgaaaaatcttagtcgcccttttaatgcatcccgccagcccctaaaatttcttgtcaggtattttttttaggatccggcaggattaatcctgcaaatcctgcaatcctgcaaatcctgcatttaaaatctgcaggatcctgcgcaggattgcggattttaggaaatttcaaaaaattctgtattaataaaaaagtctttcaaagtatagcaaagtattcaaatatatttttaaaccaaaaaatgatgaagatgaaaaattaataacgtttttttgcttacactccaagcaatcgactgaatcttctttaatgcgtttaaaaagaccgatttgccaaattgggtggctcataataatagcttaaattagggttcgagccccgtggggcgggggtggcttttcacggtggcgggggatgcgggggtcagagtcacgggggcgggggcgggggcacgataattccgcccccgcggggacggggccggggttttctttgaattaggtccaaaaatctcacaaaaaaatattttttaagaatgatttctttggctccacattcctttatttgttgatcgcctagatactatttcttttgacataaattgcacagatttcgactaaaaagtaacccaaatttagggatttttgggtaatttttttttaagaaaaaaaaaaatttttttgggggggggggcgtgccgataggggcgaattttaaatttatttctaacagatattcaccaaaaaaattaagattttttcgataaatattcgttttttaactatattaaattatcgtgatttactcaaaattggaaatcagattttttaaattttttttcttgcggccactttttcaaaaaaaaaaa

SEQ ID NO: 20893 - DNA, 1863 bp, Heterodera glycines
cccccccgaaaaagaaacaaaacagagcccatataataatgacacccgcctcgtccgtccgtctccaccactactctttgtgcccaattttgtcgccgctgccgccgccgccgccgctgggacatttttaatggttttttgggggaccaaaattgcctgaggccattttttgccgtaggcgaccgagcagtagtgaaattttggaaattgatacggggaccaatgcctgctggttgaatgttttgcgcgctatatatttttgcaaaaaatcgcctacatttttatgcctttgggtttgtttatgtttgtgtgtgggtagtaaatgccaaaaatagacaagtgcaaagagagagaatgccattaaaaaatggcggtggatgagaaaaaaaaattggtgacaagcgcattttcctagaaattttttgaaaatatgcattgataatttgtttcttgaaatctaaaggcgtccttgaaaataagtacatttaattgccgcgagataaataatatatatacataactatttgatcagctgtattcaagggcgtccttggagcccctaccaaatcggttagccgacatttgcggaccgacttttgcggaccgacttttgcggaccgacttttgcggaccgacttttgcggaccgacatttgcggatatttagtgaattaaaaaaataaatttaacaatatgaactacaatttaagtgaaacaaataaatgattttaaaaaataaaaataaccaaaaatatgagtgagttaaaatgaaaattatccaaatatatgagtgagttaaaaaatgaaaagtatccaaacaaaaagtttttcgcttagaattatcacataaataaatgtacaatcccaaaagtcaaaattattagctgcgaggcgatactgtattgctctgagatggcttagaatctgttcgttattaggtgcttgaatgcggtcaaaattttcaattaattgtttaatcgcacgatcgttggttttattatctttttttatttatttttgttaggtgttgatgggtcgccaaaacgaattcagaaagaagaaaagcaacttgcactgttgcttttgtatgcatcacacaactttggcaaattgaaattgtttaaatgcgatgactgacttatcgtagaatattttgatattaatcccttatatatttggatatattttattttttaaacttactcgtatatttttggttatttttatttttttaaatcatttatttgtttcacttaaattgtagttcatattgttaaatttatttttttaattcactaaattatccgcaaatgtcggtccgcaaatgtcggctaaccggtccaccggcccttccttctcctgactgattcttctaaggcttcattgagattttatttttccgttttcgtgttccgtttttgtccataaaaatttaggtttcgttctcgaaaaaaaaataataattttcgcgctcccaaaatcaatgccctaggaagaaaggcaatggcccctcgggggtcattttaattttggtatgtcgcgtaattacaaaaattaaactcgtttcttttctttttcctttcgtttgttctctctcacaattcgtcgttcatcagtaaaaatattcgtttgattattttcttatttccaattaattcacttgtcaaatgcgttcttctcgcttggaaattgtcgtggattattttttccaattttatggcgaagcttttcaggtttcttttgcaaagaatacatttggaagtcggcaagaaaattaacaattttgaagcttacaattagtctgattttatgtaaaaatgaaaagaagttatttttattaaatgcatcttttcttttcttttct

SEQ ID NO: 20894 - DNA, 1489 bp, Heterodera glycines
gctctaaactgccaaattggcaggctctaggctctcttaaaccccaaaaataggctctaaaaatggaaaataggcactaaaaactagagtgaagcggtaccgggaattttgggcaaaaccgggaccgggacttgccgggacctgagaagccgggaccgggacctcgatttttcttcgggaccgggttaaaaatttaattttaatttatttcaattgaaaataatacaaaattaaatttttattttgttttttatttaataattaaattaatgaaaattttcaatcaaattttcttcaatcatttcaaacaataatccagggttcgaaagtttttttattttaatttctgtagaggaattgaaccatgagaaagaaattccactaggccataagaatatatttaataatttttttgatttttttcttttaactccaattttcttcactaatttttcactcagacccccattcttaccagtgcttgttttcccggttcccggttgccctaccgggaccgggacctgagcttttcaaaacccgggacctcgggtgagcgggaattcccgtcccggtcccgcttcactctactaaaaaccctcatttttaggggtgtaaaatgaaaaaatgtattcaaaaaaataaataattaggccaaatcagtattgagatacataaatgattttaaaaaaattcttgttacgaaataaattcttgagatgaattttttgaaaattttttcatttttaggggtgtatttttgaaaaaaaatttaggtcgattcttggggtttatttttcgtttttattgcacttttggttaaaaattttgggcaaaatgcaaaaatagagcctagaaaataggcaccaataactcaaaagtagattaacaacaacagaaaaaaacatgtttttcgtgcgtttgaggccacggcgagctcaggaaaaaataggcttttgcctaaaaatccatccctagtaagaatttaaattttaacaaaattaaccggttccaggcgcaggtttttttatcaaaatttgtttaacgctgttaaaggtatcataaattggtttttttttgatttagctaagaattaagtcaagtcatgtgcattgggaaaacccggtgctagctcgttccacaaaaaagctcagtgatcgataaaattaaataaataaatttaattattcaattcacaaaacacggtgccgtccagttaacactaatgtacggcgggacgcgtcattttcaaatttttcaatttttgacatcacttctcgccaattttatccatttgtagtagacatagccggacgccattgataccgttttgtagagctcatcgagctgtacaaaaaagccgctggtaccgtcaagcttagcttggattggccaacgacaggggtcgggggcgaggctgagggtcctccggcagatgtgcccgacccatgacgggctccaagtgaaaagagcaagaaccggactcgggctg

SEQ ID NO: 20895 - DNA, 765 bp, Heterodera glycines
  misc_feature (748)..(748): n is a, c, g, or t
ttcgtccatgtgcattggccttttttgatttttaaaacacttatgtatattcaagaaatgactaaatttatttcaaacttattttttctttataaattttcaaaatatgtaaaaaaatgaaaatatgtacaaaaatatttgccgaaattttggcttttttttgaggatttccaaaaatttccgtaaaaaatactcaaaatatgtaaaaaaatgaaaatatatatgaaaaaaatcaaaaatatgtacaaatatgtaagaaaatcccgaaatatgtaaataaaagtcccggtttttgttcgcaaacacaaaaaagaaagtgtttttcctgctatttagagcaaggagaagccaggaaaaaaatatgtatttacataaaatttgcagccctattaataagttaataaacaatcatcggcatgcacatcggcgatttaattcattatgagcggacgggaaaattattgggggacgcgtttatacacattacgaaaaaatttaccccccaaatcctaagaaatacccctcaaatccaccttttctctcctcaaattacccactcattaatttaaatttacattctatacctcatatttccctacccaatcagccttctcactcacaaaaatttttctactttaaattgtgtgtacttcaattgtcgatctattttaaataaaatcacgactttgaaccagggatcgcattccgaggccccaaaaattttgggaaatcggaattctgaccccanaaaacgtcggaaatcgg

SEQ ID NO: 20896 - DNA, 2001 bp, Heterodera glycines
tttccgtttttcggggaataactcgccgggggatacgcggagcggagtggctccgcttgagcatttgtgcagtttttaaagctgcatccgatggagttttcggattttgaaaattttcaaaatttttcgagctaggccccctcgaaaatttttcgtttttgaattttattattttttgccgatttttcccaggaaaacggagaccactttcaagcaaccgttttttgagctctatcgattggtggcatttttgaaaaaatttcaaaattttccggaaatagaaattttttttggcttgagcgggacatttcagtcccgggctcataactcgtcaggggttgattttagcgaaaaattgtcttagagcatttttgtagagaattttaagctctatctaatgtgctttatcccatatttttatctttaatataaaaaaagttataaaataaaaataaattttaaaatgcaaaaccaaaggggggaccccatggatttgcattttatgaaaaataattttgctcctaaaattgccaaaaaatacttttctggggtagtttgaggtgctgaacacgaatatgcactttatattgctttttggattttttggagggaggtaaaaaaattttgaaaaatcgtcaattttttggatttgggaatttaagtgattcttttgaaaattcataactcgcctcaaaatggtccaattcagctcatttaaagcataaaaaatagcaaaaaatcgggagaattttatgagatttatttgaaatttataccgcaaaaagaaaaaaagttattccagaaattctggaaattttctatttttcagaaaaaaattcagaactcggttctgaaaactcattatggaaaagtaaaatattacaaaaatccgcaatttttttctctattatataaattttatttgacctttttatcacatttttaaaaaaagatacaaaaataaaagtgattttggcattcgggaccaaagggtgtgaccatgatttctgagtgaaaaatttttttcaataaaaatcttccaaaaacatgtctttatgggttatttgggccgctgatcacgaatacgtgatcagattttacttttgacatcgttaagacctcagaatccctgtgtgattggggattctgaggcatcattttgagggggcggggggcaagttcgaatccgggcggtaacacattatttttctgtgcatttttacgttattttcaatgattttcattaatttaaaatattttgttgagttaataaataaaaaattatatttattttttttttgataaataaattttataagtttaaattaattatttttttaattgatagaatttcatgtatttttttaattaaatttgttaaaaaatattttcattttaatttaatgaatcactgttgcacctcttctaatcactgctgtacccctaaaaaacgggcgcgaagcgcccgtctggcccaaacaaatttaaaaaacgatcaaacgggcgcgaagcgcccgtctggccccaactaaatttgaaaaacgggcgtgaagcgcccgtctggccccaactaaatttgaaaaacgggcgcgaagcgcccgtctggcccaaacaaatttaaaaaacgggcgcgaagcgcccgtctggcccaaacaaatttaaaaaacggtcgcgaagcgcccgcccaagcccaacaaaatttgaaaaacggacctcttatgatcactgttgtacctcttctatttcctgttgtacctcttctaatcacagttgtacctcttctaatcaccgttgtacctcttgtaatcactgttgtacctcttttaattaaaattgtacctcttctatcatcggagcgcaattttccggaaatagaaaaattttttggcctgaccgggacatttcagtcccgggctttataactcgtcaggggttgattttaacgaaaattgtcttagagcattttttgtagagaattccgagctctatctaaagtgcttt

SEQ ID NO: 20897 - DNA, 1413 bp, Heterodera glycines
tacgctttctttgtagccatgacaagacttgatcctaagcaaagaaagggaggtaagctgacggcggcggggggacgcattgacaaggataacacggggagggggtgggggaatggttgttattttcccacactttcgtcaactcattttacatggcgccaaagccattcaaccatttttaatgctaacggcaatgcttttcaagtgaaaaaaaaacagaatttacaatttaaaaacgaatttctctttttttacatatatttaatcaaaaaaataatataaaaattgggtttttttttagaaaaataattttatttaagaattcggcaataaataattttcgaaatttttagtgtctgcccaattttctagcgccaaacattattcaaatgctctaaattcttaattttgcttcatatacccttagaaaatgtacagaattttttctccatcggtgtggaatatttgaagaaattttgttgaagaaaaaaaattttattgaaaaaagaaaattcagtttttctctattaacagagagaggacaaagaaatagtacgccaaaatgagaggtgtatttttttacaaaaataatttaatttaaaaaaattaataaattttccgcgataaataataattttcgaaaatttttagtgcctgtccaattttccaaagccaaatttcctgcggtgccttcaaaaaaattttcggtacccatactcacttggaaacctaaatttacaacatttaggaccatatgcgtcattgcctcagatcaaagttcagtgatcactcactgatcgatgtcttttgctttttctcaaaaaatctgttccgtccgcttaagcaaacatgcgcaaaaaagtgacgttttgtttgcttttcatctgctgcaaatttcattagcagaaggaatacataaggaaggacccaaatcagtggccaatatttaaggcattccaaaaattaattgttggcacttttatttttaaacggaaatgatttaacgatttaaaaatattttaaattataaaaatagcctaaaagcatagataaaataatgtttttttttctctaagaatatgaaccaaatttactttttcaaattttaactttaaaaaatttcattaaatttttccataaatttttgggatatattttttgcatttataaacgatcgttaaatttgaatctctgaaaaaattaatgacgatttttgaaatactttttggtttagcgtgcaacaaaaatttagagattgagccccgaccccgagctataaaatttttttgtttggaggggggacaaatttttgcgctaaatcgtggcaaaagtttttcaaattttcccacggcgcgcctatctgtgatgcctaaaatttttgtttgtgaattatttcctccccgagggttggag

SEQ ID NO: 20898 - DNA, 1360 bp, Heterodera glycines
gaaagggaaaaggaaagactaaaaggaaaagaaaaaagcaagtgagagagagagagagagaaaaaaagacgaattggcaagacatgatagtacttaaaaaacgatgaataatggagagggaggaagaattaaacaaaacagcagaaatggaagaggaaataaaaagatgaggaggaaaaaggaatggaaaatgggaaggggtgggaaaatgagaaaaaaatgacaaaaggaagaaccattaacgatggggaggaaggacagacaaatggacacaaaatgagacaaagggacaaaaggacaaaacgtcatcggaaaaatgaagaaaaaatattgggctgagattgttgaagccgtcggcatgcaaatgcaaatgtgcaacatcgaaaagcatagcaaaagcatctttgccccctcaccccccgctttattatttattattcatcgcttaatccctggagcacaccatttgcctaatgatccatacacccattaattaatgcttccattcattcatcccttttcatttcttccgtgccgccccaatgttcgacatcaatggcaccgtttgttccttgccctccaggaaaaaggtggtgcactcgcctttgcccttaacaaatccaaattaaaattttgcaaatcgtttcatcaattagtgccttaatgtcaattttgccacgctccatcacaatgaaatggtggtaaaagcatttcaaaaggttgctggacgactcgcttatctgaacgggcaaacattccattataatgttgggtaattatttgctaatgggctagctaatgacttggattttgttggccactccgcttgactccttaaattgaaaattgtcaaatttcgttgtaattattccccgcgaaccattcgcgatgccatattcactgtgtcaccaaacaaacagtaacgaggtgcggccaacccgaccttaaatggactgatcagtgaccgatcgatcgatcaatcatttggttttgccggcacttactgattagtctttctgatcattttccgttcctcattatttaattcttaattttttctgaaactgaccacgccagccgccaccgatccggaatggaagccaattcggaccatcattatatcatccggacgatgggccactttgaagttggtgacaaactgaaaaggaaatggagaatgcgacaaaatctcaatgatcaaatttggtaataaaacgcaaaagcactcaccgatcgcatttttagcgcaatgtcccccaatgtgttggacgtgggaattgccattctcgcgcgggactccgctgacaatcatataagcatcgccaatcttgacaaataaaaactcaatttatcagctctt

SEQ ID NO: 20899 - DNA, 1935 bp, Heterodera glycines
tcagattatatgccaatcccttactaattagactctgtgccaatcccttactaattagactctgtgccaatcccttactaattagactctgtgccaatcccttactaattagactctgtgccaatcccttactaattagactctgtgccaatcccttactaattagactctgtgccaatcccttactaattagactctgtgccaatcccttactaattagactctgtgccaatcccttactaattagactctgtgccaatcccttactaattagactctgtgccaatcccttactaattagactctgtgccaatcccttactaattagactctgtgccaatcccttactaattagactctgtgccaatcccttactaattagactctgtgtcaatcccttcctaattagacaatgtgacaatcccttcctaattagacaatgtggcaatgccttcgatctccgccccctttccccgcgctttctcccgccttaccgtctccactttgtacgcgtcatgtttggcgataatcgcgtcaaaaccggagaaacaaatcgttgaggaaattgaccacttgcagcggcgtcgaactgctcgccattcgcgtgaaaccgcgaatgtccgagaacaaaacggtggcacccaaatacagcaaaggcggcactgaccgacccgccttcaaatcgtcggccacggaactgcacgaaaaagtggttaagaaagactctaatggtgccgacccagcgcctgattctgcggggtgcccatccataaaccattgttttcatatttacaaaatgcttttgttaatttcatttttcaaggacgaccatcagcgggaagactttttaagcctcaaaccgttgaatttatgccgctattaaatagcctccccaattaattagcgtagctaaagaaatgcgcttttttgtttttgcttcattttgcttgatttagcacatacgccggcagcatgttcttgagcagacggtccgcttgttgctgcgcttcctccaaaagtacggtacgctctttgaccaactgttccaagttggtggtgtactgtaaccgggggaggggggggggggggtaattaatagtaattagttggattatgagcagaaaagttttgtacatcctccatcattttcatcatttggtccaccagactgccgcttccggtcgacttcaaatttgcgtttacgatcgctttgacccgtttgatgttcggacgcatctccggcaattccaaccaacatgcctccagggcctatccattaaatggcataattaaaattacgaatagttaattataattattgccgaaagcaattgcaaattgtacgcctcctccgaagcggcgatttgttgttggttggggaaactcggccgaatgatttggtcgtcctcgctggccaaagcaattttttgaagaatttcttaaaaaagaaaatttaacaaaagagaagacattatggaatgatcaaaaagggaaaacggacaaaagagaaaaagaaaaacggacaaaagagaaaaagaaaaacggacaaaagagaaaaacgcacttgaagggggcaaattgcgctcgaaaaatggctccaatttgaacaaaatttggtagagcaccatgccaaggctgaaacaaaactgaattgattgaataaatgtttaataaagggggttttggcttctgagtgaccctttgaaattgatcgggtccgcttctcttctctcccccccccccttcggccccctaatgatcgaagtgtgctgattacaaggctatcgttctatacaaaatgggatcaatcaacatcctccccactcccacctgtacatatccgctgcttggcacccctgcggcaaatttttggtgaaaatgaattcgcgaatgatttcgggcgcctgttgcatgtatccctggcaaaaaaaatgc

SEQ ID NO: 20900 - DNA, 1008 bp, Heterodera glycines
  misc_feature (344)..(344): n is a, c, g, or t
agaagagcttttttaatcagaaatcttccccagtatttttgggcattaatttactgcataattaattaacttgtaatttcaacagttttttgttaatattaatatactttctccaatatttcttgtccttggagcaaggaaatttgatgtccatttcatcggtttaaattagagtagagcgggaccgggaccaaaacaccgacaactgagtacaatgagtacgaggtccccggtttgacccggacccgggacccaggccgggttttttctcggttttcccagccaaaaattcccggttttcaacccgaaaaaggtcccggtcccggttaagcccaaaattcccnggtcccgcttctaacctctagttaaatataattattttgcattttatttaagattagaaaggggtttggttttttatatttaattaattaattaataattattttaaattgttatcgcagttctatgtattaaccgtaaaatattgtggtaacgcttttttaaatggatttttactaggtaagacatattttaacatttaatttccaaaatgtaagtttacactttgtttgcgtaagctacaattcgatcgtggaagatttcaaatcagtttttcgtgagctaattttcgttaataaaaaataaataagtttataatatcattttttaaacttggtaatttttttaactttctttaacaagaaaaatattgtaatttatgcatatattcattttattagatttacaatactcattccgatttaaaagcgatgtttaattcgataacgttccttattacgaacggcgatgttttaattttaacgaaattttacgattagcgatatcaaattactactttttttaaattttattattttgaatccgtgattcttcctcttctaacgtttatgtgataaattgtttaagagcgattcgagaatatcgatttgcgaaacggcattaaattcatttataaattaaaatttgccattggatgaatttgag

SEQ ID NO: 20901 - DNA, 993 bp, Heterodera glycines
tttcatttttatttttccaattagctttcgaaaagcaagaggttttcatattttcttatcttttatcaatttagctcattttatggcattttttattatttgcatatttggggtttttatatataagtgttacttatatatttaagtattttttgtaaatattttgatttttaattttattttttccttttccataataaaatacaaagttcatttattttaaaataattaacgtgaaagagaggaaaatcttgaaactcgtttttaattcattaatccatccgatcacagatggttccctaaatttggaatttttcgatgtgtgcgtcaatttctttttgagggttgaaatggaagtcatttgagatttaaaattatgtattgtgttatctgtaaatttatacataaatattctctgtcttgaaaatattataatttttttatatagttttttcaatttaaaatattctttaaactttttgtatgtcttatgttattctatatctttcttattttaattggatttatttatttctttttattattttagcttattgccattataattttttgttagattttatattcgctgaaattaaattttagttttttaattttttctgccctatgaaaaaaggggctcaaaaatagcatttctacgtttaaattttttgatttggtgagtgtttttagtccatataaatccatattttgtgggttttcggaaataaatccatatttcgtcatttttgcgtttttagtccatattttggccatttttggcaaattttcacaagaaaaatgcaaaaaaagtgaaaaatacacccctaaagatcgacttttggaaatttttaaaaaatacacccccgaaaatacgaaaaatttgagttttcatcgatcgttttggcatttttaataaatattttcaccatttttttgcgaacttttctttttttaaatgagaatttctatcgaaaatttggtaaacttgga

SEQ ID NO: 20902 - DNA, 2362 bp, Heterodera glycines
  misc_feature (2257)..(2257): n is a, c, g, or t
  misc_feature (2263)..(2263): n is a, c, g, or t
  misc_feature (2274)..(2274): n is a, c, g, or t
  misc_feature (2304)..(2304): n is a, c, g, or t
  misc_feature (2309)..(2309): n is a, c, g, or t
  misc_feature (2331)..(2332): n is a, c, g, or t
  misc_feature (2355)..(2355): n is a, c, g, or t
tttaaaatcagagtgttccattcattaataattagaattcaaaattgtaaagaaaataaattgaaaattaaaaaacatactaaaatatatatttaaaatatcttagactataagcttcaacaatcgaatggaagctttgaacgagaataaatggaatgagtcaattacaattcctgaaccatttaataaaataatattaaaattgttataaatattataatactcttaaaagcatgttagagaaaacgagctaattaaaagataaaaattaaaaataatgtatcaaattttattaaattgtatgtttcgaatactggagttttgaaagtaattaaacgagatagcatatatttaaccaaaaagtgaatttgagctttaactttattaagttttgtttttattggaaaatgtttatgcttggacaaattaaatcattacattatagctttaaatttaaaaaatttaaagaaactaataaaaaacatatgtacaggaataaaacttaaccaatatttttaacaaaataatttaaaagaaatatatccttggaaaaacaaatataattttatagtgcacgcaactctataaataaacaagcatttgctgatataaaaaattaattatcaaagtattttgtctaaattaacaattatcactttacctagaaattttcaattttaataatataattttgcattttgaatttaaaaaaatttttttttgtccataattttgtgttaacaaataggttttttttgttatccaaaaaaaactgagtcccataatatgtatttgatcattttataattcctgatgaattttatattaaaaaaatcaatttaatttatttttgtatatttttattgttcaatagttaattaaattatttaatatcaaattcttaaaataaattctttcttttgtatttcacgtaaaatttatataatacattgagactttgagctgctccagtttttacagccacaatgaattgtctttttaggaatgtcaatgtaatttacactttgtaaactttacattttttttgtttttttatttaatttatttttatattttaaaaaaaggtaaaatgtcgtaattaattgttatttattccgcatataatgaataaattttttaaattaatatttatattaaataaaattaatttttaaaatacggattaaaataatatttatgaatattaaattaatctgattatcctttacatttgtgactattttacttttgtaattcccattacggagaaggcctaaaaatcgcatccctaattatttgtattttaaatttcatacaataaaattttataatttatcgagcgcaattttcatttttttttaaatgaaagtttataattattaaataaaaattatatttattattaaattccggttagtaaaatttgttataaaacataactgcaattagcttaatttttattttataaatgtagcgggaaaagcaatagatatatttgaaaagatttttttttgaaaattacataataaatactgatgaataaacatatccaagggtcaagtgtgaagcaaattatatttcgtgaaagaacttgtacttggctgctcaagaagataaagaattataaaatttcatttttaaataaaaaatttatccacctatttgaaaaaagaataatttgcaactaatattaattataaaaaaattgttaaaaggtcttcaatcaactacgtaactcaatgcagtcaaatcaagaatatattagaaaatatagaactaagtaacaattaaaaaacgataataaacaaactatagctctgtcgtagaattatttcatcaaaattttaaagcagacgtcaatcttcatttttcgaaatatggttacaaaaataggagttaagacgaataaaatctgtttaattcatcgaaaaatattttctgaatataatttaattttttctgtgcatattaaataaaaataattttgtaactgaacatatttaataaaaatgaatgtaaatatttatcgaaaataaataggaaacaatatatttacttcttattttggcctcgaaacattaaaaaataatttaataaattaataatagaatttcttttaatgttttttcatatttgagttatcttagaaattaattttttttttaatttcatttttattttcataaatttttaatagaaaaatgttaaaaagatgcaataaaatcaaatttaaataaaaaatatacatgggtatganaatacnattatatctanattgtaatataaaaaattatcataaccttngcttnaaatagtcataagcactataanngtcgctattattctgcaaatatncaaaaac

SEQ ID NO: 20903 - DNA, 1664 bp, Heterodera glycines
attaatccgtcaaaattttccgagccccaattccggagccgggtggtccactacttcgactttctcgctatttgtctcatttttattttttggcgccttatttcgagaagcgcgtttatttttttgccaaaatgttatgccaattcaaatatttccggacagaatttgcaaggaagtgaaaaatcgcgcgctgtcgaaatcccgccgcgtcgaaatcccgccgcgtcaaaatcccgccgcgtcgaaatcccgccgcgtcataatcccgccgcgtcgaaatcccgccaaagccaaaatgagtcgaaatcccgccaaataaaaattagcgaaaaagtcttaaaattacattcctaaggcttcaaaaatacgaaattcattaatactttaccagaatcgcataaataaataacaattttcacgaaaaataatgatatttttaaatattgaatgaatcgaaaaaagagaattgtatgatcgaatcctcaaaattttcatagtgcacgaaattccgagctcaattcgctgcgtccacttgtcggtcgatgtttctgctgacttcaaaaattaagtcggaaagggtcgggcgatcaggcacttataaaatttgttaagttttttgggggtttacaagtaaaaaatacagaaaagatgggttacttcgagaccaatgttgttgttgagggggcgggtgaattgatgccaaactacaacggctgccgagaatacgtttggtcgggttcaacggattgaaaatgatgccccgcgaatgcttaaaatgcaaataatcaaagaggaaattataaaaaatggttctttacggttatctgtactcagattttgaaaaaaaacatttttttgaaataaacttgttttagggggttttcaaggtcggggaaaccgattctggcatctgttttgacccaattcgaaccccaatcccggatttgaaaaaactcaaaatccatttttcaaaaaattcacattttatacacaaaatcgcttcacaatgtcacgaggatgacccgcacaaccaaaaaatgccctgagtacagataaccgtaaaataccaaaaaaattattagaacaaacattgaaagcttatttggggcaagaaaacactcgccgaacgaacaccaaacgcgttgacgccatcaagcaatgactgtcacgcgtggcagtccacagattttttcaatcacatatcggaagacttaattaaaatgtatgacttatttttaacaagtttctaccttcagaccaaagacaaatgcctaccttttgagttttcccaagtttgaaattggtgatgtcttgttcttctccagtcttcataacgttcattgttgttgtcgtttgctcacaatgatcagaattttttgcattttcgccgtcattgttgttcagaaatctgtgtttacaacatttatgaagaatttcaatttttcgacccattttgcttagaataatctattatgatatttttatatatgtataatataaaatatacatacaaatacatgtataaaataaataaataaataatttttatttggcgggatttcgactcattttggttttggcgggatttcgacgcggcgggattatgacgcggcgggattttgacgcggcgggatttcgacgcggcgggattttgacgggcagcg

SEQ ID NO: 20904 - DNA, 2832 bp, Heterodera glycines
attctgggatgagaccagattaatcagacctccccttggcatttaaaattgaacccgcctgtgcacaaaaggtcgccagttgtccggaacacgtcttggtaattgggtttggcctgcgcgctgagacacgctccgagacggtgcacacaatgtcaagggtccaaccagttcagggcgtccaattcgcgatttgttccgctcgtccaattcccaattgtcagtgcgtccaattcgcaattgtcagttcgtccaattcccaattgtcagtgcgtccaatttgtaatttggtctgcgcgtccaatttccaatttgccaatgcgtccaatttgcaatttggtctgtgcgtccaatttccaatttgccaatgcgtccaattcgcaattgtcagttcgtccaattcccaattgtcagtgcgtccaatttgtaatttggtctgcgcgtccaatttccaatttgccaatgcgtccaatttgcaatttggtctgtgcgtccaatttccaatttgccaatgcgtccaattcgcaattgtcagttcgtccaattcccaattgtcagtgcgtccaatttgtaatttggtctgcgcgtccaatttccaatttgccaatgcgtccaatttgcaatttggtctgtgcgtccaatttccaatttgccaatgcgtccaatttgcaatttggtctgcgcgtccaatgtccgatttgcgcgatttgtctttgtccaattgtcggcgtcaatttgtccaatgtttcccgattgtccggcgcaatggttgtccgtgtcaattggtcgcagtggtcgaattgagtcaaattcccttggtgaggtgagaatgtgatttgacgaaatgagtgaaaatccaaatgccaataaattggtaaatggttttacgcctcttttcaaaaagtttgtgatttagttttgaggcggaaaatcacttaaaacctccaatcccttgccttccgttgttctcaaaattcgaggaatttttattgagcaatttgatggaaatgcgaagagcaataaaaatgttttttaaagcattttaaattgtgtttgtcgaagtgaagtgatggatgggaaaaaatgaatggcttaaatatggcggatgagaccgccgtcaatttgcgagagatatgtgtcggagataacaagagagaaaatgaaaaatagaatttaacaatttaaatgattgaaaaagcatttaaaattaaagcataattaataataaaaataaatgagaatttgggcagaagaaattgaatgtccctgatcatcaaattgagtgatcgaaattttgtcagatttgccagccctctccattcgcaacttcctcctcatgccttcctccctttcttttccctccactttcgccattcttcctttgttctcgtttgtacgcgctcaactcgtccaaccatgtcgccctcgttgaccgccttgtggcaaattcgttgctcgcttcgctccgccaagttgagacttgctccgatgtccgacttctcctggtttgggaaatggtgagtaaattggtccgaaaaggggtgtgtttcggacaatccccgaaaaacagaaacttgatctttaacgggtttaccaagttgacttaattcagcctcgaggaactgattttgcttctgctctaaaatcccctttaatttaattcttccctcaacataatgcatagccatgagagaccaaccgaatgtgtttaaataaccggaaccattcaaaatgtttctggtttttgcccaattttttatgccaaccagaaacaacgggattcgaggatccccttccacatatatatttttttgttggaggtattgagaaaatgtttaaaccactgtttattgccaaaggactgttttcactaatcttttgagggcaagtcattttttagtaagctcccaatgagtcaacacgtaaacgtttgtttttggtcttaacaaccataggtggtccaattgaagattggagcttatttatattttttcttctaatttttccataccgtggtatggtttctttcttgtattttttaaaatcaaatccctgtcctttttggttttcaatgttatttgctgccgtttccaaaaggtttttaagtcctgttttaccctcgctgacgagagactccttcaaatctttaccttccaatacatttgtcaacactcgattcccgctttcaagcccctgacgtgcaattgacgatccaatttgtttccctatcggtaaaagaaatctcattaagcttctaaatactgagccgataccagcaccgcgctgatatggtacaccacgaaaaatattgtaacctccatattgaataaattcgtgcgagaatgtagaccaatccacttggtggggatcaaaatcgacatgcattttttgtgaaaaaaatatattttttcaactatttatatttattattcttgtaacaaaagaactgacaagtgtgtcaggtgttgtttttccaaaatgcaaaaatcttacaatcttttcaaagggagttcccagacatctattaaacaaaaagaagagcacatgacgaccacacacacttgaattgggagattgaagtagaattatactataacgaatttgtttgaatcttgacaaataatttgcaatgtgtatgctaggtggtggccaaatgcccaacgagtcatagtattcaatgtgtgacggagaaggactgtaagcacaaacccaatgtgatcccttagaggtgattgggtcaatattcattaccagacaatttggaaattttccatttccatatttggtatctggtcagccgcaaaacagccgatataagtctgttttgtgagtggg

SEQ ID NO: 20905 - DNA, 2236 bp, Heterodera glycines
  misc_feature (2122)..(2122): n is a, c, g, or t
  misc_feature (2227)..(2227): n is a, c, g, or t
tttgacgataaatgtgaagccgggctggaagagcggcccccgcatcactttccccaaagagggcgacgtgttccccatccgtatgccagcagacatcactttgtcatcaaagacaaaccgcaccccaaattcagaagggacggctcagacattcggtagcattttggaggaacattcccaagattaatttgtatcattaaaaaggtataaacaagtggttccattgcgagacgcactttgcggcatgtccataaaagtgccaactttggagggtgacatcatcccgttgaacatcaagcacgtgaccaaacctggcagcacacaacggtgggtttcatttggatttctatcaaggaatttggctaatttcgagctcgatgtatgtgaacttaatttcctatcatttcaaaataacaaaaactcacaaaaacaaacaaaaaacagaccaaaaaaataaaaatacatttataggtttctcaagttttttaaaggtaacttctttaaaagtgttgaaaaaaggaatcttggaaaaaattatgtatcgacataaaaaagtttaaattgaaaatgtagacggcccaggtaattaactgacaaacaagcgttttgataaattttactgaatttatggacttaggtaaatgtaaaaaggtggacaaattttgtttactttgcagcgcccttatgagatgaatacaattaatagtggagtttccccccccccccatttttcgaaaaatttcttttgtttttaaaaaggacacgtatactttcccttatcattatttccttttttccagaatccacgatcgtggcattccgaaccctaaaacgggcaaacgcggcgacttggtggtggagtttgacgtgcgcttccccgattcgatagcgcctgccgcgcgggaactgatcgccaatgcattgccacccaactgatcggacgaacggagggccaaaagacgggaaagcgaaagaatgtgcatttgaaatgttcaattgacaagcgataaaagccttttccaatcctcaattccccaagaaatgagtccacttctccacattctgtggttctattttatttagttttattatggtgtttcgtttttcaataattttgtacatttaatttctgatggttgagagagacgtataccaaattctaccaacaatagatttgctatgcttgcggcgctgcaaaacatcacaatgctgggttattatttcgggacaattgaatatcttaaatttggtagtaaaaagagcaagaaagcatagaaattttttattttcagggtgggactgcattttttgatctgcattatttattgagtttgaattcgtcattgttgtttgtccgtcaatggtttttccgtagcgaatgaagtacgtacctttgccttgggcaatgaatgctttctttcgctcgcttttttgtctctttttggccaaccaataaaatggcctttgtgccgttcccatcgaatgcttttgcccttcgcttattgcgtgaatactctgcctttctcaatttgtgtgcaaaatattaaaaatgtttcaaattatttgtaatttttcgtcaccccaataaaaagtaaattaattaatttttctcggcttttcaagtctgttcaaaatgtattagtggtgtttacactttttacatcatttttaaacccacggaaaatcggattcgaaaagtgcggcggtccctccggccaatgtttgcttttgcttatacatatttgtgtgtgcggcttacatattccctctccgctttctgtcactgtgcttaatccctcggcccattgggggcattttgtcttcagcctttgccctttggcgccgtcgttaatttaattgggcgaaggggacgaaattgattggaatttcaaattaaaattagcaaatttaacgggtggaatttgccaaatttaattatacataaaattctttttttttttaaaagataggccactgtttttatgacttcgccaaattccgcttttcgccatgagagtccggaagacgtcgttttcgacctgttcaaattgcctaaccgtgacgaagcgtcgattggcaaattgatttcagtgagaaaatgcaaaataatagagcaatttanattcaattaactaattaaaaaattcgaatgtttccaagggcaacaatgtgaaatattctcataataagtgaaattttcaaaatgatgaattgataattttgttgngcttgaatt

SEQ ID NO: 20906 - DNA, 963 bp, Heterodera glycines
aaaaaatgccaaaaaatgatggaaaatattaattgaaaaatgaaatatttaataatatttttaaaaatattctgaatggcgcataattatgagaaataattgaaaaaatattttaaaataaaataaataaagacttgacttagatttacgatcatttttaataagtgtctttcttcccccccccccccaatttatcggcaaattattaatccctaattaccgcccctcccccgcctaattagtcatttcactgtctttgctcccgctttgttcagctgtgttcatccgtgcattgcactgattacgcgtgccattcgcaatcagttgatcattccgaattggacggaattcaccggaaaagtccgagaactttttgaggaggtaaaaaatagaaagattattttaaaataatgtcaaaataagattttgttcagtgccgtgcagaaactggtggccaagtggccacttacattccccaattggcacgtgccgacccggaaaaggtccatttttactcttttcaattaatttatttcgtcctaatacctataaggtatttagcaggcttttggactagtcagctgacggacaactaagagaagataaattttgaatggaaattaatttttttccccaactatttgtgaatcagattgataattttggcatttttatactaatcattgataagcagggcgaggattttttgttttttaactattttttctgcggctttatttcaacgagaaaggcacgaaaaacacatttttagctcggaaattcttcgttttaacgccactattcatcactaggaatcactattttggagctttgccactaaaaaaaattattttggaagttagccactaaaataattttttgccactattttggcgtttcgtcattatttttgcctactattttggcattttttggaaaatttcacaaaaaatgcaataaaaa

SEQ ID NO: 20907 - DNA, 1753 bp, Heterodera glycines
aaatttggtatgctaatatataacacctagggctatcgagtgctattgaatacattcacttcgaacaactatgaaaagagttatgctccaaaaacctagctggagcccagttggttggcgcccgtcgacccccacctttccaatcctactatagtatttaagaggtacgacctgcatttttttgggcatggattctcctggattttttttccaaaaatacagattcaggcaagactgaagcccaggcccagtatgttgatctctaataaatctttattcccaaaatgcatattcttatatatatatatttttttaatttaagtaatttatccttttgggctcgctgtcttcgttactttatatggcttcgtacaccaaacaattgttaacattttgtttgattgatttttaagaatgttgcaatggacagacagaaaagaggaagaaaaatgattcgtttttaatcattaacatttacatacatataaatgaatatattggagctcaccaagaattaatccgggccgggcgccgttttcgtacaagaggatattttaaaaaaataaatgaaacaattgcatttaaatcatatatactactaatgttaattatgctttttaaggttttgacccaattaggtttttaataactacaaaaagtaaataaaagattacgatttttgaaattattttggcaactaaattagaccaacttggtatcattcggaagctcttgatgaggaggagctttttcgtagcaaatgttaaacgattttaaaaaaagataagagcgttcgaaaatttgtttttcttctaactcatgaataatgcataagcaagccaaaaagggctggggacgttagtcaaaaaccatcaaaatgggcgttagtcaaaaaaacatcaaatgaataatttttgacagaaaattattcataatttcttctaaaatggatcaaattttataatattgatatttttccatagacctaaatgttttctattatcctgcgaattttaaaaaaaatctctctcaagacctggatccagttatgaactgagatttttttaaattcattttataaactcaaaaaaatgtttgaaaaattcaattaattgcttggaaacatctaaaaatatctaattaataataagaatgtgttttaaatttatttaatctgtttttgaaaacttgaaaaaacatcggtcacttgaaaaaataaattctaaaattttgtccaggaaaatccaggttttttcctgttttgcctggacctggatttttttcacatttgacctggacctggatttcctggacaaaaatcgaggaaaatccaggtccaggaaaaatccaggttgtcaaaaaatgacctggacctgatccaggaaaaatccaggcctggatccaggtccaggccgaactctatgaaccacttctaaccaaaatatcttttcaattttggatggaacaaacattaataaattaaatgacagagggacaattaaatggatttaaatttcgaaaatgggttaataaattcatgaactgtgcgaaatccaaacggttttcttgaaattcatgaaatttccattgaaaaaacctggaaatagctaaataggataagcaatgaaatttttgaagaaaaaatacaaaatcaaaatttgtttttttttaaataaacaaattttatctttttctatttaatcaaaataatttttggggagattttcattttttaagagcccagtgtgttttt

SEQ ID NO: 20908 - DNA, 1570 bp, Heterodera glycines
  misc_feature (13)..(13): n is a, c, g, or t
ttttatttatttngttctagtccaatatttttatatttgtgcatttattttgcttatcataacttactaacaaattattaattaattaatttaacaaagaaaagaaaagaaagcaaacgaaaagccaagaaaaataaatagaaatttaaaattaagaaaagaaaagctgcgcaatatttaaaaaaaaaagacgaaaagcaatgaaaaaataaatataaatttttaaagctaagaaaagaaaagcagcgcgatattaaaatgaaatgcaaacgaaaagccaagaaaaatagaaatctttttaaagttaagaaaagaaaagctacgcaatattttaaaaaaaagtcaaattttctattttttttacagcgaaaaattcaaattgtcctttattttatggctcaacagctaccaaccgttttcggccaaatgccgccctttggccaagtcatattaacaataataaaaaataaaataaaaaactaatattttattattttaaaggttgcgcaattggtgcaacccatcctcgtcaacgcgtcccaccagcaattggcggtgcttacttgttttttttttaaatttttttaaaattttgctatttgcaatttcaggaacctttttgtgcggatggaacgcacaacattcaattcttgattggatgcgttgctgcgttgggtcaaccattgccgtaagttgaatttacaaatcgatatttaaattgtgcgcgagtttttttttagcccgatgtgcctgatcgtcgtgtcggttgaccatcgccctgcgcagcagacgccagctggaccacttgccgtgacgaactgtgtgcttcgcacgggtgacggccaccgcgttgaagcctcgggatggcaggcgcatgcgggtacgctggcggccttgtgtgttggcagtgcctactggttcaccaactgcttggcccgtgccaaataccagcgactggactgctggtttcgcattggggttggaggccccaatgcgcttgtggtgccgcacgtggccccagaggtaagttttttttttaattttaaattgatatttcttttgcaatttatgtttaagtttccggcaaacgttccaccaatgctgcccgttcaaattggcgcagggcgtgatgcggtccgggtgctgccaaacgtgaccaatgctggtgatgaacaacgcgcggacgcggaactggacaacaacaacaacaataatgtgaggaaatgatctttttattatgatttgtataattttattgctttacgatgaataaactttggttctcaggacaccgttggtcttgagccacgtccgagtcgttgtgcgagtcgtactgctggtgcgcgaccaacacaaagacgagcggctgaaccggttcgtttgagggtccgattcgacttgccccctgaggtcgaagaaattaggggggtggaaagacaaaaaccatatcccgcccgtaaaattcgtttgctgcccaattttgacatttcacgcattcatattgaaaaatccctttcctgtcccatatgcatgtgtccttttgtgagtggggaaggcgcaatttctcttc

SEQ ID NO: 20909 - DNA, 954 bp, Heterodera glycines
ttttgatgccattgtatcagttggttagtgatcggcttattcgtttctgatcaatgatctattatttatttgttttgatcagcaataatgatcaaaatgaagcttaaaccttgtcgccaaatgggacgaatcggatgccaatgcgaagccgattcgggcccatttgctggatggaagtcaccatggacaaatttgtgacacacctgcagagaaaccggataataattggtaaaacgtcaatcggagcaatgcgaaaaaggcacgaagaaatctcattaaaaaaaaattaaaaaccttaattgtgaaataatgaaaaattaaaaaaagaactaacgcaaaagctttaggtgttaatttgaatttcgtttttacttttttacgtcaattttttatgttttccgttgaaacttttgccgtccccttaattgttttttctaggcgtcacccctcctcattttttcttgtttctattgtaaaaaactaaaatttctttccttggaattttttgaaaataaattttaaaatatggaggatggcttatggaatatgtgcccttaccctcccgagtcccaggtttttcgataaaattgccccacccattggcatcgatcagtgccaccgaattggtcgcctcctcattttcggaattgatcgctttcaggtcgctgatcagcagtgatccgtcctcatcatcaccatcattagcataattgtgcgggaaagtgcggcggtggcggcgccgaatctccaaaaagccgggcatgcccagctctaccttttgcaccggcatgccaaacgcgtcgagcacctccaggcgataggcggggcccgccggctgatgtttggccaaatgaaattataatttttaaatgatttataatgcaataatttccattttttaataaattataatattatttttatttttatttattttactatttatttattcac

SEQ ID NO: 20910 - DNA, 902 bp, Heterodera glycines
atcagtgccgtgctcgcctctttcaccatcagtgtgttggtgtgccgtcgacgcgcgccctggcggttgtccgtttcaaaggcgcactgggcgagcggcaaacggacgcggaacgcgtggaccggcgcggaaacacgacgcatacattcatccgcgtccgctcctccgactggcctagctgccgcggatggcattggcactggcggcgtaatgtgcttttttggcaccacatggccgcggaacagtttcagcggcgagaagccggacagcgtcagcgagttcaagtggcaatccaatttaactgtaaatttcaaaaataaaatgcgtccgctggcgagagtggttttggtaggtttttagagccgcttttatcaaaatgaaattgaatctcgaaccgaaaaaagactcgggtttttagggccaaggcacgatttaagtagagaaagatttgaggtttttgtggctcccgatttcggtacaaagcctcgactcgacaaaagtctcgggtttttgggtctcagtctcggcgtcgaaagtcgaattgagaaaagcctcattttatttggttctcggtattgatttcggctgagtcgagaaaagtcccggaacgcctttaggttgccttttggcctaggaatggagtcgagaaaagcctcgttttttttggtctcggtctcgacttgtcaagtctcagtttcgagcatcggaaaaatattttttattggcaaatgagcagcccctagaaaatttcctgaactaacctaaaaaatttgaaattgtgaaaaactcttttaattccaaaaagttgttccactcacaatccatgcattcgtccaactctccactggacaggccgggctcaatccgttccaacacatttcgaccccagtgaacgcaatgcc

SEQ ID NO: 20911 - DNA, 2634 bp, Heterodera glycines
cttggctcaaaatgtaaaaaaaaaagggggggtggagcaaaattttgggtaatcgcgcgggattccgaaaaaaaattttcaggattgatctggatcgggatttggtagggatccggacccggggatccgtcccgatggtttttccaaaattttggggattgatcgggattaagtcgggatatcggctcggttccctccgaccccagttgtctggtctctagtttaaaatgaaagaaaaaaaaaatttttttttaaattagcatttcattaaaataaagaattttatttattaatttgtatttttcgattaaaatgtattcgttaagcaataaattctacctcgtcgttccgatttcttatttctcatgtgtgtgctataaattgttatgatccagtaatttttcgtatcgacattgtcaccctattcgatttcgtatttgtggtcatcggcactttaattaataatagttttcgcgaattttttagtatttaaacaacttcaataagagaagccgattaaataaatagtagaatatagaaaaattaatcgtttgattgtccttaaattatatcctccttagtttgccgtgtagctacaattccattgttcatgttcccgccttatgggcgtggtaagctggttgagtgttcagggaagaatctgaccccgctagtaattaaatatattcgaaatttttgaatacatttttctaaaataaataaaatttcaaaaaccaaatttggtcaagaaagaaaaacaaatttagtggaaaaaattttgaatatttaaacaagtcgccaaaaaagctacgtcaaaaaaattttcaatgcatttttgttaaagaatttgtgaattttacatgaaaaaatttaaaaatcgcgaaataagggcgaaaaaagcatgaaatggcaaaataatggcaaaaagaagttctaaaaacacaaaaaagtgtcagaaagtgtcaaaaatatggcagttttcttcaggaatgctaaaaatttatttctttaaaaaaaatagcaagcaaagcgcggtcgatcatcgcaaaatgatggactcgtatttatgcgagttaatctggcgcgaagacattaactgactgacttaacgtcgatgcatttgaggaaattttggagcaaattgttgcttttatcttttatgctattgaacgtgctttgggcaattaacaggggttttccccagaacaacaacacagtttgatttgctttttatttccgctttcaaattggaattttaatcttttaaattgttaataagattttttcgcaatatttgtttctcaccattctttataaccatggacaacaaattaatgtcatcacattgtttctcactttttcttcaaatacaaaagtgcacaaatagcaatttggatgcactgtcagcagctgcaacagcggaagaggaagaaggacagcaccgccagcgacaactctgtgccgacagggcactgcttttgtgaggagatgggaagggaggagtgcccgattgtccagtcatcaaatccaagatcggcattcttgcaggattttctcaaatgctggcaccgttttttgaataaattttccgttcatttttgaattgtgcatggaatttaaaaatgggggaacataggatttgatagtggattgagaatggagggtctcggaaacagaaataaatcgctgttttataccctcccaaattcgttttttcgtgttcctccctccgaatttttttttctggctacaggcttggcatatttgaccaatttttaattgattccactaccctcccaaaatgcaatttcaacgctaattgctctatttatatgtgtggcatatggcaattttattttggcatatttttcaggctgaaccgactcgcccatgcccagggattgcccaatgtttttgcaaaagattccactgttcggccagccaccgattttttcaaaatcaacgagcgccaccacatgcaattggtaattggggaaaaataaaattttttttttgttcttcgtggcgaaatctgtaaaaaaaattataccaaaattttagcaaaataataaattctaaattctaggtttttcgttttgttaaaattcatttgtgcctgatatacgacttctgtttaatggagtgtctaattttttttttgaaattctataatttaacccgtttttactagtacatgattaaaattagagctgagcgggactggtactgaaaaaacacttaaactgagtaccgaagtcccgttttttcccggttttcccagccaaaattcccgggttttcaactcgaaaattcccggttccgctcagttctaattaaaattgaaggcccagcaaaatatttaaggcaattccaaattttttaatgtgtgtgcatttgtaggacaaactgatggacaaattagaggcggaagcagcaaccaacgggactgggctgatggcatccaaaacggccgctttttctccgttagcgccctcctcggcgttgcgattgaacggcgtgccaaacagcaaattcaaaaagcgggcccaacggcgcaaggcgcgtgccacggaaagggcccagcaactgcacacggtggtcccggttcgtttttggccattttttctttcgttt

SEQ ID NO: 20912 - DNA, 1694 bp, Heterodera glycines
  misc_feature (52)..(54): n is a, c, g, or t
  misc_feature (56)..(56): n is a, c, g, or t
  misc_feature (63)..(63): n is a, c, g, or t
  misc_feature (77)..(77): n is a, c, g, or t
  misc_feature (100)..(100): n is a, c, g, or t
  misc_feature (112)..(112): n is a, c, g, or t
  misc_feature (116)..(117): n is a, c, g, or t
  misc_feature (119)..(119): n is a, c, g, or t
  misc_feature (122)..(123): n is a, c, g, or t
  misc_feature (125)..(125): n is a, c, g, or t
  misc_feature (131)..(132): n is a, c, g, or t
  misc_feature (146)..(146): n is a, c, g, or t
  misc_feature (168)..(169): n is a, c, g, or t
  misc_feature (175)..(177): n is a, c, g, or t
  misc_feature (179)..(179): n is a, c, g, or t
tgtaacatttggaaccggaaaagtactagccggaaactcttcaattgaaaannngnaacactnggaaccggaaaaanactctttcggaaaacaaaggaancgaaaaggcaangggnngnaanngnaacatnnggaaccggaaaagnactagccggaaaaagaaacaanngaaaannngnaacacttggaaccggaaaaatactaaccggaaaaccatggaatcgaaaatgcaattggttgtaattgtaacatttggaaccggaaaagtactagccggaaaaagatacaattgaaaatttgtaacacttggaaccggaaaaatactaaccggaaaaccatggaatcgaaaatgcaattggttgtaattgtaacatttggaaccggaaaagtactagccggaaaaagatacaattgaaaatttgtaacacttggaaccggaaaaatactaaccggaaaacaatggaatcgaaaatgcaattggttgtaattgtaacatttggaaccggaaaagtactagccggaaaaagatacaattgaaaatttgtaacacttggaaccggaaaaatactaaccggaaaaagatacaattgaaaatttgtaacacttggaaccggaaaaatactaaccggaaaaccatggaatcgaaaatgcaattggttgtaattgtaacatttggaaccggaaaagtactagccggaaaaagatacaattgaaaatttgtaacacttggaaccggaaaaatactaaccggaaaacaatggaatcgaaaatgcaattggttgtaattgtaacattttaaaccggaaaagtactagccggaaaaatggttgtaattaacactggaccggaaaaatactaaccggaaaacaatggaatcgaaaatgtaattggttgtaattgtagcaattgattgtaattgtaacacctggaacctctcttcaatggacctcatgatttttccggaaaagtttttacaaccataggatttttcgagaattacacgattttcaatatatttttggagtgttcaattaccttaaaacaattttctaaatacatgaccatactgtattaactgcataataacataatgcacaatattttaatttttttaaatatttgtttggtcatttatcggacaccagttattctcacagtcaatggtcattcttcaacaagttcaacggaagggccctccttgcgcatttccatgaacacgaatccctccccgtcatccatatctgcggcaatgcaatcagccaccttaattttattaataatatttaactgctaaccaaaatgttcaattttaagactaaatggcgacgcctatcgataccatttgatttaaaaagttgtatattttatttacaatccagatacaaagcaaagaagacatttgttggaatcaattatttatctgtccatagaaataacagtttttgatactctatttaggcgatattcggtactttttttggttatggggccatacttcagcggaaaggcacccgattttctttttcaataaactacaactttttcaagaaataatatgttctgagtgaatctattagcttgcattaactcgaaaaaacacctcaaaagacaatgaacgctccaactgttcaaagtcctcacttccgtccgcaatcatattctgtttaagataaagtgttcaaattaataaattc

SEQ ID NO: 20913 - DNA, 1232 bp, Heterodera glycines
ccattgccagcacttgtcgtcgttagctcttctttagcagtaaacattttcgctttggtcgactatttaaatatttaagaaagaattaatgtatatatttttctcaaaaaattcatccaacctcagacatttgggaatgagttagcatcattgtcggggacatgaatgtggactaaataattgacaaaaattttggatggttaattattgtgattgatttatttacctcggacaaagagcatttcgatgagcaggaaggacccgaaccgaaaggagaaagagcgagctgaaacggtgaggtggttggagaattggcggacggttgaacacgacgtaaagcagaggctaaatgttaatataaaattttttggcatgtacattcataaaagttcaactctatgtgacatctattaaaaggaataacttccgaattctcaactcaaataaaaggcaattttgttccaactcgggttgggggctcggaaaaattttcagcaggtatagaagtagccttttttattaaaagaaaatgttttggtacctgtggcgaatagtcccggtgaaggagcaattaagttgttgtgagtccaaaagtgatcaatattttcaaattgtggagtcttgaattttgcacaagggtccctaaaaacagaaattagtgtaaaaaaaaactaacgcaaatataccaattttcaggtggcaatgaaaactcctcagtctcatcaaattcaatgggttgtatctttgcgatttggtcaattgaccatttgaaatcctataaaaaacataattagaaatttaaataatatgtaaataaacaccgcgcttttttccttagcttcattgtttccttcatcattcagttgtctgcctgtgagcattttacgacgacggaaaatgccaggagtgacaaatgatgacttaaatagtaaaaattatggaataggaactgagtaaaatgcgagtgtaatgtaaaattaaataacctcctgaacaatagaagccttttctttgttaacaagggtattcgttgaaattgatgattcgtcttttttgtcgttagacattccacaaaattttaattctcagattttaagacctgaataattaaatatgaaaagctccgattctgtaacagattgggctaaaagattttgcagaaactgaagcgggttgtcaggccgatttagagggggtgggaaggatttaatggagcgggttcatgacaaaaa

SEQ ID NO: 20914 - DNA, 1175 bp, Heterodera glycines
gggccacttttttagtcgtcgtttttggattttgatgccgaaaaccaaaagtgttttcctttctatgtgcgcctttatttgaaatttgcggtgtcattttgttgaattggcgcgcgcatattaatttttaattgggctacttttttaattaaatttttaattttcatatgaatttttataaataaattttaattttctaattaatttttttatataaaatttatctcctgcaattgcaaatttaaaaaataaaaataaaatctggacttgattttcttggtaaaatatcatttaaaataaaaaatttgtgcatttttatttttaattgtatcgacgataaatcgattaatgagaaaaatatacgtaaatttgtttcgaactttcttaatggattatttttttaaattttaaattccccttttcactcctttatttactattttaattattcatttgtaaaatataattggcttgccgtgccaaaaatagattcttaattatgtatccaattttgcgctgtgttccgttacgcttccgcctgctgctgccgagggtggccaaatggccagagccccgcttttcatcagtggccacactgaccacagcttagtagtaattacgcaaccccaaggaaaagtgaggcttcatcgattttgaaaattgtttctctgactgtcgatttctctgcccaatgcttttctcgctgtctgtccttaacccttcacagacactcaatgcttttctcgctgtctgtcttatactctctctatcaatgcatttcatctcttatctctctcttctctctccctcgctctctctcaatgcttttctctcgtctgccctattctgttgctatatatcactttttctctctccctctctattctcttctctctccctcgctctctctctcaatgcttttctcgccgtctgtttttacctgtggctgctgtactctgcccgttttccattttgtcctcttgctcatacacactttctccattatttcaagcgtgtgaaattgatgatgaagcgaatgggctggggagggtaaagcccaaaagtgtaagccaatctgcgtgaaattgagcctgtggattaagtgtaccacctacccaacataacaaagaaaaacaaatatctttttcaaaaagccaaataccaaagccattttg

SEQ ID NO: 20915 - DNA, 735 bp, Heterodera glycines
atttgtgccactattttccatggcaatcccattaggtacactttttcactgtaccgactgctcccgacattctctcgtgcaaattttgacactttttcaatgtccatcaaaagtgtgccatcataaacacgtccattagtcggaaatttcattgggaaaagtccgtcggatttgccacgatattttggaagggaatggaagcgataaacggcgatcacttcatcttttgataacacatcggatggcactgcaaaaaacagtataatgcatggaataaaataaattaaattattgaaaaataatttaaaacattccaaaaattttcttctcaaaaataattaattattttacggtagctcattgaaatttggcttcttttttttaccaattttctccgaaaattcctcgcttgacaaaatcggaaagtgaattttgaacagtgccgaaccgagcatggcacgacgattctcggctgaacattcaatgccatttttgacggcatttcgcgtcggcccaacggagtgcctttttttttattaatgagaaagactaattattgcaattatttcttaattgtagtgtaaaatttaccgcattccaaattgaaatttctccactgatttgcaattggtaacgttcaaaaatttcgcacaacaatttttgatcaatatgcaaaaatgcctccgattcgatcaaagtgtcagcatttttgtcaatataagcaaaacatcgttg

SEQ ID NO: 20916 - DNA, 1300 bp, Heterodera glycines
  misc_feature (78)..(78): n is a, c, g, or t
  misc_feature (95)..(95): n is a, c, g, or t
tttttacatatttagaagctgtttttctaagctattggagtccggcggtgacgaaaggaaaaaatttttttcttgatntaatgagtgaactgttntaaaaaatattatttgataattgaaaattaagaattttcctacttttcccaccgaatgtgccgtgccattcgcatttttcgtcgcttcctttttaaacatcgcctcaaaacgtcggaagacgcagaaagaatggcacgatgtgcgtgcagaagcttaaaatttaattcagcaaatattatttttatttcaaatttagttaaatttaaatatattttttaaattttatttttgcctcttttttgtcgttttgcccaaccaaaaaatgcgcatcggcgaaatcggccgtgctcagcaacaatttcattcgatctgccaaaatgtccggctttgcagtcttcctttttttgccatctgagcatgaaaatatgcgcatttaaaatgaataaatttaaaaacataaattttcttttttggtgtcttttttttaaatttttctttttgggcttatccaattttttggtcaatggcaactcgtacaaaaatcaactcgtattttacaagataaagcttaagcctaggcccaaccaagcaagcctaagcctagcctagaaattgtacgatttgccatggcaccccaatttttgtccaaagtttcggaatttcaaattgctttggtcatttcagtagtaccttgatcagctgtaaatgtataatttgttgaatcgggaaaagaagacattaattgtttatttaatgctaaataaatgtaaaaataagaaaaataaataaatttaaataatcttattagattttttaaatatacttgcaaattttgtaaaaaaaatttaaagctgcaaaaaataaaaaagttttcaaaaatacattaataaaaaccaaattcttcataaaaatgccagaaaattaataggggaagaggaatagtaattagaaaagagtaaatcaattaactttctgttttggatggcgagggcattaaaaaaagaaattacggcaaaacgatgactcaaaaatgaaacaaatttgatttgattggattttccccctattttcaaatataatttttatctaggcaaaatgctgacccaaatatgggaaagatttactcatttgaaatggtaaaatatgcaatgatagagaattgcccaacatcggctttggagttgggaaatgttagggtcatttggagctggggttgactaaatcagtcgggactaaatgaaacaattttagtttttttttgtca

SEQ ID NO: 20917 - DNA, 1232 bp, Heterodera glycines
aattaattcacaatttccgcagctcttacggtaatggaaaaaattttgaaaaggctctccggaacggattagcatcggggttacgacatagaaaattgtcctaaaaagagatagccatttttctgagaattaattcacaatttccgcagctcttagggtaatggaaaaaattttgaagaggctctccggaacggattagcatcggggttacgagatagaaaattgtcctaaaaagagaccccgaaatgaaaattttccagtaaaaattggcaatttttaaaattttttacccaatttttttttaacaaaaggcattaaaaaatcaaaatttttcccgatggcgcctatcggcaccgccggacccccattttaccttagttttttgaaacaaaaattgcaaaaattagaccttttgcctgcttttttccttttttggcgctggaattaaaaatttcgaaaaaacgtaattttataaaatttcaaaaaaactgctaaaaattttttttccctttaaattttcttataaaaaaatttctaagaatttttcgttgaaaattttctaagtttgattttttttttaatttatgcggcgagattttggttagtccccgaggggggcgggtaacccatggcgtattttcgccggacttactgttcaatgatgtggtgcatataagcggcgctcttcagcagttcgtacatcacttcgccggccgtgctacactttgccaaatgccgcaccaaatcggcaccaaccaaaggggaaagttcagcacgagaaattcgaatttcctgaaattcgtaatggctattcgaataacaaaacagagaggagagtttataatcactagtgatgttcgagagtctctgtctcgactcgagaaaagtctcgggtttttttggtctcggtctcgagtctcggtctctggtttttaagtctcggtctcgattttcgagactcgagaccgagacttttttacacccctaatgattggcttttgttaaagttctatttttataaattttaggtccttttttgttcagtttttgttagcatatgcctggtccagtgggttgtgttcttgtttctgttccttgtttttgcgcaggatcaatcccctccaagtatttgtattttcttcacatttttcaaaattaatattttttttctaagtgaattttaacaattaaaagcgtgaaatattgtcatttttggactaaatatattaaca

SEQ ID NO: 20918 - DNA, 2697 bp, Heterodera glycines
  misc_feature (2325)..(2329): n is a, c, g, or t
  misc_feature (2333)..(2333): n is a, c, g, or t
  misc_feature (2342)..(2342): n is a, c, g, or t
  misc_feature (2345)..(2345): n is a, c, g, or t
  misc_feature (2358)..(2360): n is a, c, g, or t
  misc_feature (2365)..(2365): n is a, c, g, or t
  misc_feature (2370)..(2370): n is a, c, g, or t
  misc_feature (2389)..(2389): n is a, c, g, or t
  misc_feature (2401)..(2402): n is a, c, g, or t
  misc_feature (2438)..(2438): n is a, c, g, or t
  misc_feature (2482)..(2483): n is a, c, g, or t
  misc_feature (2489)..(2489): n is a, c, g, or t
  misc_feature (2492)..(2493): n is a, c, g, or t
  misc_feature (2495)..(2496): n is a, c, g, or t
  misc_feature (2507)..(2507): n is a, c, g, or t
  misc_feature (2514)..(2515): n is a, c, g, or t
  misc_feature (2521)..(2522): n is a, c, g, or t
  misc_feature (2525)..(2525): n is a, c, g, or t
  misc_feature (2529)..(2529): n is a, c, g, or t
  misc_feature (2534)..(2534): n is a, c, g, or t
  misc_feature (2554)..(2554): n is a, c, g, or t
  misc_feature (2557)..(2558): n is a, c, g, or t
  misc_feature (2564)..(2566): n is a, c, g, or t
  misc_feature (2570)..(2570): n is a, c, g, or t
  misc_feature (2584)..(2587): n is a, c, g, or t
  misc_feature (2589)..(2589): n is a, c, g, or t
  misc_feature (2593)..(2593): n is a, c, g, or t
  misc_feature (2597)..(2597): n is a, c, g, or t
  misc_feature (2636)..(2636): n is a, c, g, or t
  misc_feature (2641)..(2642): n is a, c, g, or t
  misc_feature (2646)..(2647): n is a, c, g, or t
  misc_feature (2651)..(2651): n is a, c, g, or t
tacaggcaaagacataatgcaatgacttctattgggttcattaaaaaggtctgaccctttaagcacttcaacattaaacaattttttatttcacaaaaaacaaatgttcaatcaatgatgtactcaccattttgatcaatgatcctcccccatcgttcgggcaacatttcaatcccctttttataaaactgatcatttttcgatccaaaaaagtcatccaatgcattttcgacctcgttttgatcagcaaattctttccctctcaagaagtgctccatagatcgaaacagatagtagtcacacgggctgatgtctgggctgtatggtggatgagtaaggaccgcccatcgaagttgctcaattttttgttgcgttgagaacgcaacatgtgggcgtgcgttgtcatggagaaggagtacgccgccgcggaattttgcagaaaatggaggacgacgaatttggtcatgaacccgctgcagttgttgctggtagatgtcggcgttgatggtttgcccaccggaacaagttcatagcggaccaaccctgatgaacaccaccagacgcacagcaataccttcggtgcatgttgaagacgcctgggggtcggctcgcacaattcgtttggcttcagccattgtttttgtgccgttttgttgttgagataaacccacttctcatcacacgtgatcagctgggaaagctgcattccagcactcaaacgggcgagaagttcagtgcaggtgaccactcgctgatgcttttgttgttgggtcagtgcatggggaattcggcaccctttttgttgatgaagccgggctgatggaggtaattgagcactgttgtctgatggaccccgaactctgctgcaagttggcgcgaactagaacacggatgctgctgaacgtgctgctccaagtcgtccgaatcgagagcaggtggtcgtccggagcggggttcatcttcgagctgctcattgccttcacgaaattttgtgaaccatcgcttaactgtagaaagagagagtgcatcatgccctcactttcacaaatatttcgaagagcttgggttggggtagaattttttcggaattcgtaaagtaacagttgtcttagccgaattttatccatgcaattcaaaaattcccacactgcttcttgcgggcaaacataccgcgcatcaatgaattctttaacttcatcatgatcatttttctcttctaattccaatcttgctctatctggtggcttatgcacatacttatgcaaatactttactgaactaacactattaaccttttcaagattaatgtggcacttgaacattttcaacaggtataggttgtgcggaacaacccatctgttgtctaattcatgtcttcttccatttgcaaatatttcaacttctctttcatcatttggtcttgcatacaaagccaaaccattttcaagaacaactgtctcttcttgaaatgttttaggatatcccttagagcatttccttcctctcataccattcttgtcaacaaattaataaatgttttgttcgaattaattataaaaaataatttatttaagcaatttgaaaaaattttctgatttttgactcaaaaataagattttttatttcaaatttctcctttataaatttttctatatatttttaatttaataaattgattgtcctttaaatttgtgcattaaaaatatttttgtgagtttttaattaaattttcaaattactcccgctcccgcccgggactcccgttaaaaatggacgggattttaactggagcgggatttttacgggaatcccgttcgggactcccgtcccggaaaattttgaactcccgatcccgctcccggaaattttttttaccggactctagtttattttaaattagctaaagcataatgccacaaaaaataatagtttggcagactgcagcaacaatcaattagccaattatccaagcatgaaatggtctcgagtctcgcttcaattcaaatatgtagacagagcatcgtttgggcttggcttaaccgactcctttttatttcaattttgaagaaatcaaaaaaaaaccgcatagtccatgtataatttgcataaaattttaatttttaagggttataaattttaaaaagaagtaaaatggtcgatgcgcaacattttacccaactgctcatcggaatgatgaactccgaaaatgaaattcgaagtgtctactctttttagtgcatgagttaaatttttgtttaaggtgaggctgaaaaacagtacgaagcgattgcactcaaagacaaaggtttagttttgtgagtcctnnnnncctncgccttttnggnccccttttgtttnnnccttncttgntttcctctgcggatgttgnggttttgcttcnncttgtggcccttttcccgctttgttccctccgtttngtctcgctctttggctttggttcttctgcggcgtttgctgtcgnnttcctncgnngnnttcttctccgntcttctnnttcttnnggncctntttcncttcgaaaaaattgtgtgtntcnntggtgnnncggngcccgttttgcgcnnnngnctcnccgntttgttggcggctcttttgaagaattcccttggtgtttntctgnntttnncccnttcctgtatggggttccatagacgacaaaactggcaaacagacgtg

SEQ ID NO: 20919 - DNA, 1224 bp, Heterodera glycines
gagaaaaatgaatttacctcgtgacgtttaacttttttttctacacgttaaatctacttcaaattttgcataccaatagagaaaaattttctgcatcgaaaaattagaagatttttcaaaaataaggctcattaaaaagttattcaaaaaacaaattttcgaacgcccatatcttttttctaacgcatcaaatagcttagaatttgcttataaaaatattctcctcatcaaaagcgtttgaatgataccaagtttgtccaatttgttggcaaaaacctccaaagaataattttagaaaatggaccagggatgggccgaggtttcgcatttcgcctttcgcattttttggcgtttcgcatttcgctttttggcgcgaaaagcgacttttacacccctaagaattggattaaattcccataaaatttttcaaaattttacctttaaattggctaattttcagtgaaaaactgtttataaatgatcaaaatttccaattttttccccggcggcgcctatcggcaccgccgcgcccccaaaactcctattttttcttagaaaatggcccaaaatcgcaaaatttggtaatttgatgaaaaactgttctcagcggcgcgccaaaactcttatttctccttagaaaaattatataaaaatcacaaaatttgataattttttagtgaaaatctgtcaacaaattttaatcaaattttcaaaaattttcccggcggcgcctgccccctcttcccaaaaagtttttttggaaaaagcgcgcctcaaaaaagcgttttattgatttttaaatttggaataaaatttaaaaaaatgatttttgctttatgattttaactattaaaagttgtaaaaaaaaattcgcttttcgcatttcgcattttcgcatattttggcttttcgtatttcgcttttttttcatttcgcatttttcagtttcgcaaatttcgcttttcgcatttcgctttttatttttcaatttggcccatccctgcagtggacggacccacatgatgaccaccccttctccggttcccttctttttgtctcccctattgtgcacttactaatttttatttttttattagagcaaatgaaagaacatttttaaacgcgtcgcacatagttttcctatttttagactttaatttccgagcgcattcaagtggcctctagggccaacatgattgcgttctaggaaaactatgatttgac

SEQ ID NO: 20920 - DNA, 1152 bp, Heterodera glycines
ttatagacaaacccctcccaaaataaagtaaaacaaatttttctttaagtaattaaaaataaattttttaatttttttccccaaaatacttaaaaaaataataaagagcgaggaaaactttaaacttttcgcgaaaggacctagcatcttattttaaccaaataatttatttgttttattaatgtgtcatatctcgttaattttatagaaaataccattttttgtcgatccatgtcacagttctcattgtgaccgcatttttggtttcgaccagctgatggtagatgaccaaagtggattccggatggacaaaggtgaatttgtcgaaagtgatcgacatgtcacggtcgacaattggcttgaaaagccttccgcgctcaccatcacgctgggcgatctttatttttcaatataaataatttgataaatacgtgggttacaacaaaaagcaaaaaacaaaaacaaacaaaaaagaggtataaaaaccctcgattatgcattaaaaatagtcaaacaaaagttttctgaaagattttaaggtaaaaaatccagaaaaattattaggaaaaaaaactttcttgattatatttcaattataaagaatcgaataaggaaaattttaaatcaattttattgcgaaataaaaattaatttggggatcgactttagagatcatttttcaattcttagggggcatattttcgtttttattctattttaaaaaaatttttccgaaaaccattaaacaaaaacggcgtaaaaccataaggattcgtccttgggtgccaaggacgtccttggatttgggctctacgtcttggaaaattgaaggagttcttatttgcaagaatgcctctggaaatcagatagaaaaatatttaaatttctcggtgaaaatctattaaaaaaatagtcaaaatctcgaattttttcctccgctgcgcctatcgacagctccggaccccaaaattcctatttcttcttttaaaatggtcaaaaacgtttttaatgaagatctgtaaataaacttctttcttcccaaaatttttccccgcagagactatgggcatcgccgaaaaagtagtaatttgtccacaattttcattaattttttaaaataattcccattttcccacaaaaaaatttaattta

SEQ ID NO: 20921 - DNA, 2498 bp, Heterodera glycines
ctctagagtcgtttaatgtttgtagaagggagcaacaattaaattatctctttaagacaacgcacaacaaagataataatccaaaatggattttgtttctcaatgcaactaaaacttaaaatttttgatgtcatagatccttttagataaaaaacaaaaatttaattaaaccgaatgaaattttagtgatattttccaaacattttgatgaaggtatggggctgactttgtcgagcgttggcgggacaaatgaaaaattttagtggtattaattaattttctaattgagcaattcaaaaacccataagcattatcttgttcacttgttccaatgcttaccgatgggtccgtcggtttcttcggaaagacacgcgttcaaaaagccaatgattttctgcattatttcgtggtccatgcagattcaattatcttaagtgtttaaagaataggaagtttcctgcaataatatggcaaaaatatttttgaaaacgtccaaaaaagaatttttttctgttgtacatttatttttaaatgtattgagggttagaaaggcgccaacagcgtcacctcggaaattttttttttgaaaacctgggttatttgttatcgtgctgggtcgtttcgtaaaaagtgccactatgggcgtttcgtaaaagtgccaccttgggaatgtttcgtaaaagtgccactgtggtcgtttcgtaaaagtgccaagtcgtttcgtaaaagtgccaacttgggaatgtttcgtaaaggtgccactgtggtcgtttcgtaaaagtgccaactattttattcgattttgataacatataaaatgaatatataaaatatataatttatcaataacgacctagcaccatatattttaatgtattatttttgaataatataattggacctataattatatacacatcaggggtgtgatttgtctccaaaaagacgagagcgagactttggcgagagtcaccaaaaggacgagagcgagagttcagcgagaatccccaaaaagatgagagcgagagttaggcgtgagtacccaaaaagacgagagcaagagtttggcgagaggtgagagtcccaaaaatcacgagagttggcgagaggacgagagttgttcagtttttctgtagccttattttttattccaaaaaacttcattcataaataaaatcgtataatttgatcttatggtttaaaaaataaaagcttttcaatgttctccaccaataatttcttgcgcttattagtgatatttgaccagccgtcgaaaataatcgttcactctctctcagcagatgttgagggggacaaaaaatatttatgcgctataaatacagaattctgagtgtttatgcttcaaatgtgtggccaatgttgtcgttggtcttttgggcggaaaattccttttgtagtcacaatttttgcaaaaagcgattccggtttcctttttgaaataattccatattttcgacatggtcacaccttcgttaattttacaacgtgcaaaagcaataattaattaaattactgataatttatccaaaaataattgtgctctgattttaaaacatgaggtgataggcgagtgtcccaaaaatggcgagagatgagagttgtccacgcctgatacaaatgcatgttttttgttctgaactgtgatttaacgaaaatgccgtgcacggcggtcttattgccaattagacaatcgtcccaatttggcgccagaccaatcggacctgatccactcggcggtcggttcgccggcgcaatttaggtttgcactcagctgattcgatccactatcgcgtttttcggtcactttgttctatcatcgtagtgaataatggaggctgttttatctgtttgctttttgtctctcttctaaagcctttaatttcctcgctgatcactgcttggttttggcatgtgatcactggactcatactgaacattggcgcggcattgaacggacccattataaaatatgagacacacacatgataaaaacgagacaaaataaaacacgagtcacgagacgagacgcccctaaaaatacaagatacgagacatgagcacgagacggcctaaaaacacgagattacgagacacgagacgagcaacatccctggtaaaaataaagaaaatatttcggagcgatgcaaggaaattgctgaattcgtgaccacgacaccaacagcgggcctattagaattgtggcgttattgtaccggccttcggagctaacactcgaacagaaaaattttaattgccgaatgattgcttaaaaatttttaaaattccaatttcgaaaaaatagtgaccaaagaagtttcaaaatttttttatattactatactagggaatctgaaatgcatttccttattttttgcatgcttgttttggtcaaaaaagcaagaaaaaaaatatttttagcttagtttgaaccttaggaagaagccattttttctacatttattttccatatttgttgt

SEQ ID NO: 20922 - DNA, 925 bp, Heterodera glycines
aaatgtatgtatgttattcatcaccttcttccgagggtaatatgtattcataggaaagcggtggatgggctgacggattgtgtttgtaaatgtcgaaaatggcccttaagaaatcggccgcaaaaaaacagtatgaaaggcaaaaaaaaaggaaaaaaacgaaaagattttcaagcctagaagaattttattaagaaaaaacttcaaaaaattgacttttttgcaatttcatgttataacttttttggtaattgtccaatcgctaagcaatagcttagaaaaagcctctaaagtggaccctggattttgttggcaaagaaaaaatcatagcgccaaaaacttgtgctcgcgccgaaacgacctagtccaaatccaacattgttggtatcattcgaacgttctttatatgctttattagccatacaaaaagcaaaaagattttttggcttctgaaaaagtaacattgaaaaaatctcaaaatttcgactttttcacaattttcatgtatgacttttttggtattgtgtgaataatttttaattttgtggatgaatgaatcattattaattttgaaaatttttcgttggaattcgagttgtctcaacaacccctttgccgcttttttaaaagcatttgtatgtgtgaggcgccaacaaataaaacaaaaaacaaacaaagtgcaaaaacaaaatcgacgcacaaagtgaaataacggttgtgaacaaaatgggcaaaatgatatgatgatgaattctaattttctaagcgcttctcttcacacacattttttgatcaccgccaccaccggcggccgccactccgttacgtttttccccgtcgttcgtctccgcgtccatcgtcatggcgtcgaaaaccaaatatttcttcttcagcaacggctcccctcctccgccggcaccagcag

SEQ ID NO: 20923 - DNA, 1204 bp, Heterodera glycines
  misc_feature (93)..(93): n is a, c, g, or t
  misc_feature (120)..(120): n is a, c, g, or t
  misc_feature (1191)..(1191): n is a, c, g, or t
tgctgtcgttattgtttttgtgctccgccaccattagctggaccttcactttcggctgcgacaccaccattaatttcatcaccacccaccgcntgtcgttgttgttgttaccacccgtcnttgacgtcgtcgtcgttgtcatggtcactcttttcgtcgtcgtcaattttgtagagaatggtgtcaaattggatgaactgcttgggcttaaacaacacattgaacaaccaatgatttctgcttggagggggtacgataaggaaaatcaaaattcttggttaaaaattttttgattttcccttaaaaatgcgggttcggaggggtagtgcccaataaaaatcctttgggccctgcctaattttccattccatctttcggcacggcatccccacaaagtgtccaagccacgaaatgtccaagccacgaattgtccaagccacgaaattagagtgccacgggaccgggaccgggccgggaattcccggtcatccgaggtcccggttcccgggttttgaaaagctcaggtcccggtcccggtagggcaaccgggaaccgggaaaaacaagcactggtaagaatgggggtctgagattcctcatagttttttttaaattgatacatattttatcattttttaaatgaaaatcctaccaattgagcttaataatcgcaaaaaccaacctttttttgttgaaaatctgttaacaaattgcacccaaattttcaaaatttcccccggcggcgcctatcggcaccgccggaccccttctttcccaaaagttttttgaaaaagcgctccgaaaaaaagtgatgtgaaaatcaaatctgaatttctattaatattcgatgatttagtccaaaaatgattaattgtttgaaataattgaagaaaatttgtttgaaaattttcattaatttaatttattataaaaaaccaaataattttgtattattttcacttgatataaattaaaatttgaattttttttttaaatttttaaaatttttttgaatttttaaaatttcccggttggtcccggttcccggtttttctttcggtcccggtcccgaaaaaaaatcgaggtcccggtcccggcttctcaggtcccggcaagtcccggttttggcaaaaattcccggtcccgtggcactctagttttcaaggtcgctgatcacgaatctgacctccanaaaaattataaaa

SEQ ID NO: 20924 - DNA, 2555 bp, Heterodera glycines
aacccaaagtaaaaattttttttgaaattttaagcaatttctcaagcctccgaagccaagggtctggctacgctctcgggagattaatatatttttgacatttttattcatatttgtttaaatttaaaaaatgcataaagtactttgatttaatgtcaataggaattttggatttcgtttatttttaaccaattttggtgcatttttgacagttttttatttttaaattttcaattaggcttaaagctgaaatggctaagaactaaaaattagaaatcgacggttattttaccccgccgcctgcgcctcctcccaaggcgccgcttcctcccccgccaccgccaagaaatcctccgattaattcctgggggaataaaaattagatatgttaaatttaaaaaaaaaattgttcattaccccggccatatctgccaactgattgccactgcctccgccgccctgctgcggctgattatcaccagaatttgctcctcctccgccgccacctccgagaagcccactgataagttggtccattattgaaattaaaatttaaaaagctaatagaaaaataaaaccaaaatataagagcgagaaataattcaaaaaataacaaaaagcgacaaaaataattcataggaatctgtttttaggtgttaaaagtgctggtaatttggtttctagtgtaaaagcaaaaaacatttctttttgtttttcaagggtaaaaagtatttattctgatcacggacggatctgagctcaggtttttcaaaaaatgcataaagatacaaagttagaaatgtcatagttattattctaatggtttaaattttaaaaatttgaagtttgttgaattgatattttagcaaaatgaaaaaaaattatataaatattttaaaagaatgaataaatgtatttacaaattggttttgtcattaaattcttttgaacgttcacatttcgcattatgagtcatttatatgaaaagaaagggaaacgagaagcatttgacgaatcaaataaattaaataaatatttaatgaaacgaattataaattaattgaaaatagaaataattcttaagaaaaatgaaatttaaaaatttcaaaccaccaatcttcaccaatataaagaagaagagagtggtggggaaaaggacggagaatttatgagaatgggcggagggattggtgctcaatttgagtgcgtactttgcatcgatttttcagcacaagcggtaaaagcgtaaattattttgttccgtttgatcgaattatttccaatgctttaataaagaggagggcagggagaaatggcgaataataacaaaaaaaaagtcgggtcggaattcgggacgagaaaatgtccggtttcgggatgagcggcaaccctggaaaaatagaacttgacaaagtttggggggtcaaacactaatatatctttattattaaaaattttacctaaaaattaattaaaattacttagtttttcttaaacgcgtcccataatgtttacagttgcgagaaaatttgagggaataagagaaggaaagagaagaggaagaggacacgaattaattaggcaattaaaaataaaataaaaccagttgccatagaggaggagaagggcagactgattcaaagaatgaatcattaggacggaacttttaattactttgtttgttgacgatcaaaatttttttgttatttttataatttttctcaaatgtttttatattaaaaaactcaaaaaataaattcacaaaaaataattgttcaactgaaacgttggcaaaaaaaaaaaaaaaaaattcattttatttctgaaaattcatatatttttaattttcatttgcccatttctatttaagatagttttaaaatcttcgaacaataattagtcctcataatacaccgagtcaatttgggttctccgttcaaaaattttgcattttaactcaatggtctgtcagttcgtctcacaattcgcaggcgccgaaatgtctgcgccgaaaagacctttccctcgtttcgtcccccaaatttatttaaattttagattttcttgtttcatttttcttttggtttcatttttaagcattctctgggacgtcatttgcattctttatatccaaccaaacgtactcacgggcaatttggcatcaacccaaacatggccgtcaacagtggagcaagccgttggttcagcacgcgttgagtgaatcgtcaacttcttcactgcagcaaggcacagccaatttcataaaaatgaacatttttttttaatttaagtccgtaattggaaaaagcccattgtccattcggcactaaatcttgaattctagcttcataaaggccatgttttcttgaaattcccttttacccctgacctttcttctctttctcttttttttgtttccgtttcgttttcactttgctttttctgtcctctgtgataaattatttttttggcacgcaatcgttccatcgatatctcaaacgacaaaagtgtcgcaaaaggcgaggattctcagggtgtggaattggttcctattt

SEQ ID NO: 20925 - DNA, 2674 bp, Heterodera glycines
taaagaagctttgggagttttcggatgtgtgacgtagaagtcaagaaaaagaaaaatcattagaaagtctaatcaatttattaaaaaaattttatttagggagatataaacttaagattaaagtgttattgaaaagaattccaatttatattcatgtcaatttgatagaaaataaacccatatttttcgggcaaataattccttttaaataaaacgctttctaatattaaatgatttaaaaatactttatccaacgagaaaaaataattaaagaatgaaattaattaaactggaaaattaacaaatttaacaataaaaaaatatgaaaataaatgaaattcatttataaaaatagcaaaatttaacaggaatagcaacatattaaataatattatgggattccattcgaaatttgaattctaatagggaaaacctgacgctatcgaatgaaattgaatgtcctgagtcaccgtagggtcctttgcatccctaattcctcattaatacagtaagcaacagtacgcctttaatacatgataaataaagttggttacaactaaaaatttcttaaaataaaattacttttagttaagagtaactatttattcttaaaatcactcggtagcaattaattaattatgagttatttaaaaaatttcgattacaaaaaactaaattatagcaaaaatactcaaaaaaaaagttctttagtttttaggtctatattttttttaaattaaggaatttgttgaaaaattttttatttgattgttttgaataaaatattgattttcttaatttttggtgtaattataaattttacatcctggagtttttcaataatatgcccaaacatcactcgaacactatataagcaaatttctcaaaattaataacacaaaaaatcataaaataaataaaaattcacttggattccatttataagaatttaaaatgcttttaagaacctttagaattaaaaaaattcaaaaaataaatttaaaaaacaagaaaaaatttttaaatttatattttatgggataaatatatgaataaataaaatataaaataatatttggaataatatggtaggttttaagaaccaaacttattttctcctataatatgattgaacaaaaaaattgagaatttcttctataacctcaataaattggaatggaaaattagtaaaaattaattaattaaaaataataaaaaaatcaacaatttttttaatataaaattcatataaaatatatataataactcatatattagtagtttattacttatttgaaacgcggttaaaaaaataataaaaattattccatgaaaatctaaatagctccaaaccatttgcgtgtcatgtttttaaatggcataaattccatgttttatataaaaagcaatcaatcaatgtctacccgcaaatgccacactatgggtcaattacattaatgtatctttgacgcataatttctattttgttgaaaattgagtcttcaaattttacgtcgcgcaaatttattttttgaagaaaattgaatttagagtggagatttccgacgagcggtagggcaggaggcacaaaagttagtggtggttaggactgtgcgcaaatgctgaaaattgttatgattggtggtacagttgtatcgtcagttgcctatcatcactcaattggttaggagtcgcttagcttgccagccttaggtcatatgggccttggcacttcaattcccaaaattttttttgtaccttttgcaagtgtacgactccgccttccggaaattattttttgatcagaccaaaacccggacctgtacagacacggagactcagttaatttgtttttcccacttcagtaccagttgaataccaggccagggtttgcactgagcgagggagtgccagcgaacttattatagagctcaatgagttggatttttccagtttttaaaattgcgaaaattttcaaaatttctcgagctaggcctaaaagtaggtttttcagtttctgaattttaggattttttaacgatttttctcgggaaaacggagagcagttccaaaaaatcgtttttggagttctatcgactggtatttttttcgaaaaaatttcggtttttttccggaaatagaaataaattttggcctaagcggtacatttgagtcccgggcccataactcgtcatgagtcggttttagccaaaaattgccttagaccaaaattgtagagcttttaaagctctatcaatggtgtgccaatgtcggaaagatttcaaaatttttcgagctaggccccctagaaattttcaacaaatttttttgggccaaaatgggggtgaaaaatatctttctggggtaaattaggatcctgagcacgaatatgctgtttattttcagtttcggaaattttggcattttttaaaaattcaaaaatattttccaatttttttaccctcaggtattttggataatatttgaaaattaataactcggtgatggtttcatcgattttattataataaagctttaaaaatagagaaaaataaggagaattttatgagatttatttgggatttctatcttctaaagaaaaaagttattccagaatttctggaaattttcgatttatcagaaaaaaattcgtaactgccttctgaaaagttat

SEQ ID NO: 20926 - DNA, 1244 bp, Heterodera glycines
attaaataaaatcattagccaaattactttgaatttttaaatatttggaagttcattataaatggactaaaattaaaataacctaacttatattaaaaatggaaaatttttttatgaaaatgtatccgcttcatctcaagctaaattacttgggcctaggcctatgcttaggctttattttgtaaaatttataggtgaatttaagcttcaaaatttaaaaaattcaagtaacctggctaatgagtttatttaatatatggaaaattttaattatttttattcttgatccaaaaaaacttctaaatgaattgtatttaagcatcaatttaattaaattttaacatattaaaacaaaaaaaaaatgataaaaaatcataggaaaaatcagatttttgatttttgcactttttgtgaagtggccaaccacgggatcaactcattctcactgatcaaaattgatgagcagatcataaatggcgtagcacgtagcagcatagaatgagccaaaaaaagcagatagcttggcattcgcataattcaagtgattaaaatttttaaatttaatattcttaaacggtgtatgtcttactgtgttgggagtgccacggcacagactcggtccaacccggtgcatgccattgtcattgggccaatcgccactcacagcagggccaatcagaaacaaaaaacagtgtaaacagcaaaataaatgacaaaaaaaaattaatataataatagccatgtcaaaatcacggcaatttactttccatcgcaatcaaaatcttgaaaaagctgcgaatattccgaaacgaaaatttaacaaaaattgaaaggaaaattagttgtgtttgtaagttttgagtgcaagatttcaggccttgaaccgcatttcattcaaaaattctcgaaaaacaataaatcaactttaaaaattttatttctttatacatttacttatctttacgcgagatttgcatattctaaaacaaaattacaaaatataatcaaattttttgcttaaaggaattctttttatttcaatcaatgggaaaaatgactttttcatttttcatttattccatttattatattgtgtatattaatcttaataagattttttcttgttttttattaatgcttaactttttattgcttttattggcaataaatgcgactaactttgatgagattgcaatggaagaatccattggagttgatcaaaccgacaaacagcagcagaacaa

SEQ ID NO: 20927 - DNA, 2692 bp, Heterodera glycines
  misc_feature (1582)..(1582): n is a, c, g, or t
  misc_feature (1585)..(1585): n is a, c, g, or t
  misc_feature (1612)..(1612): n is a, c, g, or t
  misc_feature (2680)..(2681): n is a, c, g, or t
ttgctcgcggaccatttgtttcgctagaaatatggttccaaaaagaggagatagccatttttctggcaatagccgagacctttgagagttctatgaaaaattagctggcagttgcttaccgctccgcgtctcttgctcgcgagcgtttgttctctagaaatttgttccaaaaaagagatagccatttttatggcataaccgagaactttggaaattatatgaaaaattgactggcagttgcttcacgctccgccggctcttgctcgcgagcatttgttcgctagaaatttgttacaaaaaagagatagccatttttatggcatcgccgagaactttggaaattctttgaaaaattaactggcagttgcttaccgctcctcggctctttctcgcgagcatttgttcgctagaaagttgttccaaaaaagagatagccagttttctggcatacccgagaacttaggaaattctttgaaaaattatatgtcagtagcgacagactacgcggcgcctgctctcgagcatttgatcggggtaaatgggttgccaaagagagatagcaattaaataacaataaacgagtaatttgtaagttctctgaatgaggaattggcagatggagtcagctcggtgaatcttgctcacaggcattggtgggaaagtaccaggtgtcaccacccatttaaaaattccaccccatttaaaaatggcacttttactgcttccattgctcgcttatgtggctgctcaggacggcatcaaaaagcagcaacaaaataatggtggccaaagttttaccggcagcgtgaacaatgccgaaattcgtcgggcagtcaatggcactgaggtggaaaatgccaaaaaaaaaaatatgcatctaaatattttaataattattttttctaaaagtttagtttatgcttgagtgccctcgtgccgcgtatttggtccgtactcatatggcacccgattttgagcacccgcaactggtgagaaggttggattggcttcacgacggtgcactggttgccagctatcagcaggtgataagaaaatttaattataaattcgagaaaacgaaaaaaattaccaaaaaaattaaataaaaaatttatttttaaaatcgagaaaacgaaaaaaaattacccaaaaattaaaataataaaaaagttttttttttgtaagaaatatgctaaaaaattttgaatattcacttttttatttttttgaattattctttttaattaaattttaaactaaaccaatataagtaaaaattgcaattttttgttaaaacttttttaaaatttttttttaattatttccaaccctaaaataaatttaaaaaaaaaaattttttctatattttttggactagaaaacaaaattaaggatttttttttaaatgatgaacccattttttcaaaattcatgcattttcccgcctattttcttccaatttccttcgttttttgttttcccgtcttgtgccatggcattgagttttcccattccccacacacttatacaaacacacaataatattgtggtacaatgaagggcaatgcaacacaacccaacncanaatttgcatgccaatgccaacaaccanttcatcggttggggtgatgaaatttgagctgctgggacataattttttgaatattgggataaattgtgagttggagaataatttgatatgtgaaaaaaagggttttttgaagaaatattttagaaaaaatttccgattaaaaataaattttttgcttgaaaatctaagggattaaagaagaaaagagaagcaataaatagttatagaaatttttaaaaaatttagccaaaaacttttttaaagaaagaagggttcaggaaaattcgaatattttaaatgcatttgaatcgaaatcagtagttttttttaaattttataaaataattaaatttataaaattatttatatttagcattttattattaatctttagaaagtttgaaattcgataataaaaaattccgtctattttcgatttttatagctaaatccatgcaattgtttcaataaaattttttttattaataaaaactttttgtttctaaatatttttcaaacttattccaatgctattttatccaataattgccattttaatagtacataattgtcgtcaaaatgtcgcaatttttattttggccccaccaaattttgtgccattttatcgtcttaaatggcacatccaaaattctttttttcccactccactttaccgccgccaatgtattgaaggactttgcaataatttttatatttgttgccaaccgtggcggctggcacacttatttgggcgccaaaacgaaaatggttatgccacgtaatggaaagagggaccaataaaagttgataaacaaacttaaaattggcttacggggaaagtgccttggaaattttacgaaaaaaaaaaatttaatttgaaaataatttttgaaaaatcctgttttggcattttcccaaaaattttggtaatttcgggttctatttttttccatagtgtgtcaaattatcgactttttgtttactcttagtcctaattattttgctattcaattggcaattaaaaatttgaaagtctcataacgttgaattctaaaatattaaaattttaacttcaataaagacctgccnnggccatgcaag

SEQ ID NO: 20928 - DNA, 1462 bp, Heterodera glycines
  misc_feature (70)..(70): n is a, c, g, or t
  misc_feature (74)..(74): n is a, c, g, or t
  misc_feature (82)..(82): n is a, c, g, or t
  misc_feature (84)..(84): n is a, c, g, or t
  misc_feature (86)..(87): n is a, c, g, or t
  misc_feature (112)..(114): n is a, c, g, or t
  misc_feature (117)..(117): n is a, c, g, or t
  misc_feature (121)..(121): n is a, c, g, or t
  misc_feature (127)..(127): n is a, c, g, or t
  misc_feature (153)..(153): n is a, c, g, or t
  misc_feature (167)..(167): n is a, c, g, or t
  misc_feature (182)..(182): n is a, c, g, or t
  misc_feature (191)..(191): n is a, c, g, or t
  misc_feature (193)..(196): n is a, c, g, or t
  misc_feature (205)..(205): n is a, c, g, or t
  misc_feature (207)..(207): n is a, c, g, or t
  misc_feature (209)..(209): n is a, c, g, or t
  misc_feature (217)..(217): n is a, c, g, or t
  misc_feature (222)..(223): n is a, c, g, or t
  misc_feature (227)..(228): n is a, c, g, or t
  misc_feature (231)..(231): n is a, c, g, or t
  misc_feature (248)..(248): n is a, c, g, or t
  misc_feature (253)..(253): n is a, c, g, or t
  misc_feature (256)..(256): n is a, c, g, or t
  misc_feature (259)..(259): n is a, c, g, or t
  misc_feature (277)..(277): n is a, c, g, or t
  misc_feature (288)..(288): n is a, c, g, or t
  misc_feature (294)..(295): n is a, c, g, or t
  misc_feature (297)..(298): n is a, c, g, or t
  misc_feature (304)..(305): n is a, c, g, or t
  misc_feature (307)..(307): n is a, c, g, or t
  misc_feature (314)..(315): n is a, c, g, or t
  misc_feature (321)..(322): n is a, c, g, or t
  misc_feature (324)..(326): n is a, c, g, or t
  misc_feature (330)..(331): n is a, c, g, or t
  misc_feature (336)..(336): n is a, c, g, or t
  misc_feature (339)..(339): n is a, c, g, or t
  misc_feature (341)..(341): n is a, c, g, or t
  misc_feature (345)..(345): n is a, c, g, or t
  misc_feature (353)..(353): n is a, c, g, or t
  misc_feature (359)..(359): n is a, c, g, or t
  misc_feature (367)..(367): n is a, c, g, or t
  misc_feature (371)..(371): n is a, c, g, or t
  misc_feature (373)..(373): n is a, c, g, or t
  misc_feature (375)..(376): n is a, c, g, or t
  misc_feature (381)..(382): n is a, c, g, or t
  misc_feature (384)..(384): n is a, c, g, or t
  misc_feature (387)..(387): n is a, c, g, or t
  misc_feature (395)..(396): n is a, c, g, or t
  misc_feature (408)..(408): n is a, c, g, or t
  misc_feature (411)..(411): n is a, c, g, or t
  misc_feature (417)..(418): n is a, c, g, or t
  misc_feature (423)..(424): n is a, c, g, or t
  misc_feature (430)..(430): n is a, c, g, or t
  misc_feature (439)..(439): n is a, c, g, or t
  misc_feature (447)..(447): n is a, c, g, or t
  misc_feature (458)..(460): n is a, c, g, or t
  misc_feature (462)..(462): n is a, c, g, or t
  misc_feature (470)..(472): n is a, c, g, or t
  misc_feature (474)..(475): n is a, c, g, or t
  misc_feature (477)..(477): n is a, c, g, or t
  misc_feature (480)..(484): n is a, c, g, or t
ccggggacctctagagtctcataattttgcgttgattgatggtttgttgtactttctttaagagaaaaangagnccattcgncngnncgaggccgaccctttcagaaaagannnganaagncaacgncacgaaggaaaaggcgcagggcaccnaagaggcaaaaagncacggagacagcccncagaaaganannnncggccaaanangncgagggancgcgnnaaanncgngacgagccgcagaaccngcgcncanacncgcaaaccacgagggaangaaccacccangcaaanngnnaaaagnncngaaccgnnggaacnngnnngccnngacanccncncaancggaccancggaancacaaaancgcnananncccgnnancanagaccacnngaccaaagaggnggncacggnnccggnnccaaanaaaaacagngaaacagncgcaagggcannngncaacgagnnngnncnaannnnnggcactccaaaacgcatccacagcgaccgaggaggcgaatttgtaacgaaacattgacagaaattacaaaaatgcttggcgtgaaaagacggtaacgtcaggttacgaccctcaagcaaatggcgtaaatgaaagggcgaaccaaacaattttgaacatgttacggcgatcaactggctcaaattggagttgggatgagcgacttccgtttataacattttgctacaatactacaccctctgaggtcaccggattttcgccgtacaaaatgctatttggaaaaccagctaattttcccggagaccatgacataaattggcagaaaaaccctgcctacacaatcgaccaagaaacgtatttgcaaattttccgcgaaaacataaaagacatcatcaatgttgctaaaaaaactgcagaaaattcaagagaaaagtcgaaaatgtattacgacaaacgaccaaatgtgacagaaaacaaatttggccaaggggaccactgtatggtgatattcccaggctcaaacagtcgttcaccgcataaaaagctgatgtggaacaattttggcccatacaaaataattgaaatttcaaaatcctcagcaaaattggttcccgtcgataaaaagaatgcagagccaatttcagtgcctttggaacgtttagtccgagtaccaccaggattaccaaacatttcgaccctcccaaaaggaagaaatgtctatagaaatgtcctcaacgcattgcttacacctaatttgaaattgacagaaaaggagccgaaaaaacggggaaataatggagaaattggtcgaactgacaaaaaatcgataattcaattagggacaattgaatttttaggcggcgatatggaattggacggagaaggcaattacgcactttcatggtcatcgatttgttgtggaaagggtcacgaagtgtgcaccagaatgagatgcacggatctcgacccggtccttga

SEQ ID NO: 20929 - DNA, 1335 bp, Heterodera glycines
gtagaccaaattatggaacagtgcgcccgactcaaacaaatgtgcaaccgtttctgcactgctcatgtgttttggatcccaccgccatacattcgacaaaaggacaacgaatttggcgaattcatcactcgtttgacacaaatggtcccggaatggttcgtgggcgtgacatcaaatgggagaagcattttggagattttccgccatggagacacattcgacacaacgcgcgtggcagccgacggatggatgacaccggagggcgtgaagactttggctgtttgggtccaatcccaaattccttcttttcccggcaacaaagagcttggaattcgttcgcttcgttctgctgttcatgtcgtccgccaaaaccaacgtgggggtttgggtccaggcgaccgacctccatcacgtgccttgtctaatcgatcagggttgggtcgagacgaccgccttgtgtccggtccttacatgcgcatgcatccttaccgcggccacagctccaactcttccttctctggtgcgggtggacgtcgtttcgtgcgcggctttcgtcggcagtgagctctacacccaaacgaacaccccttttgacagtcgaatgcgcgggtttctaattgccacggcagggacgcctctctttagcgtttggggatgtgttaattatttaaatttgtgcctatttttatttgttttggcgttttgacttttgatatttgaccttcttttattcattctcatttattcattcatgttttattctcctcaattttgtccttttttggtctcctccggaaaatttggttttaatcgtaattgattgtttctcatctcgtcttccgactttacttaattttgtttggtgtgattttattaaagttgtaagcctatttggtcgattgattgtgtttgatcgtcgtgcggtggactcaaaaaaatattacgcattttctttaattgtccattttccatttcccctttccccccaattttcctcttctctctccttgacccatatgtattattgttatttcccacttcaccttcttctcttctttctcttcttcttccttaggcttcactgcaccatttttcggacaatttccttttcccattttttgtaatgaatccaccgcaaaacgcaaaagaaattccacggctccgtcctctccattttttgttgttgcctccgtcgaagtaaatccaattattggcaatttctagcaaatggccgaatgccattgagagcataaaaaagatagtgccaaagaaattgcgagggtaaaaacataataaaagaagtcccaaatttgccataaaaattcggattctcct

SEQ ID NO: 20930 - DNA, 1088 bp, Heterodera glycines
tattttattgagacaaaagttcaaacaatatgctccgtcttaaaattataaatttatgatttttttatccacctcacttaattcccatgggcaatcgacctgaaattttttaccaagcgtataatgtgatcttttatcggttgtacgaaataatacaaaaaaaaaactgacagaacttgtcaaaaataataaaatttaaaatttaaaaagaggaatttttatcgctaaaatttttccacaaatttttctccgtttgttaaaaaaataaactggaaataaattcgatggaatgatggaagtgatgtaaattgctccatttcctccccatcccaaaatttacataaaattgccaaaagagaaacgggggaggggcggaaattaagccaataaagtccccccccccttgggtccctgggtcaatcccgttaaaagaggccagccaacacgatttgaaattctttcttgtttgaattttctttgaaaatgatttttttttctttattgaaattagatcggattttcccaaaataattaaattttcttgtatttttgttgagaaatttttcaaaagttgtcggaatagtggcaaaaatagtgacgaaacgccaaaatagtggcaaaaaactattttagtggctaacttccaaaataagcatttctcgtcgaaataaagccgcagaaaaaatagttaaaaacctaaaaatactccctacttatgactttgttagagttgtgtttaaaaagcgaataggtataatgttcctgatttcatttgttttcctcgatccatatttttttttcactaaactaatgttttttttatttaaaaatgcctgaatctacgggccgcccatgcccgatctgttgcctattcccgacgactacaaatcgaatcgtgaaaatgcaaatggtaaagcagcttgggattcatttgggtttttggtaaagggttatgaaattaagagcgattttatttaaaaaagggggaaactcaaaaaaaataattcagtggtcataaaacaggaaaagtaccttaattattaaaacctacgggattttatgggttttaataatagaaaatctactaa

SEQ ID NO: 20931 - DNA, 1365 bp, Heterodera glycines
  misc_feature (149)..(149): n is a, c, g, or t
ttaaccaagtctcatttatcaaaattatttgatgttatttgtctaaattagatattctaaatcagctattttgtttgcgattgaacgggcatttattaatatggaataatccagggcattttgctaattgctttttctgagtttaaatntagacttttaggtggtttgctcagtagcccctagtggttattcgggaccagagcgtttgggcccccgtttttgggccccggggtcgtttgggccccaacccaaaaatagaaaaatgtgcttttttaaaaattaagattctaaaaactaagcctgagggatccctcgccacttgcataagttaggtttaattagcattcgctcattttttacaattttacttattccaaatcctattattttctaatagttaaccaatttgttgtacattctgatttggacatttttcagggcgccttcaattgccgacacccgtcgatttttcacttcattgacgtgctacgtcgtgagcagaagacaacagaagtcaaatacgcgtcattcattgccggggaggagccaccaccaaatagcgaaagtttttggcgacagatgaacgaattcttaatttggtgcgcctttacgtcccgatgaatgcaggcaacatcgaccatgatcacaattaccaccaaaatcgcaatcaatttcacattattttggagtttctccggtgaatttctcgtaactatcgaatgaaaccgtgattttttgttttattgtccaaattaccttatgaaaccgtgaatttctgttaatttttacatgttttattgttaaaattattgttgaatttatttttaaaatctttattttacatttttatgctgaaatttaaaaagttgtttttactgtgatttttcatttttctgtacttggggcccaaacgaccctggggcccaaaaacgagggcccaaacgcgggggcccaaaaactcggggccccaacgcgccccccccggttctaagaatttagccattaatgcatattttcccttttaattccgagttgagcgcatttgtttttttcaaaaggaatgactgaaattgccgacgacgatttgcctgggccggggccgacgcccgccgactatgcttcttcgcgcactccaaattctgaacaaagaaaccgaaaaagaagtcaaagaagaagggaggattccccagctggctcaaatcagtcttctgctacttttagtccgatttgatagacgttgttaggtctgagcaaaaagctcattattgttgcactgtgttgttgtgaataaaacattaaaaaatagacatccgaagaaattgatttattgtttgttgaacaatttggtcaccaccatgagtggtt

SEQ ID NO: 20932 - DNA, 2238 bp, Heterodera glycines
  misc_feature (198)..(199): n is a, c, g, or t
  misc_feature (205)..(205): n is a, c, g, or t
  misc_feature (456)..(456): n is a, c, g, or t
atagtgaatggttggatttggatagagtgccacggacccgggaattttgggcaaaaccgggaccggggacttgccgggacctgagaagccgggaccgggacctcgatttttcttcgggaccgggaccgggacctgagcttttcaaaatccgggaccgggacctcggatgaccgggaattcccggcccggtcccggtcnnccgtgngcattctagctttggatgacaaagaaaaaagttatagtccggggcaaaaacgtttcggggcccaactgacggagtccgccataaaactaatttttatattgcaaaaccaaacatcataataataattagagcccggaattttgaaagtaccgggaccgggcccgggaccgggcttcgaaaattgaccggggcgggccgcccgttcaaaaaaagcccgttttaccgggcgtcccgggcccggtccaaaattnttgccgggcgcccgtacgggaccgggcttttttcaaaatttttggaattttgaaattcgaaaaaattttataatcctttattttagcttagaaatgtcaagccattgtaaatcgaccttttttactcttcaaaagaattttaaggtgtattttttcaaaaagattttgacgacattggggggggggggtccggcagtgccgacagggccgccgggtaaatttttgaaaatttgagtttggtttgttaacagatttacacgaaaaaatgacaaaactttgctattttgagctacattttagaaaaaaatttagctttttgtactaggcgacgctgaagaaaaactttgacttttaatgaaatttattaagaaaatttttggtttttcatgaaatttgaaattttttttttgtaaaaagaaagttatgaaaatgttgttcaatttcatatggattttggggtctttttaacagttgaaattgcccaaaaatttcaaaaatccaaagttctatcttgaaatttttgaattaaagacatttcgccaaaataattatttaaattcaattttgggcagtttcgctggcggaatttaagcccgttttagcccggtcaaattgaccgggcccgggaccgggcttcgaaaattgaccggggcgggccgcccgttcaaaaaacgcccgttttaccgggcgtcccgggcccgtttttttccaaaaaaaaacggggccgggaccgggacgcccggtaaaagcccgccgggcccgtccgggctctagaaataattaattttcaattctaaattaaatgaataatttcatatgaataaattattaatttccaaattattgcctctttaccatttcatcacttgccgcgtttgctcggatttgtgcataatcacaaagtttgtctcgaactgtggcgggtcggttttgatgatgggcttataagttccaatcagttcgtatgttctgttcggctcaaaattggtgtacattggcaaaaattcgtacattcctgggaatatggggtgaattacaaagtaaggccattgaaaatgttttttttaccaggatgagttgacatattcattgtgtggagagcaactaaaaaatgataattagtttataattcactcattaactttaaaaggtcaattcatttcactcacagcttgggatttgcacagtgccaatttttccgttttgcatcggttcaaaaaatcgtttgaaatcatttttacggaaaaccactgaagtgtcaagccaaaccacagtgtcatactccaataaaacgtgctttaccattttaacgaatcattttaaattcaaaatttaaaaataattaccgcccacagaaaaattttccacgcgtaacttttggggtggcgaacccgtccttccaccatttgaccgaaatcgaaaattcgccattcgaaattgcacaccgaatccaattcattcatctgcataaagatggtttaaattagggttatgccccgagccctgcgggggcaaaagtcgggggtcggggacctcggggggcgacatgtcgggggtcgggtcgggggggagctcaattgtcgggggttggggaccccggtcgggggatgaccaaatttatattttaaccaaaaaataataatttttctttttcaatgctagtaaataaagtcttcaaaactcaaaaatcgtctttttctttactttcctcatctgattcaaattcatttgttggtgccagtaaaagtgcgtccaaattggccttcacaatcaaaatttggc

SEQ ID NO: 20933 - DNA, 1339 bp, Heterodera glycines
gtctgtcgatcacttggattgcccctcaagggcttggttgacacccaaaaccttcggctcatccaccaatcgatcgtgcagttgttgaaacgtaggtgatcagtgagcgctcgtccggtgtgtccacctcgcacacatcctccggatcgagcagttcggctacgccgaactccgactcgaaggcgtcaaaggcattccggagccgatccaacggcttctgggcactgatctggaaaaaaaagttgaagctaatttaatgatggaaaagattataaattttttttgaaaatattgggttcaaaaaaatttcaaaaaatttgaaataaatgccaaaattcggcctttaactctaaaatttgtggcactaaaattttagaaaaaaataattaaatcccattcattttttatatagatcagtcagattacctcttcccagttgatcagcccgggacgataaaagtgcagaagggcacagaatgccaacccgtccttccaactgccggaaaagttggcaacattgacgccggggtaaccggacgtaacatggcgggcccattggagcaatgcttcacgggcagtcagcaatgccaagtgagaggttgtagcagtaacagaagcagcgatagatgcagcattagcttgtgaagtgccgttgttggtctgttgagtgatcaaagggatgggtgggaaatagagtggtgaatgaagagttgaaagagaaaatgagagaggaagagagagggtgactcgagaaagagatgaagacttgagagagtgaaaggggaaaaagataaagaaaaaagagagaaagaaatggagagaaatcgagaaatcgcgcgcggctaaaaatcgcttggcatatgccaatttttctcgccgagatttcaaaatttttaatgctaattaggttcaaattaactacgttgctaattagaggatcattagccaacacacacgatccttaccctctcaatggccagcccgttcgcgtaggaagcgcccccttcaacaatccgcgaccgcgacccgtcccgcacgagtgctgccgcggacccctctcggaccaagccccgctgcttggcacccttctgcattttgcgctcaaaatgctcccgctgctcccagctggacgactcagaaaagccgtgcgcgcctgtcgccgcgtcgtagaagcgttgctgttccgtgtacgctcctccaccgcctccgccaccagcagcaccagcgccggtcgcgcctggcgcggcgtagccgtttcggtactcgcccgacatgccgccacggctgcgactgcgctcttggaaatccgcatcacgccgaatgtgctgctgcgagccgt

SEQ ID NO: 20934 - DNA, 1328 bp, Heterodera glycines
gggggaaggggagagggagaagccctacgcgaaagaaacaacccccagcagccagcggagggaagttaattagatcagtcagtgctaattaattgtgtgtggcccgggggctgaatgtgatctatttagtgaatttgtaaaaagataattaatttgacgacacaaaatttgtttcatggcgaaggaaaatgcttcaggtgccccccatccttggaggaaaatggcttggccatacattgcaataatcagaattatcagggtgatcggaaattttaattacattttcaagggctgtataatagtgagtttcaaaacagatggctgaagaataatcaaaagttgatcaggaaatttcaaagtgttaaggaacagtcaaagtgatcgaggcaatacaaaatagttaaagtgatcgtgacccaaaacattcaatggcccaatcagaaacagtcaaaatgatccgaaccagtcagaagagcattggccataattaattaacgacagagtcatttccatgggacgataggcacccagccatccatgaacaaacaatagcacaagcaagaattagtaagagcatcagcaacatggcttgtactgcattagcatggttgggttggccgccgtttccccccccccccccgcgggcacattcaattctttgtcccttaattgtcaatgatttaatgtgggccatcggtggggggaggggcaaattttgggtgaacaaaaaagcaccacagcagtgggacatgggattgggcgaggagacgggttggctttgtgcttctgtgaatgcaaaaaaataatgaacaacggcggctccgttaattgatttccgctcaattgagtaccagctatttggacccatcagataaatttaccgggtcaaacaaacttattcaattttggcaacttttcaaagtccattaacagacaattaaaagtaattaaataaaaacctatgatattttttttatacctatatatatatttttaagttgcaagcatttataatttatagtccaatgaatcacatattttaattttttggttacagaagaacttgtgcttatgaaaaattagtggccgtttaaaaacagtctggcactcaatcgcgcgggactcaattggcccccagccgcccgggtggagggatggacccaacatggccctgttactcacctcccccgtgttgatgatttgatggcggtgagatggggggaaggtttttaacccttttgaggggggtaaggagcatcccgctcgccccctcgcctaaatcgacaggatgcgcaatattaggaaggggaaggaaggagagattccga

SEQ ID NO: 20935 - DNA, 1396 bp, Heterodera glycines
tgccttgagtacttttggccataactttgctcaaacccccaccgcgccctcacgtttgggccacaaataaaaaatacaacttaattttaaagggagtatgcgttgacttttttttttattaacaaaacattttaaatgttatttttatattttttgttttaatgtttattaaagaataaaaatattcttctgtatcgtatgcaacatcaaattgacaccaaacaacatcaagtgaattcgccacaagctctgtccatgaatcttaacaacttttgagacaacaaagttatcggaatcttaaataaggaaaaacaaatatctaaatatatttagctacaaaaacaaatgaataatgaaccactccaatcgattctacaaaaattttgtttaaattttctagtccacaacatactctgtgggttactgatctcctaacataatttttgatgtaaatctttattttcttaaaaatggctcatatcgcaagcatgatgcgtcgctgttgaactccctcactcaaatatcgtgccgccgatgcgggaattctttgactcttacaggttacaatgtatcaacaacatcaacattaaccctgctcaccgatatgatcacaattaccatgccaatgtcaatgttaatcccgataactttatcaaatttctcgttggcatttctcgaaattatgaaatgcgcccgtaatcatttttcaatgttttgtttttttgttggaaatacattgataaatttgttttaatattataaatatttgtcgaaaaaaaacagttttttctcagctggtcaatttataaatttggcatcattcgaatgctttatatgtctagaagcttttgataagctatttctacgcgattgaacagcttataaaaaagttaaacatgaatactaccaaaaattcagaattttgtatatttttacttataagtattaatactgtatgttggtatatctttgtgttttttggaaagccaatagagattgttaagagcattcgaatgataccaagtttattggattggatcaacaaataaaaaagttatgatgctctaaacttggctcagactataccggccagactacagtgtctcagtttttttttacccttaaaaattcaaaaaaaaccaaaaaaattttgtgtgttgcaacttggggacccgacatttggggatcccgacctttggggacccgacttttagggacccgacatttggggaccgaacgacatttggtatccgacatttagggaacccgacatttggggacccgacatttggggattttaataaaacaaaaaaatatattaaaaaattaattttaagtccaaattagacaaatttacgtctgctttacccagagttaattgcattgcaagaaaaaa

SEQ ID NO: 20936 - DNA, 1291 bp, Heterodera glycines
aaatattattttgtttttccttgcaaatggaaattaactctggcttaatgcagacgtaaatttgtctttgacataaaattaattttttaatatatttttttgttttattaaaatcctcaaatgtctggttccctaaatgtcggatccccaaatgtcgttcggtccccaaatgtcgggtccctaaaattcgggtccccaaatgtcgggtcccccaagttgcaaaatcccccacaaaatcgggtagcccttctgtcagcaacaaaacaacaaccagccaggtgctgttatttgatatacagcaattttttgaaatccaaaaaattaatttaaaggcctcccattaaaatacgaaaattaaatataaatcccaatggaggaaggaaaagaaaaagggaaaaatggaagaaaatggaaagggaaaagaagcgaaaaattgaagtagaaaaatgccatgccaataaaagtagagagcccatgtcccaccaaaagaaacattgacaaattcaaagagtggaagcctgcccaagaagcccaattaaaaaattgttaggaagtccgaaaagattttacaaacattttgaggaaaaggcaaaacagaaaaaggaaaaaaaggaagtggaagaaaggagagagaggaaaaggagcaaagagcgcagaaagagaagggaggaacgagagcagagaaaggagcgaattttgaaagcgaaagtgacattcggcgaaggacgctacgacaaggtaaaaggagaagcggcttatttggtcctaaaaaaggcctgggcctattagaattaacatcacatcactgatgtgatgatatgacgatatgatttatcagacgtaggacccctgttagaattaaatcatatgattaatcagctcccgcgtctgatttatcacatcatattgtcatatgcgcgttagaatatatcatataatcacatcagggatatgatcgtcctatcagacgatcacatcgtatgcggggtatgacaagtcgtacgattagtcatacgcgtgtttgaattattcttttcaaatcatatgatgctcgtcatatgacgagagtttcactgtgccaaaaatcatccctccgaaccacgtatgagccttaaacaaaaaatcgtagaaaatttagagttcaatgaaataatttaaaattttaatatgttgttctttgaacttttatctttctaatgaaccataattttattttttctgaccaatagttaattttatatgaattttttaacaaatctacccaaaatgtgtattatttaaaggagaaaat

SEQ ID NO: 20937 - DNA, 1947 bp, Heterodera glycines
atatttttgggattttgcctgcttttctgataattttccttaatagccaatgcaattatgcattcataaactgaattgctaaataaatgggagcagactttccatctctcaaaatttgttttatttattttccaatttattttcgtttttttccaaaaattatgaaaaatttaatttttaatgcatcctaaaataatgtgtcatcttatttacacctttaattagcatcacttttctgtccaatttatattcacaattatcacctcattaacaaacacagatcactgacggcttctcattgttccaactgaacatgttcattgacgggattggcaaagatcgtgccgccgctgaacaagcgttggccatggtcggcacacaaaatgcccaacttgctgaactgcttgccgccagtgctgcgcaacgggaagaaatgctcagcaccgagttgaagcagctggctgaattgcgtgaccagctggcagaagcggaagcaacagccgccgcccaccaagcaatgcttgttttccgcaaaaagcgtcaaaccaatgaggacggcgtacagctgaagggtagccaaagggccaaagtgattgcaaaggtgtgacgtacgatcaatggtggatgaccaaatcaacatactaatgggcaattaattagcattggcttagtgtgacactaattagggcgagcttcgagggtctgatggtggattattgtggggtaattaactaaggcggcgaaagcagacagttaaaagagatacccaaaatgccattatgagcaattaaaagttggcaccggaaccctaattttgagggagttcagttgggaagggatgagtgaacaccgcaaatgtaatttgcaacttaaacttgccaataaaaacataatttagtaagataatgtggcttgaattacaggttacacaactggaaatggaagcgcaaaaaattcgtggaatttatgacgccacccgattggaagcacaccgagcaattgaggtattaattactaatcgcaattaattacattgcttattaataatagcaatttaaataactgtaattatgtaattaaattttaataaattaaaatatttctaaaaatataaatgattatactaaaattaaaatttttctgaaaatatgttttaaaattaaatttttaatttcattgatggcactaattaatgcattttttaattgtccaaatgtaattaataatttaggcggcgaatgcgttcacgcaaattgcgcacgggttgctgcaggcgcgcaacaacactcgcaccgcacaacaactgatgaaggaaacgcacgggcacctgcgcggcgttgcggaagcggcaacaaacgcgaaaagtgcaagcaaagcgatgggcgcatcaattgacatcggctgcaatggaagtggctgtgtcgaggtagggggaaaattttagaaaaatttgaaaaattttctgccgtttttttgatattttatgatgattttttataaataatttttctcaaaaaatttctgcaaaaattgcttaaaatttttcatcttgaatgttcatataaaaaattaaatttttttccagaaaaaattttaagtttgacaattttttaagaaaattttgaagtggtgggaacaacaatgattttttgcttggtattcatcatttgttataaatgatttttgttttaaatttattatttttttctataaaatatatttgaattaaattatctttttttatttccaatccctcagggctcagggtgccgctttggacgtgcgtttggtcaacattcaggcaaggctttgtcaggccaaagcggacttggtcaaagtcagccggacaaacggggagctgaacgcgcgcgaggacacagttgctgaaattgacaaaatcatggagaaagcggagaatgcttatcaaaaagtgaaaaataatgaaaa

SEQ ID NO: 20938 - DNA, 2877 bp, Heterodera glycines
atcctgaatacgttcaaaacaatcttcaatgcttccttgttgttcaaacgtctcagacgcgaccaaaatatcatcaagataaacaaaatcattgatcagatcttcaaaaagacgagacatgaatcgctggtaagttgctacagcattacaaagtccaaacggaagcaccgtgaattcatgcagtccaaattctgtgacgaacgctgttttttcaatggacttctcgtccattttaatttgccaatatcccgaaaggaagtcgagggttgagaagtatttttttcctcccaatgcgagaagaatgtaatcaatgttcggcaacgggtatgcgtctttcactgtgaccgaattaattcctcggtaatcaacgcaaaatcttaagcttccatcacgtttcgggacaagaacaatggggcttgcccatggcgattttgacggccgaatcaatcctctgctcaaataatcctgaagcatcattgaaactttttcacgatgtgcaaatgcgagtggtcgcattcgatttcgaattggcggtgcacttcccgtgttaatgatgtgctgcgttatcgcagtttgtgtcagttcgttgtcgtcaagcgcaaaaatttgttcgaactcgagaattaaattctctaattgaccgtgttcatttttgtaactcctgtcaatgcgagtttacagaatgtctttaatcattccagcacgtcctttttcagaatatctagcgttttttgcaaccaatggtgttacaaacgaattttctaattcatgccaatcttcgacaagttcaacttgcgcaacattgcttttcgcctccaaagtaatcggaatggccgaataattgacaatcgggacaacaagttgtccattttttcctgatgtaagagttggctcaaatttcagttgttcatgaaaaccgtctcttccgattacagatacttctttatcatccagctcgcgcaggactgacaactcgacaagcgtagatgattgcggaagaagagtgactctataaattatgtgtgctgaattcgcttgtttatcgagtggagaaaaatcgatcacattcatgttaactttgtcgatcaatttaaatcctaattgattcaaagcatttgttccaaaaagaagatcgtatccaaaagtagactggacaacgaacattcgaatcctagccgtttctgttcccctaacaattgggaggcaaacagttccgtaacatttcacttctttgccatttatgtccacaatgcgcctttccgagtaggaaatgatctcatttttgtccaccatgtccataatttgtgcgaaaaactcagctgaaatcagagaaatttgggcacctccgtccaacattgcatccgactgtcgtccgtaaatagaaactttagcaacaattatcttcccgacaagaggactttcatttgaaacgacaaggtcactcaatttgtccgccgcgttgcggaagaaattttcaatttgtggtcggtgctcagcattcacagcacccgccagcaaatcattcggtttttgcggttcgttgttttgttcaacgaggtagttttggcgaagaaaatttctcgacgccgaaaactgtggtccgcttttggttggagcttgacgattccaatttaagggcgcagtatttgtccctgttccgggttgtttggaaaattggttttggttctcttggaagggtcgagattttggtggaaccatacaatttcgagacacgtgatcaattcggccacagttgaaacatgtgacattggttggtttgtttgtgtttatttctggtctggaccaattactggtatagttgtttgatggcacgttattggatgaatatgacgaattcggcatttgccgttgaaaagtttgatttgacctaaacgaatttctggcagccgattgcgttgcttccgctcgggctgcttgtgcaatgaattcatcaaatgtcgctctgggtctgcgtgtcatttcaagagtgattgccaactcgggattagaaatggctcttatgattgaataatcatcgtattgctgttcggttagacccggataagcgcggcggaccaaacccgaaattctgttcccgagctcatcgacactctcgtttggtcggcgccgaattccgcgcattagttggtcgaaagacgtcaattgtttggcgtctgtgtcgtccaactgtcgaataattatccgcctgattagctggtattcatgcgggttttcggcaatagctgaattgtaagccctctctgctttgccaaagcatttcgatcgaagagcgcgaagtcgtttatcctcaggccattcctctgtcgctacatcaaactgtttaaaaaatgcgttcactgcgtctgatccgctgggccgtccaaattcggaatagagttcagagtcattgtgtacgagaagctgtctaggcttctaatggcctgtgccatcatgccgtcaaataccagtccggggtggacaggctgctgatattgttcgaactgattcggatgattttctctaattggcacattttggttgtgattttggaactggggagcttgttgggaattttgtgccttaaatcgctgagcataataatcgtcattgtgagcgtaggcatgaggtggcgggttttgtcgaaccaaatgatgctggttttcggcaacaactggtctttcgactcggagaggtcggtaccgttcagtattacccggggcattctcatacaattgttgattcattcggtaactgtttggctgtggtcgttcaacgttcaatggcagtaaaattgttcctactgtgccccgtttgttgattttacttgacattcatatccagcctttgatttcggtcgagaattaaactcaaagtttt

SEQ ID NO: 20939 - DNA, 916 bp, Heterodera glycines
  misc_feature (23)..(23): n is a, c, g, or t
  misc_feature (50)..(50): n is a, c, g, or t
cagtccccccgacccgatgcgcncagattatgggagaccgatcttcgggnaatagcttccctatagcctgtactttaattctgcgttgattttttgctccccataattgtttgagtaccccaaacggacactgaaaaaaatcgattttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgttttcggggcagtccccccgaaccgatgcgcccagatttatggggagaccgaatccttcgagaatagcttccctatagcctgtactttaattctgcgttgactctagag

SEQ ID NO: 20940 - DNA, 2247 bp, Heterodera glycines
  misc_feature (2238)..(2238): n is a, c, g, or t
aattgtttcccctcccctcccattgctcagattttgccgttccaatgcgccccattccctcggcctttgagcgtcgcgcgcggctgtcgtcgtcgtccattggcatcgatgcgcccgcaaagttcgctatttcccgatttttgtggcttataaatttttccgtttcatgatccaatgccaactgtgcggcttggtcatggtccgtccgtcgctgctcgtccggcacatggcccgggttcatcaacggcacgccaacttcgacgcccatgtaacgcgggacactcacccttcagtcaaggggacaccggatttttacaatttttttaaatttcttacttacaattagagtattttaaaaatttctccgacctagaaattttttaagaaaaaaactttaggaaattaactttaggaaaatttttttaagaaaatttcaagaaaaattttttaatttagtcagcgaattttaggaaatttttgagaaaaacttagtaactcatcataaaattttgaaaatgttgttcccccatttcacacccaatcttcgtcaggtggtctatccgctttggccctctgtgcccccgttgcgctacgccgtcgacgaacatggccagctgagttggatgtgttgcgagcacaaattcgtggacaagtccgttagtaaggcccacgtccgaagggccaccaccattttaagaggatgggacactaatttagagcagttttttcatccatttccgtcggatttaagacaaaaatttttttcttccatgtttaaatttttaaatgaccatttccaacagaatttcaaaatttcgactcaatttgccaacaatttactcgaaaatatttttgatacaataaggcatccaaatattctggtctctccctgggagagctctcaaggtcgggctcatttatttttgtgtttgacccaaatttttttgatgtgtagtttttctttaatgatttgctgtccaattttcccaaaatgaccatttagggctgcactgcttcgtcaccgcgcgactgtacattacagcagcggaacacaaacaacagaagtggccaatgcaatggaacaacgatgaggggagggggaaatactttgtttttttttgttgctatttttagaagaaatttttgtaagaattgtttatttcataattatagcacataaaaattggtttgtaattgtgtgaagtccaacgagagtctcggctctgtgggatgttttctcttccactctccttgtctcgtctgttcgtctgtcaccactccctcgcacttctctttcgctctgcttccactgtcttcctcctctttgctgctgctgctgctacttcatcttctcccttttctttcgctgtctgtgcctcctctccctctcgcgttgttttgtctgcggtgtcttcttcctctctttctctgtccccgttgttgccgtacactctgtccacaattttgcgtttgattcgcgcgatgtgccgtccgtcgtacttcggcatgaacgtcgttgcccagtcctcctccacgacgtccgtcagacggagcgaggaaaatgccatggacagaagctgagaaaaaggggaggatggacaaaatcgagacgaaaatcgtcacaaaatgtctttgtaggaagaaattggttcatctcctcaaatcctacccgaaaatttttaagcggtcgaaaaataattattcgaaaattaattcatttcccatgatctgaaataatcacagcacaatactttaattatgatctagaaaattgttaggggcaggaccgggcgaaacccatcaattaactaaaacattcaaaccgaaaaatagccgaaaattactgccgcatttttctaaacattccaacgcctattttttcattttacgcaagaacaaatttaattgtcatttccatttagaaaaatttgcgtattttaaaatccaaaaacaaaaattttcccgaaagttcggctaatttatccgaaaaatgaaactgaaaaaaccccaaaaattaaaaaagcgaggaaattgaatttaaaaatgggtgtagagtcagcaaattatggacggaattattgtgataaatggacgaaatgcgcctaccgcaacggccaacgttctcggcttgtggtccagcacaatttgtggttcggcatacaaatcctgtgttgcaaatgcttattattaaatacaaaatccaggttttgtgtcactctgtttttggcagcccgactntttttcccc

SEQ ID NO: 20941 - DNA, 1802 bp, Heterodera glycines
aaagctcagcagattatgcatccatccgttcgggaagttgccaacaaattgaccaatttatttagacagattctgatcaaaatcccctccaatatccgtcgccggggttagggctttcgtttgcttaaccccatgtatatatgttgttgttgtttttttgcggttttaagtagagaccgaaatttttcaatgtatgcataagggtaagggagttacgggctaggcacctaacctatacggagtacggacttatgggctaaataatccaaaaatccatagtccataaaggcttattggtcgaaaaaaattcgggttacaggcgctacgggtccgtaaaaacgcgtgcacggatcacggcccgtattcagtctctagttttcagcgccttagaaaaattttttttatcagcatcgtcgtcatcacaaattgaaaaaaaacaccgcggatgaaggaagagacaaaatgatggtgaaaaacaaaacggtgcctgctgatcagcagatgtgatcagaacaacacaaaacggaggccgggggcgactgatcagcggttggactttgagcaaaagcttctcaaatatcactgactgaagaagctgtcgacgtcgtcgtcgtcgtcgttgtcgtcaacccacccaccccgtccgcctcccataaaataatgcgctgattttgttagcaccccctcatgagaacgtaaaaagttttttgtaaacaccccccgcccgccgccctccatccactgatgagtagggatgggaatttaagtcacgaaaaatctcaaaaaagtcgacttaaaaagtcatgaaaaatcgccaaaaagtcacaaaaaatgcaaaaaagtcatgaaaaaataaccaaaaagtcacataaaaatgccaaacaagcacgaaataaatccaaaaaagtcctgaaaattagccaaatgtaattaaacccaaacgccgtttttaaacattcttcgaagaaagtaatttaaaaacgactaattttaatggaaaaaatattcaaaatttgttgcggcgcccagattttttaatatattaaagttaaattttgccttaaaaagtgtaaaaagtcatgaacaatgtcataacaacgcaaaaaagtgtaaaaaagtcccacaaaaatgtatgttagaagcttcagacaaattgcagtacaccttggaactcatttcaaggtcatttagagtcagcacaaaaaaagtcatgtgtcttaaattcccatccttagtgcatattgtgtttttttcgttagtttgatgcccagtacgagttgggaaacttagtacgagtcggggtaccagtatgagttggggcagtacgagttggcccagtacgagttgggaaacttagtacgagtcggggtaccagtatgagttggggcagtacgagttggcccagtacgagttgggaaacttagtacgagtcggggtaccagtatgagttggggcagtacgagttggcccagtacgagttgggaaacttagtacgagtcggggtaccagtatgagttggggcagtacgagttggcccagtacgagttgggaaacttagtacgagtcggggtaccagtatgagttggggcagtacgagttggcccagtacgagttgggaaacttagtacgagtcggggtaccagtatgagttggggcagtacgagttggcccagtacgagttgggaaacttagtacgagtcggggtaccagtatgagttggggcagtacgagttggcccagtacgagttgggaaacttagtacgagtcggggtaccagtatgagttggggcagtacgagttgg

SEQ ID NO: 20942 - DNA, 2534 bp, Heterodera glycines
tgctgaaaatatgtttttgccatggggtgatcgatcctctcctatcggagatgaccggaacacccaactgtgttagagcattagaagaaacgaaattttgatcaattttttaaaaataggtaattagcggtaattggtggtaattagtggtttgggaggggaaaattttcccattttccttcaaaaatttttacaaatccccaacgaaaaacaatttaaaattgcaaaatttgaaaattaaatgtgccctcccctccgtgccccagcgacaaaattgggtcccactttcggttgacgaagatgaattgccgcatctgaccggccggcgccgtcgccgcatcaccggcgccaatggcattggccgcggcgaaatggccagcgtacgcgggcggtgcgccagccgccgtctcgccgttgctgctgctagcacggaacgcgtcgttaaccgcgcccgccgccgacgtcggcccaacgccgccgaccgacaatggcacagctccggcggaagtgccccaggcgccaccgccattccctttaaaggcaaacatacggcgatagggagtatggtaggaaggaggaaaacccagacaaatacggtaggagggggaaaacccagacaaatacggtagtagggggaaaacccagacaactacggtaaggaaaaagtaaaacaccgtaaaacgggaaaaaaattggtatagctcgggcaaaaaagtacaaaattttgatcactgagaactttcaagagtttgattcgagagtcttggctcgagaatatccttctttgtgacccagggctaggggaaaaaaggtcgggtacatcgggtactgtaatccgattggtttagacgcaaaaattaaaaataaaagaaattcttgaatcttgatcaagagcatttgtcctggagacgactcccatgccccatgggattctcagctgacaacgagctcgagagtctcgaaaaactaattaattttgtgcccccgctgtgttgtgccgccataaccgacctccgcccagcgaggacgagtcgttggagtcgttcagcggctgctgcgagtcggtgcggccccggcgggcgccgtaaattgccgccagattgggcagccggcgccttacgccgttcactttgctgaccaactgttgcgagggcggcggcggttggtgatgacgcacgtccgcctggagcagttcagggggcattgccgggctaaatgtgggtggtaagaaggtgtccgaaagtggtacccaaaatttcgaaattggcatactgtcatactgacgatcgagagccttggtacagagccgaaactcgaactaggtctcgggttttttttggtctcggtttccgaaagtcgagtttttgaaaagtctgttattgtggtcttgagtctcggggtccattctcgatctcgaatcttggaaatttccggtctcgagcatcctcgctatttgtgtgacttcatgcgccactaaccgtccgatcagtgcaattggaatttcgtcagggaattcgtcctgttgctgctgctgttgcgcatgcgccttgtgggatggtggcaaattgacacttctgaacaaattgaggggaatggttactcggtacggtagggaggggtactgtaagtgtttttatgtggaactgggcaatttaggcgcgaaaattatactgtatttccatataatgcgctagaattttgtgcaaaaaaaaaacagcccggaaaattccaaataacgaagaggacgatgggtacggtaagccgcccaatcacttgttggttgtcattccgcgatgcagtgagccgtgatggtattggatggacatcagatcggctgccgcgatggaatgtgtcggggaaaggccttcctctgaaaagaaagaatttttatgccccgaggggccaaaatttaatttgtcaaaattttgaattttataaaattgaatttcggaagagcaagcgatggcagaggaatgaagcgaatgtctaccgactgacaccaggggaaggacattggcatctcgcccgattatttacggagaatgaaaagtttgccgggaaatggacaaaaaacatttattgaaaatgtatgcacggacaatggaagacccaatttttggggggcagaatactgaactgtccgctctgaattttggcacggcacacattcattcattcattcagtgaaattcgcaattcttcttcttcctctcccctcccatttgttgttagtgccaatgccatcgtcattaacgcggcggccaaaaaaaaagtttttcggcggatgggagaagacacgacacaaaaaataaaataaatttccgctccgcttggcccttggcccattggcggcaaaatttgtgtggtgccacccgtggccaagagagtctcaacccccccccccctccatttgcgtttggcactgtgccctcgagggcggcggaattttttttttggcgtttgattgccgtgggaggggacactccaaaaaatgccgtgccatcattggccaaggctgtcaattctgttcactg

SEQ ID NO: 20943 - DNA, 1935 bp, Heterodera glycines
ttaaattgctgttttttctatgtaaataagttaaaagctaaagcaaacctattcattgaatacagttgcaaataagatacatttcaaaattttcaggggtaaagggtcgattcttaggggtgtattttccgaaattttttgggtcgattcttaggggtgtattccgaaaatttttgggtcgattcttaggggtgtatttttttgaaattttttaggtcgattcttaggggtgtatttttctgaaatttttttggtcaattcttatgggtgtatttttcgtttttttattgcattcttgttgataaatttcccaaaaatcgcgaaataagggcgaaacgccaaaataagggcaaaaacttattttaagggcgaagatgtaaaataaagatttttaagggcgaacacccaaaataaggatttctaaggtcgaacgaataagggcgttaaaacgcaaaattttcgaattttgttcgaattcggttcctgtgttcgaaattgatcgaaatggggtacttatggttttcaggggcgctgaacacgattataacatctatttagaccaatttcgaaccccggaaacggattcgacctaaagtcgaaatcccccaaaagtcgaaaattcaaactttttcaacaatataatccttttctggagttcgaaattggtctaaatatgtatatgttataattagggccgcaacttttagtgaaaaaactttttttttgctcaattgttttgaagaaaggagctcaaaaaacgcatttctgcattaaaattttttcatttggacgtcacttttcgtcactagaaatcactattttggcgacttcgtcactaaaatagttaaaaatcactattttggcgttttgtcactattttttcactatttcgacattttttgaaaaattccttaacaaaaatgcaataaaaccaaaaaatacacccctaagaatctacctaaaaaaatttcaaaaaaatacacccctaagaatcgagctaaaatttttcaaaactcctatgaaatgaaaaaaaattttctcaaaaatttacttggcaaaaatttttaattttaaaaaatttttaggtaactattttgggttttttggtcttaaaaatcccagtcctactcatttgcaactgcaatcagtgaataaaaattatttttgctcaatttttggctgaaaattatgtcactattcgtcactatttcggactttttgtcactgtttcttcactattttgggatttttactcactattttagttaactatttcgggatttttcgtcactaaaagttgcggccctaataatgagtagggagtgtaattaattatatggatataaaatcgcgaaatatggccataaaatatggaccaaaaatcgcaaaatatggacataaaatggcaaaaatctcaaaatatggaaataaatggcaaaaatgtcaaaatatggacataaatttttcaaaattgagtgcaaaatttcttcaaatttattggttgaaattgcatatgagatacatttccaaattttttgacttggtaaggcgctttgacaaagacggctttcgttttgcaattagtcggtcaacattcggaaattggtctcgaattttttcggcaattacgtgcaatcattttaaaaggaaaaaaacataaaagctaaaatttattcatttttagcgaaaaatcaaccagaaaagtgaaattttatcttttttgcttatttttgacataaacttattaatttttaagaaaatttaaatttattcaatattcccgagaaaatttggcgaaaaaatgatttttttggaaaattccggtttttgggctcaaaaagaccaatttagctgctgggggccgttctaatagaggtttttttgaaaaatgccaaaatatggaaaaatatggaaatatggacataaatcgcgaaa

SEQ ID NO: 20944 - DNA, 1321 bp, Heterodera glycines
  misc_feature (18)..(18): n is a, c, g, or t
  misc_feature (24)..(24): n is a, c, g, or t
  misc_feature (32)..(32): n is a, c, g, or t
  misc_feature (37)..(37): n is a, c, g, or t
  misc_feature (47)..(48): n is a, c, g, or t
  misc_feature (54)..(54): n is a, c, g, or t
  misc_feature (70)..(70): n is a, c, g, or t
  misc_feature (72)..(72): n is a, c, g, or t
  misc_feature (90)..(90): n is a, c, g, or t
  misc_feature (133)..(133): n is a, c, g, or t
  misc_feature (138)..(138): n is a, c, g, or t
  misc_feature (144)..(144): n is a, c, g, or t
  misc_feature (160)..(160): n is a, c, g, or t
  misc_feature (163)..(163): n is a, c, g, or t
ccttttatcaaatacttnttaatnatcttaanaaacnttcaaaattnntatcantttcatttttattcananacccccaaaaattaccantaaaatttatttcacaaataaaaataaattcaaaataattttncaaancaaaanccttctttaccctcanctnctttttaattaaatttaaaaaactgccacttttaaatagcgcctataaatcatgaatatttgataaaactttaaataaatgatttaacacatttctatttaatatcacttaaacaaatataaattttacttaatatgtaaaagatttaatttttatttataatttattcgttttgctgcaaatgaattatttggaagaatacgaaatcaataaaaagaacaaatatcgagagtgcagaaagaaaaacattctctcattttggcttactatttttttttctctattagaagaaagacaaatttaatttgtttacaccaaaaatttttacgttcatccgcatcatttttgcatattttgaaaataaatttcctttacatttaattttattcatgctctttttaaagatatcatggatatttttgacaatatcttaaaatatttagacaatacttataaaatgaaaaaaaaaattctactactggcggtggcggtggcaaggaccgcagcggaggtggtggcacggacggcagcggaggcggtggcacaggcagcggaggaggcggtggcacgggcggcagcggaggaggcgttggcaacggcggcggcggaggtggtgacacaggcggtggcacgggcggaggcggaaattgtggcacgaacgtcggaggaggcgttggcaccaacagcggaggaagtggcacgagcggcggaggaggcgttggcaccggcggcggcggaggcgcacggacacaggaggcggtggcacgggcacaggaggcgctgtcacgggcagcggagatggtggaacgggtggcggaggaggcggtggcggcgcaggtggtaagcaatcatgggatcccaagggttcaaaaaatttcgtaaggaaatcagaagaatgccgtaattttattttttaaaaacaaaaaaagttaaatataaaaaatggttatagaccagctataattaataattatgggccttactgcccattttcgtgtttttattttttagaggctaaaagcattaaattttgaaaatcctcttttgccttatttggcttttccctaaaattattaacaaaaatgcaataaaaacgaaaaatacgtccataaagaatgaaattttttcaaaaattcatctcaaaattttattattttc

SEQ ID NO: 20945 - DNA, 1226 bp, Heterodera glycines
  misc_feature (1095)..(1095): n is a, c, g, or t
  misc_feature (1166)..(1166): n is a, c, g, or t
ccgaaacttctcgggaatggtcgtctccgttcttttggatcgaattcttttgttgcctttggttttccattggtacgaacaatcaaatgaaaaagtgattaattcctcatttttccattttttagaattaattgtccgatttttggtgagttttttctactaccgtaattccctaccgtatataccacccatttttcacaggcatcgcccagcaaaacggagttcatgaaggtacagaaattgttgaaaaaatgttataaccttataagaaaacatttcgagattgaaattccatactaatataaagctcgggaattttctcgagatttattcgggaaagggtcgggaagacagaatgccaggggctaaaaatcctcctatttccatgccccccccccattgattttggcatggcattcttttcaaaaaagttagaatcagcgaagtacagaagtgctatggtaaaagtcggacccatcccactttttctgctttggctaattaactaattaatgaatcgattaattggtaattttgtgcattcagtcctttctcaatgtgctcgacttcatcgctgttactccgttcttcgtcaacctcatgtgcgtgcgctttttctgtgcaatttttataattccctctcattaaattagcacccaattggtttcaggatcagcttcgcatttgcatttttgggcctaaagttcgaaaatcctcttcctttttttgttgctaattttcgctttttggctcctttttggtagctttaagcacattttgaatttggcatattctttttctggccattttctgtttaattattttaaaattttgccacatttgcacttttttcttgtctgtgatcattgattagtacttttggttaatacttttattcttttgatgctcggctgactagcttcacttcagtttctaatcactgatcagatcagcatcataatccggtcttctttttttgttgcccttctctacacttgtccactttctggtcacctccaatccttctgcccctctgtgtctgcttctctctctctctctctctctcttccctttccggtcacttttccgtctctngtctgctttttctccaatcattttcggcagcttttcctcaaccgctcattctctgatcactcactgatccngtattgatcaccccccccccgttttaggtgcataacaacgaattctcttccgtcgccccc

SEQ ID NO: 20946 - DNA, 1133 bp, Heterodera glycines
gtagggcatttgaaaattcaaaagtttcacttgtactttctgaattgcttcttctttccatgctcaggtgttcttcttgggcattgcccttgtgcttttctccagcggtgtttattttgcggagcaaagcgaaccgaacacaaagtgaagaagccgagggaaaaagggggggggggcaaatttaaataaaaatgtaaatccaaaccacattaatttattaattaaaatttcaaattcccatccattttttaaaattatttattattattcaattaaagctgttaattccaattcctaaaaaatttaatttttcgatcacccaaaaaaaataattatttaaatattatttaaaatcacatccccttaaagtttaattttgaattttaaaattactctcccttcagattcacctccattcccgcttcgttttggtacgttttggccacaatgaccaccgtggggtacggtgacctcgtcccgcacggcgtttacggcaaaattgtgggttcatgctgcgcactgatcggcgtgctgactttggcactgccggtgccaatcattgtaaaacgatagttaattaattgattggtgaataatttactaaatgggggggggtcattagtgtttttgaataatccaaaatatatcggcttttttaaaattttgactcattaaaagaatagaaaaaattacgcgactaaacatttctttttctccctttaaaaggtggccaatttcaaacgtttttatcgccaagaaatcattctggccaaaatgtacgagcagaatccaccgccaaaacaggtgagagacattaatgatcctttcccagcattaattacgcatttgtttggccattttattaaatttttggtacttattggttttgtacatgcaccccaaaatttaaaaaatatgtcaacaaaggatgatgcactgaatttttatgccatcaaaaaattccaagattttatacctttttttaaaaaatgccctcctcatttgtcaggtgaaggccatcataatgcacgcgcgtgccgaggaggagagtattaacgcgccaattctcgacgatgggccaaaggcggtggccccgtctttgagaacgtcggttgcgggagagattacacagc

SEQ ID NO: 20947 - DNA, 2400 bp, Heterodera glycines
ataacgacatagcaccaaaatatttaccaaatctttctaagtatttttaaaattgttattattttggataaaaaactatctttataaatggtgaatggatgaaaacaaattttaggagaaaaattttaaatgaaccaactcttaattgcaaattcatttcaaaattaaataaataaatgcttttgattttatcaaattacgcgaattcatttaatcatttttttatgctcataataaattagatttacatattaaattattttttttgatacaaaaggacaaaacttttcttttttataattttatttgcattttgtcaaggaaaggccaaataaaattattcttaattgatagttaggctttaaattgaattaattcataattatcaaaaaaaaaccgaatttaattagtcttaattgacgttaggctttataattgaaaatcgagagttaatctgaaaggcaataatttcatcatattttatattagcattttgttcatgattgaattttcctttgagcaataattcaaattttggctttatctgagaagaataaataaattatttacgaattttttcaattttttgaaaaatactttttaaatcatctttaatccttttctcaagctcaatatcaaaatcatttttttgaccaattatccgacaataatattccaattttattgaaaatggttgaagcatcttcaaacggcaccgaaatccacggcactgccattttcgctttttatttgcatttgtgaaggaatgtccaaattaaattatgcttaattgacagatctggctttaaactaattcataattatcaaaaagaccaaattaaattatgcttaattgacagatctggctttaaactaattcataattatcaaaaagaccaaatataattatccttaattgtgagtttggctttaaattttattaaatgttatacagaaaaccaagggttagcccgaatggtaataatttcattctattttatattagcaattcttcagtgtttgaattttcctttgcacaatgatttaaatttggctttctataagaagtataaaaaagattttttaaaattttttgaaaaattaaattttcaaaaatttatttaatcctattctagcacaatatttaaaatcattatttggctaattgtccgacaataatattccaattttcgtcaaaatggctgaagcatcttcaaacggcaccgaaatccacggcacagccataatccgcggcactaccattttcgctgcttatgccatggcatttttggaacttggcacatttattccgacaattccaattgtggcattctgcgcttcaatagtgtacaaaacttccattcttcaccaaaaccttaagggcattctgttggcccaactgtttggcataataatgaatttgtggccacgtgcctttatgttaattgcccaaattttcgtgacgaaaaatatttttttgttgccaccaaattttatctctggcgcttcaactgcggcattgacattcaacaacatggcaggccatgtgctgattgtggagcgaatatgtgcaactgtttatgtgggcacttatgagagctaccgtagttggacatttacggcactttggctgccaattatggtaaaaacttattagtggaatatcgtactgagtgttttgtaaatccgcataaatacagtagttggacatttacggtgctttggctgtcaattacggtaaaaaacttattagtggaatatcgtactgagtgttttgtaaatccgcataaatacagtagttgggcatttacggcgctttggctgccaattatggtaaaaaacttattagtggaatatcgtactgagtgttttgtaaatccgcataaatacagtagttggacatttacggtgctttggctgtcaattacggtaaaaaacttattagtggaatatcgtactgagtgttttgtaaatccgcataaatacagtagttgggcatttacggcgctttggctgccaattatggtaaaaaaattattagtggaatatcgtactgagtgttttgtaaatccgcataaatacagtagttggacatttacggtgctttggctgccaattacggtaaaaaacttattagtggaatatcgtactgagtgttttgtaaatccgcataaatacagtagttgggcatttacggcgctttggctgccaattatggtaaaaaaattattagtggaatatcgtactgagtgttttgtaaatccgcataaatacagtagttggacatttacggtgctttggctgtcaattacggtaaaaaacttattagtggaatatcgtactgagtgttttgtaaatccgcgataaatacagtagttggacatttacggtgctttggct

SEQ ID NO: 20948 - DNA, 1389 bp, Heterodera glycines
gaatttaagtataaccttagaaaattcaatgccgcggttatcaaatgtacaactcttatcaaagccacgccattattatgggaatccggaaaaatgatatgtctggggacgaaaagtctgatagactgtgaaaatgctattaaaaaatttatagaaataattaagggctcggggtgtccgggggcttcttacaccggacacacggttgaaaatattgtttcgacctttaaattcggacatgaaattgaactgaacgagtttcgaaaaaatcgtcgtgccttttatgaacccgaaatattttgcggtttaaatttcaagcggggtaaaagcatgacagcgttaattttctggaccggtaaagtcgtaattacgggaactaaaaacaattctgaaattgatgaaatgtatcattatattcttccctatctgaaaatggctcaaaagaagttagggagacgataaaaatttttatttattgagacggtcccgaaattcttgcagatgacctacttttgaaaaagttttttttcaatcctaatttattattatttttcaattttatatttaaattgaatttaataattatttttactgtaaaattcattaatttgctgcaattattaattaaatttgcacttctacaattccattattgattaatttgcgcggcggcggcatcgtggcgcggggagggagggcgtggaggaaatgcaaaaaaaaacgcacattggcaaattttcaaaatgagttttaatttcaggataaaaaatcatataaaaaatctcaggatttgagaaaataccccaaaaggtttggaatcaaaaaaggaattaattggcaaaagaatttccttcacctgtcactttggtgacaggtggatgattgatgaccttcccgcggcgctgcgcggcgcgggaaaaaaacacccgcaacaatttgggaaatcggatttggtcaggcggcaacttcaaagtggtccaataggttttggttttgaaacaccccccatcgtggattttttgatggggcggcaacttcaaagggctgcacccctcccataggcacgggctcgtgcgggaaacacccgcaaccaacccgcaacctttaggggtcctatactactgacgcataaactggagtagagccgttatcgattagaaataaggcaattgaatatatcggaatatattatttatacggctggatctgtttccttatatttttaatatattcccatttgtttaaactaaaattttagcatgtgtcatttgctgtattacattttaattaatattaattgttctcaataaaagattaaaatataatttctttctttgaaaatatattttaatttataaaatataatttctttctttgaaaatatatttt

SEQ ID NO: 20949 - DNA, 999 bp, Heterodera glycines
gaaaaaaaagtctttacaaaaataatccccctgggagaagggagtgggaaaacatgatttcaaaattttcatttttttctagtctaatctactcaaaacggctcagaattcaataaaaataacatttccggtgcgaaaaatgggttttgaaagtttttttggggaaaaaagactttacaaaataatacccctgggagaagggagtgggaaacatgatttcaaaattttcaattttttttagtttaatctactcaaaccggttcagaattcaataaaaataacattcccggtgcgaaaaatggggtttgacaatttttttggggaaaaaagactttacaaaataatacccctgggagaagggagtgggaaacatgatttcaaaattttcaattttttatagtctaatctactcaaaacggttcagaattcaataaaaataacattcacggtgcgaaaaatggggtttgacaagtttattggggaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgacaagtttattggggaaaaaaagactttacaaaataatacccctgggagaagggagtgggaaacatgatttcaaaattttcaattttttatagtctaatctactcaaaacggttcagaattcaataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcgataaaaataacattcacggtgcgaaaaatggggtttgaaaagtttattgagggaaaaaagactttacaaaataatacccctgggagaagg

SEQ ID NO: 20950 - DNA, 2579 bp, Heterodera glycines
tggcaggtcaaatatacaaggtcgaaagttcctcaaattttaatgaaccccttaattgtaccagctgataaaatccttctaagatggtactcaatcagagaaataagtctttcgtaatgcccacccttccagtccgctgaaggggtcctcaaatgccaatttggaatttattatgaaattgggacacaaaagatttgaaggcaagaaatgttggagcttggtcacaataaattgaagagggacatccaaattttgaacaaaatcgccgatatgaatgggaaaaagataaatgattgatcgggtactaagtcaaggtaaattgctctagtaacaagacaagcccaaactacaatccaatattttttagaatttttgaaaattatttctttggttttggtttgagtgggaactcgaacaataagtgggccacaaaaatcaagtccaatagctgcaaatggtgcgattggttgtactctctcagatgtaaaaattatggagagggtttgaagaggacttgaatgatgattgagtaaatggtttcataaataattagagcggttagttgtgacttgggtggtaaataaattggttcaatggtatcggtatttaagagctattaaacaaacaaccattgcttcgaataagccccatagggtcactgtataagccgagggcctcattgtccttgtcgggtggtggattttgagattgttcttgctttacaataaaaattaagggatcgcgcaattcatttggggtaataaaaagagtgtgaaatgttatcagtgatgcattggcataaaaaatagaaattggatccgagattgttgggttcagatcggatttaaattatttgtatgaaacgcttttatttctttattttttgtggaatgaatgggggagatgcgatttttgacaaaaatgtcatgctcggggggcgaatggagccacccaattacagcagatgaatcaacccacagattaagaattgggtctaagtcaaattcgcttaactgggaaaatacaaatttaagggctcgggtaccctttaattctgttagaggcatcagaaaaacagtgcaattgatagtgttttttgtcttgaacattcaagaaagacacgaaacgggaaatcgaaatttctgaatttgggctccaatgggtaaacaattttgaccaactttctccacaattttttggtaaaatgtcatcccatctgattttgtcatgccacaaagactgaaggaataatatgtgtgaaagtaaaacaggtgaaatgagtcctgttgggtcataaaacgaggaaacaaaggccaaaacagagcgctttgttaataaaaaattgggcgggggtggagaaagacaatagcttaaggaatcagtgtcagtgacccatttaatgcctaaaaatttttgatttgaaccggttaacttttgatcttgggaaagatgagcgagagtctaggtgaattgctggcaaattctctaagatttagggaagcccattcaaaaagagaaatggcatcagaacatttagattagccttctgagggggtggaggcaacgagtaaaatattatcgacataaatgttatttagtatttcgttagaaagtggcgaaggggatagggataaatgatgctgaatcccagatgattggaaagctgtgcaatcacccgaaaattttgggagttcgatggattagttgattgttagcaattgggactgaattggtggaaggctggggattggaaagtctggattcaaatttgcgtttgtcgttccgaagggctttggcgaattggcgtaattcttgtaggcagttatgatagggggtattagcaacttaaccatgattattcctaatatctttgggcttatgtttgtaatatggctaaagcatatatgttattactttaaagtaatattatatacattttttcatattaattataaaaacaaattagtttagattattatttaaaaagcataaaaaaattccacatttcgatatgatagtttttaatttataaaacaattagattatatttcttttctatatctgagttaaacgattatattgcattatacaagagaagaaaaaaaaataacttatagaaaattaattattgaaaatagcaaacaaaagaaaattaaaaattttaatttgtttttctaaatcaaatttttttgaaataagcggataaaaaattcttcgttgagaaaattttagcaatttttaaacaaatttatttaaatatgataattcttattctaatttgaaacaggctttagagataaattattcataattctataaatttttagtgatttttctatgatgaactttttgtaatatcattgtttgttatatttcaaattatttagcaaagagttaatatgataaataaattgtacgcataaatcatacttacatttagcctaatagctatttgtcaaatgaaaaagagttaacaaaaaatttattagaatggaaagcgtaataacaaacaacaaataagtgaaataaaacacattgaaagatttaaatctaactgttgatgaacattaataggctaa

SEQ ID NO: 20951 - DNA, 2595 bp, Heterodera glycines
  misc_feature (56)..(56): n is a, c, g, or t
  misc_feature (158)..(158): n is a, c, g, or t
  misc_feature (1871)..(1871): n is a, c, g, or t
  misc_feature (1884)..(1884): n is a, c, g, or t
  misc_feature (1933)..(1933): n is a, c, g, or t
  misc_feature (2200)..(2200): n is a, c, g, or t
  misc_feature (2202)..(2204): n is a, c, g, or t
  misc_feature (2208)..(2208): n is a, c, g, or t
  misc_feature (2227)..(2227): n is a, c, g, or t
  misc_feature (2238)..(2238): n is a, c, g, or t
  misc_feature (2247)..(2247): n is a, c, g, or t
  misc_feature (2258)..(2259): n is a, c, g, or t
  misc_feature (2262)..(2263): n is a, c, g, or t
  misc_feature (2268)..(2268): n is a, c, g, or t
  misc_feature (2274)..(2274): n is a, c, g, or t
  misc_feature (2279)..(2279): n is a, c, g, or t
  misc_feature (2285)..(2285): n is a, c, g, or t
  misc_feature (2288)..(2289): n is a, c, g, or t
  misc_feature (2294)..(2295): n is a, c, g, or t
  misc_feature (2298)..(2298): n is a, c, g, or t
  misc_feature (2301)..(2301): n is a, c, g, or t
  misc_feature (2303)..(2304): n is a, c, g, or t
  misc_feature (2306)..(2307): n is a, c, g, or t
  misc_feature (2312)..(2312): n is a, c, g, or t
  misc_feature (2315)..(2315): n is a, c, g, or t
  misc_feature (2317)..(2317): n is a, c, g, or t
  misc_feature (2319)..(2319): n is a, c, g, or t
  misc_feature (2321)..(2321): n is a, c, g, or t
  misc_feature (2324)..(2324): n is a, c, g, or t
  misc_feature (2327)..(2327): n is a, c, g, or t
  misc_feature (2329)..(2331): n is a, c, g, or t
  misc_feature (2335)..(2335): n is a, c, g, or t
  misc_feature (2337)..(2337): n is a, c, g, or t
  misc_feature (2341)..(2342): n is a, c, g, or t
  misc_feature (2344)..(2353): n is a, c, g, or t
  misc_feature (2355)..(2355): n is a, c, g, or t
  misc_feature (2357)..(2357): n is a, c, g, or t
  misc_feature (2361)..(2362): n is a, c, g, or t
  misc_feature (2367)..(2367): n is a, c, g, or t
  misc_feature (2370)..(2370): n is a, c, g, or t
  misc_feature (2380)..(2380): n is a, c, g, or t
  misc_feature (2396)..(2396): n is a, c, g, or t
  misc_feature (2408)..(2408): n is a, c, g, or t
  misc_feature (2410)..(2411): n is a, c, g, or t
  misc_feature (2413)..(2413): n is a, c, g, or t
  misc_feature (2416)..(2416): n is a, c, g, or t
  misc_feature (2418)..(2418): n is a, c, g, or t
  misc_feature (2430)..(2430): n is a, c, g, or t
  misc_feature (2445)..(2446): n is a, c, g, or t
  misc_feature (2448)..(2448): n is a, c, g, or t
  misc_feature (2451)..(2451): n is a, c, g, or t
  misc_feature (2453)..(2454): n is a, c, g, or t
  misc_feature (2458)..(2458): n is a, c, g, or t
  misc_feature (2460)..(2460): n is a, c, g, or t
  misc_feature (2473)..(2475): n is a, c, g, or t
  misc_feature (2477)..(2477): n is a, c, g, or t
  misc_feature (2479)..(2479): n is a, c, g, or t
  misc_feature (2481)..(2481): n is a, c, g, or t
  misc_feature (2485)..(2485): n is a, c, g, or t
  misc_feature (2487)..(2487): n is a, c, g, or t
  misc_feature (2518)..(2519): n is a, c, g, or t
  misc_feature (2533)..(2534): n is a, c, g, or t
  misc_feature (2536)..(2536): n is a, c, g, or t
  misc_feature (2543)..(2543): n is a, c, g, or t
ggccgtttttcaaaaaaggccccaatgaccaaaacattgcggctcgaactttatgncacggaacattaatgtgagtattgatctggctaatttcgaaacttgtttaaacaaaaatttgaaaatttcaaatttttcgaattcagattttgttcaaactngtttaaattaaacacacggaaaactaattaaaagtcatcagcagtagggatacaatttttaggtttttacctattttttcctgcgttctccatgttctgaaatgcccgaataatagttttttttggtggctgtcaagctacttttcgacttattagcacctattttcgaggtttttattttttgaacctagcaacctaaaaattaaattttggctttttccccaaaattattaacaagaatgcaataaaaattttttggaaatttcaaatgaagtaggcttggaggtggtaccaacaaggaaaaccgcaaattttcagcaaaaatactatttcaaaaaattgaaggccaatttgttcgtctatttcgctgtgatggaggcagaagaaatttgttcgccgggcgatgtatttatattccataagctagcataattgcaattgcaatcagttaattatattttaggtcaactttaaattttcaaaaaaatacaacccaaacactggcgccggtcgatgaggtcgcgactgtgagcctttctgtgatcagtgtaagggacttattataaaaaaacaagtaacgaacacacgaagtgtttgtggacggggtggtgaggaattaggatgaaatttggtatatctttcttggttaaaatcttgctgataatcttaaaatctacaagaatttgcggacgaaattgcagcacaaatctcatttaaactctcaggtcactggccttttggcggaggaatttgcggacgacattgcagcacaaatctcaagtgttggacatgttggcagctttgaggcatattttggaagaaaatgaggtgttagcgaatggtgtggagctgaggaggaggtgggtattgatctgatttgggaagcccgacatcgatattcggcaccgacaacctcgggtgggggtgccgaacagcggtgcgggatgtttgatttataagaaagatggtgatactgggaaggaagcaatgagtacgaaaggcggggtaaataaagttagaaaaaatccatttataaataatataagtacttgaatgcaaaaggaaccaaaatggtgcagatcaccttcaaagaggttgaccgactggaccgccgcagggaagagattctgaatacaatagtctcggcagcgaatattcagggatattttggtaacgctgttgttgagcctttgcaatacttccgcgccgcttcactgacaacgatggagtttgtctttatgcccaacgattacatcgtcagaggaccatcgatacgggacaggatggcatcattcctgcgcccgggacaaacgcagtggggagttgaaaatcctcctgattacggcacaaaacgaccgcggtcggagatcatcggcaagctgaaaaaacgtcttgccagcagggtgagctgtggttggggggaataaatcccggcatcgccgcttggcatcgaccacctccggtggggtgtcaaatagcggtgcgagtccatttaaatgtattaaccaaatttatatgtgaacatagtgtttggtcaacttctatctaaatgctcaggagaccgtatggactagacttctcgaagaagtccagaaggcctgaccacctactggccggtacgaagatcttacggtagcttatgacgccgtcatgagcgccggtgaggcgatcctcactgctaaatggccagagggcggggaccaacaagaaganaaggccgctcttncagaagcgatgcaacggattaatttccaattcgccgatctgttggcaanagcattagatgaaggcgaggaccttaatcagcgattgcagccgaccaccctcgggcgggggccgcagctgcaagaggtgcaggaggaggaggaggaggttggctggtttgtaaggtttacagctgtattatgataaatgctttttacatttttactttatagtacaatgccttccgtcgttaccgtccatcaaaccaaccacagccgcagaggaccacccgcgggcgggggcagccgcagcagcataagtcgaattaagaaggaganannnttcnttttaaatattcataattnaaatcatttantactaatancaacatcatcnntannaccanataaanaaatnaatctnaannattannatnaanannannatttnatntntntnaanatnannnccantnattnnannnnnnnnnncnancccnncatcnctntttaccaccnaccaccctccctctancttctcaaacancnnanccnanttcatttatatncattaacaaaatttnntnccntnntcancnccggtctcctatnnntncncnccantntcacccactctttctcttctcgaggaggtannccccatttaccgtnnanattcttncgcgttacttaggaagtacactggaaaatgcctgtacaaagtgattttgtat

SEQ ID NO: 20952 - DNA, 2107 bp, Heterodera glycines
ggaattcgttgctgttgattgtgctgtatgccttgctgatttatgttgtgtcggtatatttcagagttgtgatgtaccgtgttcatatttggttgttcaacaaactgaacatattgttgaatcggtgcgctcggagctggcgctacacgctgtcgcataccatactcatgttggtaattctgatgctgtacattctgccgtcccagattcatttgatggataactctctgtggttgtgctacagacgtaggattgcgttgctgtcgtgttacaatttgcggttctccgtttatcactaattccttttccaatctagcaataacactaaaattttctcgaacttgatccatacccatttggtttgctaccctgttttccactggggtcgacgcaataggaaaagaaattgggagtaaattttgctgacgttctaatctcacattttcaaacatacgcccagcgtcaaaatctgttagactcacatttctgttgtgaacattaaaagttcgctcttccaaattttcaaagttttcgaaattcaaacctccaaatccgtttgcattgtccacttgttcgttttcgtttcctttgtcctcctcaccatcacgaacatttctttgtcccacgtccaacaatgcatcatggatttgttcagtgttcatcattggttctgaaaaatttgaatgctctgacatcccgtcctcattttgtctcagtccattttccgcattgtttctgttttctctaaagatttcctgcccttcctggttaagaatgattcccgcattctgtgctctctgcctagttaatggcggacttcgcactatcattgttctcccagaaaatcaatttataaccaaaattcaaaatttccaccgcccaggtcgtctgcaaattcaaccaaattacgtagttcaaaatttccgttttcttcaaaaacaagttgaaaaccgctcaggtgtcaaatcgttccgataaatgccgctttgctgcacctcccaggtgacaatggcgagagatttatttattttctttaaaatttgtaatccaacaatccgttagccaaattatattatcgtctcgcccagagactgataaatatccagaaaatttcgtttgttcttacttttcgattttacacccagtacttcacttatagaaaacaaaattcgagtgcttcttacctgctttaccaggagcgccaaataggacgaaattccaaattaacttaaacaagcactgaatttgctggactgtcgccaccaaataaactcaaatcaaaacaaagtcaaagacaaccaatctttaagagaaattcataatatcggagatgaaaaccacaaaattaaaattaacaacgaacaacgaaaacaaaagaaaaatagggagggaacaatttaatcaacaaaatgccaatacaatttaaatatataatgagaggtcaaaagtcaacttaattactacaccccgcccctatggaaaaaggcgtctctgccgcaaaaggtcaattattcggctccaaaaggtggggttcgcgcaggaagaagcatcagcgtcggctactgtttgcttcattcgcaaaccgaggattgccacggccgcgatagggaagacgagcgttggtgtacgggtggtgacgagtcggaccaaacgaacggtggcgatttgtccaaatttgagaaaagcgaccgggtcggtcacccagacctccccccccatggttggcaaacgacgtcccggatcccgaagaagacgaagctctacgagagtcacccagactactcgtagagggtttttggacgacggacttcacggtgcggatattcaacgccttatcccctggaaacggggattgggtaaaaagccacgctttaagcgctcgaatccctgcgtctttcaaaactccctcaggcgaaataaggtgttggttgaaggagttgccgaaacggaagatttccaaaattgagcgaccattttccgtggtgctaatggagcgaaatttagcctggtcaatgaaagggcgcattttcatgaccaattcttcatattgagcagttttggcatgaacgtaaggagggaaggtgatgaagaagtcgacatgctggaa

SEQ ID NO: 20953 - DNA, 3076 bp, Heterodera glycines
  misc_feature (33)..(33): n is a, c, g, or t
  misc_feature (97)..(97): n is a, c, g, or t
aaaaccattcgcatgaactgttcgatggaaatnggcaatgcatgtgcggctggcaccaagctgatcatgttggcaatgtcgggcagaacctcattgnagaggcgaacgggcgcaagagagacatggatgaaagaagcggtagggaacaatttaattgaatttattaattatttctgtttaatcaaattgaattttaatgaattcaattaatgagaaatgtcgaataattaatagtgagaaaaaaataattgaaatattcacttaaaaactaaataagaggataattgaagaatataacgaaaaaggacgagctgcactcatttgaatttaaaatttgaacaaaaggacattaattgttttttattgattggataaatataattttggatttaattaggccccgggcgaaatacaacgattttttatcgccgacccatcgggaggagaagcggcagatgtgaaacacaaattagaagaggagcagaaaaagcatggtgacattgtgtttttgcacggctttgtggataagtacaagcatttacatctcaaagtgattttattaaaaaacaaaaattaattttaattaattcaaaatatattatactttctaattacaattaattgctttcaattgatagaaacggagaaaaaaagcctttgttttggcaattctttggcgcaatttaataggtcggatttacataagcctataaacatttttgcagtggttcggtgccctgacttggcaacaacggcactgtgccggtgccgaatgggtggcgaaggtggacgacgacacggtggtccatctgcgccggatggactattggataaacaaaaaatttcgccaaattgccgatgaccatccgctgatttttttcgggcatatgggcggcagtcgaaagccatttcggaacagggacagcaaatggtcagttgggcttagagtttgtggaggtgggggcatttctttgttttttcctttatttttttggaaattatgggctcggactctttgcggcctcgcatccttctcctggcattttcttatggcacaatatttcttagccttttattcgttttttgttcttgtttcttgtcattttcttggcaaaatattttttccaaacactttctttgtcgtttttcgacaaaatttcacacttgtgtaggtttctaagacttgagaggcgcattgtgtacatctcaaaacaatgaaatataacaaaaacagacaaaataggtaggctttttgtgtagctgcaccgtaacattctccgtcgagtaaaaatttgtgaatttacgccacagtatggcacctttaatccgcccctttttcattacttttggtaacttttgcatttttaaacattttttaaaaagtttgaccatcttaaatatagtacttgcataatccgatacgatatttgtcaatcgttacacgaaaatacatttgcattgacttgacaaagaactgatcatgcaaatctgatcactcccaaaaactggtcaggacaataaattattccaatcaatttctgatcagtcccaagttttttaaataatatttgatcagtaccaatatattttggttgcgggtttgatcgcccttagcaaaatctgactgctgatcacagcttattttctgatcacttggcattcaaacagattgtttattaaatgtttctaattttgtctctgctgaacaagtcctcccacactttttttgttgatttaactgtactggttgataaaagatttattgcgttgtttgacataaatataaattttaaaaatattaaaaaagcatatttttgaaaattgctttcatttcgctcgcttgatttaatcgtgagtcattgtgccgttgatcagtcttatcggtatcgtatccattctggcaaaaaatgttctcgtggggatagtctaaaatggaattacgcattgttttaatccaatgaaaataaaattaaaaaatgacccgaaagtaaattcgaattgtacaaaattgtggtgccgagatatacaaagaatcgcatgacaacacggcaaaagcaaaatcattagcccttggcattggtttcggcaaataaacattggcaaaaagcaaaaaaaaaaaaggaaatttattttaattaatttaattaagaaaatatgttaatttatttgcctgccatttgaatgaaaagtgcttcaaaaattgcttgtcttctccaagcaaaacaacagaaatggaaatattttcatatttttccttaaattttatttaaaaatagaaaaggacaattcgccatttgattcacctttaaatatccaaatccaaaatcaattcctttctccctaggttccttcttcgagtcccaaccatatttaacaaaatctcccctgcgggtgtgcacacaaaatttatgagactgatcgggggtgctctatctacccaaaaaatctcatttcgaaatcccacggacacttggccacctccctttgtaaataacattaaaacttttacaaaaacaatccttttcatttatgcttattttattaaagtgagattatttttagagctatgtacgaaaattcgatctgattcaactttaaaatttttcaattagtgatagacaaaatagcattataaaaataataaaaagagttgtgcctgataatttgataattagtaaatttttgaaaaaatcatcaatattcaaacggcagaattaatgctcctataccgtatttactcgatttccgggacgggagtccgaacaggatcccgtaaaaatcccgctcccgttaaaatcccgttcaccgaaaaaaagcgggaccgggaatctcgtaaaaatcccgcgggagtcccggtcccgtcgtgctctaatcaaaaacaaaaagaaaaacacaattaaataaatcgtaaaaagaaaaaaacatttatgaatttaataactcaaaattaaacagtaattttgaatttccgagtcctgttaatgattgggttttaaaattttcatgggcgcacgattagtcagacaaaaccctgtaaatagtaatttttgggaaatttaaagtttcctggttggat

SEQ ID NO: 20954 - DNA, 1352 bp, Heterodera glycines
ccctccccaaaatgaggcttgcttcggaaattgaattaaattggaatggattaataatagtttaatttattttttaaaatgattacttaacagtaaaattcctccgttatttaagtaaatcacctgataaattggaaaatgcaccgacaaaagcacaaaaatttttgtcaaaaacagaaagacagaacaaaaaatcaatttcgttgagcgaacaattcagacgagcttggatgctgactcttttcttggcattggtttaaggtaaccataaaaatgttaaatattatcagaaattttaaaatttccacggctcgccgccttggaattttttttaaatggcgcaaagtttcggagtcatgaaagcttttcgagattggattcattcacatttaaagtacaatatttcttatgctgggacttatttgccaaaaaaaaactcaggaccatgaccatggtgccgggtagcgatgttagggcgggaaaagcagcgtattgcgtttcgagtcatgttaaaaaaattgattttaatttttttgatgatttttagaataaaaatcagggtccagttttaccgacagcaccaatgggcaaaatttgtaattttaattgtatttgttaagatattttctaacagattcagaaacttttaagtattttgattaatatatattttaagtgtgaacattttattgaaattctttaatcgattttctccattaatttcgatggtattttgagattttctattctcataaaataacatttttagacaataaaaaaatatataaaacatttttgaaagaaaaaaatagttaaaatgaatcattttgtcgcttagcaaaagtaaagaaccttgagattagcgggacataggaacacagttaagtcactgaaccatgcgcataagataagtgcaaaaatctattggtttgaccgaaacaagaccaaaatgttcgggtcgcggattaaatttaatttaaaaaagtagctgaaaatgattaaaaataccgacagaccaatggttttttaatcctttaagaaaaatttaaaaaaactatttaaaaaaatgtttttttactttctcgttgttagtattaaatgacatatttttaacaaaacttgtctttaaccatggcttatttagccgctgtttgcttaaccacggttaaagataaaaattttaattaaaaataaactacggttaaataaaccataaaccacgggtaacttaaccggaaaataatacccctgctggtgccgcaaaaactcttgcaatttttaaaaatttcggtaaaaatttccattttacatcggctacttaattaattgaaagaaacaaccctttggatgca

SEQ ID NO: 20955 - DNA, 3070 bp, Heterodera glycines
  misc_feature (1925)..(1925): n is a, c, g, or t
ctgtaatttatattaattaaaatctcattaataaaaatctttttattttttaaattgaatagaaagaattccgtatttcctaaaatacatccttcccccttaaattagagccccccccccccctaaaatagaatcccccttttcaggggagttgaaaaacagagcccccggaggcactattttaggaaatacggtatgtcacattcaataaataattacgctttttaattataaataattaaaaatttttttttcccctaaaaatcgatgattttcttaaaataattttccctcaccctttcccgaaggcgattttcttttatgcgttgcacaaatcgcctaatttgcacagacatattcatcagaagagcacaaatgattacgccgaccagccaaactgctggtgaccagcgaaagacatcatcgaatgccaccaaaagaaaatttaattgcattttaaattaaaaatgtatataatttaatacaatttaattcattttttaaattaaattttatcgcttaaaaaattaaattaatcgttttgaattggttaaagtgaaagtccttcgcattgactttaattaattttttaaccaattttttttatcgcttataataaaaaattaatcattttttaattgcataaagtgaataaaaagtccttagcactggttttaatgatttcttcaaagaagaaaatatttttaaaatttttcgccactatttcggtattttcagaaccattttttgatgattttctcttcttaaaaatttccctaattcaacctggaatttgattagtacaaatgcgcacattagcaggaaaaacagtccagcaaagaccaacagtcgcttcgcttcttcatagctttcaggatggcttaaaatgtgaaattaattattattaatattaaacggaagaaggatgaccaataaatgttcatttaacgaaacaataaaaattgaaataaattttgcattggtaagattaaaattgtataaatataaattgtgaatctgatggccttatctacacacggaaatcttttaaatatgatatttttaaattcaaatattattgccgtaagggtacagttaattctgatttggatgaattttcatgtttcacatagctgtgctcaaaaaaaagatgtcgcgacaattcgtagaaacggcaactcgtataatggcttaggctaggcctaagccttatgcctaagctttaggcttggcctaggcataagcttcgactttatttagtaaaatatttttatagtatcgtacgagttcccttttgtagaattatccgtgagccataaaaaaaaaaatcccagcagctcatatacatacatttgctggtgttgcaaattgccaaaaacgcgttcaattgattgtgccaaagtagaggttgaacatggcacaaagtctcctgctgccgttgcatctgctgttactccttgcccaacaataacaattccgtcaaattcatcggctggtggtggtgttgcgtgcactggtcgaacatgacgatgttgttcaccagcagcagcagcttcaatgctctccattgaactgttcaatgtggacgggttggaactccaccaaggaaccatttttgtagtgattgagaatgtgatatgtcgtgttgaatttgaatgattggaatggttttggtcgagagttttcgctaattagtcgagaaaggaatttaagttcttgcttgaccttgacttcgaagaaaactaatttaaatttgtttcaaaagtaaaagaataataaaatacacaagttgggataataaaatttaatattcataattatagagataaaattttcaaaaacgaaaaaaagtgcaaatcggattttgtctatcattttcacagtgatccgatgaaagaatttttggttatttaaaaaattattanatttgaaataaaaatttttcataaatatttaaatatattaaatgaaaaaatatttgaccttaatttgaacttaattgaaaaagttttaattaaaaatacatgaaaggtctttattttactgtcaaaaatattttcactgtcaaaattccctctcgttaaaaagcccaccctacaaccctaaattttgatgattaaaatgcaatacaaatttaggcaaaattggggcgactaattaggcacagaagtataatgatacataaagaaaatttatattataattttacttacaaaatattttggtaatgtttagcgctatgaatttcacatggattgatcaaataaaattaccaaatttaattctttaatttactattaggtattatatattttgccataattggcgatgatcaattagacaaattgagtgaaaacaatcgttcaatatggaaaattaatagggagtgaaacgggaaataatacgaatttttctccgcaaatttggggatcattttttgggggtaaaaaatgtgcggggcaaaattgggagagggggcaaatttggttgagacaagaaaaattcgcacacacatcgcaccgacaaataaaacacgaggacggggacacaccgtcgacggggattgtttgtcgattataatcgaaggccatcaccatcatcaccaaaacatcagcacaattgatgggaaaaatgaacaaaaaaaatgcggcaaaattttcataaaattttataattgaaatggcgccaaatcggtgatatttagcacaaattttcataaatttaaagaaaatggccaaattagtggtaaaaatatttaattttcataaaatttatagaaaatggccaaatcagtggtaaaaatatttaattttcataaaatttaggttggccaaaattttctagcataaattttcatgaaatttctaatagaaaaaggccaaatcggtggttaaaatatttagcatagcaaaacatatttttttgttcatgtttcccaaattttgaaaattttaaactaaaacttgtcctcagattaaaggtgaaaccctgacaaaatttgtcgtgaatgtgttgagattttttaagaaatatctggtaaagaaatttaaaaaataaacatttctacaga

SEQ ID NO: 20956 - DNA, 1202 bp, Heterodera glycines
gttttcccacaaggcattttttctgaaaaccggattcaaaaatctggggtttggtataaccgttttagaaatagcgtagaaaacagcttcgatatcaagaaaccaagtcaagtccagaaaggaatattttaaaacgatttcgttttgttttggcattatgataccgaataactttcggaaattatggaaacaaaattggagaaattcgaataattttttgactgcaaatttttttccttttttgaattgggttcaaaaaaattttaagagaatttttgattattaatttgaagtcttgaatttatttgacaaatccaagacttaaaactgggagaagcaaggggctgtggctgggggcctaaaatttgggccacattggagaattaattctgatttctgaaaaagtcccagaaataactattttttctttccataccttcttgtagagctcgagctgctctttccaatggtcttatcccggtctcgatccgtgccgaactcacaaagttatggagtgaaatgtgaaatattgttttcaccacaaggcattttttctgaaaaccggattcaaaaatctggggtttggtataaccgttttagaaatagcgtagaaaacagcttcgatatcaagaaaccaagtcaagtccagaaaggaatattttaaaacgatttcgttttgttttggcattatgataccgaataactttcggaaattatggaaacaaaattggagaaattcgaataattttttgactgcaaatttttttccttttttgaattgggttcaaaaaaattttaagagaatttttgattattaatttgaagtcttgaatttatttgacaaatccaagacttaaaactgggagaagcaaggggctgtggctgggggcctaaaatttgggccacattggagaattaattctgatttctgaaaaagtcccagaaataactattttttctttccataccttcttgtagagctcgagctgctctttccaatggccttatcccggtctccatccgtgccgaactcacaaaggtatggagtgaaatgtgaaatatttgttttcacccccaggaattttttcctgaaaaacggaatcaaaaatctgggggtttggtataaaccgttttaaaataagggaaaaaacaggctccaatatcaagaaaccaagccaagtccaaaaaggaataatttaaaa

SEQ ID NO: 20957 - DNA, 2342 bp, Heterodera glycines
tattctgatcggaatcagtccctcgctccgaattttcctcttttccgttgcggcagttgcttcaggcatggcgctcacttcagcggtgagatgtgcagagacaatggcgcccatgacgaacatcgtttgcccttccacggatcgacaccattccgccattctgtcgacgaagcagggaagcgagcgatcttcggtcgatgactcacgaggcgcaaccggaccatacccagcctaaaaccaaagcaaatattagttgcggaacgtaacgagaaaggaagcaaaataccaaggatgagaagagttggttcgactgaatgggtgcgtcaatgttggctgccggtagacgcctatttccatacaaattgataattcgttccattttttccctgttttcctcttcgctggcgctttcgccgtttttcgtcgccattccttcgagcagcttcagcaatgtgttcacagtgtcgatacccggcttctcgtgtaactaagcgattttaacattcagatcaacaaaacattgatttaaagaaaactcaccggaattttccaaatgcctctgacaaaatcttttgccaagttctccttgtgaatgcttttgacgataaacatggcctgcttcgcattgtgttgattgttcacctgttcaaaaatattccatcttttttctttacgatttaattacgcgcacctgcaaacactccctcaaatgcattgtcagctttgccaaaatggtcactttgtccgcaaatttcgcatgtgcaccgctgttgctctcatcggaagttacaaccgtacagtcaaagtcgccacattcgatgagaagtgatttgatgttgcccacgacatgatcggtgatgcgctgacttgacgaatttgagacgagctcgctgaccacggctttggcccagtagacggtgtcggacaaatcgttgacgggagcggacagaaggaaacgttcaacgatccagcgaagaaccgatttttcgcccagggattgctcgatgaaaattggaacagccatctttggataactgtgaagcacttcggcaatcaatttgagcaggtttggaggctgcataagacgagtgtttttgtctgcgtccgcaaatgtgtcaaattgcgtcaactccgtcacgatttgactcagaagctaaaatatgaataacgcacatttacatattgacactacgaatgaaaataaccgttttaagaaattggtctgaagccgccgctgcatttccattgcctgtgacgtcaccccgctgttctttgaccagaatttcgttttgtttgatggccaagcatttcttcgccgcgtccatgtaaagtgagggcgaccgcaccgccaaagggaccaacatgcgcacaactctctgaaagcgagtgaattacattacagattttgaatgaaaattaacaaaccttaacatccttctgataacgcttcgttctcattgggcgcgaagtgatttcctgcatcgaaattggctggccattgcaagttgcggtgatcatttgttcgaaggctgactgaagaagtgcggcgtccgagtcgatgcactggcgaagaataagcgttgccaatgtgttcagtgttggaggcgttgtcgtgccatttgtcaccatttgtgccgaaattggattgcgcttcatctccagcagtgccttcactccatcctccttaaaaaggaatgttcaaaatgaaaatgcatttagacagacttacattcagaaactcctgcgccatcccatccaatgaaacgaggcgaagcaacaatgtcagcgcgttgtgtgccaattcgttgtccaacgggtgagtgctgctcgacttgatcatttccaggatgcctttgacaagcagttggtgtcgttcagtgcccttcctgagttcactttccagcttgacaagcttctccatattgaagtctccgcgcaggttggcgtttgcgtagattggcactgatgagtgaagcggatggaagccctgctgttgctggtcaggcaacaaacgcttggtcatctcgttcaggtcgatgaagtaaacgctctgggcaaccgtcagacgaacagaagtcttcttctcattgacagctttgttcagctgcgcaaccgacagctgagagaattcgcgccacgcgcccgtgtaatggtcatccgctgtccagtagaaccactaaaacttggtttatgtgctgcactttccacaaacaaaagacgcgacctgaaattgagttccgtccaatgcttcctgtaagagatcctgtcgtatgtctgcactccgctcctgctcgtacatgaggaagaacagcaacgtcggcgtcagcaatttcctcgtcaat

SEQ ID NO: 20958 - DNA, 1202 bp, Heterodera glycines
  misc_feature (34)..(34): n is a, c, g, or t
  misc_feature (58)..(58): n is a, c, g, or t
  misc_feature (68)..(68): n is a, c, g, or t
  misc_feature (1177)..(1178): n is a, c, g, or t
aaaaaaaattttttcttaggaattttacagtgcncagggatttgaattatccataacnacatcatagngtaaatatctagcaaaaacaaattttttttacacaaaatcctagtccagcaaacagatgaagcgacttaataaatcgattatggatttgcaagagttaatttctcaactcacactagctaacacggaatttgccgagtgtaggcgtaaaatgagccattatgaattacaagcgtatatcttggtccacattgagtgtgtgggcgagattaagtaattttctgaaagagctcaaaagcagctttcgaatggtgtattcaattaattgtttacttgaaaattcacagagatatgtccaaccgaatcttgaaatgaataatggcgtagtattctataaaaaaaaatttttcttaggaattttacagtgcccagggatttgaattatccataaacacatcatagggtaaatatctagcaaaaacaaattttttttacacaaaatcctagtccagcaaacagatgaagcgacttaataaatcgattatggatttgcaagagttaatttctcaactcacactagctaacacggaatttgccgagtgtaggcgtaaaatgagccattatgaattacaagcgtatatcttggtccacattgagtgtgtgggcgaggttaagtaattttctgaaagagctcaaaagcagctttcgaatggtgtattcaattaattgtttacttgaaaattcacagagatatgtccaaccgaatcttgaaatgaataatggcgtagtattctataaaaaaaaatttttcttaggaattttacagtgcccagggatttgaattatccataaacacatcatagggtaaatatctagcaaaaacaaattttttttacacaaaatcctagtccagcaaacagatgaagcgacttaataaatcgattatggatttgcaagagttaatttctcaactcacactagctaacacggaatttgccgagtgtaggcgtaaaatgagccattatgaattacaagcgtatatcttggtccacagtgagtgtgtgggcgaggttaagtaattttctgaaagagctcaaaagcagctttcgaatggtgtattcaattaatgtttacttgaaaattcacagagatatgtccaaccgaatcttgnnaatgataatggcgtagtattctat

SEQ ID NO: 20959 - DNA, 1015 bp, Heterodera glycines
tttacagcgcaaaattgggggggggggttggcaaaaattaatttctaacattttggacgagggcatgccccaggatttgcacctccccatcgggcggagaacttattttttcatgccactttttgcggcgcgtttttaatgggggacagcgggggtccagcggtgccgataaacaccgccaggaaattttagtagctttttcttcaatttttaatagaatttgttggtagcaaaaaaaaaaatttttttttccgtaattttgtggacttttggaaaaacctcgcgtaattttttgggaatttgatgaattacctaaattttggagggggtactaacaaggaaaaaagataattttcaacaaaaaataataattgcccattttcaggctgtattcgcggtctttgggtgttcggcgaagacgaatgcaaacgagtgggttcattattggttaatcggtgtgccaaaatgtgcggcaaacatgcttttcaatgccaaatcgtccatattttctttccacattcattttcagtcccgtaaccggacaaaaaaaaattttttttttcgtagccccctttggtttttttttgataactgccttcccctcaaatttgttttggataaattgttcagcgcttttttaatatttttgaaaacttttcgacggtaaaactttatcaccctcttggagaggtctaatttttaaattgttataagagaaaaacaaaacatggcccgttccgcgctgtttcattaaaaaaaatttttttttcaaaaaacccaaacaatttgtttgccaggtttttgacactctgacgaatctgagcatggagctgaagatgaaaagtgccggtgccaccaccagcagccccaaaaacagcatctccgtcatcaacaacgacagcggtgccgtcgccgctttcgctgccgcaacgccgccgacaaaaattgtcgctgccgccaaaccgtcaccgccgccaccgtcgcagcagcaacagcagcagtcgatccgcgtcag

SEQ ID NO: 20960 - DNA, 1450 bp, Heterodera glycines
tttccccggcggcgcctatcggcaccgccggcccccctttgttgcgaaattttcttgaaaaagcgtgtcgcaaaaaaagtgcatttgaaaagcaaaaaaaaggtcgccaaattacatggctgggaccccttcgcaaaattggccgctgacctcccccccccccctgacttcttcgcaaaaatttcggttgacccccccccccctttttcatgtatgtttttgagaggaaatcttagaaatgggggggggggtgtataaactgaaattttcatcaaaaaattattttatccataaaaattgtatcacttcgcattcaggaactgttggagaaaattgacgtgttgcagcgccagttggacaaggcaaacggcaacatcgaagtgttgcagcgcgagttggacaaggcaaacggcagggagcgcttgcgcaccgaaaacgagcagttgcgacagcgcgtcacggagttggaggcggacacgcactcactggaggcggtggcgcgcgcgttggccgggttggaggcgaacaaacagaagcagaagcaggacacaacgaacgtaaggcaacaaaaaagggggaaaaaactcgaaaatttgatttggtaaatgaaggcactttttgatcaatgtaaaaagtcggagcaggtcgtcccttccatgtcatttcaagcccccgaaattttttttttttttaattttcaattcaaaaaattttttgaaaaacttttcttacggtttttaatattttttggaggagttatatactacttttttgttgctgatcgacgacaaaatatttctgtgccacttttgttttttgctgcaattgtggcgatgataattaattaattacctaattaatttcttaattttgacaggatacgacggttgcccagtgatgatgatgtgccgatgatgatgtgatgagaatatgccatcaaaaatttgtgtgaattaaacaatgcccccggaatatcttttcacataccatccataaatacccaatttatttttctctttttttgatttgaatttattgtttttttaaatcccgatttctacaaaaccatgtgtgtgttttttattttgtttttgtttcaccacttttggattatgcactgtttttgtccacttttgattatacactgttctttcatgtcttgtcttgttgcattattttgcctgttttttttctggatcgaccacggctgagacggacggattccgtaaatttcgaaaaaaaaaaaattttttttgggggggggggcgggtgaattggtgtccaccggatttgcgccttctccaatgccagcagggatggggactgacgacatactcaaaacaaaattcgacaaaacaggaatgccggaaatgtggcaaaggtgcagaattgtggtcccgatgggaaaaagcagtaaaattttgaaaagcatttattctggggtagaaaa

SEQ ID NO: 20961 - DNA, 915 bp, Heterodera glycines
  misc_feature (857)..(857): n is a, c, g, or t
  misc_feature (864)..(864): n is a, c, g, or t
  misc_feature (884)..(884): n is a, c, g, or t
  misc_feature (903)..(903): n is a, c, g, or t
ccaaaaatggcgacccttctcggaatttagagaatgttaaattaaagaaaatgttaactatgcaacttagaaaaccatgactacaataatctaacccatttcatttaatgtcgattttttacataataattttttaattgtaagtttgcgtttatttttgctttatttcaaatttcattgtcagtattaaataattcacttaaaaataacaatcgtccgtgccttttattacaaaatttaaatacttttctttttatttaatttttgttcatataatatttttaattataaattttttagaaattttatcaattacaatagaaaattacttattgcataatgaatttatgttctctatttttaaatttgaatagaataaagttttaaattcgttttagtttaaataatagaatttcatcaaagctcccttggtcctgcaacgagctacgcgatgtcgggtggaattgtgaataatggtatattttttatcataaaaatttatagaactttaatatagttcagtgcataatttttcaattcctttttttggctccttaataaagtttaaagtaagtttgattcactaattgcttacaaaattgtgttcaaatatttaaattgtaaagttttgatattttatttttattaaagtaatgaactttcattttattagaatttttcgtttttatttgataattactatttggaacaaacattttttaattgttctttttgctcgtgcctggcaacggaatgttcctttttgagttcaacatttcatttattcaaataattttagctctcttagtcctttaagttctctgaccgatgtgatatttgtttgtaaatgattattngttattntaattttatatttttattanatgaaattagatcatattnaatttgaaattt

SEQ ID NO: 20962 - DNA, 1278 bp, Heterodera glycines
aatcatacacatcaaatcttataatcatttttgtacctctcctaatcacagttgtacctcttctaatcctgtaaggtcaacaaattttgaaaaacgggcgcgaagcgcccgactgaggccgcgaacggcataacaagctaaaaaacgggcgcgaagcgcccgtatgagttcaacggatttaaaaaacgggcgcgaagcgcccgtccaaggccaacaaaaattgaaaaacgggcgcgaagcgcccgactgaggccgcgaagcggcctaataagctataaaaatagaagactaaataaattatttattttttgtcaatcatatctaataatatatccagttgctccaggaacattcttcacacaatagccattcagcaaaacgaggtggaactcgacaaagacgtatggacgttcattgaaagcggaaggcagtctgtcccacaccaagaaacttgaaatttaagtaattaaaggaaaaaataataatttcacacactaagcaatttatttttaaaataaaataattaattaatagaaatatttgtcgatcaaattaaaacaaattcatatactaattgataatactatcatcttctctccaaattatgttaacaaatttcatataaactgagttttttatgagtttctatttaaaaatatacgaatatacatagatgatttaaaatccataaattaatttgtttttacaaatttactctaaatatataacccggttttcagacagaaaaatatcgggttcctgcgaaagttttaatataaattctgttttttttggttaataattgtaaatgaaatgtttttcatggcattctccgacaactggttttcgagttgtataatcgtaggctcagttgttagatttaagaataaataactggtaaacactatttttattatatttttataaataaacccaatttcaaaagaagattaaaacaatgcaaaaaaaaatattaaaatatataaaagcaaaatattaattattagatgtttttaagtgatttatttttaaatatattttcattattattaaatcaacttctattaatcttttttataattaatattaataattaaaatgagtaagttgcataatttattatgaaattcggaagattttttccaaattgcatatattatattttattgtaacttataaacaaaatgtcatttttattttttcatttttaatgaaaggcaaccaatagaatcgttttaaaaaggtcatttaatataattattcaaatgctaataaatt

SEQ ID NO: 20963 - DNA, 2075 bp, Heterodera glycines
  misc_feature (63)..(63): n is a, c, g, or t
atcattagacgtttgcatgtattttcgatttctgataatttttctggtcgtgtttctggcttnttctattgatctttgtagttgtatttcttatcattttcttttatctttgctgttgtgtttcttatcattagacgtttgcatgtatttttcgattctgataatttttctggtcgtgtttctggctatttctatttgtctttgtagttgtattttttatcatttgttttgtctttgtagttgtatttcttatcatcattttcatttgtatttgctgttgtattctgattattttcaagttttcatgtgttttttcttacgtgtttcttcaccgtagcaggaaaatgccgcgtgaaataataaaaatacggtagtgcataaaatatattttccataaatttttacttaaataaattcactttttagctaaatctgacgaacaaataaacctgttggatgttcttgaagattaatggaaattcctttatccccatttgaaatcacatattgatatattgtttaatcatatattgattttatttgtttgtttttattttgatttatattggaaatgtttttgttttgagaaataataaaaaggttgatgctgtaatggaaaattaatttatttattatttgtgacgatcactatgattttttggtaattttttagcgattagtattttacgagagaaggacaaaaaaaaacaaaattttccgctcattttttaatacagttcattttaaacacctaaagatacctttatttttggtttgtcacttaaaaaatgatttcggctttttagcatttctatccgcaattttcgaaaattcttaagaaaaatacagtaaaactcaaaatgtttcgctcatcggcgtctatcggcaccaccgccggaggccaaaattacttaaaactttaaaattttactcaaaatcaaaaaactataaaaaaacaggagttcacatttttgctaaatggttaattgccgccggttccatccctaattaatggccttcttttttggagttttcaataattcaatgttgggttaaataaattatttaattaaaaaacgaaaatataaacaaaaattttataccaatatttattttgctgtaatttatgcatttataataaattattcatttttatttttctgtaaatcatttgtgctgatgaatccgcgaaacacattaagcaaattcactgggaatgattttcacttttgtccattaattcatttatttgtcaattcactcataaattattttttaataattcgtacagtcaaataattaaaaaaaatttctttaagtggacattttctaaattttaatttattaaaaaaattattaaggttcaccatctttagctgcttttttcttcattcgcggcattcattttgccagcagaagtgtgatttatggaaaataagttgatcctggacttagcgtttaatgtcgaaaaaagggtaacatttatttttattatttgaatttttaattgtctaaaataataaaattaattttaatttatgaaaaaccatctctagccaaagtattatcagccacaatctcagcattgtgattttgtgccatgaatgaatttggcaatttacaaaaaatgtgagaatttttttttgaattatattgaacaacttaaagcatttagagttttaaaaaagcaattgacagctttttcctctttaggccaacaatttggccaaatcgaacgaagaatttatcactgcactcgaagaggggctacggtgcttgacttaggcccatttgagaatacgcaggacaatttggcacatgccagaacccattagtgctttaacggtggccgtattgtttttaaaaaggccacgacatttggtctttttgtctatttggtgatagaaattcattaattttatcaaagaatttttggattaaatttttggtacaaattttggtcgcttgatcatgaagctgacattcgttttgcctaattcgaacccccgtccacgaaactcaatcaaattaaatttcactttacattaaagtgcggcacacaaaacttacagatg

SEQ ID NO: 20964 - DNA, 963 bp, Heterodera glycines
tggtgttgttttatccgactgcgtttgtagccattgtaatcgagaaacggggataacccgcacggaacggcacagaatcgcacgtgggcacaataccaatgccattttcaagtttggaaaaaacatgtctttttaatccaagattccaaatcaaaacttttgaaaatctcctcattggtgcctcaaaattttttttttttgaattaatcatggaaatcatcttttaaatcgtcttcgtttcaagaaaaagcgtttttaaaaataaattttggttttagcaaaatctgcggaagaaacatgttttgattaaaatttatgaaaactccttcatttcccttttcaatctcatattgataaatgttttttatttcatatattgattttatttgtttttttattttgatttatattgaaaatgtttttttttgtttttaaaaagattaataaaaggttggtaccggaatggataattaattaatagaattttatattatcagtagggattagcttttaagcacaaaaatcgcaaaataggcataaaataggggaataaaattgtttatgaacgctttttaggtagcaaaggaaataaaaactaatcaaaaacttatttaagtgttatattctaatttattagaagtttttttcgaataagaacaatttttgaaccaaaaatttttatcaagaaaaaaaatttaaattttggggaccaatttgaagaaaaaattttcattctttgtggcgtattttctgaaatttttcagatcatttcttaagggtatatttttcgttttattgcatttttgttaaggatttttcagaaaagcctcaaaataagcgccaaaatggtgaaataaggaacaaattaggcttctaggcattaagaataaaaaccccccgaaataggcaaagaaaggcattataataacattggtcctaggaacctcataacaaaacgcgttt

SEQ ID NO: 20965 - DNA, 1458 bp, Heterodera glycines
gatacattcgacatgagccgtgtccgtgccgatgggaaaattttgccagagggtctgaagtgcttgcgtgcctggatttttactcaaatcccacgattccctgatgataattctcttgggatccatcgtttgtctcgttccgttcaatctgtctcttctcatttgtcagaattgtctattgatcactctcataattctcgtgaacgccgggctcaccatccttatgctgttcgccaatccttttaccgaggccgaggccgtagggatggaaatgcgctggagactcgccgccgtcattgagcctttaaaccttggaaccccaccgatcggagccgaatttgccaattcttttttatttgtctttcacatctcttttgacgagggaccgtcttttcataaagggtcggggtgtgatatcatttggacttcattaattatttaatttattatgtttgttttggcgttccgtttattcaaattgaccttaaataatttgttttggttttaattagttcttatgattgtgaagtaaaaagttaattgtgtgattgatttattttcttctgtgcctaattctcgccggttttcaagtttgtttgaaattgtgtttgttttggttatttcgttgtctttaatttcgttttgcataaagcataattttattgttttcgatttattttgagacagggcaagtacctttgactgatcaacaaatttaaattgttcgaattgcttcctttgccttcgcttgccaatttggaaaataaagtagaagccaaattggccaatttgttttaactaaatttcccgtactcaaatgatccgattcatattcccaaatgtccaaacttgacaaattgctcaattatctttttttaattgcgataaatttcgaagatttttaatagaataataaaaaatcgaaaagggttgaaaaagcgatgattataatgatgaaaaaaacagttaatcgataaaactgacaatttttagcattcacattatctttgtcgattataaaatgaatagaataatagaaaaagcttaattaaaataccaagtttgaattaagaaatcctatataaaagaaaaaacaatgtattattaatgtttctcgtttttctcgtatctcgtgcctcgtattttattttcccttttgcaatatccctggtgtgtggataagtagtttagtttagaaaaaatcgtcaaataaaaatgcaaccatccttttcgcaatggtcctgcaagtttttatgttttttatttaccttacaatttttaaaattgagaaaagccttaaatttaaagtgtttacttaatttatcaagtttccctatttttttcttccttcaatttttttgtctctcattgttcgattttgtgcatctttttcatcagtttttctctgctgcatttctacaatccgcgactgcggcaaataaacattttaatcagcat

SEQ ID NO: 20966 - DNA, 1368 bp, Heterodera glycines
aaagtgattataagaggtacaacagtgattagaagaggtgcatcagcgattagaagaggtacaaacaatgattagaagaggtacaaacaatgattagaagaggtacaaaagtgatagaagaggtgtaacagtgattagaagaggtacaaatttgatgaagaggtacaaaagtgatagaagaggtgtaacagtgattagaagaggtacaaatttgatgaagaggtacaaatgtgatttaaagaggtacaacagtgataaaagaagtacaaaagtgattagaagaggtaaaaaagtgattagaagaggtacaatggtgattagaagaggtacaaaagtgattagaagaggtacacatttgatgaagaggtacaaatgtgatttaaagaggtacaaaagtgatttaaagaggtacaaaagtgataaaagaggtacaaaagtgattagaagaggtacaccagtgattagaagaggtacaactatgattagaagaggtacaacagtgattagaagaggtacaacataaattcaaattaaaaattgtatgaattataaatttattaaatttaaaaataaatcctccatttattaattgaaaataacgttgaaaattaacccaaaaaatacaaagaaaaataatgtacaccgcccggcttcgaacttcgccccccccccaaaaaatgatgcctcagaatccccaatcacacagggattctgaggtcttgacgatgtcaaaagtaaaatctgatcacgtattcgtgatcagcgtcccaaataacccctaaagacatgtttttggaagatttttggtgaaaaatttttttcacttaaaaaccatatgctcccccctttggtcccgaatcccaaaatcacttttatttttgtatctttttttaaaaatgtgatagaaatgccaaataaaatttatataatagagcaaaaaattgcggattttttcagtatttaaaatttcaaaaacacctttacagaaccgagttctgaatttttttctgaaaaatcgaaaatttccagaatttctggaataactttttttgtttttgtgatataaatttcaaataaatctcataaaattctcccgattttttgctatttttaaagctttaattcacttaaattgaccagtcctccattgagttatgaattttcaaattttaacccaaatttccaaggaccaaaaaaattaaaaatattttcgaatttttaaaaaattccaaaaaatctgaaacttaaaataaacatcatatttgtgctcaggaccctaatttaccccagaaaaaatttttttcaccctctttttcaacccaaaaaaaattttgaaaatttctagggggcctagctcgaaaatttttg

SEQ ID NO: 20967 - DNA, 3510 bp, Heterodera glycines
  misc_feature (1773)..(1773): n is a, c, g, or t
tcaattaaaatcacagcttcaacgaatgaagtgaaaatgtgcaagaaaagggaaaaagtgaaaataaataaataaaaaagaataattgttaataaaaagggaagaaagaaaagattagcaaaaaaaagtaaagcaatgaaaggaattggcacaatttccgttgcaaatcgcacaaaaggcgaaaatgccaaacgaaaagaggataaatttgcaaaaatgaattaattacacgtaatgccaccacaaacaaccacagcgctaatcagaaaattaaaaaaatgccaaattcaaattttgcaggcgccgcttttcctcatcaaaaatcggtgaatttttcggcgtgtgcgtccggcgcgtcgccctgcgagtcgccgtgcgactgcaaaagttcgtccgcttcgtcgatttgctccacaaaatggcgcgtgtcgtcgggcccactaactttggggtaaagcgcctcgaaaacgcgcggcatttccgccgggtatttggcgctgaaggacgcgttgaaattgggcggagtgatctgtaagagagagacagcacgggaaaagtggagaaaggaaaaaaggcagagaaaaaggggcgaaaaaaaagtcagcaaatggccaaaagaacggccaaaagtgaaaaacagataaacatcagcagcggagtgcagacaataaggccaccacatcaaacaaaacgcaaattcaaaaatccgccaaacgtccgactgacctttcgctgatagacggaaatccaatcgaccgacgcgaaccatttgtggtttttgatgtcggcgacgccgttcttcaaattgccgtaccttttggtcaggtcgacctgcagcaggttcttcagcaggtccttcagctcgttggagaaatgtgacgggaatttgacctggaaatgatggcacaatgccaaaatctgaaaaagcaatggtccgacctttccagacacaattttctcgtaaatttggatgggctgatccgcaaagaatggcgggtagccggcggccatttcgtaaatgagcactcccaacgcccaccagtccaccgctttgttgtacccctgcaaaaagttgccgacaaattcagtaaatttgctcatccaaaaaacacgccttgctaagaatgatttcgggcgccaaatattctggcgtaccgcaaagtgtccatgtccgacctttgacccgttttgcgaatccgaagtcggtaatctgcggaaaaagtgatgccaatttcggaatgtcatatgcaaattgagagtccaattttaatggcatggcattcttgcaaaaagagtgccaaactccatcttcccccctcgggcttttgcatgccttcaaatatccgttgctatcgatcagcaaattctccggcttcaagtcccggtagatgaggtccaatgagtgcaaatactcaaacgccagcacaatttgtgccgcataaaagcgcgagtgtggctcagagaaacgaccaatgcgtcgcaaatgggagaacatttcgccaccgctgatgaactccaaaaccatgtacaaattgctgttgtcctaaagagaaggggagaaatagaaatttgaaattaaaattaaatttaaaacgaaaaacaccgaaaaagacacactttaaaggaatattgcatattgacgaggaagggaaagtcgatggcctgcaaaatccgcttttcgttcagtgtgtgttcgacctaaaggcaattgaaacgaaacaatcggtcatttgctggtcataataaaccgacctgcttcagtttgaccacttnttgtttgtccaaaattttcatggcaaagtaaatgccggattgtttgtgcttgaccagcatcactcggccaaatgagcccgtcccgagcgtttttatgcggtcgaagtcgtccaaacatgaggtattctaatgaaacatttatttttaaaatgcacaatgttagaacaaaaaccaaaaagtcattttgcttaaaattatttaacaaattttgcgctgtctgtccttttgctacagtatgctgtgccgtctaactgtctctgctgcacttcgaattgttgccttttctcatttaaatccaattgctacagtaatccccgtctctctctctctctctctctttctgtttcttccttttctattttatgcccttttatgcacctaaaccacaatatccttttttacgctaattctaattctaaatccgtccatgtaacaagtgcatacaaaattttcaccatttgtctggccgagcctttttaaggaaattgaatcttagaccttgggaaagtaaaggggaaggagagaggagaggaggggagacggatagagcggacataccgtccgttagtccaaaaatagcattgcgaatgaatccctttttaaattatgtgagcaaaaataaaaaacaaacaaaaataatctcccccctttttttcactatgtgaccaacaacacaaacatttgttacttaatgtgttcctatttttggctgtctttttgttatttggaagaaaatatccgcacggaaattaatgagaaggataaaaagtaagggagaattgtcacgaataaatgaagtttggaatggcatttctccgagaaaggcatgccgtgctctttgtgcgtcacctcacctgccaattcaaaaggcgacacacggagtgcctaatggccgacttcagccaaaacaattcggcacggagattgaactcgcgtgcgcctccgggcaatgcgacggctgtcgcctgcttgaacaggtcgcatactttctgcacaaagctcttgcgctcaattgccaaaatgacagtgcccttcagaggtggccaagaataggcgtgacgaagttcgggccggaacaatggaccgtcgtcatggtcggcattggttgagaaagacgagtgttgtggaatagcatttgccgaaggggccgcccaaacggtgccgccgttgggaggcagtgacgaggactttctctgctgctgttgatcaaccctcgtggcttttagcaggggctgttgctctcccaccgattgatcaatttcagctgagaggggcggtgtttttccgtcacggtaaccactcgccatagcattctccgaaagcagtttttccgtcgcgttgtgctgaaactccgcttctgcctgtgcgggggcatgtcgtcgcacgggtgtgccggcggtaaggccgccaaattttgtttctgaaccgcacggaaggacgggcaaaccgccgaaatgcagcggcggtggctttatgttcggttgctgctccgacggtgcgttgtttttctgatggtctgacggagacaaatccgacgctgcagcaagagtttcgcattgtgaagacggcgatgtgccgccccaaccgccgtcctcatttggccgcacttcgtcaccacaattcggtgctatttctgatggtgttgttgttgttgttgttggcattgatgaagcggttgagttggcagagaaaaccaaagggaaaggaaagggtccgtcggcagagcccaaaaaagaa

SEQ ID NO: 20968 - DNA, 1226 bp, Heterodera glycines
aatgccgtaaattctcttagagctctaatcgatagatatatgaaaacaattttggtatgagtccgattttttgaactacctatatcattttgcttggccaatttttacggtaaaaaccaactcgttttttgccaaattttaccgggcccgtctatttatggagaatctagtttcgaaatccaaactttacgacttttattttcgaccaaattcagaccttacctgagttcttgcgaaaaaaacggaaattttatttccttctttacccatccatcagtgacccgacaaccactcatttattggtttcccattttttaataaaattgaattgtttaggcgcaattggtcacattcggccgttgaatttatgaagtatcgacgtctttttcccatgcttgttggagatgaacatgatccgggcagtgtgtttgatggtttgtgaattttgggtttctttttgaaaataaattttcccaaatcgctaaaaatcccattaatgaaccgtcggcggacttctgactcaactctcaaaaaagcatttatataggaaaccggtacttgtgcagtttacatgatacttttaacatacattttcaaatgcctataaatgttgttttagaaattaatgaaaataagttttagggggtttttagggtcgctgatcacgaatacagcaagggctctgtcctgggccctttattatttttgatctatattaacgatcttcctgatgctttgccatcatgagtaagaattaaattatatgctgatgatgttaaattgtatatttgttataaagcgagagctgacacagaaattatgcataaagcattgcataatttatccgaatgggcaaataaatggcagatcagaatctcaattaaaaaaacttttgtacttcatttggggaataaaaaccccaaagaaatatataaaattgatggaaatataataaatgttgtggatacaattagggatttaggcataaatattgataataaattgcaattttccaatcatgtcgcacaaataataaagaatgcatatttacgtatgcgttctttatttcgggttattaaatcaaaatcttctaggatttggattattttgtaaaaacttatgtagaccgttattggaatatgctcaggaggtttggaatccatctcttctaaaaaatattaaaggagaaggaaaaatgtcaaaaatatttcaccaaaagagttctt

SEQ ID NO: 20969 - DNA, 1336 bp, Heterodera glycines
gctaagacaacggatccacgtaaggggcaccgagcggcggttcaaatccggtctccaccccaatttttcgcctaaataatatatggattaaaaatgaattcagtaagtcgttagaatgatcagtgcttgatcatcccttaatcatcatgatctgatctttcttccctccccatttcatctcttccaaattctgcaaaacaccaacaacctttatcgtctaacgctccatttcgtgcaccccctcgttttccctccctctctctctctttctctctttccctcgctccctctcacttcctcccactttcttctcagcttttcctaccattttgcggattattaatgccgcctccgcttcatcccctcccctccccccctctccgaaaacccattcaaatgccacgccttggcattcattccttcttcttcttgtcctcacattcctttgctctttttgctgttttattttcttggcgagggtgtaaaatgaatggtgaggccggggagggggagagacaagcccaaagggaatcttttttaaagaaacggaaaagtgacggaagcaccgcgggggggggagggggcgaagaaaggtcgatggaaattatctgaaaaggccatgccattttgaatggaaatttttgggggggggggaggcgcaaaaaacgcctggggtaagagagaaaagattgccaagaagcaaacagcctatttgtgaattcaatgccaagcacagcccacctcgtggtaggccctggggcctcatttcttgaacagagacccgcgaaatgtccaccggtgggtagggacacacggagtcgggcaagttcggtggttgctgctgatggtcgggcagaacagtgaagtcgtggcttatctgagcaagatgattaggcacttggagcgtgaaggacggggaggaggggcgacgccgcagggaatggcagcgatcgaacgaagcgaaagggccggcggaagtggaagggaaggccgaacagccgtcattgttggcacagtgcacctttggcgtgtcattggcactttgccccgacgccttcccaaattggcactttcactcacttgcccacttcggcctcttctcccttcgccgccaatttgtgatgttggccacgttccctcattgttctgcaacatttccatgctattcccgccgtcgttgtcctccagcctgagcattgccctcagctgatcgtctggcaccacaaaattggaaggcacaagccccgaacgaccgtccaacgtctcaccccagtaaaatctaaaaaaacagagacgagactatgcttaaacattcgctttaccctgtcctcatcca

SEQ ID NO: 20970 - DNA, 806 bp, Heterodera glycines
ccccctctctgccccccccatttttctcccgctttttctccctttcccccatttttctcccgcttcctcttttcccgctctccgtcccgcacattctcccattcccccaccttgtgttgggtttgccccgaagcaatttcctaagcattgctgcgtctgatcccatgggcaactgctgcgattggcttctcgtcccatccttctgctgctcttcttcctcctccgtcttcccatcttttcttcctccaatgcgcatttgccctcaagggcaaatggtttggtgaccaatatggcacttcggtgtttttggcgttgggggcgatgattaataagcctatccgttggtgccagtgccactgctttgccccctcaattaatcctgcttaagaatgatcgcttaagttatttggcactgtcacaaagagggggagggggagcaaaggggatcgatttggcaaagcggcgatgttgggaagtggcaaaacaacgcgtcgtttctcggcaaaaactctcgtcttcagcgacgaagtgcccatcgccacgccaccctccgccggagggggcagcaaagggattgaaacggacgacggaggaggaaatataaaacagtaaaaatagagcgcgcaagggagagaaaaggaggggggcgggggcccctcccgcggaggcggcggaaaatggcggcgcccgagggcaatgatgaggagggactgttagccggctgtcgaaggcacaacggccacggaggcacggagacgccggcggcggggaaacgacagagggaacggcaaaagccttcgctcact

SEQ ID NO: 20971 - DNA, 2374 bp, Heterodera glycines
gtctctcaaactcaggctaagcaaggatttgagaatctggccgaaaagctcaaccagtgcggaaagggtgggcggcaacggcacaaggcaatcactctgaacaatcgaaaaaataaaaaaaatggtacattgagaggtaaacgacagatcattgatcagctaacacttgcacattaacatttgacaccatacgaagcctataaataggtgagataattttagttttttcacaatcgactacactctcagcaacatacattaaatattttgagagaaacatactaacaaaaaaaaactcagtggaaaatgagcgtaattaaaaagattgacaaagacagtgttgagggtctggaaggaagtctttcattattctctttgccgccaacaaatgtggccataaataagacaaacgtccgtgaattgttgcctctgtctgcacttaatcagacaggtccttatttgtttcgcctattctcggacagccaattttgtgacttgagcaaaacctatatgtacctgctcagctcaattgaacggaagaatgacgcgggagaatgggtagcactcagtgacacggacccaaacgataaacatgttggcgtcattcaaaactttgctagcagctttgttcgctcgctgaaggtcaatatttcaggcattgaggtgtttgacagttcaatttattatcactaccgcgactacataatgaaggagttgggctattcacaggaaattcgcaaggctttccatgaggcatcgtgctactatgccgacgatgatgaccagaacagcgcaacaaacccaggttttaccgcacgtgcggcacggttttcaggcggcagacaatgtgagacaatggtaaaactgaattttgatttggcacgtcaaagtgcattgatgttgaacaatcaggatgtaatattcactattcaccgcaacaatgattcattcctcctgcttacgcccccatacaaaaaaccagatggtacacagcaggaaaataagaaagagtaccgcatccgtgtgcatgacatgcgtctctatgtgcgcactgtggacgtaacgccaagccttaaccttgccattagccggcaattagagtccacttcagcaaaatatccgctgcgtaaaattgagatgaggtctattttccttggcacaggtcggaccgagctggcacacaatgtgttcacttctacgttacctcgtcgtttaatttgcactttcgtttcaaccgatgcatattccggtaaccgaaaaatgtcaccctacaagtttgagcacgccaatgtacgttcgattagtgtcgaggcgaacggacagacttttcccagcacaccgtatttgctgtccttcgatggtgtacagccccgctttgtccgtgcttttgtcgacatgtacgcaggcctgggtttggatgactccgacaccaaaacggtctcgattgggatgcagcgttttcttaacggttgggcctttttcgtcattccgctgacttccactctggaggacacacctggttttgagctgatcaggcaaggcacatgcacgataaaggtgcaatttgagcagcctataaaagcggatggatatgagatgcttgtccttggtgaattcgattctgtgttgtccattaacgcagaccgggttctgagtacagacggaagtgtgtaactgactgaaactgattgacactgaaaagcaacaatgaattcagctcaattggaaataattctgaaaaggttgcaccctaccaagaacaaattcattggtgttttcccatctgatcgaattccgaagcgggtttccaaattccctcattgtatggtcgtgaatacggacaaagaagggacacgaggtgaacattgggtggcttgctatgctttaagccatagaagggttgaatattttgacagtcttggtgagtccccaaacccatatttagcggtctacctcaacacatttaaagaggtactggtcactagggagcaaattcaatttcccacatccgatacatgtggacatttttgtgtatattttttggcaagccgatgttctggcgttcctttctgccgtgtgattgagactttgcgtaagactcgaggcatggcagattacctcgtgaaatggtttgtcagaaacttgatcaacggtctataaaagctcacgtttcctgaacagtgagaaaaatgatggttcattttatgaatgtttttaacgcaggtctagtcctcagctgtgtaccgtcactattgcaatcggagctgataaatgtggatttgacggttgacaatcaaaactatttcgatagcggcaaatatcgtaccttttcaaaagatgctacagcagcacaacattttggttatagttggaa

SEQ ID NO: 20972 - DNA, 2748 bp, Heterodera glycines
  misc_feature (10)..(10): n is a, c, g, or t
  misc_feature (75)..(75): n is a, c, g, or t
ctaaaataantcttttctcgaaaaaaaaattcaaaaaatcttgtattttttgaaaaaaagggtgggtgctaccantcgggtccactcgcgtttcggcgccggcagtttcggctgccagcatagttatttgtgtctataactttttttctatagtaattcaatatccacacattgtctgatatacattcgaaagcttaacatgtttagaaactttttctaagcgattgcttcgcgattagacaattaccaaaaagttatacatgaaaattgcgaaaaagtcaaaatttacaagttttttcttaataaattttttacaggcttgaaaatctatccgctttttgtaaggctaataaagcatgataagagctttcgaatgataccaagattgttggacttggatgccaaagaaaaaagcttaagtggaaaaacgagctggcgccgaaacgccagcgccgaaacgcgtgggtcccctaccacctaaactattacccaaattttggacaaaacgccaaaataggcaaaaaaagaacctctttcaaatttttttaggctaaataaaagctaaaagcctagaaaaaaagtattaataattcgaaaagtagcttaacagcccaaaaaaacaacatgtttttcgtgtgtttcaggccacggggctcaggaaaaaaataaaaatgttagccctattcatagcattgtaacacatcggcacgtcgttctgatgaggcatgaacagccaattgctcttggccatccgacggattggcactgtcaccaggaggaaattcgaggaaaatgtcgtcatcgaacgtgacgaagctaaggatggacaccgttacgggcactgtttgttgctccaatttacaattttatgccgcaagagacgaaaagggacgaaaaacggtggagaaagtgaaaacattgtggtcgattatggaaaatagaaaatatgatgatttaaaagcaactcaaatttagttgcttttatatgatagtaaagactcgtaatccgccgaatgactttgttcggcaacggattttgtgggattgcaaagcttatcctccgtttcacctaaaatttgcatttctttgctgttaaaccatcgctttttcattcgaattagaattggtgtccaacgtctgtttacgcattttgaactattcgtacacccaactattaaagcggcgactgatcagtgcaattccgatgccaagctgaaaaggcggaagagaagaaaatcgaacattttgagtcaaaaatcggcagagattaagctgaaaaaaacaatgattaaccattgtgatgtttttccctcttagtataaaaatgctttttccgctgccatttttcattcacgttgcagttttgttttttttttggattcagtgtcggcacatttcaagacccttccattgtttcatttatatgtgcttaaattcgacttttgtttttaaattagtcaaaaaacctttcaattttttgtttcagaaaagcttttgctaaccctgctttttacacctctgaattccaaaaaaaaaaaaaaagtttttcattatgcatttttgcttctgtacatatttcgttttcttaaattgtttcaactgctttccctttcccgttttctctctcgcaataatctctttaacgaattgcccttttcttattgtatttttttgtaatatttaataaatttttgactttcttcagcaagcactctgtcggttttacgaattgttttttgatttttttcttttctaagtttttttattttaggccagtttgccatgccgttggttgtgtttggtggcactcaaaaatgggttgctggtagcgcagggacgtcttcatttttggaaaacggtggataatttttaaagcacattaaaattttgcaaaataacggcatttttttctaaaaatggcatttttatcagaaaaccatgacagaaataccttgaattaaaagtcgaaaaattgacctgaaagttcattaaataactgaaaataacaatgtgttactcaaagaatccaaattgtcgaataaaacatcccatacaaagcaaaacccggtttaaaaaaaaacattttgccaaaataaaaatcaattttcctactaattgtgcacatttttggtgattaagtcagtttcatgcaattttgattagagtatcacgtgaatattttgagagaaatgtgaaagctgcatattattttgtattctgtatgcgaaacatagggttttgcttttaatgtgagttgttgtgtaggtgaaaaattattcaaaagtcattttcgtatgggtttctgtgaaaattagagcattttatgaatgaatggttcccctgttgttgacattttcggtcatggtaaaaaacaatcatttacgtccccttgtccgttttttggtatgatattgagcatttcttgtgaaccgattgcgaagccgccaaaaataatgtaccactgttagaaactcaggaaattgaccttaccggtagactaaaatttatattttctcattgcgcatgccgtccaatttgctcgcacgcggctacctgacatttaaggacagaaaatgagtaattgatatctgaggatatggaattggtgacggactatgtatgagtaaaaacaattcaataaatcacccacttttatcggtaatgctggagaattggtgtcccggtggaaaataaatttaaaatttcatgtcaattttaaaaaaaatgtgctggttacctacgaatttt

SEQ ID NO: 20973 - DNA, 895 bp, Heterodera glycines
aaaatgaaataaaaataaattttctttccaaatcaaaaataaatcaaatattcgcttcaataaaaactataagtcaaaacagtcaatcaaattttgcatttttttatttccaacccaaaaataagcacaaaataagcacgtaatgctgaaataagcacaatcttagaaataagcacacttgggaactctgaataagaggcttctttgtcttaaattaaattccatttagcctccaagcaaggcatttcgtgttgctgtcccgtcgtatgccgctgctttcatccgtaataattaacgacagattttttttttttgagtcacgttggtctaaaacgtgtggaaaaattttttagtttcttttatttagctaattgctgttttttattttaaagctccaactaaaagcctacattttgcatattttggcgttttttcacaaaactccttaaaataaaataaatcgaaaaattcacccactaagattgacatttcaagttttcaaatgttcaccggtcggaaaaattaatttttttttttttattaactcaatttctcagccaaaaaaaattgttacacataaaacctaaatttgaaaataataaaattttcggtgaatttaatgcaaaagatgacaaatattaatactggtccaattttttcagacctgttaaatttgaattttttcctttttggaggttttggtgcttaaaaaaatcgccgcatccattagtattttccaattttttaacacttaaacaataattttcagtgatggtgagcgtgcttctgcacttcttgctcagtcacttctttggcgacgaatgataatttcttagatcctggtcggcgcggcgccatcacccatttgaccccaatccgatcatttattaaaaaa

SEQ ID NO: 20974 - DNA, 1067 bp, Heterodera glycines
  misc_feature (62)..(62): n is a, c, g, or t
ttgataaaaacgcaaaaaaagtctcattgtcccccatcaataattattgtattaattcagtntaataaaaattattgcatatgagtttattaatattatgtcacacaatctgatatgactttacctgctttaccacacaaggtctaagaataccacctgttaagtttgtttttcagggttatgtcgtaagtaaggaacggaatggatttggatttatatggatttccgttttttttgcaatttttgatccaagtagtattttaaggttggtttgagacttctaggatgccttccagattttccatgtttcagatttttgtccatatttggctgttcataaaatttctcgaaaaaaatacattggaaagaccaaaatttatttttaaaaatacacaacctaaagatcgtaaattttgaaaaataaaaaaaatatttttcataaagaaagcaaatactttcttagaaaattaacaattgaaacatcaaattgaaaaattaaatgatcattgatcgactacgaaaccaggacagaaattaaatgattttttgtagtaatagtaccaaaaaaaaagatagccaaatgccaaaattttgaatttaacgcttacatgaaatatttgaggataaattgtaaaagtaaattaatttaatttctactgaaaaaaagtttataaagtacagaatatgctattttttttgccatggtcatctaacgtccttaaaatgcaattgagccaaaattaatttgtgtatattcgatcgctctaagaattctcgattttatctttaaaatttcaaaaaatttcattgagtttaaaaaaactatgactaaaaaaaattctgactcaatttgaaattttgggaccattactttttatgattttataaaaaatttataatgaatattatgattgacaacacttaatgctattgaatgtgatttaattagagaccggatttttagtttttaaactaatttttgcggcttagttatggagagaaaagcccaaaaatagcattttcttcgaatagttttcgatttagagcgactttttagcaactatttt

SEQ ID NO: 20975 - DNA, 985 bp, Heterodera glycines
tcctctctcaaaaaatttttttttttaaattttttgcgtttttttatgaaaaaaattggagcattccaatggaatgattccattagcagttgggaacaacttttctctcttgtctctctataattgtctgttctcttatttctttgcactctctcgcctactctctttttctctctttaactcatcactcaaagtaaaggacggcaagaaaaaaaaattttcaaaatttattttaaaaatcttaataactcatgtcccaacacagatggatggaggagtaccgggagatgcgagaccgtgaccagctccaacaacaacaccaaagtgtgtcggccggcacttcggtggtcgactcggctgccgttgccgccggcatcgccgccgcttttggcggcaatgccaatgccctccacaacaacaatgacacggcatccagcacatcgaccaacagccactccacaataccatcatacaaggttctttcaaacaaaaaacgatgattttattgccttgtcgggggattgtatgagatttagggctttaaaacttgttgcaaataagaaaattatttttctatcatactttaaatagtaggggggtcgacccgacttcatacgaacgcaatccaggggggtcgaggggttttttgctcttgggccaaaaaatttttggtttttcaaatccgctttttttgcggcgcgctttttccaaaaaacgtttggagaaccgggggtgggtccggcggtgccgataggcgccgccagaaaaattttcgaaaattggggtacaatttgttaaaaaacgaagccctatttgataaaaataaccaaataatactcaatttcgtaaacttttttttttttgcattttttgtacaaaattggctaaatttaaaaggattttgttaaattatttaaatttttttgcctttacgaagtcgcctttttcttttcccttcgtctccgaccttccccagattttttca

SEQ ID NO: 20976 - DNA, 1742 bp, Heterodera glycines
cccccccccctttatttaggtatgttttctatggtttgtattccggagatttttgagcctccagaaatttttttgtgtgactgattctcctggaaaaagctcgccccgtccgcagattttatttatttgattacaatttttttatcagaaagttttaagaaagagtttttaacgagtttttaaaattttatcaaaataattaagttcttccaataattttttcgaaaaatcgctgtttgtaaaaaaaaaattcgggcacgggggggaggtgatgaactgatacgggaggggggaaacgaagtgccgccgaatctcatatcatcgcgcccctcaaaattgtttaaaaaataaaaatagacgacccgacaactccaaaaaaaaacaattttaaatgctgttcattctacagaactgcatccatctcggcgcctgctcgtccagtgaacagttgccttttcacaacgccgatttgccggccgatctgttcacgtgttgcctaacgtcgcctattcaggcaccaattttcatattttttccctttttaaataatttcaaatttactctaaaaatgtgtagacatcgttgctgtgccacatgctcaaaacgggcaccaagaatcgtttcccgccatcaatcattgacgaaatccctggcgttctgtccgaccggcgcacactgttgggcgagttgaattggattttcaccgccatcaccgacgcaattgcgtggtgccgtctgccgcgcagcaccttccaaaagctgttcagacaggtgaaaaggaccaattttttgtcaattttttaatttattcgtctgtccttatccataaaaaacaattttgttataaacttttgtggaacggtcccctaattttgggaggtgcattctgacaaggcacagtttttctacaaggttgactaatttttgaaaaaagccaaaacatttttgagtgcgggatgatcagcaaaaaaaaattttttttttcatttaaataacaatttttaatgctccaatcgtgtcccgacgcggtccagacatttgcggcccgacttttacggccagacattttgcgcttactatgtcaaaaatcgtgctcaaaattaagtttttcaaaccctgaaagcctaaacagcattaaataagtgatagaaagtgattgtgtctgatagtttgatagccaataaatttttttaaaagatcattaattattcaaacaacataattaatgcttctaataaactagaaaactaagatttcttcatttcatgccgtttaggctattatggatggaaaaaattcaatttagaatccgatttttgacatagccgcaaatgtaggggcttcgatgcaataggaaatttaaaaaatgtgaaaatcaacggacttttctaaaaccatttttttaaatgtttcaatattattttggataatttattgagatttaaaaacattcgcgacggaaaagtggccggcttgaagtggaggggtaaagaaaatgaactgcttccgggcaacgttgcttatgacaatcagcagatcatcatcccgcttttgtgcccttccaggacctgttgatcgcctccctgttccgtgcctttttgctgtcggaacgtatcatgcgcgagaacgggtgccatgtggtgtccacgccgcagttgcccagagtgcatgaccatccattgtgggagtactgggacctggtgggggacatgtgcctgaccaacctgtacaacctgtgcagc

SEQ ID NO: 20977 - DNA, 1773 bp, Heterodera glycines
  misc_feature (43)..(43): n is a, c, g, or t
agagaatgtggaatgtgaaatgaataattatggtgattgcctnttctgtgtcccagtgtcagcagaagaagcagataaaatcattttattaagccaaatatagcagaaaataaaaataggaataaaataaataaataaattgttattattatgccatttttgtagccaattttttaaaatctgatttctagttttttccacattaaagtctaactttacctttttttaagcatttgtaaattttagcattgtgctaaaaatgccgagtttgtccatggtttttgtgagttttttttaacatttcaaataaaaaaataaaataaaacttttaaggaaattatcattctggggctgcatttggccatcattttttgtgccattcttggcatttacttggacatgggcattgaggacaatgtgttcatcatcagtagtgccgttttgtgtgttgtgatctgtcagctgaaagcatatttttacaagaaaaagggcgttaaatcatcgtgcgcagtaaaaaaaactaaacaaattaatgtttaattaattatttttaatttaaggacatgctcgtgttgctgttgcatttggtcgtcttttttgtcgcaattcttggcatttatattgacatgcaaactgaggacaatgccatcatcatcggtggtgccgttttgtcgctggtcatctgtcagttgcaaaattattctgccgccaagaaaaaggagaacccgaatgccggaaaagtaaaattatattaaaaaattttaaataaatataatgattttttttattttagatttcgatctttgttcttttcggacgttgatcgatgcgggcattatcattgataaacaaaacatacatttcattataattcaacttgctattattaacaaataaaatttaaaaaaatctatttaaaatttaaaataaaaacaaatttttagtagaataaaaaaaagcattaaagagctaagagagaaactttttttcggtctctattcaactgagtttcgaaccaataattttttttttaatctttggtcttagaatcgcgaaataggaattaaattggcacaaaaacaggaaataaaaattgctattagcatttttggtaccaaaaacacataaaaaacttattcaataaacttaattttggttatattgcatttgtaaatgaaattataaaattttaaacttttttaatatagggaaatttttaaaccaaaaatttttattaagaaaaaacattacattttagaggatcaattttggaaatttttttaattcttaagagggtgtgtttttctttttaatgcatttttgttaaacatttttcagaaaaccctgaaaataggcgcaatgtactgatttttttttgttctgtcctgaattggatttgttaattgaaaatgtactgatttttcagatctctcctgaattggagcgcataaacacccagtagaatcctcaaaaagtattattcaatttttattttataaaatgtttcgaattcttttgatccaaatgtccattcttctggtcactatgatcggaatgtcaatgttgcgaatggaatggacaaggaggaacatgaaaaattgcttgaactgttacttctaaaaaagaaaaacaaaactctgatcagccgcgatttgaattgatcgaatttgacacagcggaggaggagaaagacatggaaaaagcaattcaaattggcaaaatattcttttggcgtaatatgatagctttatggaaatgtgaaaatgacgattt

SEQ ID NO: 20978 - DNA, 1396 bp, Heterodera glycines
  misc_feature (77)..(77): n is a, c, g, or t
  misc_feature (1200)..(1201): n is a, c, g, or t
  misc_feature (1232)..(1232): n is a, c, g, or t
  misc_feature (1266)..(1266): n is a, c, g, or t
  misc_feature (1311)..(1311): n is a, c, g, or t
gagctgttttttgttaaatttttgctttaattattatctacgtatattcttcattcccatttattaaaataaatatnttcttccatttgttttgtgtccatctttaatgaatccaaaatttcttttctttctttagtcagtgaatatttattttccacggcacaaatattccaaaaaaaaaaaatccatacaaaaaacaacaatttcgtcgccgccgcctaaaaaattcatgacgctgtcgggcggcgtccatttgcgacaaaattcggcaaatgccgtcgccggcgccgccgccgccgtgcggcatgagcagcagcagcagcactgcgcggctgcgcgtcaacaaagtgtggacgcggcgggggacaacggctgctgtctggtgaaggcattgatctccaatctgatgctggcatttaccacgtaaattttggactgatcaaaaaaatcgtcgtcatcttttgttttggcgttaggcataaaaaaattttaaattaaaagaattgttttgagcctatgaaaagttgggcatttccgggttcttattgtttactaaatctttttttaaattcttttgtaaggttttgtcaacaaagaaaaagcttgtagcttcttaaactttactgagatggaaagggtcccctaccgtaggggaaatacagtatgcattttcaaaatcgtctgctcattataatataactttttctttgacatttatttattttgataattaattttttaattatcgtcttgagttctaaattcgaaacatatgaaaaatttcctaaatttttgcattaatattttatttattaaatttaattcattctctcggctgtccttttcaaaaattaatctttgttctttttttttctctatgtatccgatggaaacaaaaatgtaaaagaagtgaaaagaaaaggtcttctcttactctacatactcaaatttccttctcccacaaattcctgcaaaaatttttgcattttcctcacaaaaaaatttttcgattcattttttactttatttttttcattttttgatttaatttaatttaattttttaatcattttaaatcagagttcaattttttaacaaaattcgtattataacaaatttttgattcttggaaaaaacgcatatatttttaagccgggaagtgattggggatcttgtccagagtttcctgcgggatcttannatcccgaccccatatgtttttgacagggatntcgggatttgaaccacggtgtgtccaatcctggncctgtttccatcccgaatgtctgtcctggtccgactttttcaaanttacgcgctttatagtacattttttgattacatataaagctttatcctatccaaataaaaaaaaaaaaatctttttttcaatcaa

SEQ ID NO: 20979 - DNA, 1388 bp, Heterodera glycines
agcctcctcctcctcctcctcctcctcctcctattcatattcctctgagtacggtttttttttttttgttctgagctttggtccccttaaatgagaacagacttcgagaaatattgaaagtgattagaaatagaaatttggtaaatcttttgggttgttcttcttagctattcgtcggttgtttaaaattggcatttccttggcgacaaagccgttgattaaaacattttgaaacacaattgtagaggagaaccgatgtaagaataaatttttcttcgcctaatcttatttgaatttatgcaatccaataatgacaataattatagtacatatattttattaatatattaaaaaaaaaaaattaaaaacagatgcactttttctgatgatttatttttccattcaaaaaaaaattgtttacaaaaagaaattatgccgagcttccggaaaggcaccatcacattttctgatctattttgcataacaaaattttaagggataaaatttaaataaatattaaatttcttcttcacttgtctggaatagttttttttaattcaatctcggtggaaagcattaatttgaaaacatttcttgtcatatgtaagagatagagagagagagcctcaaaatttcatcaaaattttccaaaacaaaaacgagggatgaagcaaggctccactggcactgttttaagcggggaggggtcagtcagagtacttcttcaacacaccgcacattgaccaccaccaccggcccattgtttgtgtttgtggtggccaatggccatacatatttatacttttgagagggtggcgccggcggcgacggcggcgcccctccaacggtggaaaacaatcgctttgaaactcgcatttgcttaaaattctaccgaaaacatccacttggggcgggtcacactttgaatttgaggagttgtcatcagaatgaagggctggggaaagaagcttttcgtccccggcagaagaattaaagctgtttggggggcccttattccattcgcgaaaatttgacacaaaatcgcattttacatttagtgcacagctctagcacccacctgctggatggccaaaaggcatcaaatttccgagccaatgagtgccattttggcatatggcgccctcctttgattgggttaaggctaatcccgaggtttaaaatccaaatttttaaggcttaacccactaatagctccaaggggcgagagaccaatttgaaaaattcaaaatttggttatgacattttggtttaatattaaatttttgaaattcaatttcatttttctccatttcgtcactcttttttgccaagaaagtgttctttagtcccggcaaaatgttctcccccccccctccccattctaagca

SEQ ID NO: 20980 - DNA, 2272 bp, Heterodera glycines
ttttgtccttacttttgtttagcggaaatgtcccctccgtacatttttgaaatgttttttggcggaggttttccgtccgggtctttgcaccgacggcgcggacagttccattttcgtcatacggaaccgcaacacagggaagagccggtgaggaaggggccgaggaacattgggatttatttgcaataaattagcccttcctggccctgggttttcgtttttggtgtcccaatattatctaatgcctttttcacactcgaaagaacctcttctaccaactgttgcaaattttgcccgtaattattatcatcgtcggtggccttctcgtccaattgttctccagcgacccgatttactcactgaacagagacaggtcgaacagaagacaattactttaattgatatttatttgctctgtgcccttttgagcttttccctgtctttttcagcacttaccatgtccttcgatacatcaaggatttgcgggttccttactacacaaagccggacttcgaggctaattacggaaagcgtctctatcaggtggaacaggtaaagtgatgttgattcggaaaagttgtcttacaatttaatgcgttttagcacgtcgaaaatgactatgtgagccatctccgcaaccaatgctatcgagaaaaatcgcacagtaaaaacaaaaagtgcaataagccaaattgtttttttatttaggagaaggacttttatggaccgcaaaaatgcgaggagacgcggatttgtggagaagggcgcaagagatggaattgaccaattgcagaaagttggaggagctgtacaaatgatcaatttaagattcgactggaatcattcaaaggaaaaacaaattttaagtccttgcttttgtgtagtatctatattttctgaagtgataaaataataaataaaaaatgtgcaagacataaaaaatatcaactgctgatataacaaaacaatccaatttacactttttctccatttctgtttgtctcctcattcccatttgtcaattctgtatcgttcagctcaggcttaattaattcgctggaagtgggcaattctttaatctgaattttattttttgttgcatccccattaattgagtaatgagttaatttacctcattaatggtgtcttgcgtcgcttcgcccttttcttttgccttttcggctttcttttcttttctctgcttcattttctcccaccattttggtaattctccactctgccgttgtttttctgtcccaaattcgtgcattgttttctaaactgccaatttttatttgaataatggaaaattatattaaatgtgccttattctcttcgctgatttctttgctttcgttgaacagtttcataaacacgcccccgggcgttcttctccttaagcggttttgtgtcaacattccgccgttccgctcaacttcttggcattgcttgaacagttccacggcatgtgattttccagcaaaatgcaccactttttgcatcaattcctacaaaagtggcgatatgctccatttttaaataaaacaatattactaattttgtatttactaaatcttttgaatctccccccccccctctcaccgggactttctctccaagtgcttcggcaagttcgtttgcgagttgttcttcgctcatttcatccgcgttaatctccacatccaaaagttttgtctttgcatagtttggcgtcataagtttgcgtggcacaaacttttccggtggtatcattttccactgccgtttctgcgtttgttcgtttttcccgtccactgctttggcttcgtttttgaaaattttctgcccccttttaaagggctttttccatggatggctttgcttatgcttctgatgtcgacggctgtcccgtttgaacttcttccatttgcctgttcttctaccgtggttctgttgttcggtcggcagttcggcggcgcccgtgtcgacgccctcccaaagggaaatggacgtgtccacggcaacggaaagtgtctaaagaggaggggtcgtcaaaatgaattgttcctctccatcgcatttacggctctaatgcactttatgagtccaatcaattgacaatcctgggtttttatacaataactttgttcatgttcgaacaaaccctatctttttggtatcattcgaaagcacaaagtctgaataatgtaataatacgagaaaacaagagaattctaacattccaagaaagttacaagcgaaaataatcagcaattacttaattaatcaaatc

SEQ ID NO: 20981 - DNA, 1480 bp, Heterodera glycines
cgacgaattttatccattaaaaagagaaaataaaggcgcaattctaagccaaaaatgtcaggcgtggccgaggccgaggccgtggcattggaattggctttctgtcgcctgtgcgcggctccggcaacattttcagcgaggacggggaagaacggaaacgcaaaagccgccgtcgctcttcgcgctccgtttcttcggagacggccaaacggtcgcgcaagtcgatgtcagtgttgtcgcgttcgcgctcagcaagtttagaagaggaaaagaacaggcagcagcagaggggaagaaattcggacagttcagagtgagtgtttgtttcggctgaaaagtgccaatccatggcattggcatttccccctcacttttatggccaattctccccccaggcgttcttctcgctccttctcctccgcttcctctcgcttccgccgttcccattcgcgctccgtcgcagcggaaaaaagtcgcaaaggacaaaagagcagaaaagggacggacggcccccaatcgccagatgacagagagtccgttgagctcagaacgtttgccactgatatggaaatgagagaagccatggggaagagagagaacgagcgagaaggggaaaaggcaaacgaagcgaaggagcagcgggaacggcacgaacagacgaaaagctacgggcaccgtcgacgctattcccatcggcacgggtgccgctcgtgctgccaccgacagagtcggaaaagccggtgccatcgtcgccatcggcagaaacgggcaaagcaaagtttgcgagaggaagaagagagtgccagaaagggtgagaaaatgccaaaaaacaaaagatgaaacaatgtgtttgatcaatcatccgcaaatgttaagatcaaagttgcgccaagaaaaggaaaaagaaatacgcggtcgtctcgcgttccgcgtcctcttccaacgcttcgcggcgttcctcgcgctcctcctcctccgcctctttctcttcttccttttcgtcctcttcttcttcctctcattcaccttccgccaaaaaacaaaagaaagaaatgcaaaagaaaaggcgaaagaagcagaaaaagaagcatcactcggaaaaggagttggagaaaagagtggcaaatggacaaaaaggagagaacgaaggcagaaaagaagaaaacgaaggcagaaaggaagaaaacgaaggcagaaaagaagaggagtttaaaatggcaaagggaacggaggaggaggaggaggaagagagacgaagtggcacttactcatcctcgggggaggaggtgtatctgaacgaacgggaggaggaggaactgctgatggtcatggagcaggggctggacagaaggctgggcaaagagaggggccaagtcggggaggggaaggacaagcagcagcagcagaacggtgacaaggagcacaaggaggaggaggaggaacagaagcagcaggtgggccatggaatgggggggggggg

SEQ ID NO: 20982 - DNA, 2246 bp, Heterodera glycines
  misc_feature (13)..(13): n is a, c, g, or t
  misc_feature (47)..(48): n is a, c, g, or t
gtttcagttggcnggagggcacgtgaaagtaaatttctcgatttcannttacagcccttgtgaatccgtcagagtgaacaatgactgaagcagaaattgaaattcattcatttttgggctaatagccttttttatcttatttcgacaagacgtaaaacatctcttaatttactttttttcatatttggactaaaattacctaattaggacattttggtcaaattcccaacaaaatatccgttggttctgaaaattttctgatccaaaattttattttcaaattcattcaccctttgcattgtttcttcatcttcaactcgaacttttgcagtgacaaaacgctttgagacagtgatggccgaatttggaagcattttaaaagcaaaagaatggaaataaaggcaaatacaaaattaaagaaataaaattaataagggaaaaattattagtgaaaattaattattcaaatttgaacagcataatgtccaaattttttaattttgcaagaaaattcttaaaacaatttaagaagaaaatctgaaccaacaaattgcatttttacgctcaaaagccaataaaaaaaactttaattgaaccaatcaaaaaaaaaccctacgacaaaagtgcaataaaagcacaaaatgtgcatggatcagcacgttcactccttttttgaacagtgtataaaaattgctgatcaaacgataataagtgcagcaaagaattggaattggaaaacaaagtgataaaaaactgccaaggtcatattttaatcattgtcatttgatgcgaatggaaaatgtgtaaaaacagaaaatttgaaaaagtatgggtgttcaattggggacaaacaaattagtttcaaaatgtattaactgaaaaataattatacagaaaacgtagaaaattaagccattcattttgaaaacgattcataaagtttacttggtctacaaatcaaatttgtcaactttaagcaaaaaactaacccgtaatcaggcgggatggaatccctccgaaatgaaaaatgaaattttcaagaaaaatagggcattttttgaaagttttctaataaaattgcctatcggcaccgccgaacgacgaattgcttaattgtttggaaaagtttatccaaaaaatgcacaaaagtgccatttttaggcgatgtgatgccagaaggaacgaagtgtgggagaaagtgggataaagaacctgagagaacctctaaaaggagcgcccgtagctcagttggttagagcacggcacggattaagggcatttatgggccattttggtcaaaaattccatgtgttaaaagccaaagaccatcaaacacttttgcctgatccaaattaataaattcgtttattattttatattatttaatgactttgtctgcggagaattaaacgcttcgcaataataaaacaaaagaaggaggaagaaaatgataggtaattaccaaaacagaaattttatttgcgcaggtcggcgccatttcagcgccaactgtcagagagtaatttattagcgagagtcaatacctccgggactgagacggcccttcctctccgaactgagtgaggaggcgccaaaaaagcagcccccgaggggacaaaaaatgtaacaaatgaaataattatgtattgtaaatacatatgaacaaataatgggatgggggaggcggcaaacagcggaaaagtttcgtcccacccatttgagggcggggaaagagaaagaaagcaacattcattcattcaattcactcattcattgaccgccaaattcacatgcctttctttcatcattcatttttgaaatggtaaaattgaattaaagatgggattaaacttacatttgggaagaatataattcacaaatgaattttaataatggtttaaagacaaaaaaaaagatcgctaaatttaattggggtaatcaaaagaaggtaatttgtgggctaattggattaattaatggtgctatgatgtataaacaggacattgactgacattgaccaacaaacacaacggcggatgacgacaaatggagaagaagaagaagatggatgaggagaggaggagggagggattaagcggcggaaggcggaaggcggcagggagaagcattgagcagccgttgccgaccaaacatcgcttacaattattaaaatggcgacaatttgtcatcatattttatcaattgaaatttttttgaattatttattcgactttttgtatatatat

SEQ ID NO: 20983 - DNA, 2347 bp, Heterodera glycines
  misc_feature (834)..(834): n is a, c, g, or t
acagcaaacaaaaataagaaatggttgtctccattttggccaaaacgcactttgaggacggtattcacaatttcagctgccatggaatacttcgtcagtactttgtcattggctggcgtcgtttcttccttcgcttcgtccactgattcgttggaagcttcgctcgagtcgctcgtcgacgattggctcggcgacgacgaaacgtctcttttcggcgccgtcttcttttgttttacgtttacactcattttgtcaaagcttaaaatgtgcaaattacaaacacactcataaaacataaatattgaaaacgcaattatcatttaattagcttttaaaataatggtctctaaattaaagtgaatattatttattggagcacacaaataaataatgagtcgccaaatacggtaattgtcgttttcattaactgattttgagatacatttcggacagggaatacacttgttgtccttctattaattaacttattatttctgttttctgaattttccttatgttttaaagtaaaccgaaatactttagaaaaacaacacgcgcggaaatgatcaaagtcgtccgaattcaaatcagaaatagtccttaaaaataggcaatgtccgacaagtgatgccattgtttggtccccttttcagtcaagttccggctccggcgctttcttcggtgcctcgggtcctttatcagcagtactcttctgttgcggtgttccctcagtcgctgttccaaagggtgttgagtcgcgtcccgtttcgttggcaaatggcgacgctgagcctaatttagagccgagtttctcaaggaccttctgaacattgnggtcgttcatatgcttcatcatattggctgggttctgcataatctccataagtttcttaaataaaatagaaattacttgaaatttactatcgaattaaactgcctgaatcagcgaagggtcgcttttgatggcacttaacaattcggggtcatccgacaactccttaaatcaatagtgaacaatgaatgacatggaaacttgccttaaacatttccgtgaagggtcccattccaaaatgagccccgccttcccccgaatcagcggcgctttccttcgcctttcggttcgcctcttgcgctcgacgcacgcgttcgagtcgttcgcgctgctctttctcttcggcacgcctttgtttagcgcgttcgtactcctgcagctttttggcctacgcaacagaacatttgtgaagtcacgcaagtggctgcttacattcggctcaacttctttcatccacccataggccacgtcatcataatccactaaaaggcaaaactgagaaaaaagtgaattattcaatacatttgcaagaagtagcaaaatcatggtgtgcctccgtccaattacccaacagtctaaaaattgagttgtttaattcactccttaaattcgttaatatttttccgatactgattagcgcgtccacggaatttgtaaggctgagcggagtcaggattgatagcaattgctttgtcacagtcttggatggctgccttcatcattgacattttgaggagagtgctaaatttagcagattcttgggtggaacgggtaccccaagggggtaaatttcttaaggcaaaaaaaaaaccgaagttggcaaaaaaagacttccaatgggtaattaagccttgaaaatcctaattcaggatcgtcgatgactcccatcctaatataatttttaagggaaaaaagttgggggagaatgttaaatcgaccttcaacgtcctcgctcacctcgacacttcgagattattttctagtgttttttttcttattttcaaatatttttgttatttttcctttcgaaaactagaaaaaattgcttgccgcagagccaaaaaaagatagttcggttgatgaggtgggagggtggtatatccaaggacgaaatcctctgttcatccttgcttttgaacccaatgttgtgtcagtgttcgttaaattaacaaacttggctcttttggcgtgcaaaatggcggaaccaggattcagctcaatggccttggtaagaaggtcaaaggcagattggtaattgccttaaaaattgttttctccttgagcccagtaaattcctcaaatgattgccaccttcgctgaacgctgccatggccgattctcggctctcgttggcacgttcaatttcctcttccgccacttgcttgctcaggtcgcccatagaaagttgcaaatccccggttttgtcagtctgcactccgctgttgtccaactcgggcaatggcacttcttcgtcttcctgtcgctgttcttcctttccgcacttttcctctgtct

SEQ ID NO: 20984 - DNA, 2733 bp, Heterodera glycines
ccccccccccccccccccaggggtcggggagcaaccctagtttataagaagaatcaggaagctaacaaacgttttttggctgcctttttcaattattttcccaacttatacaccattgatagagcttcaatagctctacaattttactctgaggtgatctttcgctttttctattgataaaaatggtttattatttttttgggaaaagataaaaaaattcaaaaaaaccgaaaccgaaacggtataccgaaaatttttcttcggtttttttcggttcggttttttaaccgaccgaccgactaatttttgagtttttcggtttttttcggtttttataccgaaaccgacctaccgaccctcttgtccggtctctagacaaaatacataacaaaagacaaaataaagaaaaaaaaattcaattttttattttaaaaaaatcgtatttattttttcttttgtaattaccggttggtccaaatttttcgtccggttcttccagaaaattcttatccaccgcagctgctataaataggtatatttctatctgtaaaaataaatattagaagtttatttttaaaaatagggtaaaaatgttaccttttgagcaaaaagaagttttatatacatatttacttgaaaataaaataaaccattgacccgcttatctaagcccctttcggctgcaaaataataatttatttatttttttaaatagagaatgttaactttaaaaatttttacaaaattgcatttatttttcagaatttttctttgtaaatttttattccattttttatttgcaaaaaaccgctaaaacccggcgccgagaaatttataaatttaggtttattttgtcaaaaacaggtttctagcaatttttattttatagttactacacatctgaataaaatgtaattactttccgtggtgagtcgaagtgacaaaaaggcaaatgtgggcgaagtgacaaaaaggcaaatgtgggcgaagtgacaaaaaggcaaatgtgggcgaagtgacaaaaaggcaaatgtgggcgaagtgacaaaaaggcaaatgtgggcgaagtgacaaaaaggcaaatgagtggtgatcagaagaggcgggtcatttaagtaccgaataatgattttaattaattaataatataactattttaatctattaattatattgctggccataattataatttcgttattatttaatatttcccaatcaaattacaatattatattctgtctagagagagaaataatatccacatgcatagttgatcaattcgatcaattgcacttttatttattcacaattatatattatattctgtctagagcatttttcatttctttaatattccactattaacttgtctttaataatttatttccgaatttttaattgatttagaatgaaaagtctacttttgaaactttttgttggcctctgcttcattgactttacgtcaaatataaagtcaaaatttgaggactttcttgaaaatcaagaagcaatgaagttgatccaaaattaccaagaaaagcgaatcaaaactattaaagaattacatgctgaactaacaaaaaaagggattaaattggcagaacgtagtttgaggctatatctttgtaaaattaagagtgccaattctgatacatcaaaagaaagtccaaacataccagaaataaaatttgaaaagtgtctttcccgtgatctaacatatactatttatttaatcggaaatggaagcaattggcgaaaataccgaataatgaatgaaaacaatgcagatatatatatcgcgtgttcaaaacattccgtaaaagactaacattaatttttataaaataaaaaaaggctctctattatattaagatggtcgctgatcaagaccgtgaaacgccaaccatttttattttaaactcttcaaatcactttgaagtgatacttaatttgattgggaaatattaaataataacgaaattataattatggccagcaatataattaatagattaaaatagttatattattaattaattaaaatcattattcggtactgaaatgacccgcctcttctgatcaccactcatttgcctttttgtcacttcgcacacatttgcctttttgtcacttcgcccacatttgcctttttgtcacttcgacacagcaccactgaacataccgggctttccgggagggagaatgaagtgccacgccttccatgctcattttgacagattttgcgacgaaaaattcacaaaagagtacgtccggtcggattgtaacgattgttttggctctgattgcaacaaggaccaactgaaattgtcaattggtagcaaaggtaaggaaggaaaaagagcaacaatgttaacgctaattatgccaattaaataatttgataattggtaacgaaatgtttgtccccaaacatgaactgctagggcagccttcatcagctgatagagcattggaaagccagagatgccggctcaaagcggggacgggacaaaatctcgccgccgaaattttaaaaaaaatttcaaacagaaatttctcaagaaaaaaaccttagaaaattttttataagaaaatttcagaaagaaaaatattttaaaaatttacagcgatttttttttgaacttttgtaataaattactgtttttttaaattttcaaaaaaactcaacaatttttttttcttgaaattttcttataaaaaattttctat

SEQ ID NO: 20985 - DNA, 1237 bp, Heterodera glycines
actttttaccatatttattgtttcgtttcgttttccatatatatttatactttttcttctcttaaatcacagaaatatcgtctccccaatgattgtctctgtgggagagatcgctttgcacttttttcccccttttccattttcccctccctcccaaatgttccgctgctcctccgtcctttttgttggtccgcttttcctcattttcgccggtccattggtcggcggaattgcgttcagttgcggcggtgggccaagcaaaggctccgacagaagggaaaaggccgaaccgatgctttgaggacgagcggattggccgaagtgattggccaccggcgttttgtgctgtttgtccaccgatgggtcggtggaacggcggaggaccgttgagagagcactcgtggcggtggagttgttgttcatctcggagacgcctcctccccccagcgatggcattcttttgctgtcaattcggtcgccttcggtgcaactctttcgacgacagaacaacatccaaaaggtgtcacgaaaggaactggacatgaagcagtaaatgccgaaattgatcggataagtggcctggcaaagacaaatttggcaattaatgaggggggggggaacaaagccaagagacagaccatgacgagcatgttgttgacgaggaggaaggtgaccgggaaaacaccttccaaaaagcggttactcagccccaaagtgttgtacacctaaaggggtggcacgggaatttagggggaggggggagacagacgcaaagcatggccatgaacagagcggtgggcaaattgacgatgaggaagatggacacgatgatgacctggcaaagaggacaaacaaaaatgatcacaatcagtgaatgggtgattaatcaatggctttaaatggccaaatcactaagaaaagtccaaactcagcggaccaatcagtgaacataaaaccaatgcgatcacagatcagcatggtaaaattattgcttgtttccaatctcccaccagcataatcgaagtcgaattgctgtccgtctgacgctctgcttctctcgctctcttctctcttaaacaaaaagcaattggccactaattaattggttaattaaatatttaattgttcgacctgagaaggcgctctttcctccgttgcgcttttcgtatctgaaagcaattcaatgctattagataattgttaaaaaatatttttggtaatttaattgacccaattg

SEQ ID NO: 20986 - DNA, 2305 bp, Heterodera glycines
  misc_feature (2279)..(2279): n is a, c, g, or t
  misc_feature (2296)..(2296): n is a, c, g, or t
attgtgccattacaaatttttaccgtttttaaatactcccaaaaaattagacaaataacagatattttttggtaaaatgtcttttctggatcataataatacaaatgattcaaaataatctcactttctttccacaaacaaatacaacaaattgaatgaaaggtattcttacgagatcaaaaaaggaactcaaacaaattaaaaaataaaataataaaaaataaaacattaaaatgtaaaataaaaataggggtttttaaatttaaacttaatttaaattttttgtaaatgaccaattcgctatttaaaattgctcattcgcctaacgttcataagaattgtcttattattatttaaaatatgtaaacatatgatcaattcttattaatagcttttttattgatatatcttataaattggtgcatttgatataaacatttcatacatttaatatactaaaaaagattttgcattttattgtttattttttgtttatctaaatttcgttgtttaatttgaaaaaatcatagtgatttgatcccgacagggcacgatttttccaaaacccttcctgattttcttatagaaatttcattattttatttattttatatttttaagtttgaattctcatcacggaatttgctaataatacaaggaataataatggtagggggagacagcattaattaataattatgcacttgatatgttaatacacaaaatttaaaaataattttaaattttagactgttaaaattgtatggatttattggtttttattaccaaatttgccacctttttccatttgattgtttctttgcccatttatttgtcggttttggcatttttgttgcgtcaaaggcatcgtccgcagttcacttcctcattttatatgctttttattgcgcttggctttgtggatttaaggtaagaaagctttaaaataatttaaattggaaagaatttttgattttctcacaaaagtgcccataatttaaaatattttccaaaaaaaattcgccgtctttcatttttgttacatttttcattaaaaaatttccaaaaaattgccaaaaaaggacccctgattctcatttttctcatcatattggatattgggactataaattcgattcagaccgtttttgaaggatttggagttttgaagctaacaaataagatgaacatttatttaattaatttatttttgtttttattccattttagcaaatttttgttgtaccttatcaagaaatgcgcttattggggttatgttccggctatattttacccgttgaaccaagcaaacagcgcagcgaatttaatttacttttcgctatgggcattgtgtttaatccaacttcaggcatttttaattttaaaataatttttaaaagcaatttttctaaatttaggctaaaagaaccttatttaaaatttcagttgaatttcctaatgtcattgaaccgtttttgtgccatttgttgttcccaaatgtatcggcgccattggtcacaaataattagcaaatatttattggccattattcttttgttcgctttggcaatttctgcaccaattctttggcattctgtgtgctttcggttgtctgaagtgagaacaccgcttgggcaaggacagcacaaaatggacggccccgtgttcatggaaattccaacacaagtaaaaaatagaggagcacaaaataaagaaaatttattttaaaaattgaataaattattttgaacaaagattttccgatttttttttaccttattggcatattgggtgcttttgccattcttagtagaggtcggcattttcaaactgcaggcctcgtgctcgggcttaaatgttttttgaatggttgcccgacggacatgtgttttttcaaaattctggaaagatgattataaaaaattatataatcttctatttgcttgtggttataatttgaaatgacgtacgattccatatccataaaagctttaatttttagccttaaaatagcttcggagctaaagttgatcagagtgatcagacacaataacataatcagacagtcagaaaataagaaataatgtacaataaatttctagagatatcactaaaaatcgaactcaaaataattttttcctgcttatacaatgggctattaaatacaatagtaagtaatttatataatttttttttaattgaatttttttattttctaaactctgcttcaaaacttttttgaaaacatggcattgtaattatgatcttcggtctaattntttaaatttaaattatnattattttt

SEQ ID NO: 20987 - DNA, 2610 bp, Heterodera glycines
aaatataaatgcgcagctgatcagtgcccaacttgctttggcatttttgtatgccaaataaaactgaaaataaattaaaaataattattatttttcttttggcttactgtgccattgtttaaatctgccattgcttatatttgaattggttgttcaaaatattattagaaattgtgcacttttaacaaccttttttcaaatgccaagaaatgattacattcttttgttgctagggtaaaaaagaatggtgaacaatgtttggccgtcaacgggaatgtaaaattcagctgccattttttaattaaattattctcgtatatgcaaattcaaaaattttgacttttactacattttgttcgaatttgggcaagggatatggaattggttaaaactaatgccgtattcgttgtcatcgaccacgaaaagtgcttaaaacctattttcataatttttaaacataattttatttatttattaaaagttcatgtgaaagttgccctctaaactgcaaaagtaccgaaaaaccatgcaaatttaaacaaattctttggtgattagtagaattaaatttatttgtagttaagggtaacctaaacttcaattatcatgctgaagaaggtccaattttgaaactgacggaaatgaccagacggaaaaagtaatttttttataattacgagggtttaacaaaattttcaatgctattattatggtgacaatttgtacacaatttttattctgaaggacaaaatgctaataatgactataattaaattgataaagcctaataaagggatcatttgaattataatttcttgttataaagcccaaaaaccaaaattttccaaagtttaaagggcaattaaaaaataattgtttatttttaaatgtatggaaacatcaactgtgaacaaaaaaaaatcacaattcgaaaatgaaaaaaaagcgaaatgcgaaaagccaaaaatatgcgaaaatgcgaaaagcgaaacgcgaaatttttttcaaaattttttaccaatagtaaaatcatagattttgaggttgtgatgcaaaaaaaacaaaatctctgcattttccggttcaatctttttctcagatcaaaaaagacaaattctacccattttggggttaaaatttcaaaaatttgaaaattttaataaaatatggtaggaaaagttgcaaaattttcaaaaaatatactatttttttcaaagaaatactgaaaaaggcttgaaaaaggcagaaaggtcaaaaaaggcaccaaaatcgcaaaaaaaaaggcaaaaaaatgtcaccaaaaagttcaaactagaagcttcaaaccaagttaaaaactcgtttttcgtgcgtattaggccatagcaagttagaaaaaaggtaattattaatcttgcagcccaaaataataataaactgaagcattcttttaaaaatttaaattttcaaatatattcattcttaggggtggaaatttcgcatttcgcgccaaaagcgaaatgcgaaaagcgaaacgtcggcccatccctgccctcatgggcatcagcccatgagggtacctttggtacaagaagctgtcaattcgttgtcccctgtacagcccctggggtgtacgatatcgctgatctgagcccgggttcatgatcagaacctttaaaaagccattgaaatttattttcattaatttttaaaacaaaaatattttttttattaaaattcatttgaaaagtgtccccaaactagaagagtaccgatagttcaatcctgaaaacgtagtccgcaaaagtcggtccgcaaatgtcgcactacgaatcaaatcataggtaaaaataaactgcaatgaagcgtagaaaaattttgaaaacttaaaaaatgtcattttttcatagtaaattaatttgttataagaataactctattaatatacatgttattttctatcaataaacaaaaatttttgagctgcataaaaaaattattgcaccaccctgatcagatcaatccttcttcgtctgaaaaccaaacaacaaaaaatagaaattgtttttaaaataatcgtccctgcctgatattttactgaattttttataatattttaaattttttatttattatttttttgttttcattatttttcttttactatgggtttatttattctattaaagcataggagtactgaaataattatattttttctcgacatgtctttttttaaatgaatgaaaaatgtaattaaaatatgaattacatttaatcatttatgtcaccatcaggacaaagtaattaaaatatttaattaaaattatattatctattgttttaggtcactcaatggcaccgttaattaaaatggcaaaaattgtatgaaaatattttttactgtcataattaaaatgggtcccaaaactgtaaagtaaattaaaaaatgaatagaaaatttcattactaaagaatcttatattttaagacacatttcatgtaaacattaaaggttgaatttaaattcacagccaaattttttaattcctttgccggaaaaatttacattgaatttaaatcatgagttcaaatagtacacagatgctaaaatcaaaaaagaatacaaaa

SEQ ID NO: 20988 - DNA, 2417 bp, Heterodera glycines
  misc_feature (2349)..(2349): n is a, c, g, or t
  misc_feature (2373)..(2373): n is a, c, g, or t
cttttagttagcagcatacactatcgaagttattaggctatcagttaaaattcgtcgcagctgacccatagcaaatgggcagaacaaatttactattactgtgatcgttacataacaacaacatagaaaacctcataactgattagcacttataattcctacacgcaaaaatgaaaataaaccattagcgacaattcctccagccaattcattttgatgttcggaaaaagtttcccacacattgggttgagacattcgtacaatttcttgcattatctttgcactctttatagtctctttaaaattttcaggcgagtatagttccgtaaaatttgttatgactttatttttaaatataggaacgcttatttccgggaaatcaattcttccatgtcttgttaattggcgcactgattccattggaatttgctcaatgtctccggttttttgattatactctataagtttgtctccttcatttaagtacagaaaattataatttccacagtcaacctccctagaaaaggggtgaattatgcgtgtcactgggtcgataaaaccattctttattttcccatcaagtttgaaagtaaccgggatttcagaaaaacaaacaccctgttgccaattaaaatgcaactgcgtgaaaatagcaaaacagggctttaaatccaacttattttccgttactaatcgtcccaccaaaaagggatttcccagaaaatatctcgccaacagagtaggattagccactgataaagtaagaatttgatctgacagaatttgcatatttgtacatattttacggacagtctcttcaaaaatacgccgggtattttgggtaagccttaagcttaaagcggtgagttcagccgataactgcgaagagtagacgagtccaacttctggatcaaatcttttcttcctgttcgttgttcctatcgtttgagctttttccaccatagattcataatccgacatcaaaacagcgaaagactgatcagacaccattaattggtcgttaactagacattctttttgtttaaaaattgttttatttttaaatgtaagtgcgaaatcaccactctcggccaaccatatttcagaagaatattcgccctccatatttgccatccaaatatatgagcattgatgaccaatgtcggggtcccaaagcaggctgttttttgtacatctacatgacccggcttggtaaaggcaatttgagcattctccaatgggagtgcttatcccctccattccatggcgtgtaaagatcaccgtgtcatatacataacaattcgaaatctcaaatgtttgccaaaaaagattatatggccaaaagccccatccaacttctaaataattatttgtggccataaaagttccatttatcaaatttagttctcccgccatggaatggtttgtctctcgcatttgcctgcaaattgaggtcggaatttccatttgttccgtttttgactcctggctcatgtaaaataggtgcctgtgttgggctccaactcgggcatattgggtcagcaggtagtgtcagcaggtagtgaccataggcttgttggtgcgtcgggcagacaaatcatgggactaccttttgtacccaaagttcctccaaaaagggtcaaaactgcaattagggctaataaaatagggcttgcgattctcgccgctgggattcttcctccttgaaatcgcactcctttctcgggcgagtgagaccgctctcttgtactgtaatcatcggcattttcgtaacgtcgattgttctccttctctcttatccacgttcttctcccctcaggggttggagaccgtctagtcctccaattctccctttctcgattccggttttcattataatcgttatttgccctttcccattgtcctccccaattacgattatccctcttgttttcccgattaaaataagtttggtttctctgaccatttttctgggaattctcgtattttctctttcgacaatcctttatcaaatgcccggggcggtgacaataaaaacaaacacctcttttattttgctggctatatcccccccttgggccggagctttgttgttgaatagcaagggcctcaactttcgaactaagctcagcgaccgaaatttgacttcctcttcggccagctattaacaactcaaaatgctgggctaactcatatgcgttagaataatccactgggcgatttgcttttacctcaaattgtaaatctggacttaatctgtccaaaaattcctccaaaagacgcttttgtattacattttcattttccccagataagacagttcggacaacttcattaagccgattagcnaattcataaactttctcccccggngcttgcttacagattgacatggcttgtctggcgatcgacttagt

SEQ ID NO: 20989 - DNA, 1036 bp, Heterodera glycines
  misc_feature (1030)..(1030): n is a, c, g, or t
tttcctttttaagaaataaattaacaaaattttgttaatggaaatgcatttttaccttccaagccgaacaaatgctttatgtctcctccattttcagttttgttttgttgtcatcagcacgaactgatgatgcactcaactaaaattaaaaaaatatttaaaaagttaataattaattttaatttaattatttttaataccccaattccaattaaaatggtgagaagcgccataccgaaagtggccatgtcgattttggcaattaggcaaagcaatttggaaattattttcaaaatcaagctaaatttcaccaaaaacctctcattttaaagctaattaatggaaaaaaaaactattggcaaaggcccgcgggtgtttcctgtggaacaccgtttttgcagtttttaatgaaattaattaagaaaaccgtaaaattttcaggaacaaaaaatgttaggagaggaatcggccattttcagagttcgggattccttctttaatcccaatccaaatgtctgatgcaaaatgattttgtcattttaaacaattagaaatttttgtgtttactatttcatttggatggccattaataattttaaagagtgaaaataaacaaaaagttaataatgtttatattagctcgcatttttggggaaagaaaacattggaaaaggaaaatgtgtcgattgagtgtgccacttttttaattgggcaaactacgatcattattggtgtaagtgactcattaatggcgggggacacaacacaattaattggccgatgaattgggacgggtcaatgatcagaaaattaagcaggcaaacattttcacagttttaagaagtgtgctaaaaatgaaaggattgagaagagaatttcgccagtgtgcaggagcagttaatgctaatgaccgttaatgaattaattaattagcagccgggcaaagcgcctaatttgataggcgtgtcaggggtttgtggcatgctaatgacttagggattggattgatacaattgctgtgagtaataanttataa

SEQ ID NO: 20990 - DNA, 1235 bp, Heterodera glycines
tttagcattttttaaactgaaactaatctacaaaaaaataaaataaaataaataatttattttattatttaagggttttctttcttaataatcgcagccttattaaatagaaaattgtgatatcgcaaagggaaataaatagcatttataaataaaaaacaaatttatgaaaaagatgtacggaatacaacaaattattaaaatagattaaggaacgaacttatgatataaagttttcccatttttgattatcccaaggaattggggtgtgccaagaatgacgtagcaacataaatttgcggaatacgcgaaataggcaccgtcaggaaacttgaaaattcgtttttaaaacttgttgttagaactacgcccttttgctatatgtatatgtacacaaatttacaaacacccgaaaaattaaaagaaaaaattttcagccgggaattttcgggatggcttattataaagaacacattcatttcagcgaattgcgcgaaccaattaaatcttgtcattggggtatatatttacagcgtttgtccttttctggatcacatttcacacaatgcatttcttcaatgcgcatcggctcagcgtctttttgcttccagtaataccagaagctttccgcgctgccttcccgtttctgttgagaataaatgaacaaaaaaaagttacaaaaatagaaaataaaaatccaaaaataaatgaaaaaataggaaaataaaattttttttatattacaactcacgtgacaggaaatattcaatgggccagtctcactttgcaccactttgtcattgaactataaatatatatatatatatttatacaatatataaattaggattactgaaagaaaggcagatccacaaacaactgccgtattgcatttcgggttgctacaaggaggcgcgcagtggtagccaggggttcttttcggatcaaaaagctcacccacattagcacaggcgcaagagggaaacagtttggcgccgtctaatgaaatgttaattaatcaattcctgatttttttgcgataaaaaagttgatcaccaacaacaagatgcaatataataatatacttatttaaaatcttaaaatttgttttgtttttaattatgctatgatttttcctcttaaatgtgtgcctaagtgtatatgaaagacgttgtgcttaaaaaaattttttttttagcgtaaaaattaaaggttaattgtgaaaaattctgaca

SEQ ID NO: 20991 - DNA, 1027 bp, Heterodera glycines
tataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagacatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaatttatcaaaaaagagatagccatttttctgggataacgtataaatataaaaatc

SEQ ID NO: 20992 - DNA, 1437 bp, Heterodera glycines
tttaaaaaaaattacattttaatttacatttcttttcgaccaatattcagggaataataaaccctaattcttaaaaagttcaagctttctacaatattaatttgtagaacaaaatttgaacggatttaattggcggcacagaaaaaattttggtgccaaaatttatattaaagaaaaatcggttttctaatttttcaatttttctggcattattagaggaagacaattaattatatggaaatgatcatttttccgcgaaaaaaacggaatatttccgtggaaaaaatgatttgaattttgcgattttgtgtccataaatttggtagcatttatttttttaaaaaaactgtcttttgtaaggcctcaattattaaatcgggggcattttctgagccccgaaaagtcggaaaatttccaatttttttaatatatttttcaaattatttataaaaccattttttaggattttaaattttgtttcgcggttattggtccaagttttatggccatttatttttggccatttttccaatttaatttcttggccaaattctaaataataattgttttgtctgtttgcatacaaattaatgatgaatggcccaaaaaatattttatggcaaaagcatgttttttttaaccggtcgatcagattttttttcaaatttttaacataatttttacattttttttcaaaagcacgaaaaaattgaaaaaaaacgatttattttatttaaaaaaatggacaattaaaaatatattaaatagcaaaatgaaattatcagcatcttttttcattgtaaaccaacgaaattagcaaagttataattaacaaaaaaagtacggcattttaaaattaaattttattttttcaaaattttaattatttaaatttttgtcaaccgtttctttgaattttatttgacattttaagcatcatatcacatttaaaaattatttggacatgttttattttatttttatcgaaaaataattttaaaaaaatatatttttaattttttttttttgtatcaacaagttcaaactacaaaaattatgcatttaaaaaaaatttttttttcattattttgattatttgaggtcattcttattaagtatgcaaaaattcttttgtgtgccaacccctatttagtcgggcattttattgtcattttttatatttgtcatttaaaaatcactttttaatttaaaatattttctgctctttaaaaatatatttttgggttttttgactaaatattgaaaatttttaatttaaaaaataaaattggaattaaaaactagagttgtaggggaccgggacttttcgggttgaaaaaccgggaattttcccggtcccggtcaaaagaggtcaaaaccgggacttaggtactcagttgtacgtgtttttcagtaccaggtcccggtcccgtacaa

SEQ ID NO: 20993 - DNA, 1653 bp, Heterodera glycines
  misc_feature (64)..(64): n is a, c, g, or t
aaagtgtcaaatttcattttattttcttttttttaaactgtaaactcaatcccctttcgagaancccgacaattttgtgtaaccaagcgcagcatcaaagatcaaatcgcgcccattgagaaatgccccggggggatttggccatgaaaattggcgcgcaattttggcgcaatgttcgagattttttcccatcgcaaaaccattcttggcaccatctaaacgcagtttatggtcatgctttattagcatcgtaaaattcgaaaaaaaatcttccaaatgccaaaaaacacgtaaaaaatggggaaaaaatgcgaattttccgatatttcggagcgcgtaacttttttgaaatttactaggctagttctgcagtcaaataaagtgccaaaaactctcggcaaagtttttaattaattttaaaagtttttggcatttaaaaaaataatttccccctcgaggcgtaacttttttgaaaattactagcctaatattgcacatttagtgctgtcaaatgaagtgcaaagaacactcggcaaactttaattaattaatttaaatttttttttttggcatttcaacagcaaaaattactcatcaaatatttcgaagaaaattccgcaattttttcggcggcgattacgtataacaaattagcccttttttgcaatttttctatttacctaattggtataatcaaattaaaattttttcaaaatttccgtcgtcgttgtcgaattttcgcccggccatttcaaaaaattccaattttttttgcgccggcggaacaaattaattaattaattaatttccattttgcgcgacaattcaaagaataaatttgtataaatcgctgctcccacccgctcaaaaaatggtcattattcaccgcgaggaggcgagcggcggtgcgcgtcgtcgccacagcaaaaaaatttaaattaaataaattaattaatcacaattttttgaaaaatttcgcccccgggaaaatttgtgcgacgcttttgcacatgggcggcagcagcgaaacagtcgctgctaattgctgggtaattagggggaggacgcgacgcgacaaattaatgagttttgatgatgaaaaatcggaggaggggcaaaagcccaaaatttgtgtgtgaagtggggggggggggagcgcaaaaatcagttcgttcggagcaaatttcaatttttgaaggtaattagtagcattttgttttcgcaatttttttttttgcggctgtccgggggaaaagccgtgaaaaactggcgacggcactttggggtgaaaaattgaaaattggtgggggttttcaacttgtaagcccttagggggggtggaaaattgtgagtttttgaggcctatggtgatgaacggggttccattttataggcccgaagggacgaaaatttgaggttttcaagttgcgagcccttaggggagaggggttggcaaattgtgagttttttgaggcctaggttaaattatggggttcctttttataagccctagggggtaaaaaatttggggcttcaactttaacccttaaaaaggatgaaaaattattgtttttgtttgaataactctaaccccggtatgaaaataagacaggatggcaattttcaaaccctagattaaatgaaaatagtgga

SEQ ID NO: 20994 - DNA, 666 bp, Heterodera glycines
tatacatgtcggccaaagcagtttttttattattactaatattccaacaatatattaaaaatttttcatctattttacaagaaaaaataattaattcattagtaaatggccaacttctcaaaaaatatttataatattatttaagtgttataaatttcaattttacggttttattttttgttatctttagtaagaatctttactgcgtttaatttatataatttttgaataatacaattcacaaaaatagctattctaaaatctttttttattaaagcatgtacagtgtgacccgaaattataggttcaaccccggattgatttttagaataaactcaaaaattataaatagcaatacgtaggtgctaaaatctgccaaaatggttagtttttagttctaaaaattccaaatagatgctaaaattgtgaaaataggagccctaaaatttttctttatatgaaataataattgtttatttgaataattttaccttttgatatttgtcaatatgtgaaataattatttttatatcatgtatgtacattaaatagtgattttcattattcttttatatgaattctttttcgatatatcattatttatttatctttatttcatattcattaaaatattttgatttaatcctcatgcaatgaagggctgat

SEQ ID NO: 20995 - DNA, 1328 bp, Heterodera glycines
  misc_feature (34)..(34): n is a, c, g, or t
  misc_feature (48)..(48): n is a, c, g, or t
  misc_feature (90)..(90): n is a, c, g, or t
gaatgctcgctgtgaaatagaattacttattaanttttgatttctatntaatcttttatttaaatgttttctaattttgggtttttcatntaattgtgtttagcttatgctttttttatatttttttaatttcataaatttcttattcgtcggtcgaccaaccacggtattatacatgtcgaccaaagcagttttttatatttactaatatttcaacaatatatttgccaaaatttttcatctattttacaagtaaaaataattaattaattagtaaatggtcaacttctcaaacattttttaattattatgcgatttatttgaattttattttttatgtatttaaaatatttataatatgatttaaaatgttctaaatttcaattttaaggttttaatttttttttgttatttttagtcaagattctaactgcgtataattaatataatttttgattaaattatcagtcaaaaattagataatagtcaatttattaaatgaatttcaatttgttatttttgcattctttttgataatttatagtaaatttgtttatgatcaaaaaatatattatacatagaatccgataccgagtctcttttttcttcgatttgtattttgtttaattattatttaaaaattttgatttaagcaatttctcataatattattatcgtttcaacttttttaatttaaatgttattatttaatcaatgaaaaaccaaaatcgtaatgttaagttttcattgttttaaataaacctataattataatagtattttcttattatcataattaaaactaagtttgtataattaaaataagtcattagaaaatgcgcaagtgatgcaaatattttaaaataaagttttgtagtattagtattgtaatatagaagtaaacttctacaagaacatccttctgaattccaaaccccggacccgaattcgatcagaaagtcgaagatcaaaattttccaaaattagggtttttcttctaaaccagtttaaatactcggaaacaaactgaaagcattgattcttaaatcagatatcttttatgccatttttgaccaaaaatgacttggttttatgacaataaaaaatttcactgacgcattttctaaccaacatcattaatattttttaatctaatgcatgaatggcggctatttatatgaattagaaccaggattcgataagtttatagattttgaactaagtaaaaaaacagaggaatgttagggtcaatcgatttgttattattaaaatttataaattttactatatatctttgttaatattaatatttcataactttcatcaca

SEQ ID NO: 20996 - DNA, 2330 bp, Heterodera glycines
  misc_feature (18)..(18): n is a, c, g, or t
  misc_feature (34)..(34): n is a, c, g, or t
aatgattttattaaatanttaggaataatatttntttcctataattaaaaataattaataagaaaataatttagacaacggtgaatggaaaatgaagtggggctgttcaaccattgccggcaattgtgattttgttaatgccaagaatgatgaaatggtatgtgagagctttataaaattttaaaaaatttctaattttgcgtgaatattttcaaaaattaatgaattttggtgtttggtgttgctaaaagacgcgcagtcggggatttttttttttggcatttttgtcattcgtagagaattttgataaacacaaatttattttaatttttccttttattttttaaatttgactcgggctttttccttaaaaaatcatattttacttgcaattaggggattatgattaccatgatcaattttaaggacaaatgcctgtgtccttttggtgagaaggacgttgacttctccaacgaaaatctcacaattgaaatcccggctgtaatgaccactccgaccctgacaactctgaccacgaaggaaacgacgacaaccactaccactaccaccacaaccacgacagttaccacggaggagccaacgaagcctaagacaactgcaacattggtggaattggctcaatcaaccattaatgagggtgcaattagattacctaattatttgtttaaaagaatatgtaaattacaggaaatggtgttcgcgtcagcaatggtgtgcattgctatttgaaaatcattggtgaattaatattttttattgattaatattttatttttgctaattaggcattctttgtgccgtccaagcgctaattgttgctgctaaacaattcagtgctttgtgaaatatgatgatgaatgatgaaaaggagattaaaataatatgatttcacaaatatttatttttcataatattattgggactatgttaactaaaaattatattcacctattaatcaatcaatctagataaaaacattttcctctttaaacaaacgatcactttaaagaactccaattatttacataaaaaatggggacccaacacttcgagatgctgttatgactagagaccgactaaaaaggcaccaaaaatcgcgaaaaaggcactttaataggcacaaaaaaatcgaaaaaaggcatcaaaaggtacgaaaatcccgaaaaaggcatgaaaaaaggcatttaaaatttttttaaaaggatttttagggagcaaaacacgtaaaacctaatcaaaaaaaattcatttttggtcatttaaatgattattaaaatattttagagctttttcggataaggaaaattttaaaccatgaatttttatcaaaaaaagaaatcttattttggagatgaatttttgagaaatttttcatttcgtaagggtgtatttttgaaaaaaaaaaatcaattcttaggggtgtatttttctgaatttttttcaggtcttcttttttaggggtgtattttaccgattttattgcatttttaatggattttttcggaaaaaacgccaaaaaaggcacctaataaagatctcatttaaaattctttttttggaaattcttggttcattttcaaccaaataaatatttcatggtattattcgatagcacaaggtgttctctacaagaatattaattttcaaaatttttaaaaatagtataaaaaaagttatggtcataaattttcactaagttttgagtcaaaattattttactagaacttttttaaaactcgatgaaattttaaagataaatagattaaataaagtacttgagattctaaaaagaaaatttaatctattgctgctgaaaaaaattatgaagcattgaacaggtctatgttttttgccatggcatgcaaatataattataaacatttaaaattttcaagtcattaaaatgcaattaagtcaaaataaatttatatattcgatagacctaaaaattctatattagcttgcaaaatttcaaaaaatttcattgaggttcaaaaaagttctggacaaaaaattccgacttaaggttttgtggaatttaattaccatatctttttatatacttaagtaaaaaatttaataaaattatattctgatagaaaacacctagagctattgaatgataccaagaattattaatttggttgaaaatggaccaagttatgaatttatatgtcttacatttttttgttttcctaccacatggcggtttttaggaaacgcccatggtggcggtttttaggaaacgcccatttggcggtttttaggaaacgcccaatgtggcggtttttaggaaacgacctagcacc

SEQ ID NO: 20997 - DNA, 1910 bp, Heterodera glycines
  misc_feature (1872)..(1873): n is a, c, g, or t
  misc_feature (1882)..(1883): n is a, c, g, or t
tttcatgttttgttattttttcgttgaaaccatcctttaatatgttatgatattaattttaaatatttttcaaacccatcagaacacaatcgttatgcggacaaaaacaggttgccagactataccgacccccaaactataacgaccagactataacggccagactacaccggccagactacaccggccagactataacggccagactataacggccagactacaccggccagactacaccggccagactacaccggccagactacaccggccagactacaccggcgagactacaccggccagactacaacggccagactacaccggccagactacaccggccagactacaccggccagactacaccggccagactataacggccagactacaccggccagactataacggccagactacaccggccagactataacggccagactacaccggccagactacaccggccagaatataacggccagactacaccggccagactataacggccagactacaccggccagactacaccggccagactacaccggccagactacaccggccagactacaccggccagactacaccggccagactataacggccagactacaccggccagactataacggccagactacaccggccagactacaccggccagactacaccggccagactacaccggccagaatataacggccagactacaccggccagactataacggccagactacaccggccagactataacggccagactacaccggccagactacaccggccagactataacggccagactacaccggccagactataacggccagactacaccggccagactataacggccagactataacggccagactacaccggccagactacaccggccagactacaccggccagactacaccggccagactacaccggccagactacaccggccagactacaccggccagactataacggccagactacaccggccagactataacggccagactataacggccagactacaccggcaggctataacgaccccccaccgtcgtaaatgatgaaataggcacaaaatgccataaaatgacttaaattggcttaaaacatcttttaatagtttaaaaattactttttggtatttttcaggggtgtattttttaaattatttttcactacaaattttcaaaatagtaaaaaaaatgaaaaaatgtacaaaaatattcgtcgaaatttcaaatttattttttagggatttccaaaatttacgtaaaaaatccaaaaaatatgtaaaaaaatgaaaatatatttttaaaaaatccaaaatatgtacataccaaatatgtaagaaaatcccgaaatatgtaaaaatatgtaaataaaagtcccaacttttgttcgcaaacacagaaaataaagtgtttttcctgttatttagggcatggagaatcaaggaaaaaatatgcatttacataaattagcagccctaattattaaacattttaattaaaagttaaattttcttaaatattttttctctctttctttctctaaggatgttttttagctttatctgtattttatatatttaaaaattaaaaaattttcgcgatgtccaattttcaggcattatcataatttaaatgccaaatatttgcataaatatatacactaaaaattgctaatgcataccctaaaaccacgaaaaaattttcgtttagccgtctaatcctaagcggagccaagggggccatggtattttttgttgttgaaattttagctatttttttatgaaaacgaggtttgtttttttcatcctagtgcgataattgtaagttaagggagaaaatgtgaaacgnnactttcttnnaaatgcccatgagaaataccgagacct

SEQ ID NO: 20998 - DNA, 946 bp, Heterodera glycines
tttgtccctttccgccgccattcgcaaaagataaggccccaaaattgaccaagtgaaaagagattaaaaatgggacacaattcggaatactttggaccggcgacaaaatgataaaatggaaaacaaattttacaaaaattaataactgacaaaatatattcaaaaaccaatttttgaattaggaaaaatccaagagattattggacaaaaacttttgattgatccaaaattgtggcaaaaaggagagggcatggaaaagtgccaaaaagggtgaataaatccctggcagagtattaggcttatcagaggcaatgaaatgactcatttttcattttaatttggcatttctccgtcgctaagaaaaacaaagagaagggacggcattttcctttattcataaaatgtctctcatcaaaagcaatcagtagaatttctgttcataaaatcaggcaatggcaaaaaacattgacggaaaatcaaagaaaagaaaagacaaaatgaaagaaaaataacattcagcccaaagagttacaaattggcaaaattaaataaaacatatttttgggcgaaattttagaaatggccttaaacgttttataggcagaaaaggaagtgagagatggtgggggaggggaagagagaaaaacggagacattacacaaaactacggagaaatggatgggtgttcaaatgacgaaagtgactgttggcggtgattagagattatggtaaggcaattctgatggttgaggagggcgaacatccatttaatgagtcaaaaaaaacactaattgtaagtgatttggtgacgaaaggggatataatattcaataattaacgcgcacgcagtcatcatttcatttattcattcattgttcgtttacacttggggaggatcagcatcagtatgtgttggtgtattaagcaatcaaaacagtcacattaa

SEQ ID NO: 20999 - DNA, 2263 bp, Heterodera glycines
  misc_feature (9)..(9): n is a, c, g, or t
  misc_feature (2154)..(2154): n is a, c, g, or t
  misc_feature (2169)..(2170): n is a, c, g, or t
aagcagtancagcaccaaccggcagcgcatccactcatttcttatgcattcgttcgttcagtcagtcactgctcctccccgtcctgcgagttggacgaactgctccgttcggcggcgtggagagcccattgctccgcgggcgatgcttatctcccgaaccagttgcctggagggaagagggaatgtgaactcattataaaaattctgtcccattttttcttggtacattaagtgacaattagcatttgtctaaactccgacttttttatggttacggtattagtttgcaagtacagtaaacagtgactgactgacctgtgccatcgcgccaagcaacacttctggcgaggaaacgaacagaaaatgctcattgccgaaactcttacagagttgggaaacctaaaaaatgtacccaaaaatgtgtaaatcatttgtctccaataatgccccctccctttgcccaccttctctctcagttcctttttgctttcgggtgccacccaaactgtgtacacattctggaaaacaatagtacaaattggtcaaaatttggtggcccacctttgggttgtgctccaggcacgtgcgcaacattggaatgtccgtctcggagtcgccgcacaccaaaatggtgccctcgcgcaggtcgcacttcaaatgttggataagcaactgaatgccgttgcccttgtcgaagatgtgtcccaatgatgactaaaaattgggattttggctaaattgtgaatgtatcgaatggcattttccaccttaatgaacactttgatgtctgtctccgtcgttttcacttccaacaactgatgagtggagtcaatgtcctcaacaatggcacggattctttggtcaatttgctccctgagttcacgcggcactgtgccgaacacatcctaaaacattttgggtacacaaatgtagcacattcattctccgttcggtccgtacttgatgtgccaatgtcacatggccatagtgtttctgcagtccggagccaatccaagcaaaaattttgaattccggatgctccaaaagttccgaaatggagtcgaacacgtagttcagcttctccaggtccgggtccgggattgactggtccttgaacttgttggccgggtccacaaaccattcacggccagcagaggcgccaatgtaataatacccctcggggatggtgcacacgtccaaaatgccttcaaaaaatgaattttaaagcaatgaagtaacagtaaaaaaatttgaaaatgccacccacccaatcgcatcatcggagcggtggtgacaatggcacaagtttgagcacaacgacgagcgaattgggcttggatgacgccagaataggcgggctgaatgctggccacgtacgagcagctgtacgacttcaaagtgccgtcccgatcagtgaaaaagtaattgaaatgatccgcgtcgatgaacatcttcaaaattaaagtatgcaataataagaagtgtaaaacatgaacatgctgttaattgaatcataaaaaagaacggtatttggaatgatttgatcaatttattaactcataattaactcacatcgaccaccgccgccacttcctcccgaaacgttgtctcggagacgggatggtacactttcaaagtggagatgaactgttcgatgttgtaaatgtcgtcggattggatgaactgcaggaatttcaggtccttcttgaactcctcaatctcattttttatgtccagcagaaccacttccccggcaccggtcggtccgccgcttgcaaatgccgtcgttccgccgtcgtcgctggaacttccgacggtgccgcaaccgccgcatgtcgccgcagttgcacgcagtcgaatttggcttgtgcccggcaaacagctgatctccaacgattctttggcattttgcagagagatggaaaagtgcggacggatgggaatgccctacaaattaagagattgtattgacaaaagtgaacccttccccatctgtcaatgataatgatgcccccttgtcattagtgaccaattgcacttgccttcagcacgcgctcgacaattccacgccggacgtcccgcgtgcgcagcatcaagttaaagaagaaaaccaccttcataacctctatttcaccaatcaccttcttataccanctctcttccaaaaannttcaacttaaagggaaaatcggagcacttttttggggtatgcacaaccctggatggtccgttcaatgtcgttggccatgatgaactcgttgag

SEQ ID NO: 21000 - DNA, 1557 bp, Heterodera glycines
atattttgacagtttttagtccatattttggtccatatttggctatttttgagctttttagtccatatttcgggcttttttagttaaattatttaatttacaacaaaatcaacagatcccttttttgtatgcaaattcgacaaaaaatgccttagcaaattaatttaatttttaaattcgcgaaattgtttaaaaagtttacaaaattttttgtccaaaattttgtcttttattgcccttatttgctcatttagatcctcaaaaattatacagtttctcaaaaggttaaatagatttacttgtaaaagattagtagctaagcacaaaagcagtaaaactgaaaactcatttattaatagaacaataaaacaatggaacaatcttgactctgaaattacggcatcatcttccatacgtagttttaaaaacaaagttcttaatgggttaaagcccgtaaataccataaaatatttacattgcatgagaaaaatatttttgattatttataactgtgtttcgttcgatgcttgtgatctgactttattttttcatgtgtgatctccatttatttattcttgtattcaccgatctgcagagtaagtggcttatgcccttctgcagatatttttattgactgaataaacaaactaaatacatttttcggaattttttagggtttaaaacacatattttgacagtttttagtccatattttggtccatatttggctatttttgagctttttagtccatatttcgggcttttttagttaaattatttaatttacaacaaaatcaacagatccctttttgtatgcaaattcgacaaaaaatgccttagcaaattaatttaatttttaaattcgcgtaattgtttaaaaagtttacaaagtttacttacaagatagatatttagattcatggaaatccaattcaattgcaaaaaaacggacgcttttatttgcttggactgccaaacggcggcacaaaatccaatggacaattaatgcaaaaattccaggcaataaaaattgatcaagcggatttttttttataaaactttcgaatataaaattttataaattcctttaaaatgtgaattatatatatttttatatttcaataataaacaaagtctaccaaataaatgaccccttttgacgcagtcattaaaatttatgcgactaacaaaaattaacacgaatccatcgaaaattggcgggaatgcattcacaacgaaacaaaacaaccaaatgcgcaaacaaaatgatacaaacatatatcttctacacgaaaaaatgggtgaggtgtgacgactaattggatggaaagtgaagggataaacaataattagtcaaacggagaaaagagacagagcaaaacggaaacaaaagcggagggaaagggccaatgccaaccaataggtgagaaagttgtaattcatcaggcttaattttcaaagaaaactcagctacttgaaaatcgtaaaacggaaaaagagcggagggctttctttgtttttatgggtggcacaatcggcttaactatgctgaaagaa

SEQ ID NO: 21001 - DNA, 3058 bp, Heterodera glycines
tgatttaaatgtcctacaatttactcagattgaattgcctttgcagaaatatgacccgcccattggcccatgtttgaaggcttattgtcttggccatttgcttatcattctgtgcatgttcatgcattttgagcaggaccggagcaagctgggctatttgaacttcacgatgaagctggcattcttcatttgctcaagtcaatttttagggccaaataattttttaaattggccaaattaattataagtttttattcacacccccccccccattttagtgcaagcgtttggtgccttttttgacaaaaagtaggtgaaagaaagtttcatggcgccagtaaaaaaggaaatgaaaagtgccaaaattgtttctctatgaaaaataaaatttaaaaaatataccaaaatcaattattaaaaaacggtaaacatacggtaattggattattttaagcttttcttaatttcaatcatcatactaagggtgggtagattatacacaaaaacagagacacaacaatttcgttttttttggcactcatttttatttttactttttactggccatggcttataattacagcaattaaaaattttaaaaaaactaattttaggccatatgccccatttttggagacaattcgttgccttggactgatcgcttattatgccaccccaacaattaaagacatttttcggccaagtcgcatttttataaccgtgccattcatcgcttcagcaattgcgtgggccgtttttgtgctcctcaaaacttttgtctgtttacgttcgcttaaatttaaggtgaacaaaaatagcttcgcgatttaaatttttcgaaaatttttgaaaaacgattatttttcaaaaattcagaggcctcgaaaattccgattcgagaaaatttacagaagctatggaacttcgacaatgtagaggccttagaacttctgattttagaaaactttacacagagaccatggattttttgaaactgtagagagagagaagccttgggatttccaattttagaaaattctagagacgacgaatttacaaaaatttcaaagctttggagagaaaatttgcaggcccttggaaccttttaaattagattaatatttcaagcattttcccggacaaatctaaggtcagaagggttcaaaaatggtgctgaaggatgatgaagaatttgctgaaaatccgtcggcattttgaaaaacggcgaaggaggaaaataaataaacgaaataattaatgactttttatattgtaaataatttaattaaaaaaaagcaaaaattaaaaacaagcaaaactaatttgtagagtccgtcggctcgttttggcatcgcccaaaaagtgccacacaatttttctttgtcaccaaatttttaaaatgattttttggcgcccccacaaagtgtccaagccacgaaatgtccaaaagagtaaaaacccacgaaatgtccaaaatttttcaaaatttataaaaacaaaatgagtctaatttaggatttttagggttttcggggtcgctgaatacgaatataccctttatattaccccttgcctaaccttaggcccatctgaataataaaaaactcaaattcgagacttggacatttcgtgggctggacattttgtgggtcagcggattttttagcattgtttagatatattttttgtaattattcaagaaatgaaataaacttaattcaatatgaagcacaaaatatataatatattaagtaaaacaaaaaaaaaaaaaacatgaaaaaggcaatttaatttaaaaaacaaatttaggtgaaattttttatatttaaattttttcaacataaattggattaaaattcaaaaagtgccagcagttaacaattttattttaattaaaagtacattttccattgtgcgaaaatgtccggcgaatttcggcgataaaatcgccgcgcacattactaatccattttctttttcagtgccatccaaaaattatttttaaattaattaattaatctaattgactcgaatgcgctaaattaaacgaccagccgatttacaaaacagttatgctgaaacagttaactgggtaatttaaagaaaatagaattttaataaataattttctttaaaatttaaaaaattatgccaaaagaactcaattttctgaattttatgtgccatctttttgaaaacttcaatttactgcactaatttgtaagtaaaaaaaatccgaaattggcataaacattaaacattttcctaaaatcgggatgaatccgtttaataataatttataaattaattaatttattattttaaagccgtattaacaaattccatggcatttatttactgttgtatacatttttacgacttttacggcacggcacaaattcaatggatgaaaataataataattcaaaacaaaacaaacaacaattaattgtgctgatttccgctgtttacagtttaaaaagcagactgtaagtatgtacagaaatttttttttaatctctcagcggtgacaaaacgccaaatattccggtcttttttgaaattatagagaaaaattctcaaagacttttctaatggggaaaattttaaaactcaaaaaacccataagtttttatgaattttgttggttttttaataatttcctgggaaaatttcctcgtttttcatttttttttaaattttcccggaagaatgaaaattgaaaattgagccttccccataaaaaacggaaaattttctgaaaattcagcccccctccccctaaaaacggaatttttttttctcgagatatgctgacaacaaaattgtgctgctgatcattgcaccggaaggacaacacattaagggcacgcaaatggtggccaaatccattaatggtcatcgccatttgaaaaaaaaatttgcgatttcgccggagcgtcgccgaccttaccggatgtgccgttggcttgcttatatagcggtcgttgattctgtggtggagccggaaggccacatcgagattggcgcggaaccgggtacggatttggtgaatgtt

SEQ ID NO: 21002 - DNA, 2929 bp, Heterodera glycines
actgtcgccatccgacgaagggcatcatcggcaaaacggtaagaatgaaggcaggaataagtcaacatcaacaaacgatctcctcttttcaatagtgatcagatatgggtggggaaaagacgaggagagagactttggccaacagagagaatggagagggagagagagagagactcatagaatggagagagagtgaagcaatcccatagaactagtgatcagagtggagaagagacttttggaaacggagagagtgggggagagacatttttaattttctttttttctctattttaacttgattttagacttttagaactcaatttttattcaatttgatgcttgtcctgaataaggtaaaataaacaaaaaaagaaataatgaaatttatttgatatgcaaaatacatatatatgaaaaaatgtaaaaaaaaaggctcacaaaatgtctttaatttagtaatgaattttaaaaatttaattgaaaaattcgtaaattgtcaattcttgaacaaaagcatcgaatggaatcgaaatggacagctaatcaatcgaaactgaaaaaacaaatgatattggcgaattttgccccatttatgctgtatccgcagcattcaaattttcatattttgtgcataatgtaaattgccctattcctcgacccaatcccgtcataaacttgtccgtctgttcatccaatctcaagccaatcctgtccctctcatttatcgtgccgtttctatcccattcacctctgttgcatatgccatccctttctctcttattcctgtgtttatgccgtcatacccctcatcctatccaaagtccatacccattgtgccagtatataagtccactcaatttccccctcgggggctgcgagatgtctgcggtgggtcagtctgtgccatttcttgcctttggcaatcctttcccaaataaccaattgcactgacccacccaaaatgctctgaggttgttgttgacccaaacatattcccggttttcaattcataattaattgtcaatgcttttccttataataaattcctctctcctaaaacggtaatttgaaatggctgaaagccttaaacccggggacacaacagtttattagaagattttgcgatattatcaaagtgtcatttactcaccgatttttccttgttcagaaggcacgtcatcggcccataataaaattggatgctgtgccatggggagaaaaaagcgttaattggtgttaattggtctcgacagaagtcatttcgatgaccccttctgaattggtgaaatttcgaaagtgaatctgatcggaaatgatcggagtttggtaagttttggattcgggacctggccaatgatcccttttagaattttttgagaaagattcgcaccattggttagttttgtttcgagattgttcagtgatagggattagcgatccctttcggaacatgccgagattgatcagcttcagctaattgtctcttttttgccccctccaaattttgttccctacccggctttaacaatttgatgaaattggtgtcattttgctactcccgataatcgctgccattgtttatgagctcattttcccccgagggattattgccatggactgaataattggaggacgccaaaagaacggaggaagaagcaattgacgaagacaattgtgaaattggctttgacggtacggtatggctgttgccctaaacaattattggtttttcaatgccactaattaagtgattagttaattagatgctatattgcgaaacgattaagccgattaatcggcccacctaacattttaagcttctccacctttccgtccccattttcggcttgaactccgatgccattggccttccattggacagttcgttgtggcatcgctttctcctctctgttcaccgcatccatcagaagcatttccagcttttgctgcatttgatgcaattgtcggacggcacccaaaaagccgtccttccgatcgccggcacttttattcgcccccgacgatttccctcctcctccgtccggcaaaaactaaaccgagattaaagtggcggaactttaaaatgccgccgaaaatgggtttaggaaaagaaaacacaatgggaccaaaaactctgatcagttttacctgccgttgtgttttgtcgagaatgtgccgtccgtcgtgcagcgagagaaactctggcaatggaaattgttgctgatcagccaattgctttgttttcccgctcaatgtcggcactttctcctttattggacaaaaggtgtttaattggcttggcattgtgtgccaatctgcttaaatgccaaccggctcaatggagcgcatttgagaagaaatttgatcagctgccatggcactgatcatgccattggtgggcgcgtaacggagtccgccgtcgatggcaccgcgggcgcgaagaatgttcaacaaatgcgcaatgtcgtcattgctttcctttgatggttagtgatcggaaaggaatgaccaaaggaagcttttgaaaattttacggaaatttgtcaatgattgattgggatgtatgacaattaatataacaatgagagagaaagggttttttattaaaaattttagaaatttctttctttcaatgtaagggctctgtcattagcctgcctactgatgggcttgagctttgggggtttggaccaaccttgtcacgccgccagacgaaatgaaaacacaatagaggcacattcctcgccacctatgagcccaaaatccacgggttaaccgccagcacggagggccgccgctccccgtagtcgtacagcaactcctcgtcgctgtcaatgtcgcgcatggcgacgagcaccaaatggaagccgtcacagccgaagtcagccacctgacaaaagagcgaatggagaagaaatgtggagtt

SEQ ID NO: 21003 - DNA, 1384 bp, Heterodera glycines
cttcgcttgttgcttgctgattgattggctgctctggttgtactgctgacacggagatcaagcagtatacttgtgttgttccgaccgtttgacttgtccgcgtcgggttggagtaactgctgccacggagagcgagcagttcacgccaacggtccttcctttgcttggcaaggaccggtactgttgccacggagagcgagcagtactttgcttgattactggcggcacggagaccaaccagtaattgcccctattactgatggcacggagaccgatcagtaatattaccgattactggcggcacggagaccgaccagtaatttgaccaattactgctggcacggagaccgagcagtaatttgacttaggaaatactgatggcacggagaccgatcagtatttccccgaactcccacttttgcttcccccctccttgttgtgtacaagttttgccacggagagcgaaaacttggaacaccgagtgaatttttccaaattcaccacaccttttccgttgagtgcaccgccgcggcttgtcgcgcacttgttgctgcttgtcgttgcttggttgtccctgcccaggtcgccacttgtcgtactccgggtttgagtgcgggtgtgggcgcggtggagtccgacaattgcctgcacttgggtgcaggactttgacaagttggagggagagcacaaaggggccgggggcgatcgagacgggactacggtcggattgggccgcaaaaaggaagcacagaaaattaccaccaaattttatctcaaacttgggtaattaaaccgaaatgggtgagcaatgggggaggacaattgaggggggcaaaaatcggccaaatgggccacaaagtgaaaaatgtgaacaatttggccctattagcccatcacaaaaaattgcattgaaattggtcaaaaatgggggaaattgggagagcaaggagttggagcagtacaacaacggaattgtgtgagggggcgcaatcaatgcatggaaatagcttggggggcgccgtgatggtgattgattggggagcggggcgcttgtgggacaattgtggggggcaagaggaagagagagagagagagagagaggcgaagcaacactttggtgtgctgctgatgattggtgtgttgatgaagcgctggtgttgagcacttatttatattggccaaaaagtggggagagaatgggcgagttgaagctgataaggcgggaggaacggaaaattgctggggagagtgacagccagtgataaggattgggggaggaatgtcactcaatcgaacattggccccaaatttgaaaattgtttaatttggtttttggggccaattcaattttgcacaatttgtgcacaattgtaaatcaaattat

SEQ ID NO: 21004 - DNA, 1061 bp, Heterodera glycines
tttaaatttattctctatcccagaaaaatggctctcttttttgcgagaaattttgtaccatacaaatgttcccagcgcgggcagaggggcgcggagagcaatggccattctattctacagggaatttttaaattattctctatgccagagaaatgtctatctctcttttgcgagaaattttgtaccatacaaatgttcccagcatgggcagaggggcgcggagagcaatgtccattctattctacagggaatttttaaatttattctctatgccagaaaaatggctatctcttttttgcgagaaattttgtaccatacaaatgttcccagcatgggcagaggggcgcggagagcaatggccattctattctacagggaatttttaaatttattctctatgccagaaaaatggctctcttttttgcgagaaattttgtaccatacaaatgttcccagcgtgggcagaggggcgcggagagcaatggccattctattctacagggaatttttaaatttattctctatgccagaaaaatggctatctcttttttgcgagaaattttgtaccatacaaatgttcccagcatgggcagaggggcgcggagagcaatggccattctattctacagggaatttttaaatttattctctatgccagaaaaatggctatctcttttttgcgagaaattttgtaccatacaaatgttcccagcatgggcagaggggcgcggagagcaatggccattctattctacagggaatttttaaatttattctctatgccagaaaaatggctatctcttttttgcgagaaattttgtaccatacaaatgttcccagcatgggcagaggggcgcggagagcaatggccattctattctacagggaatttttaaatttattctctatgccagaaaaatggctatctcttttttacgagaaattttgtaccatacaaatgttcccagcatgggcagaggggcgcggagagcaatggccattctattctacagggaatttttaaatttattctctatgccagaaaatggctatctcttttt

SEQ ID NO: 21005 - DNA, 2679 bp, Heterodera glycines
  misc_feature (69)..(69): n is a, c, g, or t
gaaaacaattttaaaatttatgaatgagaaataaattcaatttaatttatatgtatttgccaaattatnttaattttgttagccacataaattaatgaataaataaatgaagttactctaaatgttacgcttatacaaaaacataaatatatgaaaatgttttaaaattattattaagtttaaatagtttttgcttgaatcataaaacattgtttgtgaacaaaccgacgacaaaatcgccttttttaacaggaattaaagagcatttactttaaaaaataaaggacaataatttaatagaaaataaaaattttaattttcaaatcaacaacaaaatttaaaataaattgcaattaaaaacgccaaaacaaaacacgatgttatccgtggaggcgggaaaatgaccatattctgatagtgaaaaaaaaagaaaatgaacagtattctcctcatttttattcttgtatcaacaatatttatccaaactaaaaagaaaaaatagcgaataaaaactgaagcaaataaaaataaaaatatttaaaataaattgaacttggtgtagaattaaattttgatcaaacatttgcgaatataaaaattatgttttttttgttaaatagtaaaatgaattaaaaaatgttcaaaacattttcagttgtcaatcttaaaaattacttcgcttaataataaattgtaattataaatataaaaatatttcgcaatttataattttaaagttaaattggagatgaatgaatttgggaaaattatataatatataaataatgaataacgataaaaaaaatacacattaaataattaaagaaaattactgatgaaaacaaaaacttaaggagaatctgaatgcgcacacaccaaatctacaagagcaagtcaagagaacgtgaataggagaaaatattatgaataaattaattaaatcgtcataaaaatagttgataaaagaagcaaactaattttatttattaatcatatcaaccaacataaagctatagaaagtaaacaaataaaatattatcaaaagcaacaattgattctttgtcaaattgttggttaatgagctttggaaaatttatttaattgaaaataactataaaaataatccttaataaatcattgatgaaacaaaaatttttgtgcatgttacctaaaaataattctgaaaattaacgtctcgaacttaatggtattgctcaaaacgacgagagtaataaaaattgaaaacaatgtacaattaaattattgactttttattaataaaatatttaaaaccacagtttaaacaaaaatattttaaatataattaatatgcatcaaacatgcacaaaaatctcgaaaattaggggtgcaaattcaataaaaaattttattcctcataaattttatcgattgctttcgcaattgcaaatcaaaaatttttcaagattttcgcatggagctcactgttgactcactcgcgcagccattcagattttgaaataattttaggcataatcaattttttttcttaagtgatattcaaatcggaaaatatttgacgaaaaaatggcataattttttttatattgaaagaaaaaaaaattaagtaaattttaatggtcttatcatattcaaatcaaaaatttgctacacattcgcgaacgatgatgttgagtaaaacaagttatgtgcataaataattaaatagcaaaaaaatttattatttatttatttaattaaaaatgcatatgttaatgaaacggcaaatttacaattatcggcttaattaaatttataaattttcgttgaaataatcaaatatttcaaaatagaaaattgtctaagaatttataaatgaataataaattttataaaacttaagaaaacaattacattttctaactcatattcttatcaatattcacatgctaaaagaacacggaccaaagaagtgcatcagtacaagttatggtgtaaaaagaattaaatagcaaaaaataaataagtggcaacaaagaaaatatttaatttaaaatgcatacagttaacgaagcagaaaattttattgcaacataaaaataaaagcaaaacaaaaaagcgataaaaataaattgttttcaaaagaaaaataaaataccaattaaaagttaaaacttcaaatttatattttatttaattttacctaacccttcacaattttttatttgtctcgtaatttgaaaattaaatatttaataatttaacaggggagttcaatttgcattgttttatccgtattattcatcggttgggtcccctttttggaaggaaaattctttttatattcatgcttgtttagtatgatagttaatttgttatcttaaaaattttctttgcaaaaaatgaagggttttttctaaatataattgtgtgatagtacaaattttaattattataataaatctacattgaacttatttattttttaattttcattttttatatttatagaaatgatattttttcaatgtttttgaaaaataaattatgccaaattttaattggtaaaatatacaaatccatgtgtttggcattagttttgtaattttgttaagaaataaatttattcttttttttctattcatttgaagtttcatgttccgtaggttgaatgattttatttggttgataagctgtttt

SEQ ID NO: 21006 - DNA, 3449 bp, Heterodera glycines
  misc_feature (3443)..(3443): n is a, c, g, or t
ctaaacattccgaaagtgacgattagattaaaaaaaacgtttgtagaaattaccccttggtgcaaaggccttgcttaaagaaaacgcagagaaccgacttggggtcgacatctaaaagcaaaaaccaaataaaatgaaccaaccgatacatttttacgaaaaatgtcgcaaaaaaaaataaaatgggcaaatggaggcaaagactggtcccaaattttattttaatttcaagaaaactattttaggggtaatccaactaagcagctgcattcattttgcccattttcgaaccccgaacccggtttcgaacatttttcggaaaattttaaaattcttggcaatattttgcaaaaaaaatgaaaattttaattcgaaaaatgtccgaatccgagttcatccgtgtccgaaattgagccaaaagaaggcattgattcttgcctcgcgcctcagattctacccatagaaacaatttccgaaaataaaaaaaatatcgagaccaatgttcttcaaccattgccaacaaatttggaatgcatttcgcgcccccaaaatattccatcaaatccgtaatccgtaattgtctgtccttgctttatttgtgtgtgctctcaagtacctgcgctcactttttgctgtgttgcttgcacaactggtttgaaaattttgtttatgtccttcaggtcttcatcctcttgcttcttcttcggcgtgaactgcttggagggcgcgcccataatctgagaaattttcgtgttttttttaatttttcataatttttgagtacatttttctccatttgtgccctcaattttttgtttttcatgccaaatgtgcggtcttcaaggactttctgttttttcttctcctccgcctttttgcttgttttaggcgcattttttggaggcatttttatccgcaaaaaatttctgatggaattaaggaaatatctaaaaattcattagttatatgtatgtatacatataggctctctatagatagcgataaaccaaagggaaagggacagtgcctccattgatttgtaggcacaaaaactttgtttcataaatttttaaaatttaaatgttttggcgttatttactaaaaaattttttatcctcttcgaaaaatagagaaatttaaaattgtcggtgagtgacatccctcgtcaggcagtaaattcagtggcgcttatcggcactttcatgctttgcgaaataatattaggtatagagattaaatatttgctactcttaggaatttgaatctctgtaattctaccccgccattcccgaatcccgactttttcaaaattccgtgcttcagaaataagtctcatgtcaaaagcaattaatgtatcaattttaggaaaaccattgtttaatttaccatttaagacctgttaacttcttttgccttattttgaaaatgtctgcgaaattagaaacaaccagtccagatggggctaaagtcagcatcaacatccatgacagaaatgaagaaaaagccttgatcaactccaaggctgtccatgtgaggctgtttttttggaaaattttgaaaaatcaaagaatctgacgcttaaacggattgctattgatatttatatggtctcatattgtaaattttaaaattatacatcgggtcccgatctttttgaaaaaaaaatttgtgaaaatttgtccccgtaatccgtgttttctcaaaaatccataaaaatctgattttaggttattgaccctgccgaggcggccaattcacttggcactttcaaggagcaagaaccggccgcccagcgaattgctttacggttaaaacaccataaattttccaattttattttttttcgaaaaatttttgaatttttcaggacataccctcgtcgttgggctgtgcttgctgtggtggcattgttgaactgcttcaacacaatgatttggattgccttttcaccgatttccaaccatgtttccaatttttatggcgaggtttgtattttttttttccaatttaaagttttggctcacaaataatgtcataattaggtattgttcaaactgtgctatcaattcaaatgatagtaagtaacaagaacggccaagattttctatggaatacggtcccatttatttacaaaaaacaaaaatggttggaattttaggccaattaaaacactggatcgatcccgtctcgttaccaaaaatgaaaatccctaacctaaatttggacaaaatcgaaattctaaaaatttgaatttttccgatcacggcctacgctcttgcaaaaaaaaaactgaaattttttatttttagaaagattccgccacttatttctctggaattttcatttttgtgaccataccagtgggccttgttgcgatgtggtcgggcggacggtttggtgagctgaaaaattttttttataaaaaattaactcaaaaaatatgttttaggcctcagatcatccattttggttgcagcatgggctaatgggattggagctgcaattcgtttggccaggtcagccgtctggggttcgaattaacccatgaaaaatgtcagtcgtcaaaattcaaaagatatcgtattttcgaagctgatgggcaccccctataaaatttaggtacgccattcggtagatttttggctcaaaaacgactaatttggtgcttttttgtcaattttttcaattcaccctcccctctctgaaatttttgaaaatttatttttttcaaattaaaaaaaaattcggtgcgtgatttgtctttcgtaaaagattttaaacagtaccgattgcaatgaagaaaaatgagttttccattttccctcccaatttttcagttcatttttgcccgattcgatgatccatctccgttttccggttggcatcactggccaaggcgtggccgcgttggcctacccgttcatcatgtttttgcccaccaaagttgctgctgtttggttcccggacacggagcgcacattggcaacaacaattggggtaaaaatgggtaaaataaataggaaaaaagcaagactaatagaactcactttttaaccgagattggttccattagaaattttttaatgaataattttttaaaaattcaataattcatcataaaatttctaaaaaaaatttgagaaattttcaagttatcttataaacagtatttttataaggcttttcttgaaaaaattctgtttgaaaatgcaaaaaaaaaaaaatttttttttttggggaaggatgaacgactttttttaaatttcatttttgtccaggtgatggcaaatccgttgggcgtgttggttgccaatttagtcagtgattaattggcgattattcggtccattttttccatttttaatgcatttaggtcagtccaatgctcgtggaaagttgtcttagagggaaaatttatcttaccttttatgtcttttgcaaanttattt

SEQ ID NO: 21007 - DNA, 2005 bp, Heterodera glycines
  misc_feature (66)..(66): n is a, c, g, or t
  misc_feature (76)..(76): n is a, c, g, or t
  misc_feature (1928)..(1928): n is a, c, g, or t
  misc_feature (1980)..(1980): n is a, c, g, or t
  misc_feature (1995)..(1995): n is a, c, g, or t
tatttggtacatattttggttttttgtacagttttgttacttatttcgggattatttttttacacnatatatatantatatatatatatatatattgaccacttttgatagttaattatattttcatctcaaatattttctctttcaaccccgagcattttttggtcccaattaaagatttttttaccaatttataatgttttaaggaaattgggacccggcattgcgacggcactgccggaagaattaggatttctaatgagattgataagaaaatatgaaaatttttcaacctccccccaccctttctgatgatttttagtcaaaattaaaaataattatttgagattgatccaacgaaaaaatacgaaacataacctaaatcacaacttactcgaccacgcataggagaatcaaagaaacaaaaacttggcaaaataaatatacaaaattatttaaacaaaaaccaatctttaggggtgtaaaaagtctcagtctcggaggccgagaccgaaaactcgagactcagacagaaaccaaaaaagagacttttctcgagtcgagaatcgcgaccgagaccctcgaacagcactactcaatatggttaaattcgaaaaaattcatcagttaataaggttctagaaccggagttaaaatgaatatttgcaaaaatttcccggttgcgcctaacaatttgttccaaattttcaacaatcttccacattactcctttcgccggagattcaatttttctccttaaacgaagccacctccccactcatacgaagccctcctcctttctagcctcaattatgaaggtctcatattttccacgaaatttcttaaaaaagttacaaaaataaaattttacaaaatgattttttatcggccaaatgttgtttttgaaaatttcagttggaagctcagaattaacttgttttcattgatacttttgtgctctttctttaatcgcattcttttccacgaaaaatttgagtactttttggttaaattttgaaaatctataaatttgtcgagcgttaccgaatagcgtcactgggaaaaaatgatatttgtttatattgataaagggtttgcatcaaacaagttaatctaattgatttaattatgataattattaagaaaaattttccaaaatttaaaccaatgaatctaaaaagtaattccctaagtcaggaagatgtttgctaaaatcttaaaagaatcgtttaagaaaacatccagttcggactaaacatggaaaaatcgaaaagcccctaatcctaattacgggggcataaatcgcctctacggaattcgtttaagaactcattatttttgtcccaaatatctttcgttggccattgatgttcatctttccgtttgaactaaaaagaactaaactagcaaaacaacttaaactgtttttgaaccggtttataatgtgagaaaatgataaaatgttgaactctaattctttacttaaaataaatattttaagatcgccacggaaatacgaaaatgttcaacaaagaaatgaaaactttgcaggaagcccaaatcgccacgtaagattagtaaaatatttaaatatataataattaatgctctaaattttaagtaaatacctaaaatttttgcgcaattaatatacacttgggagtttttctacctattacataggtacttgtttttatacctattttggtatttttgttacctatcaaaaatgcaataaaacaaattggaaaaatccttgaaaaattcatcccgcaaaatttctaaaaaaaatttttcaaaaattcatccccattcttttcttgacacaatttttaatttaaaaaagtcattattttctaagaatattagaaatatttaagttattcggtaacacagaaatagaaccaacatttacatttttctactanaacgcacagaaatagaacaaacatttacatttttctataaaacgttaataanaatttgtttactatntttctaacta

SEQ ID NO: 21008 - DNA, 1221 bp, Heterodera glycines
atttaattaaattggatttttgaaaaaatgtttatgctttatttttctcttgtttaggcattgacacctatgttgctgatgggcaaccaagttgtagaggagtaccgcgaggcattccacgaagcatggcatgcggccgcttgcaaactcaacaagcactgccctcgagtgatttttgtgagagcatttaataattggtttgaatgcgtatgtgtatgtttcagctctctaccctgcccggtgtggacgaaaatgggcaagcgtaccgagcgagaactaaagttgccgagcgagttttgtttaacaaggaccaattgctggcccaaatggaatatttccttggtgagatcaattttttttaatttaaaggctcaatacccggtgaactggtttttaacagtgtgaaccgaccgggtatcaagtgcgacatggacgccgcatacattgcagcggaggcgatagtaagttaacaaaaaacaaaaaggagataaatattagcttatcttttataaccaaaatccaattacaaaggtttgtttcatcgaagacgccggccaaacctacgtggaattttccttcgaaagacggtgccccgttcaacagagaagtgcgcccgaattcggaaacgaattccgtaaatacggcgctttctgtccccttaattagtgttaggagtgtaggatttttcgaactggaactaatttttattaaaggattctttaatgagtatggcaaacaacatcccgacataaggaattagttgacagattaatttgtcaattatcttaagaattatcattaaaatttcaatttttcttctatagggactcaaaatttcatataagccagacagctcctaacaattctttttcataatgatctaattttattctttgagatttttaatttaatttaaattttttcgaagtttcaaaaatcccgcaatcccgtagtggatctcgcaaattttagaagcgggatttgcgtgattattcctctggctctcttcccgtaaaaatttttgagttccaatcccgcagcgagacacgcaaatttctattaattatggcgttttagaccccttactgacggttagtggttaaggattttgattggtaatatttttcatatggctcgaacagaaaacccataaaaccaacgatagaaaatcgaaacttaggagattctggaactttcctaaacgattctttcatgataatg

SEQ ID NO: 21009 - DNA, 2727 bp, Heterodera glycines
  misc_feature (73)..(73): n is a, c, g, or t
tttcgaaaaaattctcattaaaaaaaagaaatgttcgcaaaaaaatgacgaaaatatttattgaaaatgccanaatgacgacgaaaactcaaattttttcgtgttttgtggggtgtaatttttaaaaatttccaaaaagttgatctttaggggtgtatttttcgttttttttttcatttttcttgtgaaaatttccaaaaaatggccaaaatatggactaaaaacccaaaaatggcgaaatatggatttattcccgaaaacccccaaaatattgatttatatggactaaaaaccttcaccaaatcaaaaaattttaacgcagaaatgctatttttaagcccctttcttcatagcatatgcgcagaaaaaatatgttaatccatataatttacaaccctagtaattatacactaatgttaataaactttggaaaaacgtcaaaataggttaaaataggatttttcaaattttttaggtatattgtcgacattatgcgtatattttatgtgcatatttgtcattttttcgaaaaattctcagttagacgggccttttttatttaaagcgactcttttgaccaatgaagcagaatgttaaaaaatttaactttaagaaaattggtaatgttaaaaaataagtctaaaaaagtcaactaaattatagtattttttgtctacaatttttggttttagaaatttcacactcaattatgaaaaattaatgtgtatttaattccgagtcattattagggttgtaaattttaataaatattttcaccatttttttcgaatttagctttttgttaaaatgagatttttttttgaaattttgcagaatactagcccttacactaatttgtaaggcatttttttgcaaagttttaagggaatatgcgaactgaaaaaatcagctttttcatttataatttttggacaaaatttttaaagcttatccgaatttgataaaaatttcccggtggtgccgacaggcgcagcaggatcaatttatttaatgtttaaattacctactcataaaacaacaaattgactttttttttgagaaatcctttaatcgaagaaatttttaccaaattttaaatgactcatctcataaaaataattaaattaaaaaaaataataaaaatttcaaaagaaattaggatttttttttaataaattgagaaagttgaagaaaattaattgtaagaatgaagaaagcctgaaactagtcatttttcggatatacatgtgtttgatccggcttaaaggcaataaaaaatgcttataggatgtctgtacatgatgtcaattttggaagctgcaggtctaatgttagaagctacctaagcctcatggaacttaatttctcagggaaaacttggaaaattggctgtagtatagaattgggcccgctaaaaagccgcctaaaacgagttccaatcaatctctaatgactagggtaataaatagggttataagttgtatgcactaaaaaatgccaaatatgcgcataaaatatgcactaaaaatcccccaaatatgccttaaaaacacgaaaaatgcccaaatatgcactaaatatgccttaaaaactagcaaaaatgactttgaatcctcaaaaaatgccaaaaattatgtaaaaaattcagaattgactttaaaaaaccaaaacaatgactaaggtgcgtttttagacaattgaaaaaaattttttatatgaacaaattttttcaaaagttcacaaaaagttcaaaatttccaaaaaatgatcgaaatatgctctaaaaatgtaaaaatggcaaaatatgcatttattctcgaaaagtccccaaaatatgcttttatatgcactaaaaaccttcaccaaatcaaaaaattttaacgtagaaatgctatttttgagccctttcttcatagcatatgcgcagaaaaaaatatgtaaaagcatacaatttataactctagtaataacatatgttctaaaaaatgctgaaatatgtgctaaaaacccaaaaaaatgccaaaatatgtgctaacaataaaatatgtgttaaaaatttgaaaaatcaaaagtatttttgcataaaaattccaaaaaatctcattctttatcatttttgcccgcgaaactttttacgataaatttttttttataaattgaaaactccagccagagaattcgaaatccaatgaccaattaagaattcgattttttttttaaattttttgtgtttttcttacagatatttctcaaaagtgtcaaaatatgtgtttttatgtttttataagtcgctctaaatcaaaaattgttcggtctaaaatataaaaatcccagctctaattatggatcagtaaatcaattggaatggaaaacagactgtattaaagcaatttaggacaatgtaatgaaagtggccatttatgtgggaagataaattccaaggattaaaattaccttattttttttttttgtataaccataaaaatatattatatagttaattttttatgaactttttttcagaaataaccagatttaatttctttatatgattaaaaagatcaaatatttttcaatattctgtttaaagaaaaaaagctttgtcttatcataacttatcgaattaatctcaatgattgattttcttttctcattccatctcgacttttctgatcagtgattagcggccctgcggacgctgcttcaatactgctggagttggggcag

SEQ ID NO: 21010 - DNA, 1515 bp, Heterodera glycines
ttttatgaatttttaaaaattttttcatttttgttgatttttcagaactttgatcaattttttctgatcatttttggctccatagccaaaaagccgaaaattggcaatagcaaatcatctatgctctacacgatataagtgattttaaagcgatctgagcagtgacagttcggaatgttcccttgttagattaatttggcaaaagagactgtcttgcattttttaggtgactttcaacttggacagtcgacgaccctttgggatgtccattgtgacgaagaacaaccgttccggatttgcagggatttatgtgcatgaagttaaccctggtaagcttagaatttagagattttagtacgatttgttttatcccatttcaggcggtcttgtggcgttggacggtcgaatcagacccggctttatcattctggaagtcaacgacatttctttggatgaccttagctcaaaggaggcgctcaatctgatcatctcttcggttcgaaatgctaccgaaaccagggggtccgttatttgtttgtttgatggttggttcatttttacgggttttgtcgtttaggcaactcaaattggtctgtgctcccagcagtgagtctgttgaactcgcgcgaaacgttttccaccccattttggccgagcccgtacgaccgattgatcccaccgcgtggattcagcacgcaaacgccgccagagggttggaccaccaattgcagcactttccccctcccccgccaaccgctcattcgcaaggtccgtttgtcatttttaaagtgatagcttcgttgctttcttcgtcctcttcagggcaacagccgccgatttgttgtattatgccgccacaatgtcagccgaacgcggcgaaaccgatggccagcaaatcgtcaaccattccaaaaacaaaccctcagcaacagggaaagggtgggtcaaaaataacattcgaattgtctcattttgcacaatgagttagtgtggttttatattgatttattcgctttcaagtccatgaaaaacaacaccaatttgcgggtgctgcaaattgtgccgttgacggagacattcgaatgatccaaaacccatcgactgacattaccacgacagagtcgggcatttcctccgtggaatgctctattggccaattagagccctccacgaaagcgaaaggcgcatcaactggaaacagaaagaggagcaaaacgacggagacgaagaagcgaaggggaagcggaggcatcgggacggcactccgccgattggtgtgcattcggacgacgaaaagaggggggagagggaacagtggggaaaagaaaaatgggtaagcggaggacagacaaacggacgcagcggggggaagggaagaacggaaggagggaacgtacagcacaacccaagaaataattgaaagagggcaaagcacggcggatgagtcagcagcgacttgcaacatttttttgattttggaatatattcgccataatttttgctaattctaacctc

SEQ ID NO: 21011 - DNA, 942 bp, Heterodera glycines
ccccccccccccctcgttcgtcataaggggggcggctgtaaaaaagggagggggtcgtcgtggaagggggctcgtaaacggaagggggaaaaattttaaaatttgcacaatttcctttcaaaatttttcccggcggcgcctatcggcaccgccggaccgcccgcccccttcccgcaaagttttttcgaaaaaacacgccgcaaaaaaggtggtctgaattgaaaaaaaggtcgccagaaaaaggtggtctgaatagcaaaaaaaaaggtcgtcgcgcctgagtaaaatttttgatcttcgtatgaaaaatcgggcccgagacacccgccctgtcccaaacgtccgtcgtatggcccttgggctgagacaccccttgtgcatgtatgtaccattctccctccctttgcttgcgccgactcggactctttcgcgagggtatgtcaatgttttcagcatggcgcccattccctgcacataattcttttgcttcttcaccacattttgtggttcgtctttggtggtgccattgtcgccgttagcattttcattgataatgcccatgctgctggaggttgttgcggctaattcttgcgatgccgatctcaatgctgtaataataataatcattattattaatttgccatttccctctcccgtgcaatggcacacccttctgctccttcgtctcctctttcctatgcttttcctcttttcctcccacttcgtttctcatttttactctttcgcgcgatttgctcttcatttttggcattattttccgccttatgattgacgtctttcttcgcagaatgtgcaccagcggagaaggggacaaacgccgccggggggcgttaggccgtgctggccgatttcgacgattattctgccgtatttcagtggcacgtcggatgagttggccaatgaggtcgagacacaaagtga

SEQ ID NO: 21012 - DNA, 1938 bp, Heterodera glycines
  misc_feature (17)..(17): n is a, c, g, or t
  misc_feature (28)..(28): n is a, c, g, or t
ctaaaaaagaattaaanagtattgaaantggtttgtcctctgtaaaaaaaattttccctattcttgaaattttgcatagggccatattttatgccactctatcgaatccctattttattttttggaatttatgtttttaactcgaactcgagatcggctcttctatttttacaagggaaaatccaaaaaaatttcaagttttgcaaagttttggcgttctgattactaaataaacaataaacttatttgcactgggaacccaaaattgactcgccgtgtaaaattgaggcaattagtacattcgaatttcattttttaatttaaaaaaggttaaaatattgaaaatattaatgtcatccatcaatgcttcaataaatagatcatttaaaccattctttgaattaaaaacttaaattccaaaaaaacttttcgaaaattgttcgaagccgggttaagggttcggattcgccaaaaaggaggccggattcgaactcagctcgtcaaaacacccctagaaatatgttattagattttcagaaaactaataaattttgttcgggaccaggaaaagagatgattgccaaaacatttgaactctaaacagttcatattgttgacttttttaattttaatcttttcggcaacatttttcgtaattttaaggaactgaaagatttttttacatttgtttatttttgccattttcagaggctattggaacgaagagacggcgtaaaagcgattaaatgagcaataagtgttaatatttaagaatttttttttttgtttgtaaatattgtacgtttgttgctgccttttcaagttataatgttcgattatccctttaattgttatacatacagtcatggacatatgtttaacaacactcaaaatttttctactaaatttgatttaaattgattataaaatctcaatatgactatattgtgtatatatgttttatatttcttgtagcattttttgtgggctttataatgtaccattcactatcccctgtcaaaatgttattattagttacaaaccattgtaccaactgcactccctttttggggtggtcatatgtttaacaacactacccatttttttttcatcagcattaaaaaaatctaaaaaaattcaggtaagcataactttggatgctgatcaaaaaaggtagcaacaccaagttgatcagatcactccttcatgtagggctgccaattttatgtaaatacatattttttttcctggcttcttgctctaaatagcaggaaaaacactttcttttttgtgtttgcgaacaaaaaccgggacttttatttacatatttttacatatttcgggattttcttacatatttgtacatattttggatttttttcatatatatttacatatttttacatatttcgaggtttttatacatatttacatatttcggggtttttatacatatttacatatttcggggtttttatacatatttacatatttcggggtttttatacatatttggggttttttgtacaggaatttttcttacatatttatgtacatgtttggatcactttttgtacatatttttagccctacacggcgattcaattttggggtccaagtacaattaagttggttttttcgtcttagtggtctgtgagttagtcaccaaaaagtgggtctcaggttcaaatcctctttttgtttgtgtataaatttcatttttttaaagcaaataaataaaaaaataataaaaacagaacgccagaagaacaaatacaaacaataaaaggtaaacattttattttaccctttgattttatgatttttttttagcttataactttttcaataatagaccaaataaaaccattttatgctcattttggagggaaaattctgaagaatatttcttaattagtcaaaagtttaaaaaaattg

SEQ ID NO: 21013 - DNA, 2139 bp, Heterodera glycines
tgcataatgaaatgggaagagcacagcatgggcacggtttgcagccattgctaccatatgcaaacgcatactgaccaaactgtaggattggaattgtgcaactacggtaatcaaaggcctggccacaacgggcacattaaagccatacaacacgatggggctgagcagaattcgcacaaaacacatcataattgtagggcaaaactaaagcgcaatgtgctgagacgaaccgaaaatactctcagcgtcaattataaaatatttaaatttaaatcaaataggttgtcgaaaaataataattttaattatactattaatattaaaaatatataataaaaaagataaataaaatcattccatctcggacaaaaaaaaacatattgaaacgtaaattttaatttcaaatcttgaacgcatcaaattgattggcaagtaagcttattagaggattttttctttttagaaaaaaaaacaaatttactagatttcttcttaactttcatgcaatatttgcgtaaatttaagttttttaataaaactatatctaaaacgaactctgtgtcgggttgaggtataattcattcgtttatccagaaatttgatgtgtttcttcccataaattttgcttcatctctattcttttttccactaatgttctaagggttaaagccccgaccccgagccccccgacccccttggctaccgaagggccgggtccgtgggagtgttggtcgccggagggccgagtccttgggagtattggctactggagggccgagctcttcggagtattggatgccagtgggccgagctcttggggtttttggctaccggaggaccgaactcttagggatgctggctattggtgagccgagctcatagaggttttgatttccgaagggccgaactttgggttttgtgctaattgtcaagggaatatggccaaaaaaatttcttttaggataatggatcaaaataatataacaaaaagaaaagaaggaaatgttggagatttttgggaggggggaggtgtgcaaaacacatccacgctcatacattattattccaattatttaaaaatggaccctcccctttccacatctgctctacacttcaaaattaaaatgtttattggtagtcaaaattattcaaataatgtgaaaaatttggtgtattattcggtggtttttggcttcttcttttgatcggaaatcatatcactgacacagcaattgattctggcacattcttcacacatctcgagtccaatcgccactcgcccatcttccagccgacgtgtcttgtctttgttgtgaaataaattgttccagtcctatgaaagctgtcaattaatttggtcgtcaaaaatttgattaacctgaacacagccgaatcgctagtacaaattggccccgcgtgattttccaaagaaatcgctcatcaacgcgtggcttcttagctttcacttgttgctcctccgcagtttcgggttgtacaaattgctctgccatttttgatgatgtttcgcaagactgatttgattgctcgtgaaaaattcggcttaaatacctttgcaaagtgggcgtggtctaattttccgggagtataaaagccccagcaatttgtcagctatgtctcattcgttctgcttcaatggtcctcgtcatcgaattttgtgcccaaattctcggctgttcccctaaatcactccgcgacaagctcaatcatcccgaggaccgagtgaaggcactgaaggagctggtcggaaaaaaggttcggacgacatacaaggaccggaatggaatgcagaaaacattttttgtcgacggaatatcggaccaaggagcggctttgaccccggcgtatggcagactcagacaaccgtacaacattaacattgctgcccatttctacgctcgccaccgtatcaagctgcatttcccatacgtgccgtgtgttgtggagaaatattctggatgtggcgaagacagatactacccaatggagctactcgaaattgtggatgagtactacaccaacaaagagcgatggcttggcaaattgtttaccgaaattgaggacgacttcattcctgtcaaacgccgtggtcgagttgacgaagacgaagaaattgaagct

SEQ ID NO: 21014 - DNA, 1751 bp, Heterodera glycines
  misc_feature (49)..(49): n is a, c, g, or t
  misc_feature (790)..(790): n is a, c, g, or t
  misc_feature (1632)..(1632): n is a, c, g, or t
  misc_feature (1709)..(1709): n is a, c, g, or t
gttcgatttaataatttaaactagctttattaattcccttccagttggnccgttacatcgcttcaaatgtttcgttccccatatccgtgttgaagccatcatgaattaacagaacaatatttgttgtctccgaagtggtgtttgattcttggtgatattccaacaattctgccgctgttgcaaatgcctaaaaaattgagaaaattaaaatttgtattctttattgacaatttttattttaaatttaccttggaaggcgccgtttcaagtcgtcgtcgaggattaagcccagagatttgggcgataatctgcaaatttttaaaattaaaaaatggtgcaattttaaatgaaattattaattatttttttctgaaaactttgtcactattataataattccaattaaaatcattttgttttaaacaataaatttagttcatatttagaccccaaaagaatatgttttttcccaagaaaattaataattaattaatttaattaaaaatgaatttaccttttcaacattttttgcttgagcataatttagtccactcagcaccaccgacgttctgtgaaaggcgacaagtgcataaaatcgttgatgccctttcacttgctgatcaatgtgtctaaattaaattaaaataaaataaataatttttatttttcttaagacctcaatgttttgaaaagtcggtgttgctggttgcgaaaattggttgcatattcaggggtaatgtcgaacaaaacaacgactcggagggttctggattgtgcagaacaatcttanaaatatggatggatgcatatattatttatgttttttaaatacaataaatttatttaagcataaatggacaaaaatctcagataaaatactgcaaaattttctaaaccaaaaatagaaaatcaaaaaatttttagtgaaaaaggggaggggcttggaaaatatctttaacaatctcaaaataagctgttttaaaactaatattaaatttcattatatatgctcttattttatgaaataagctaaaatttttcaacccactgaaaaaggattttattttacaggatggctataattcagggaacgtgtggaggccggggtaaatttcacgaaatgggaatataaattttttttaatttgttaattaatttctaccgtctgttgtttgcttgacagttatgttgggtgctgattgtgacaaagttgtcagaatgcaaatcagtaaaaataatagaatatgacaggtgatcattgggaataattaaaactaaattgaaaatcaaacattatttttttgttttaattaatttcaattaaatttattcgttttaaatttcaactttcatttaaatgtgcaaaatatgaagaaataaaagtgaaaaaacgaatattattttttgctttaataaattttatttaaatttattcattttaacattcatttaaataattattcagcttatcaaagtcaatgtgacaattaatgttagctagcagcattttagcactggggtttcactttatcaccaaatttggctgtgtggaattgcgcggtttatttatgtactcttcaacaaataattagtccattatttatcattgtagatttagtatatatggatganagctaataactggagatacgaagcgtaagctgagaggtggggagagggagatggagacagattatatggcattattnaatccattatgttttgtccccagccgtcgctgatgagcatga

SEQ ID NO: 21015 - DNA, 1638 bp, Heterodera glycines
cgggtgggatggatacatattacatggacatcatttataaagcttatgggggatctgcccatctgctggtggctggggttgcatttttatccgaaaaagtgaaaccggtgggggctgtgcgcaagacggcgtagcgggcggacgagcgtggcgggcgggggggcatgagcatttccaaaatgggtgggtgggggaaaatgttaaagttggaatgaagatggggtaagaggatggagaagattatacttatattatgcaaatcattagaaatgtcgagtgctatttaagaaattaattgatcggaaatttgacaaatattgaaaattaatgcaatataacactaaatttcgatcgaaatttcaaaaaattcctcaatggtacaaatttccgcaccatcgaaggatttgtatcccttcaccagaaattgggacaatttaggcattaacgttttgctaaaattatttaaaaatcattggcacagcgaaaaatttttttttaccatttttttaatttgaaaatagtaaaatattttaagtgcaaatatttgtcatttttttgtgcatccaatttattagataaagaatggacgaaaatgatcatggtcacttatatccattctcaatatcaaggtcatttacttccaactcccttaaattttgaaaaaaattatttatgggggagggaatgtcgcaattttgagataaccaaaaaaatgtttggaaaaaatttatgcccaaattgatacatattattacttttttgaatttcaaattttttaaaaaaatttgttttttgaaaaaatctgattttaatttttatgtttttaaaacaaaaaaaaatgaacaatacgaaaaaggtagacgactataatattttgattttttttgtgctgcgcaatttttctgcgataaaatgtgcataattagttaagcaggatgatcagcaacatattataaaaaattataattaattagaaattatacattaatcagcaacagataaagggatgacatgcaaatgagcttcggaatgttgtacacgagaagcggcttaatgcgattagtgaaagaggagatcagtcaacttgataatttgcttatttattctgtgtttgttgaaactgatttttaggggtttcctgtgcaactcgattggtataaaaaaattttgaaaatcggaatcctgaactttagtaggtcggaattccagaccacaaaaacattcggatgtgtcgaattaagatttgaaaaaaaatgtgtgagtccagtggacagtggagacaggtattacattacgtagaattggccaaaaaaaaatgggtcgatttttgggccaagaaaaaatcagacttaggcgggtagaaatcttcaaaactattccagcaggtggtaagccaaatcttagaaataaagacaaatggtagcacttttaaagcgatttttaaaaatcatttttcaaaagagaattttagaatttttgcacagaaaatcaaaaattcaaatttctatttttaaggataaattttgcaaattctttcgaaatttcatttcttacaagtatattttcgttttttttttgcatttaagttaagaatttctaaaaaaaatccaaaatagtggcaaaaattgcgacaaaatc

SEQ ID NO: 21016 - DNA, 1442 bp, Heterodera glycines
  misc_feature (38)..(38): n is a, c, g, or t
  misc_feature (52)..(52): n is a, c, g, or t
  misc_feature (60)..(60): n is a, c, g, or t
aaaaagcagctgaaagcaaaatcacattatttttgctngtcagaattcaaanagaattcncagtctataaatgttaccaaaaaattacaaaaatatgcaccggcagttttcttttcttttttaaagatgtgaaaagtgacgaaacaatgacgaaaggggtcaatgtcgaaaagtgccaaaaattcaaagaaagaaggggtgactcaatgagaagaattgaggaaaatttatgggcaacggtaaagctagtgaaaacggagtatgcttgggcaggtgaaaaatgtgaaacaacagtaaatgattatatagagaaaggtaaaggtggaattttggatttttatttggtcaccacatttggccataaattaaatccttataaaggttgggacgaaatgcccaaaataactttcatttgggaaattccagagcccagcgacctatattgggcaactcacgctccagtaggagaatttttggcagaaattacagacgacgcaattgttgtcgaaagcgaacagagtgtcttttactttgaaaaagagaacactggccgagaagggattattggtgtgccagaggatgcttacaaaatgtccaatgatgttttcattataattcatcaaattgaccatcgttttaaaagggaagccaaaaaaaaatggagcctaacagaaaagaaaggccaactaaacaggaagtgaatttcaaatttaaatctgaccaaaaaaagagtaatgagtcaaacaaggtcaatttgaatatgcaaagtacaaaagcgcctcttttgtccacaactcaaattacacctaaggttagggaggtcattaccactgaagcaccaccaattacaacaacgcaaacagtaaaaattgagctcactacgaagccgcgtaaaattgagccaaaggttaaagtggaaactccaaagtccttctccaaaggcattcaatttaaaagagtaagaaatgaacaacaaatttacaaaattatgggaattaggaaaggcacaatcctgactactacaattccatttataagtacaactcaagcaccaaaaattacaaagccgaccacagtaagttcagtaacggtaccaaccaaatcaagtcaaaatgtaaaaacgactatgaaacaaaaggttgatacaaaattaccgtttataaaaactacggtaaaaccaacggtaacagtcacgacaaaaaagacttctaaaacaatgccagtaactgttaccttggcaccaaaaactgagaaaactgttacgacaccgaagccgatttttacaaaagttatgaccacagtggccacgaccacgacaatttcaccaataaaactgtgactaacaaaaaacagatttattaaccaacctaattggcacaaaattgaacaaaaaccttagcagtaagccaacgtcgcttacaaacagcacggaaaaaaatgat

SEQ ID NO: 21017 - DNA, 1818 bp, Heterodera glycines
aatacacaagcaaatgatgcaatttgacaaaggttgtgggaaagcgagcgaacggcgtgaagactaacagcaaaagattttaagccgtaaaaatggggcggggaaagagtcgtcgaaccgccgggatccctttggtattgtccaaggctcttaaccgattagccatcccaccacaattagcgggtgcttgttttttggccaaatcacttccttcactcaacacatagaagacattcagaaaaactggaagcaccgctgaaacgcatgcgacgcattttcatgtcaatggattttgggaaatgggcgcagcgaaagtgccgagaattgggtgggcgcggacgaggccgggctcggggctcagaaagtcactgaatccgaaatccggtccccaaacgattcgaaattggagtattcttgaaaatgctttactaaatatgaattatctcaaattaatcaaattctaaaattttatatttttttaatatttgcattacaaggaattttggcctaaaaaactccaaatccgagcccagccaaggcacggactctttgagcaccataacatttagggatggaggagacgttgttgcacaacgatctgtggataaacaacatcctttggcacaacggacagagggcggacgaagtggccgctttcattgactggcaactcgcctcccgtggttggcaatgagtgacagaagttcatcaccaatttgcacaggaaacccaatgattgacgtggctcgactgctgttgatgaacacttcgccagaagtgaggaaagaattggagaaggacggccgcctcctcaagcagtatttggaagtgcatcggacggaaggaggacagaatcaattcgatttggagaaggtggggggggagggggagacgacggacatgacaattggccaccacagcttaccaaagcgtacaaattggcaatggtcggccaaacggtgggctttgtgatggtgttgcccttcttccaaagagtgtgggctgaagaaacgaattgcgaagtgaaaaacgccaaactcatggaaagagcagtcgctgctttggccgatgcggtcgaagtgttggaggaggaggcgccggaatggttggaagacgcggccgaagagccggggaatttggcggagaatcccggcatttgatggacccttggagttttggcaaattcccatataataagtttatacccatgatttatacccatgatccaagctttcgaaaacaacatatgctgtcatgggttcgagtcgcattaatttttgtgtttccactcattgatgaatgaaaataatatcacctttattttgcttttttaatttatttttttgtttttggcaattaaattaaatttttttatcaaaccactccttctctctcacactcgtacgcgatccatctatattgctgatgctctgcaatacgcgtatgtattctgcatacccctctgtccctgactctgtctgcgtagacagataatcattcagagcattatattcgcacctttcccgtccgtctacttgttttcaaatacattttaactgcacaattacgcccaacgcctgacttattcattcactgaactctcatcagacaccaaactttttatgtaaggattagtatattagttttcttgacaaatattatatttcataattcagaccggcgattgcgttcaacaaatcgacgctatgttaggggaagtgcgcttgaacacaaacccattgccttggtacaacaaccacaagaggattttttttgaatagttaaaaagggaaaatttcttattttgagccattaaaa

SEQ ID NO: 21018 - DNA, 1952 bp, Heterodera glycines
  misc_feature (109)..(109): n is a, c, g, or t
gacctggattttttgaaactcattttaaaaatcaaaaaaatgtgaaaaaattaattaattgcttaggaacatctttaaatatctatttacaataataaggtttctttanatatcattattagggatgccaaaaatatgcacatgcatattttttcctggactgcgggaagcctgaaacgcacgaaaaacatgtttttagcttaatttgaagcttctaggatgactttccatgtgcatatttcgcgatttatgtgcatatttgcatatttcggcatttcatgcatattttatgtgcatatttgggcattttttcaataaatcctctattaaaacggccccctctattaaagcggccatttgggctttaatggccgaaaatttttcaaaaatatcagatttttgggtatattttctgataaaaaaagtaactttttaaaaaattggaactttatgccaaaaatagtcagaaaaatagaaaattctccattttttgctcttcttcaaaataaataaatattacttttttggttctaaaataatcattcatactatttttagctattttcgggatttttatgcttaaatttaacaaacttgaagaaatttgaaaatttgccctcaatttggaaaaatttatgtgcatattttttactttttatgtgcatatttcgcgatttttggtgcatattttatgcgcatattttacgattttatgtgcatataattttacaccctattaatgataacttgaaattaataaagcatgataaatttataatcctaaattaaatgttgtttgcaagtctttaatttcctcgggaaaatatacagggctataatatatatcttaaaggcattgtcctacaaaccggacatagacctagtatttgccgaaactccggtcggcgtgagcgtcggcctttcacgcagcagtgatgaagaggcaggaattatctactttgagacggctttcaaagaaaatggcaaacacacaaagcaacacctgaccataacgtcaggaggcggcacttcggacaatttggcgcacgattcaatggaaatagcgcatacattcgccataaatttcctcaaaacaaagggaaacacatcgctagaaaaagcgcatgtgcatatcaacataattagcactagcacggtatgtatttgattaattaacaaatgggtggagattccgcaccacatccgaaatgaaattccttaggaaatgggttatttttaaatttaactaagtcccagtcccggttgtgcccaaaatttccggtcccgacctaccctaattttaacgcattttaatttaagaaaaatgtggataattagatggagccaacaaacgacgaagcttaaaaatgctatcagcaatgaggaaaatgacgtcagcaatgagaacgatggtatcggcagtgaagacaattcatcaaatgacgtcgtcagcaatggcgaggaaaatttgaccgtgacgattcgtcaaatagagtcagcaatgccgacatccttgctgttcgtcatgattcttttaaattatttgatttattcgtttcagcgcaccgatgagatggatcggaacatgaaagacatcgccgcatcggttcgactgcttttacgtcagcaaagagggcgatgggttgctggacggtggctcattgggctgttgatgggaggacagtgtttcgtcgcagaacgtattcaggagtttctctaagcataattcgaccacattatgggattgttgttattatttgttatgcaataatataggaattttggtaatactgtgctttgtccacccccctttcgaaattttttttatgatttcaaatgtcattaaaacattcttccaaggattttcggggtcgctgatcacgaatccggcacccatttcgaccaattcggaatcccggacccgaattcgaacaaaaagccgaaacttcaaa

SEQ ID NO: 21019 - DNA, 3045 bp, Heterodera glycines
tgatgattcaccacggtttgggtgaaatggtttattgcaattacgtgacacatgcccaggttcattacaattgtagcaaaccacggggctttgggcaatcggggctttaaaaccgttcccaaaatcacgcccactctgttgcggttgctggaaatttcttccattatttggtctgaatcgctctgtgttcgcccttttcgctgccctttgtgttgtctcggcacgcgaagccaaagccacaaactcgacgaagctcatccccgatcggcgatgcaactccaaacttagagcgagctcggggttatttaagctgcggatcagatgtttaatggagtaatcatcggacaaattttgggttaatcccgggtacgctctacgcactaagcttgaaatccgatttgccaaatcgtctaagttctcccccgattttctgtagacaccattcatgaggtcgtcaaaagcactcatctccctacaatccgtttcttccaactgctgcaaaatgtttcgtttgatgttttcgtacgcgaacggctctgtggctaaagcagcattgtaggcacgttcggctcggccactcaatttggcttctaatgattcgattcgctttttgtttggccattcactcgtatattgtgaaaattttttgaaaaagttgcggatcgaatcacttccctcgtttcctttaatgtcgggcagcctgtccaggatcatagcatattcaatgccgcttaaccctgttgtttgtcggttcacctcctgctgtgggttttgttgcgccatcgcctgatttgtcggcggcggaatttgctgttgttgcacaacattcgttggctgagctctcattggttgaattgcgggttggggaatttgtggttgaaacgcattcggtgcccaattattcataaatggcacaaaattttgagccggcatttgtggaacgaaattcggtggataaaacatttgaaaattttgtggtggataagccatcatcggctgttgaggccacgcgcctggcgcatacatgccattcataccgaattgcaatggttgaatgagattggggttgtttgggattccgaaatttcccaaattgtttgcttgttgctgatttactggcggaatttgcgggttccgcggtggattttgcaaaaaatttggcatttcttgctcatcgttattctcaatccgaataaaacgtccgcgcgcatccctaggcctttctacaacgcgtctgttaacgcggttgtcaacaaaattaaaattttgccgcgcctggtgaccgggactgatgttaggcgtggacgtcataaaattatttattcgctgcgccatatgtgcagcattttcattttgccgattgtttcccaaattccagccgaaattttcacccaaatttctcagcccattcaagttactctgatccaaaaggcggcgctcttcgtccgcattcaactgttggttctgctcgttctgttgaccattgacgtccaaaagtgctcggcgaatttcgtcgtcttccatcatcggttctgaatggtggttgttcccgttattttgctggctatttcctccgttttgttcttcattttctccaactacacgcctttgatttacattcctatgcagtgaacgagtgatcattttcagcagtttcccttttgtcaattgatctcaaataaccacaatctgtgtggcgcaacccctttctgagagtgtcgcttttgatgctgttttgttgcaaccccttcctgagagtgtcgctgttgaaacaaaatcgttgagttgtgctttgtccgtactgcggaacaaaacaaaaatggcgagtgtgaagaaaaacagcgagttggtgatccgataacaaattcaaaatctgatagcccaacctgtggatctatctttcaaatgtcagcaatcaaattgtttagtgttcaccctgtgaatcactaattttcctcaaaatgcgctcaatctccaatttacttcccacttttgcttcgttttttgttgaaaaccgaaaatcgaatcaaatcccgtcgctgagcttacccagaaaagcaggagcgccacgtcgaaaatatttgaagaaaatgagggagaacacaaatgcagggcttttgcgggctcttctcttctcctccgaattcacttctcgtccccgttcgtcgtcaaccaaaattaacaaaaaagaattgcactcaaacaattaaaaccaaaagtgtatctccaacacaaattaaagtccacagcacaaaacagaacaaatttaattcaataaaaattcgaaagtcggagagcgatgagaataaattaccatcattttgaagccaaaatataatatgagaaagcactgagaaaacaaaaaaatttagaaggggaacaaaattaaatagacaaaatgccacaaattaattatttaaattaaaaacgaggtcaaatatcacaatgaccgtaaacccagttttttgtatagaaaagggttgtccaaattgcaaatggatacagtatctgatttatttcacaacgccaacacgccgttgaaaataaaaacacaagttgcatgtgatggcaaaagttgtgaaattcaaacgcattttacggccatgaattgccgggaagtgaggcgatcaaaattcataatgatagagaatgtgtggctttacctgttttgaagctaagtcggggatctgacggctaatatgagaataaagtgcagttctctctttaaacgaactgattttatggccactttctataaaggcgatggcggtcgctgtatgaccgtaaacccagttttttgtatagaaaagggttgtccaaattgcaaatggatacagtatctgatttatttcacaacgccaacacgccgttgaaaataaaaacacaagttgcatgtgatggcaaaagttgtgaaattcaaacgcattttacggccatgaattgccgggaagtgaggcgatcaaaattcataatgatagagaatgtgtggctttacctgttttgaagctaagtcggggatctgacggctaatagagaataaagtgc

SEQ ID NO: 21020 - DNA, 1144 bp, Heterodera glycines
aaaaaaattttcatttgcctaatatttattatactgtgaaactgttggaaatgcagctgatgcgtcggaaaagctccgatttttggggaagtttttttctttcagtttcaccactgattgttgaggcaattttttcgccattttcttttgtctacaaacattatttattgcgtttcatcctgtagtgtgtaaaaaattttcagtaaaaaaaacttgttatctgaatatttacaagcaaaatttaagaccatttccaaagaggaaggaacaaaaatttttgcctaaattttatattatattgttgaattgtttgaaatgcatctgttgtctgccgttttgaaatttttcaacttttcgcgaaaagatttcccagaaaatgcatgggacaaataaaaattaaacttctattatgatcaatttaaatttcctatcagtttcgggtttgctttaaacacgctggcctatgaaaaaatggagttttatggatgtcaaattttgggacttttcttcgacgtggccatcagcgggttgtttcgtgacaaaaacaaaccagtttgatgttattcgaatgagctagacgcgctctacattttcaaatgtatcaacaaagggtctaccgccactccctggcgagatatggcctgtcaaagcagaacggggccaataaatttgaatttttgttaatcttcggcagttgcctttatttcgagcctactctacttgtgcatcttttcccaatatggcactgcttccgaattattgaactgtttcacgactgattgttgagataatttttttttccgattcctttatctccaagcatgagccttataagtgattgttcatatccttctcttgaaaaaaattgtcactaaaaaaaacacgttttctgaatattaacaacaaaaatttttagacagtttctaaagaggaaggaaaaaaatttttcatttgcctaatatttatttatactgttgaactgttggaaatgcagctgatgccgtcggaaaagctccgattttttggggaagtttttttctttcagtttcaccactgattgttgaggcaattttttcgccaatttcttttgtctacaaacattatttattgcattgcatcctgtagtgagtaaaaaattttcagt

SEQ ID NO: 21021 - DNA, 1814 bp, Heterodera glycines
ctaaaaaaataaaatagtgaagctttaaaaattaataaaaaattttaaattcagaattactggagttagcatcatagcagtgcttttccttgtctttttgatgccctcgcaaaatctggttcgcttctgatcagtttataaaaaaaaagttaagcctaaaatttttcgcaaatttaaaaagcaattaaaaatttttagattttttattcatctccctttttgatagtgaaagcatcagagagccttatttaacttttaattaacatttggtgcgtttcagagcacgttctaaaaaatatttatgaattaattttgcaaaataataaataattaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaactttttggcctgtttaaaaaggaattaaaaatttttaaaatatttattcatctccctttttgatagtgaaagcatcagagagccttatttaacttttaattaacatttggtgcgtttcagagcacgttctaaaaaatatttatgaattaattttgcaaaataataaataattaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaactttttggcctgtttaaaaaggaattaaaaatttttaaaatatttattcatctcccttttgatagaaaagcatcagagagccttatttacttttattaacatttggtgcgtttcagagcactttctgaaaaaatactatgaattaattttgcaaaaaataaataattaatgaaaaagtcagaatttcgaaaaattttaaaaacaacaagcgttggcattttttcaagttaagttagtcctttacaatggagaaggcctgaaacatttggagagattttatcgattttagtgcgctaggttcgatgaaactttttaaaatataagcctaaatagggaagctattcccgaaggattcggtctccccataaatctgggcgcatcggttcgggggtactgccccgaaaacaaaaaaatcgattttttcaattgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcgggggtactgccccgaaaacaaaaaaatcgatttattcaagtgtccgtttggggtactcaaacaattatggggatcaaaaattcaacgcagaattaaagaacaggctttagggaagctattcccgaaggattcggtctccccataaatctgggcgcatcggttcggggggactgccccgaaaacaaaaaaaatcgattttttcaagtgtccctttggggtactcaaacaaatatggggagcaaaaatccaacgcagaattaaagtacagg

SEQ ID NO: 21022 - DNA, 2780 bp, Heterodera glycines
aacaaatttaatcgaaaaaataaataatatttcattgaagacagattatgagcatgaacattaattaaaatgattgatcttgttttttcataaatcaactaatttcacctgttaatataatctacttaattaatcaattaattcatgccttcctctattccgtttaatttaccaataatttcaggatttgtttgactaattaatggtttggagtagggttaagccccgacccagagccccccgaccccgacccccgacatttttgggacctattccccgacccgacccccgacatgtcgccccacgaggtccccggcccccgactttttgccccccgacactaattcgggggattgggtactccgagcgttttaaaaatttaaaagttatgcaaccaaaacatttaaattttacctatcactacgccaaaataagtttttttctcactcttttagaaaaattaataatatataatttgccaaattaaactttacacagatttacaattttccaggaatttaatagattttcacccaattgattacttttaatggcttcaaaagaatctgatatttggaattttttcacgaaaatttcttcagaggttgctaagtgccggctttgtgaaaaccaattagcgtgtaagaaatcgtgcacaaaaggattgtgggggcattttaaagcgaaacacgctaaagaatttgaaaactatttgcaaaaatccgacccgtcaacggtaatacaagcttccttttgatatgaacaactttggtcaggttgaatcaggaattgaccgtacatttgctgatcaagaattgagatagagaaatgtattgacaattgcatcacataaatactttattttctttttagatgatatctgggcccaaccaaaatcaccatgtggtatttctattccctcaacaatttccggagatcctgactctgattttttatcaaaaattgaggctgaacttgcttgttttaaggcaggccaaaggatggaagtgaacggagacttattttcttggtggaatcaaaacactggccgtcttcccgaattgtcaaaacttgcaagaatggtccacagcattcctgctacatcagtcagttctgaaagactcatttggctgtggttcgacttgattttggtttgaaattcctttaaaaacaaatgagaactccgcttggaatgcctgtcgatattccgtactaaaatataattaaaaaattcaatttaattttcaaaaatgccacctcgtaaaatataaaattggtccgttcgatgcggcgccaatgttcaaaggaattgcggcaattaattgcaggaaccaagcagtgatcggagacgaaattgtcggattgatcagaacggtgtagaacaaatagatacaatagccgccaaaattgacactgacaatgcaaataagtgcccgaaaagcgcgatgattgatctgatcagctgatggcaaacctaatgtgacgaaaatttgatcattagagaatgaatttttgcgggttttaatttttttttttaaatttatttcgtatgcaatatgtaaacgtatctataaaatcgtgaattttaattttattaatgctttttttttgtttttagtcatagatttaattgtttgaataaacttttttagaatttgaatacaatgaaatttttttttcctatattttaactaattaattcatatttaaaatttttgtccatataaatcagtccccaattaattagagagcagcacgggattgcggggtcccagtccgaaatcccgcattttttaatagttgcgagtttagtcgcgcaagatcccatcccgcaaaaattttgagtactaatctctgtatttttaggaagttgcgggattttgcggataaatcaccccgggacccggtcccgcaaaatttagggatctgcaaattagaactttccgatcttcactattaattattaataaccagggccctgcgggccctgtgaaagcgccgggggcgctttcaacgctggctctagtgggagatataatttggggcgtgcaaaaagcatctattggccgctaagcgatcctcatagtttaggaatatgagaatttggaaatgaacaaataattaatttaaaaacgatattgttttaaatttaatttaaatgcgacatttttatttaaattgatttaaatttatttttttaaattgaaatagcttcgctatttaacagtctctagagggcgctacgcgccaaaaaacctttatatgtaagaaggcaactgatttttttaatggccgggaattcaattaacgttttcttaaaactcaaattttaatatgatcgcttaaaatctcttacttttcctctttctcatcccctttctccctcctttctaccttcccatttcacttcatcactctcgctttctcttgctctcttctttttttgttccttcctctttccctttgttgctttttctgttccttttccattttctgttcttcttccactttctcttccactttctgtttctcttccactttctcttccactttctgtttctcttccactttctcttccactttctgttcctcttccactttctcttccactttctgtttctcttccactttctattcatcttccactttctgttcctcttccactttctcttccactttctgttcttcttccactttctcttccacatctgttcctcttccacttcttcttccactttctgttcgtcttccacttcctcttccactttctgttcctcttc

SEQ ID NO: 21023 - DNA, 1894 bp, Heterodera glycines
ctgcacatcccttttccgtaaatttttcacttttctctcgcctctttccacaatgcggtaacaccagcgaatgccgctggggaggatgggtcgttgtacagcttgtcaagtgtggtattgatcaactccactttttcgggcgaaattccttcttgattgtctgcggcgtcctggtggttttgctttgggatgacctctttggtggagccgtccatgaatacaaaattgggtcttgcctaagcctctcttccaatatggccgctccaggtggtttaatggtggggcggcccgctctccggtctattatatacttgagggccattcgcaaattgctatgcgccaacggtttgccgtttgcggtgttaattgtatttccccgaacgcccatacgatccgcataatggttgcatttgatgtgcagtcgttcaatccgttgagtcatggtcagctgatttgacgggatggcaaacagttcacgctgttgttgttgctcatccctttgtgcagaagttgatgggcccggttcgggagagtactgtactctcacccttctcgcttgcctcacgcgttttctaatgcgcacctcaccatcattctcaccgtttacggggtagtggcgtttggtcccccgcctaggcggaggaatagtgggcatttcttcttcgacggcagaagcaggaaggggttgttgcagcggctgtggctgttgttcaacaatttttggctctcttttcgggatacggtatggtacaggcctctttgtcggctcgggttttggtataattttgggtggaggcaagtatccggcctgcctggatgtggatggccgagggtcaagcgggaattcaggttctttttcgaccgaggcagcgcgacttttggtcgtgaatcgggctcaaattttgatggttttagttccaactttgttggcttctgaggctctctcttggcggtaggacgcggtggtggttcaatttttgctttcgcacgaggcgggagcgggagccggggaggtgaaggaggataataaaccctgtattttttgcggtccgaatcatcatcatcatatgcttcgtccttttttaattttcttctgatggcaatcctgtgctgagcagcagtgtccatctggtcaatttgatgttggtatggcaacacaggcaagtcgccatagtattgggatggtgttggcagcgctaacccactctccaacatgtactcatcatctgtatcactttccggtaagggggcagcagctgcttctgcaagaaggtcccgcacaaccggtcgccgtcgttgtatatcgtgtcgccttttctcccactgctccaaacgaccatttctccgagaaggtctactcggtctgggaggacgttgtgggcgaggcggaggactccctggtggggacggagcgcgacccggaggacttggtgggagccgagggcgtcttccaggtggaggtggtggtggtggtagatttggcccacgccaagggcgtctcccaggcggcggaggtggtggtggtggtggagcgggaggccgcggtggtgtgtccacaacttcaccatcttcatcttcaccacctcttctcaacagcacgcttatccctttggtgagctcaactttggccggcttgtctgctagctctcgccgcatttttaaatatcgcctaagctgctggttgtagttgacattttttcgagagggatgtgctcgttcggcccgggcacggttcaaatcgtgtcgaacagcatccaagtttaaatcgcccgtgtccgtcgtaatggtgagaccccgataaatttcttgaggaacaaatagaaatttatttgccatgaataatgaaagattgtagcttgataattacaacaatgatgatgggggtatgaatgca

SEQ ID NO: 21024 - DNA, 1677 bp, Heterodera glycines
ttaaatagattaaaattcaaaattttcaaaagttaactcaaaaaagttcattgctcctcttcaaattgttaaggtgcgtttttgactttttgttcttatattttcataattcatactaataacaaaatgttttaagagatgagattttctcaaaatttgtcttaaaggttgaatacattcaaaagtttacaaaatgctaaaaaatatttaaatcgtctgtgaccaaagcttcatgatcaacatcagagttcggtcccaaaaaatgattggtcacaaattgcacaaatcgccttcacaccgctggcacgagcctttgccgccttaaaacggaacggatttgtcaatttatttctcatttataaaaatttcaatatttttctttacctgaaaatctgcaagttcgtgtgcccgcgatgcaacccgtcgatttcattgcgcaagtccgcaaagtaaatgaggctgaagtggcggggggggggggggggggggtggacaattaaaataatattccatgacatgaaattctggaagaaaatttcagaggaaattcaaggaaatagaatcgaccctgctctatccaatggtatataacacatatgcattttccgacttacagttcgggtggttcccttgttagattttcaaaaaagctaaaatacttttttttcttcaaattttttaatttttttttgcggcgacgttatgtcccggcgacgttttgtcggcgatgttttgtcctgatccggagcccaccttacatttttaactaaaaatatcttttttatgacttaaatttgttgaaaaacaggactgtggttacttttaaatagcttagttgaacattaaaaaagtatcacataattttatagccgattttggcgtctccgccatcatgaagaacaacgagcgacgcgactcgttcatcggcacaccctattggatggcaccggaggtgatcatctgcgagacgttcaaggaccagccgtacgactgcagaggtcgtcgtcctcgtcgagtcccccccccctttttgggccactattttccctattaaaaaggggacaaaaaactgtgcacacactccaaattattaattaacattgtttgagtagcgacagttttgtgtttgcacaacgcgtgtattgactagtcaatccgtggacaaatctgaccaattcccacgagtcgttggccttaaaccaaacaacatttcttattcttgccattaattaatgatattataaataatgcaacctgtccctctccctaaaatgatatgaaaaggttttcgattaaatgcaaaaaaaaaatccggaaataggccgggaattgtcggtagatcgtcccataaccgaaatcctctgtttgcgccaggagaaccctccctgatttctacagataaagataaccaccactggttgaagcacaactgcttgcacatgccctttaatttgtttaattttaaaatttttagcggacatttggtccctcggcatcacttgcattgaaatggcacagatggagccgcccaaccacaacatgaacccgatgcgtgtggtcatcaaagtgcaaaagtcggagcctccgaccctcgtgcagccgcacaaatggacgcccgagttcagcgactttctgcgcaaatgcctcgtcaaaaatgtggacagccggtggagcgct

SEQ ID NO: 21025 - DNA, 1175 bp, Heterodera glycines
  misc_feature (14)..(14): n is a, c, g, or t
  misc_feature (31)..(31): n is a, c, g, or t
  misc_feature (67)..(67): n is a, c, g, or t
ctacatatgatttntaaaaaattagccaatntagagaatagtgagaaaatgataaataaatagattnttatagaaaaagtgataaaaaattaaattttgtgaattattgaattaaaaaatttacacatttcgccctaatcaatttgataagctgtgcttaaagaaattgggagcgagcagtgaaattgaaaattgaatgagtgtgaaaaggagtttttgttctccaccactgcccccgacaatcacagagagcattaaaaaatacataaacaaataaatgactcattaatttttactcttagctaataaaattgagaaataatttctatcaattacatgaagaaaatgattttcattaatttcttaaattcaattgaaaaatgatgttaaaacgtattctaataaataaataattttattctaaaagaaatatttcataccaattatcaaataaaaaatggtatccatcaagggctgcttgtaactgaattttcaattaagaaatccaaatccgtaattacgatgaaccaaaaagaccatatccggtaaatataattaaaataattttaaaacaaaaataaaaaaaaattgaataatcttttttgaatgaaacatataaaaaaatgttcttgttgaaagtctaaattaatgcaagattctcgaaaaataatcaaataaggaccgaaattacagaaaaatcgctaaattccagtaatctgtaactgcgtgaagccattccaactaaagcctctgagtttggcaattttaaacatttattcacatgttcatcaaaattaaacatatttgtaatagcagattcaggtccaaatatttaaaaattcacttttaatttaatttaattttcagaatttaatccctccgatgtgtgccgtgccattgatcgctccccccaatttcactcgctttgccttcgttcgtcggtggtcaaacagaaaggctttatccctaagcatttgcgtcccccgtggttggactcatctctttttgaggacaacaaattaaaagcggagatgaaagtgtcggccaatggatgttatgcgtgttacagggggagaaaggcgagcaatgggacaaatgaggacgaggattactgtgcatgtgtggtacggtattcgcagaggaaaggatgggcgtactacactgtatgtcattta

SEQ ID NO: 21026 - DNA, 2034 bp, Heterodera glycines
ctgcgctactgtttgctgagttagaatataattcaacatgtgaaaggatttttttttgtacatggcaaatcatacaaaaatcaactcgtattttacaaataaaatataagcccaggcctagcctaaagcttagacctaagccttggcctaacctaagaaattgtataagttgccttttgtacgagttgccatgacaccgaataaaatgacaaaaatcatttattcacaaaaaattagcctcttccctgagtttcctaaagaacaacccaaattcactccctttcctccgctctacgaattgctcgttaattttgaaaatgtgtgccttccagccaggctaacttttaattctgattttattttaataaaaaaaaatatttttaaatttaaattaggaaaataaaaattttctactctaattgtcaaaaatttcctccgtgtcgcctttaattttcaaattattcttctgccttccaaatgtccggcggaccgctttgaccaccaacagagccaggcgcattttcgtgtttgcttccatcctgtggctaacggattaaatgtgatagataccgtaataaaatggcggcatactacattatgccaaaattgcaataattttttttaaatcccactagggttcggaccccgcccccgtcacccccgccgggggcgggacaggttttttggcctcacctccgcccccgtgactcagcccccgcaatcccggcccccgcgaccttcgcccccgcccccgcgaaaagccacccccgcccacggggtccgaaccctaattcccacctgctgctgttgttctgattccgcctcctgctccattttgcgcagtttctccgcattttcggcctgcatcttttctagcttttccaacgttaccgatttcaacggaatcaattttggcttgcaataagcgggaagcataaattcctgcaaatttgttggggaaaaataagaattttaggcttatacagtaagccttgtaaaagcgcaatcaaaaaaaaaaaaaaattcatttaaacctctttcaagtgctgttcaggcaagctacatatgtaccaactacagaatgcagaattgtgggttggaatttgtttatcatttttaaaaatttaattcccaattttctcactgccaaaatattgatttaattggggcataaatcaattttgtgtaaaatcaaaaggaacaacacaacaacaaccacctgctgatagacatgtccatgcggtggccacattatctccttcactggtggctcatcttctgcactcaatggggacgaatttcgcccactttctgttgattttgaattcattttaattaaaatttatgatttaataaattttctctataatcacatgaatgcatgaaatatgttttattctgtcttcatgtacttaattttccatggcaacggcacaaatatgaaattaaatattctcaacaaattattgttcatgccttgattcatgaaaaatcgagaaaatgaatgctttttcaattaaaaaaaatggtccacgatttttatcgttccttcaccctagaccagggttcggatcgaaaatttttcaaaataagaacatcaaagccaaaaaataagatttttgggtccaaaataaggacatttttattttgtaagatttggaccctccaaataaggacaaatcttataaataaggacagatccgaaccctgccctagacagaaattcatacgtcaattactgtatcatatggtaatgagaaaacaaacaaatttgctaaaccatggcattgtgtttaagcgggaagtaaataagaaataaaaccaatcaattttttctcctccttttctcattctctctctgtttgtgtgtctctctgccaccaactctctctctccgtctctctctttctgacaaattttcctccactatttcttccccgtctatttgttccattctctcatcattgtcagtcgcgtgagcaacgcgccaccaccaccagcgccgccgccgtcgccaatgctccgctgcttcga

SEQ ID NO: 21027 - DNA, 2679 bp, Heterodera glycines
  misc_feature (16)..(16): n is a, c, g, or t
aaaaaacagggagaancgggaaattggggcgaagaatgacttcccagggggaccgcaagagaggcttttgcatgtgaatgggatgaaagaagaagtgaaaaagcggaccagcccccgccgcgcatgtgaatggtgcctaagggcagaaaaagccgatcgagcgatcaacgacgacgaagaagaagaacgaccaatcaacccaaatgatcaccccatcatttttattgtacccgcccattttctgatcctatataagcaacacaaattgtacatttcgatggcttgcgacaaataaagactaaaaacccgtccattttgggggtttcttgggtagtctgggcagcccctctccctctccctccgctttcacccacccccgaaccaatggacgcaaagcgtcccgaagcgatccgcttcatgtggcgaccctggcagggattttggtggggttttggggtttgtgagcaggggtagggggagcatgccggccccacaggtttttcgtaacctgtggcgtctggcattggcgctattccattttgcgttccgcgtttctggccccttgggttttttgtaacccaaggcgcctgcattccgcaccgtttggcctcccgggttttttgtaacccggggcgcctccattccgtaccatatggtcccttgggtcttttgtgacccggggcgccttccattccgcgccatacggcccctcgggtctctttttggcccgtggcgcctcgccttccgcaccacagcccctcaggaaagaatggtcatgcgcttaggcagcgagcctatctcgcactcattggcggcattgtgccgagctcacaaagagggcagtgagcctaatctgcgcaaattgttgaagcgcattggagcagcgcatgttgaagcgcaaattggagaaagcgcattggagaagcgcattgaagcagcgcaaatgaagcgcaaattgaggaagcgcagaccgaggcggaatggaaaattgtcagaggaagcgcaaattgaggtatctgttaaattcgattgcaaaatttcacttcttaaccttttaaaaatcaaaaatattttcaggaaattttcacaaaaatcaaattatttctttaatattaaaaataaaaataattttttaatttgctcaaaatgtcatatgccattatgaaaatgagcattgttctcctgctagtgccaattgcattaatttttgcatttcttttattcaaaataaataattctttgccaacaaataccaattcaaaaagtatgtttctgttttttaataattcagcaattagagcaaaaagtagcagaatttggacaaccaaaaaccttaattagttaattattttttccaataatcaggtgacacattcattgtcaaaaagttcaaagaaagcgaattggcacatcggttgttggatggcaaattcggcatcgaaatcggcgcctcatcgcacaacccgttcggtttggacacattaaatgtggattacaccgacgacccgacagcatttttccagcaagatcagatcaaaaattcaggtctgcagctaatgaccaaaactgtgagagcatccccaattgttttagaaccattccatacaattgtttttatccattttaagatttttgacactgacgccaaaagtgatcaaaaaaactggtcgaatgaacaaaaagattaaatccactcctataatttatatttgatatggctgttaatgggggctggattagaactgattatttagtatttttcaaagtatctttccgctgatatttttaattttattattttaaagaaatattatatttatggcaaataaaataagtaagaaaaacaaagcagtttatgaccggacaatatttgttcatcaatcaacgcatagaatttttaattagtaaaaaacatttatgtatgacaattattttaaggaaatcctgcaaaagttcacataatagccccgggtgacaaattaccatttgcaaatgattctgtcgattttgtgatcagcgcgcatgtgttggaacacatttttgacccaatcaaagcaattaaggaatggttacgagttgtaaagccaggtcaaaattgttttataaccaacttcaagtaattattcttataaaggtggcttcgtctatatggacatcccacacaaagagcgggtaattaattttaatttttagttttttttgagaacggctattattcttgtgcttgggaattggcctttagttttggaaaggctattttctgcatctccaagtccactgataagtagggccctggcgggaacagaattcccgcgggaaaacccacgaatcccgttcccgtttcccgacgaaaaaatttgggcgaaatgacaaatttaattaaaaaaattaaattaatttaacttttcgatattttccttttaattattaaaatttaattactagcgaaaatttttcgagcttcgaaaattgagttttaatccgagcgttctgttctaaccgttttacgagacttttgatcggggccgaaatcgaaccgctttgtccgaactgctcgaacggcgcggtcggccgacgaatggcgaatgcgaaatgctggcccgatgcccgatgtgttcatttttggatttacggaaagatttgctggaacattgccgacgttttaattggacgagtggc

SEQ ID NO: 21028 - DNA, 1318 bp, Heterodera glycines
attcagagggtgacaaaaggttaacaatattacatttctgctgaggatataatatatataatgttaaataaataaagtttctttataaaaataaagaattaattgctccactcgttttcgaaatgagtcgtttggtggagaaggcaaatgtggcaatcccgtttctttttgctttccataagttcataatccaaccgtttgatttccatttcctgtgtcaaatattttatattttacaagttatttattatgcccaattaaatttttagtctaatcccgcccatccattgtaaaagccccgtcgaatttcaccccaaaatacatgtgaattccttcagaaaaacttacggcatcccacaaatgatgcgctaaattttgttcctcctcgcttttctgccaattgcgatgatcagtcagcccggccaattcgatttcgtattcctccacccaccattttttggtgcttatccttgggcatgaattgttcggacatggcattgacctcaaaatatttttgtattaaaattttaaataatattttaaaaaacctacaatttttcgtagtgcgccgacttcattttccagttccaatattttttgtccttgttgtgccaacttctcttcttgttccaacagtttcttttcctaaaaaatgaccaacttttggaattgatttaaattagaaaattaacggaccaaaagggcagaatttaaaaaatataataattatattaaaataagattctcaaacaaatttaagttttcactaaagttgtgtttaaatgttgatgattttcttaaaattttggtgcatatttccagcaccttttcctctagctgctgttttagccgtttgatctccgcggcctgccgtttgatctccgcggcctgccgtttgatctcggcgtcctgaaaaagtgggacacaatcagtgtattaagtaaagaatatttaacagtttcccttcagattttgcccgcatttccaattttttggtggtatatttttaatagcttatttttgaatattttcttaagcaattgaattgaaaactctcaaatatttgaccaaaaaactgacaattttatgaggaaaatcaatattttcacaaaaattttggttaaatgttgatgattttctttaaattttgatgcttatgtcggcaccttttcctctagttcctgttttagcagtttgatcttctcggcttgccgtttgatctcgtcgtcctgaataaatggcacaattagtggcttaattaaaaaaaaatttgcattttttcccttcagatttcctcaacatttcccagactctagag

SEQ ID NO: 21029 - DNA, 2280 bp, Heterodera glycines
tttgatctcgtcgtcctgaataaatggcacaattagtaggcttaattaaaaataatttgcattttttcccttcagatttacctcaacatttcccaatatttcaataaatttgcataattttaaatcgctaataaattcttattttttgaatttttgctataacttcaaaattgaccaaaaatgaaatttttgggaaaatttaaatagcaataaaaatcaaaaaaatctcaatctccacggcttgcttggacaaacacccttagtaatttggctgttaactccataccccctgctccccgcctccctctcagttttccaccttttttgtggattccttttgtaattttttaatttggttctcccgtttggccaagatttcgtctttctttgcgccctcttcctcaaggtacagaatatgttgttctttctttctcttatcacgtttcaaccgttcgcattcatcgacattttgttgttttccatttttgggaaataagaggctaaaaaagttaaaaatgtgatggaatataaccggcaattttgaactcattaattttcaatcaaattaaatggaattgattttgaatctgaaggcattttacaaattgtgattcattacaaaattgaaaaaagttaattaaagcataaaaaacggctaaaacctcaaaaatgtctctttggcaggtttttaaaggttctaataccttaaccgaaaggcccgaaaaaacaaaaattcaattcataagtttattgaaaaactccgaaaaacctcaagtttcaatgaattattttaaaataaaatgatttaatttttatccctagaagttttagtttaattatccaatgccattaggaaaaatgctcaaaaaatgaaagaaaattcgaaaaaaggtaatgagtgaatacacaggagacggagaaggacgatttgaatttgaaaatttggacgaaaaatgtcaaattgctaggaaatgccattttcccagcagtgcatgccggggattaacaatcctcccccactttttgatgaacctttaacatttgcgtggagcaattctttttttaaatgatcatttcctatggttagaaaaaacattaatttaaaaagttaccctttccttcctccatactccaaataaattcaaaaacctgataccgaacaatcttggataaacattcaattctattcgaattttcaatatttccccctgcggtgcctttcgacactgccttagccttgagttttttttcttgaaaaagaaaattgggcttccgaggagcaaaagatcattttttcccttgaaaattttcaaatatactatttgacatcttttcctttcacaataaaaagcggaaagcattatttattcaaataaattttattattgagccaaaaattgatcacaaaaaacaccatttgatgtgatctgcaggggctaccaaaaaaaacactaataaaacttttgaaaaaactccttagcctttattaatttgaaggcgttaacttttaagcaaaaaatgcaatttttgtggcataatggtaattttggccttttgatagaatattaaaaaaacccttataaatggttttttgattttcggcaaaaattggcttctcatggactttattaggcgcctgattgtattttaggcgtccaaccaaaggtcataactttttccatgttttcccaaaattacattcttggtataatccgaagcttaaaatgaaaggtttttaatacgagataataaaaacgcttttttacaaaaatttaaaaaacgaaataaatttttaggtttaaacgggagccgaaaatgtaacagaacaaaatagtgagtagtcgttccaaggttttccaggaaaaatcacaaccctatcatataatatcggaatttttttatctttataaggttcatttaaaaatagctatgaaataaaaaaaactgaattaaatttattttttagggtttatttcaattatgtattgaatttttaaagcaatttagtaggtattttcgtcggtactttccaattacagtacagtttaccacggtttagtggctctagtgaactttatgattacatcgacttttatgagtccaattaattgacaatacctggttggtttttatataataaatttgttcatgtttgagcaaaccctatctttttggtagcattcgaaagcacaaagtctaacgaagctaaaatatataaaacctcaacgtttaggcaattacgaaaaaagatctgattaattaagtaattgttgattattt

SEQ ID NO: 21030 - DNA, 947 bp, Heterodera glycines
tgcaaaaaaaaaaatatgtttgcaaaatttatggactcatttagcagaaagatccataaatccatgcgagttcctgttttccaatacttaaatttccattttagattttgtcgagatacccataaaattcgcctccattttctcggggggtgacgtggtcaacagtttgttcagctcctggtcgagaagtgcatatgtttctcgcttggtgcatgttttccactcttcgcaactctgaaaatatgaaaacaaaaattagaaataatttatatcatcggcaaatcccaattacttcactcattgatatgagccgctgggttcggattttatccgaattagaaatattgaatttatcgaaggacgcattcagcattgccatttagatagccgagaaatatgaacccaaagataaaatcgaattaaaatctgacagactgaggatgcgagaatatttatggggtaattttctatggttttatctttttgttgtttatgtttacacgggaatgactaagggagagacgacaattgttttgcgagaaggggcaaaggaacggggagggtgggcaatggtttgtgaatttatcgggaagggagagaatttggcgagaacgaacccttcggttaattccaattcagcacaaatttaatgagattaattagtcagtggtttatgcacgaccaaataaacaataattgaccgttgaagtcatgacgggcataattttccaaaatactatttttggcgaatgaatgtctcgaggactgtgaatgggaggtgggaaggaaagagaggagcagaggcgagaaaggtcaacagcattttcgcgacaacattacaaaaaaaggggggagtgggggggggggggaaggatcaatgggggggagggttctctttttgtttgctcgccgacagcgataagcgaagggaggggaatgacgggggg

SEQ ID NO: 21031 - DNA, 1183 bp, Heterodera glycines
  misc_feature (1127)..(1127): n is a, c, g, or t
  misc_feature (1159)..(1159): n is a, c, g, or t
ggtttcctataaagaaaatatgattcctcatagtttttttttaattgatacatatttatcatttttaaatgaaatccctaccaattgagcgtaataatcgcaaaaaccacccttttttttgttgaaaatctgttaacaaattgcacccaaaatttttaaaatttttccccggggggggggtaatttcctcctcgcccgcccccccccctctttttcccatatttttgaaaaagcgctccgaaaaaagtgatgtggaaatcaaatctgaatttctattaatattcgatgatttagtccaaaaatgattaattgtttgaaatttgaagaaaatttgtttgaaaattttcattaatttaatttattaaataaaaaaccaaataattttgtattattttcacttgatataaattaaaatttgaatttttttttaatttttaaaatttttttgaatttttaaaatttcccggttggtcccggttcccggtttttcttgcggtcccggtcccgaaaaaaaatcgaggtcccggtcccggcttctcaggtcccggcaagtcccggtcccggttttggcaaaaattcccggtcccgtggcactctactagaaatcactattttggctacttcgtaaaatagttaaaaatcactattttggagttttgtcactatttcgacattttttgggaaattccttaacaaaaatgcaataaaaccaaaaaatacacccctaagaatcgaccttaaaaaattttcaaaaaatacacccctaagaatcgagctaaaatttttcaaaatatactcctatgaaatgaaaaaaaattttctcaaaaatttactttcttggcaaaaatttttaattttaaaaaattttttatgtaactattttgggttttttggtcttaaaaatcccagtcctactcatttgcaactgcaatcagtgaataaaaattatttttgctcaatttttggctgaaaatttgtcactattcgtcactatttcggactttttgccactattttggcatttttactcactattttagttaactatttcgagatttttcgtcactaaaagtcccagccctaatgatgagaagttgatttttggcaattaaagttgccaattttanatttaaaaataattaattacctaactgattcnaagtcataaatcacagaatcaggt

SEQ ID NO: 21032 - DNA, 2762 bp, Heterodera glycines
  misc_feature (2752)..(2752): n is a, c, g, or t
gcgtccaatcagtgaccatcctcacttttatgttataacttttttcatacttgttcaatccaaacattctgtgtatcattcgaaagcttaaagattagggaatttataaatacatataagaaaagagaaaatatttgcattaagaaaaaattgcaataagaaaacaagaaattaatcatttttcgcgcgtatacaaaaaaaaaaattttttttttttgtctgttgccattgtcctagaattttgcaataaaaaaacatatagacttcaagttttcgaatgatactcagaatgtttgactgagctctagctagtaataacaaaaaaaaaaacaaaacaaaatgtaattgaatttttaaaagcatttaaaaatgaaatttttaaattatccattaacaacattatttcaaaatgaaatttgacaaaaaatttctcgcttaagaatttcttcaaattctttcgtcatttctttcaataattcggcaggccttcaaaaaatttcgcttccgtgaagcatttttgggacttcaaaaattttttgatttcttttttcgccttaagaagtaaaatttagaaaatataaaataatcattttttactttttgcttttgttgtggtgtgatgtcctcggcaaactcaattttatgtttttttgctttgatttgcattgggtccttgtccattcttcgcatcactaaatcatatttaaaaaaaactaattattatatgttattttatagattttaaaagctttaattaatcattctttagcttttttgcccactataacaaaaattaaaattcttgatatcattcaatagcccttaggaattttctatgcctgcaaaatttcaaaaaatttcgttaagcttcaagaaagtaatgtcgaaaaatgttcaaaaaaacttgtttttttgagttcctcatgtcataacttacatatttgaataccgaggtcccggttttgaccgggaccgggactagtcccggttttttcccggttttcccagccaaaaattcccggtttttcaacccgaaagggtcccggtcccgggtttgcccaaaattcccggtcccgtggcactctactcaaaatcacaaaatttttttcggacaaaattcgttaacaaatcgcattataaaatgcaaacattttcccggcggcgcctatcggcaccgccgcggacccctgttccccaaaagtttttggaaaaactgccgcaaaaaaaagtggtgtgaaaagcaaaaaaaagaaaaagaaggtcgtcgcccggaggtacgccctccaagcagccgaaatcctgggaccgtccctggacccctcccaatctcttttttgtatgttttatttaaaaatatttaaattcatccgtacattccttgaatttgtcactgttgcgtagtttttttgctatatgttccggcactgattgttcacctaacaatgctttcagtacgcaatcgatcgttgaacgttcgacaaattccgccaccatttcaagcgcattaatataactcaaaggctcccaactttcctggccgacatattctataaaaaaaaggatttttcaagtacaattgtcctgggaattaggggtgttttgtaatacttcaataaaaccgttttataaaaataaacgcgttttcatatgaactttaatgtaaaagcaacaaaaatttgttttttttgtttacaaatttattattttaaaaaatggggtagccctaagttttctctatttgcttgtaaaatttctaaaaaaaaatatttttgtttcaaaaagtaatgccaaaatgttcgaaaacctaggggtttttaggagtgttttttgtcacaatttacaaatttttttaaatttaatttttctaattattaccaattatcagcacacaaatttgtttttaaaatattaaaaattactaattaaattaccttctccccaatcaatatagtaaaattgacttttgtcccggccgacgaacattgccaaaatttttgaaacagtaaaacattgcgcagctttcttttcatcaatgccttctttttttgcctccaccatttttctttttctgccttttgattgacacattttgttttcttaaaaatatgaattaataaattaatttagtttcttcttttacagtttaagtcccataattttttttcacatttcaaaataaaaaagccaaattaataagctttcgggatcatttatcaagatccggcaagcaacggttttcgaccctatttgaacatcgggcccaaattcgaacaaaatccaaaaaaatttggctgaacattcgtcaaacccccagaaaaaatggcgcaactgatatagttatggtcgaaaattttttctatgggttgacacagcggcccaattttgggctctcagtgcaaataggtttattatttatttagtaatcagaacgccaaaactttgcaaaacttaaaattttttttgggattttcccttgtaaaattagaagagccgatctcgagttaaaaacttaagttccataaaataaacttggaatcgctagaggaggtcaaaatattggcctatgcaaaatattaagaaaattaaacaataggaaaaaattttttacaagggtaaaaatttcaataattttaattcttttttagccaagtccacaatttaaggtcaaaccaaataaaatttacaatattctccagaattttcccttcaaaatgagcataaaatggttttatttgctctagtattcaccaangttataagct

SEQ ID NO: 21033 - DNA, 2874 bp, Heterodera glycines
  misc_feature (94)..(94): n is a, c, g, or t
agttgaagtgtgatgagagatttctattttccgctgtgctggaggtgcgcgtcgatgtttagaaggagactacaagatgtggccacaaatgccnccatgatgacgcacagcggagatatgtggcaacgtatacaagttttggaattggtaaaaaacacccatttaaacgtattaaaatatttatgtttaggcaaaagcatttgaatgtggttacagggtggacagattttaccgggcatggcattacgaagcggcggatgatgatttattcaagggatatgtgcggttattcttgaagttgaaggaggagtcaagcggatttccgaaaggagttgagagcgatgaacagaagaggcaatgggctgaggaatacaaggaaaagtacggaattgcgattgaactgtgcagggtgcagaagaatccggggttgcggtatatcagcaagcttatgctgaatagtttagaggtatgaaatacgaattcttagatctgataaaatgttaatttttaggggaaattttcgatgagaaattcattgagcaagaatgcggtgattgacagagagtctgccttttacgagttggcgtgtgatcataaggtggagttgtgtgacattgtggagtactcgggtgacgcgatgcgggtgatctacagggacaaggaggagtttgttactgagcacaagtcaagcaatattgtggtcagcttatggtaagtttttttttgaaaaaaagcgagaaaatataattttaacaggacgacgagcatggtgcggttgaaattgctggagtttatgatggaggcggaaaggaatggcggggagattttgtacacggacacggatagtatattcgtgtttcatgacagagagtggagccaataacgacggttaaataccttggagagatgagtgaggagtatggaggttacgaaattgaagaattttgttgtggtggggcgaagcagtatggtttaaagatcaggagcaaggagacgggggaggtcgattatgtcatgaagattaggggtgtgacatttgatgtggacaaccggaaggcgttgcattacgatgcgtttaaggagatagtgctgaattatggaaagggggaagtagaccccgcattctttgtttacaaaaatgattttgggaatgttttttgaaaatttttttaaacaatctcatattattttagtccaacgcgtgagtcgaaggtcgtgacgagggagagtcacaagatgtacaagccggtctgtcagaaggggattattgatgaagaattgaatgtgatgtcatttggattttgttaattctgtattttatttttgttttttgttaaataaagttgaataaaaattaaagtgatattgggactagcaggggtggaacggtctaaagtgaaggcctgcacctgttagctgtaatatttttgtaacccgtaaaatccgaaccaatgattcccatacccctcgcattgggtgtacgcccaatgactgccactagcaaatgttggttattttaaaataactccaaggtctctaaaggaaaataacttttatgcccattattttcgcgcattattatgcatggtagttgtggatatttaagcttaacatggtgtcttgagtataaatgctgttcgacagtaacgccgaggaaacctctgtaggcaaaaagtattagaaccgttaaatacgatgtcatccggtgagataaactgattgtacctaaggtgtctcgttattagaatctgtcttcttagaaatttcaaattatttttcttacgcagtcgtagaatttcagatagctcgtgaggttggcattcgttaaaatggcatagaatttcaacgagagaattcattttttgagcaccgataggcattttcatattcgttgcaaatccttatataccattacctcaccactgtatgacgaatttttgccttttctctttaatttcaaaattctgagaactgaaatacagatgacgaccactaccaaatcgacaattgacaaaaaatatacccaaatatttgaacttgaaactttaattttctcaaattctttgaacacgacaaaattaaagaattcactatttgtctcgtacacgtattttggaagtatctcgtttgagtcaaatcgatctttgtatattttcttctctttaattagataaatttgtccctcaattattagtaagtcggtaaatgatgatggtatagacccgatcgctttagtaataatttcggtttcattattgtgggtccataaattctcgattgatctaatgtcaatttcatctattcgatcgtctctgattacaaaaagtcgaccatcaatatgatcaaatctaagatccccactgggaaaattcctgacaaccatttcttgactccctcttgttatcgaagtttcatttgtcttttcgttttggaaaattaaataactatgactccaccctgaaatcggattcctatttatcgtacacagtctcgagcgttcgaatccgaactgtctttcattggccgaactctttgtcatagtgagatacttgtcgtcaaaaagttgtgtatcagaaagaatagtaactctttctgaaatcacttgactggctaccgttaggagaacaaataaattaaacattactgacaaattgcttaactaataaatcggccctcgggcgaaccttatatagaccgtcaatgacctcacaataagggattccgtagcatcgttgtgtcaagaaataaatgcaaaattgaccacatgcatctgagaaattgatgtggacgatgcggtcgttaatgagaatttcgttcattaagttaaggtatgaacttaaatcttattggggatatcgcccaatgaatcaaaat

SEQ ID NO: 21034 - DNA, 1711 bp, Heterodera glycines
taaatttttaatattaaaaagatagattatgaatgtattatctgattattttttttgttagtccaattaaaaatgaaaaattataattgcaaagatctcattttgaataccgtatccaaaacacgaattactgttacagaacccgtcagcaatttgggcttctgcggctttttgttgaccattttgtctgtcgttttcctgctgatcactgccccattttcgttgtttttctgcgtcaaaattgttaaggaatatgaacgggcggtgatttttcggcttggccgactgatcccaggcggtgccagggggcctggtaattttttaattttcgcattttttatggattaaaaatttttaggtttattttttgttaacccatgccttgacacctttcgtaaagtggacttacggtaaaagaaaattaaatattttaatttaatttttttttaattttttctttaaagagtgttaacatttgatgtgcagccacaagaagtaatttattgccggggcttgaatggatttttaagtgcaaaataatgacaaaattttcaatcaaaaaaataaaaaaataaaattttgtaattctacaaaatggctaaaaaatttattagatagtcccgctggataaaaatataattattccattatttatataattttatattttaatttttttatcaattaattggggtcaagaaaaatagataaaagcgatttattaaaaaaggaaatccgatttttgtaaaaacgattaaaaaaaaaatttaaagccctttttgaaatatagcgccaataattcattttaatcataatttttggatttaaaaattaaaaaaaaagattctctcccgtgacgcggtcactgtggcggtcgatgtggtcgtatatttccgcatttcaaatgcaacaatttcggtcacaaatgtggaggactgcagccggtccaccaaattgttggcccagacaacactgcgcaatgttcttggcacaaaaacattggccgaaatgttgaggtagaaaattggtcacaaaaaatgttgataatagtaaaataatagtataatttgaaatttttttttttttttggtattttatttacacaaactatcgtaaaataaaaatttaaattatttataataattctatttatacaccattaataatattgtttaacaaagaaacttgtagtataaattaaattaattttaaatgcttttatttctgtattgtgaatattttttaaatatacaattgtataattaatacataaaaaaaataataaattttatttttgaatgatttttttacctagcaactgattaatgaataaataatttataaataataaaataaataaaaatttatggagtttattaaacaaagagaataaaaatatataaataatttagtgaccgtgatcacatcagcctcaaaattcaggttcaaattcttaaaaaatccaaaaacgaaaaatatttttaggaaaccttggacgaggctacatacccatggcatttattcgagaattttaaaaaaatttaagcattttaatttcaggggcgttaaagttgaaagggttgagatcaaggatgtacgcctaccctttcaattacaggtcctaaaaatttttgttttttttacaaataaattttaaagcgcgcaatggccgcggaagcggaagcacgcgtgaagcgcgtgccaaagtgat

SEQ ID NO: 21035 - DNA, 1185 bp, Heterodera glycines
ttcaaaaaataggatatacataattgcagtcccaaaaactccattattttgccttcctaatcaaccgataattgcttttaatgagtcactctattttaagtgccgaaaagaatcagacaattgtggtgccagtaccagttgagctagtccgctggcttaacagaaagtgattaatttaaaatgaagaaaatatcaattaattaaatttgtgatttcaaggaaaaacaacaacaaacaagagaagaaataaacacagtttgatcaacaaattttagcaaataaattcacattttttatttatagaaaaatttttctattttaaatttataatttctttttcataaaagtgtttatcattttcgtttgtactcttaattaattgaatattttttcattgaatttcatagaacactttttaaaattaataattcataataatatttaaattttaaatttcttttttataaacgtgtttatgatttttgtttgtctactacctcttaatttggtctctctcatcaattaacataaatatttacgattttcacgagttgtgttgtgctaaacccttgcctaccaaatcacatttttggtgccccatttgattagcatattttctaaagcaatgggagtgaatgattgaaaaggcgaaaaagttatctatttgcttcatctgtcaacccaataaacaaaattggtaggtgctgcccctcctctaatggtgttgatttaggactgaataatgatgattaaatggctaatatttgaaaacaattttttattttgcataaaaaaatgaagtcaattttaattttaaaatgtttaaaaggaatacaaaaaaattttaaaaaatgatgaagtttgtcacaatgtttttgcactttttgcctttgttctccatgccgaagcaattgttaaaaatttttaaatttatttatgttgcataatttttgtatttttaaattaaaataaataaaaatttacatagcaaaatttctttaaagatgaagttagtcagtattttggtactttttgccttcgttctctcttccaacgcacttgagggctcaagtaacaaaaaattatttaaatttatttattcataattataattttgtaaatttaataaaatttaatatttattaacttcgaaaatttcattaaattttacattttttaaatttt

SEQ ID NO: 21036 - DNA, 638 bp, Heterodera glycines
tcttttcttgaaattttcttttttgctttaattcacccctcattctaacgtatttttggataatttctaatttttcatcatcagttttcgttttgtatttatataggcataattctttaatccatttttgaatatattggcgatttgttcccatttttttcgctattttttgttcaattttatcgccattcttttgttgaatattttcttcctttttgctttattttctcttttattttataatattttccaattatttctctttttttgagttcatttcgtttttcttcttctttttcttgccatttttctccaaatatttcgccaaatgacttttgttgcaattttttattcactgttccaattttgacaattaaaaataaaataattaataatagtagcggaaataatttcatttttgtcgtctcgaaatgattttattttatttttcttcaattaaatggcaattcattttttgaggcatttaatgattttttttctgattaaaaaactgaataaatcattattttacttaataaaataaggaaatcctgtttaatttcaaagaaataataataataatttatcttaatgacaaaataattgccaattggtaaattaatgattaaataaaattt

SEQ ID NO: 21037 - DNA, 1143 bp, Heterodera glycines
tcggagaaaaataaattttaactgtcatttttggtgtgataattaagtggtaattatgggctaatttttctaaaatttcgagaaattagtgcgaaaaaagtctttttaatttggttgttaaaaatttttatataattattattataataaatttttggtttaatagaaaaattaaccaattttaaaattaacattcattaaatttgtttcattttttataatattaaatataaagcattgttttattaataaaaacaaattaattaattatttaattgagattctcaacctccaaaaattgtgcgcccaatttaaaatatttaattttatcaaaaaaaccaaaacaacatcacaaattcacaattctcagcttgcccccattcgtccgcaaatattcccattcattctcaattctctcactcatcatcatcatcattaatttattaattttctcatttctgtttattctcccgccccccataaccatgatgcaataatataaaatgttcgtgatgcaatcggcgatgtgaatgatgttgggttgggttgggttggggggggggggaggagggaataaaatgccccaaatgaggggatgaacagcaggcagggaaagggcgggataaaccgggacgggcggataaagataaatgtggagccggtgggatcagaatgacactcactcccattactgaaaaattttaaaaatgaaataaattcttaaaatttatttttaaaatttgtattttatgtatgaatttttcatttcaattctgttaagtgaacgggggaaagaaagtgataaatggaagcggtgggattagaatggcactcaatcacttaaaattacttaaaatctttcatttattttttaattttcgttgcttaaatttttcttttttattatgagtaaaaaaacattttattaaaagaatttttaattttgtttttaaataaatttattatttatcaaataatcaaaataaatatttctaaaatgaagtttggacgtgaataaatgatatgtgataaatgggaatgctattgcatcagaatagcactaactccaaattctgaacaataaaaatataacatttatatggccggcaatgtagagatttttttttctattatgtttattat

SEQ ID NO: 21038 - DNA, 1799 bp, Heterodera glycines
  misc_feature (1789)..(1789): n is a, c, g, or t
cagtgaattaaaaaaaagatctatttgtactttaattcttccgttaacactttatttctacaaatattgaaataaaaatgttcgtaaaatttttccattgaaaaatgccaaaattaaatttcttaattatcgtaacatttgaaattaggaaatgatttttaaattaaaaaaaaataagtcatattttaattacgattacgtatttctgaaaatgaacaacacaccaaagaccgtgctgttaactaatgttgcgcaatcgccaattaataatgtcacggcaagaacaccagggcggcttcttttggattggcaccaccggaacggcgccgcccactgatgagccaaactctgcgggtgcgggcgacggcggaggatcagcagcacaaccggcaaaaagcggggattataatgcccccctccctctatggggagccaaaaatgccgaaaatctcttgccccccccacaaaacaaaaaagcggcctgcagtgattagtctcgtgttccatcgggatttggaattggcatgaataatagctccgctgtcctgtcttttcctgtgccaattttgactgaccccggtgggccgacccgttcaatcccggcacggcactttcgccccaaccaaccctccggcggcccattgtactacttactgtcttcctttttgggagttcccattcaaaaaaaaaaaattgggggcgaacaagaacaatgaggatgagtatatgggggatgtgaccacagagcgcaaaaaagcccattttcgggggtaccggggggccaaaaatactgttgcaaaaatcagtggcccgaaaggagtgaccgaccaccagcaactgtgggtgacaaaagaaaattgttggaagaaaatgatgatgagatgatgatgattatgatccttgtgccatgtcaatcccttcctcttggctattatacgtttggcattgtgtacccaccgtcttggcaccagtggaaggaaaattacatattgttgaagagaagagggcgggggagggacattttgggattattcatccatttattgttggatggatggcatatttttaggattagaaaattgcattttgaaatagtcaaaaatgtttaattcaggtttttattaatttagagaaatgagagacgcgccgcgccggtgccaaagggcaacggcggggaaattaattgaaaatttagcacgtttaacagacattgccaaaaaaaaacaacaaccaagttttgtgatcttttggatcgtttttcggcaaatttctaaaaaaaaattgttttaccagagtttcgacgaaagtgccgaaaagcgcggccttttaaaaaattgataattttgaaatttgcataaaagaccattaattttatatttttacttacgaacacactgtttataaataaaccaatttttgtattttttttttaataaaagataatcaaatgggctatttacattaaaaaatggacgacgacggattaatatggtgaaacggaagaatgaatgaatgggaggacaacacttttgagatgggatgcctagtcaaggtgtgaagaataatgaggaggccaaagaaggcttcatcctccatcatctgatgatgaagatgagaaaatggggcaattattggacccttaggggcgagcgcattcaacaggaagaggccaatcttgaagaaattgcttctgataaagacagaattggccaaaccgggggggggggggggagggattagacaaataaataaacctttagtgtatgattactttctttctggtcgaaanggtgcttctt

SEQ ID NO: 21039 - DNA, 1261 bp, Heterodera glycines
  misc_feature (79)..(79): n is a, c, g, or t
tcatttaaaatttttacacgaaatggaggtggagggggtgtaaatcagaaaaacgaaaaaaacccatttttctaatttncctttttaggataaagaagaaaaatgtgaaagtgtaatttgttcttaataattatgaatgggatctgtgaatgacagccttatggagagcaaagaaagccttcagttgctgtgcgctaatgaatatgctaagaaaaagctttaaaccataaaaaaaaccttaattcatgcttacaaaatggggattcctatttttatataaattaatttttttatgcaacaaaatataacaaaaagttataaaatttaaaatatttttcgagcaagttttgattttacctactttattatacaaaaattcagtcaaaaactaaatatatataccttaagaaacgacttaaaattttctaaaaaacaccccattctgaaaaactgaatttttcaaaacaaattttatgttcttagaatttttctcataaaatcttttctaagaaaaaaaaaattatgaccaaaaattgccaaaaaaaaaactgaaaatattaatttaaataaggaaaatattgtttaaatttttcaatttttgcattaattatttttcaataaaaactttatagtttcataatcaatttttctgtgaccaaaatttatttacaaaatttttttataattcaacaaatttttgttaacagttttaatatctaatttttaaaagttcaaacgattcgttgccggaaaaaaaaacgaatttatttttgtttttcaattaattgacaaccatttaaaaaaaattttccctgaacgggaaaacgaaaaaaagcgggacgggattcccgcttttctcgttcccgtaaaaatccgaccagctctattctctagtaattatccccaaaatctgcaacaaaaaaataaatttaaaaaatttcaaaaatcttttttttgcaacaagccaaaaatggcatcaacaaagcaatgaatgacatctgatgaatgatgaaatcaaatacaaaaagccattctgctgatttgcttcctactcaacttcatcactaatctcttcaagattagtcatcagcaaagtctaattcactggtattacgtaattcaccaactgtagttttgtcacatgaagtctgaaaagataaataagaaaaatttaaggcgtagattatgaaaatattaagttttattcatttcagaactttaagtcaaatttcaaaataaaaaattttaaatgattgggaga

SEQ ID NO: 21040 - DNA, 1805 bp, Heterodera glycines
  misc_feature (1695)..(1695): n is a, c, g, or t
atttttcagaaattacattgtttttcatgattttttctcaccgagaaattaaggagtattcatcttggcacattcatttttacgtattaatccccaaaggttttgcatatattaatcccacattccttttttgttattgaaataataaatggattataagaaaacagaatcaaacgttttattgctttgtagaacaaatattttataagattgatcaaataacaatataattcccaaattatagtcaatttgctttgtgcattaattaataatatttcacttccaaattagggtcataattgcttccgggcccagttcgatcactggtgtctcttctccatctgatcggccgacttcgtcaattcgtattttgaatggatttgttgccgagttgatcaacaccaacactttatgtccatgtggagttgtcacggagacatgctgaacagggtgggcggattgatcagtgccgagttggctatccgaagcaaaaagtgtggagccaattcgaacggagccgggcggcataaagcggcttaattatggacaattttggataacaaatttaaattggtcaaaaatggtattccgaacctaaaatgagccaaaaaatagaacattggctgtttgtagaactcgtctcgttcagcgtttacaattattggtgcatcaacaaaattgtgcacccaatttggaccgccgttcatgtccaaacctggcaataattattttttaaaaaggctaactaacccatttacaaattgattctaaggaaaagcataatttcatgccggaattccgaagaggaggctgaatgcggaaaagaaagatttttttttcaaatttttgtatttttcaaaagatatcttcaagcaaacttcaattcaaatttttttgtctcggctctttacaagtttaaaaattgaaagctccgggcgttcaaacattggacccaattagcgtatgctaattaatgcgataatgatcggttctgcacccgcgtctaataaatatttcaacacacatttaatgatgatctcatatattcaactttgccgacttacacaagttccagtccacccaaccgccgctccaatggcgcaggttctgcacaatgtcccacccgtattgccagccccgggtccaattgccgagccgtggccccgagtcgtccggaaagataaagcccgtacatgccttgaaagtgccagcaatttgttgcaaagcattgtttgaccataaatgccgaaagaaagatgccaaagagaagtcaattccgattattagaggcattcggtcattatttttcacttaattagggctctaaatgttccattttccttgcctctgtggaaatgatcattttgtccgggtgttgcgcatggaatttgtcctgttccgaatgtccgcccaaagtgtaccaatgcactccaatcccatcgatcacttccatgccattttcgccttttgaactttttttacatgcgaggaactgaaaataccacaaaataactgttcggttactttaccaattcctcattagtatgggtaattaaaagttgattgacttgttccgcactggtggccataaattcgggtaaaattggggccaaattgcgacagatctgacaccaaacagaagtcacctctttgtcagagttggagtcaccagcgaaggtgccaaacatctgttgngcaagggggaggagtacagtaacatttgaaaggagacaagagcggactgtacatacagtatccaagcgcaacatttgaaaatgaaacccaatcatcacctctttcatgga

SEQ ID NO: 21041 - DNA, 1745 bp, Heterodera glycines
  misc_feature (7)..(7): n is a, c, g, or t
  misc_feature (29)..(29): n is a, c, g, or t
gcagacntaaaatggaagaggaaatgggncatttaaattaattatgtaaaatatatgtaaataaactaattaaagtgttttcaaagggaacgactgaccacggacaagcaaagagtcggaacttttcaccgcttaatctcactgcttctttgatgaagggaatctgaaaattttaaaatgcgattcttttgaatttttcatttgcagcagactttctgttcaaagtcctccggcgccagcgaaaaagtgctcaaatcgaagtcgtcttcctggtcaacataggaatattgacgcgtggaaaagtcagtgctggcaattggcacacggccgaatgagtaacgaatgcctgcggggaaatgggggaaatgggaggggcaaatcggcggcattggcaaaggcattgcaaattaattgagagattagaaacgagagcagaacaaaagactaattgagagtgaaaagtcggccgagaatcaggaaatggaacgtgtcacaatcattgaatgccaaaatttagcagaaggccaaaaaaatggttaccctttccgtaatggaagtacgcctcgagcaaatggcgtctaatgggcgcactcaacgcgttcaaattgatgccggatgagtcggaaaaggccccgccaaagccaagaatggtttggtatttgtcggatgggtccacgctaagccgcaagacattgtcggaggacggaaaaacactttcttaaaagggaaagcatttgaatggaaatacaaaaatgtcaaaacgagcctatgcaaataattcaaagtctttgttttttatgctgtcatttttggcatttatgcaaaaagcgaaattggatttggttttgataggcataaaacatgagaagtgcttttcgtttccgcacttcgtttgcccttttagcattgttttagtgccattccttcccttttccttttaattacatcatcaaaacgggggggggagtcaattcatttcggcatttgtgccacaagtgcacatcccttacaaaagggctcactttgctttttgtttttgctttgattttctctcatttgtcatttaggtgaccttattttgcctacatacaccctaaacttttttctgtttttgggattaacaatctgcaacaaatgggatattcctccggttacggtaaaaaccatgaatttcgccgttttggtcagaaaatgagtaaatttccagtaaaaagaaaattaaaaaatattttatcaaaaatttccaatttttacccaatattttttgaaatttcgggtttattttaactgcatctactcatatttaaatttgaaggttacttcaaaattttttaaatgagggctaaggatttataatatttagacaaatttaaattgttaacgtttttcgttttcagaaccaaaacgtcgttggggaatcagaaaacttggaaattgttaacggttctttttcgcagttcgattaacgcgtaacacgatggaattcattggcataatgtcaaattggctgttttaccactaattatgagttttgcgcccaccgcaccttccgttgctgccccttttgccctcattggcatttcctttctttccaatcgcttccatttccgatcacttgaataagtgaccaaagtgtccgacggcacttcgtccaccgacccatcctcaaaagcatcgcaatgcgaaacatcgcacgcgcaaacgaagctgtcctggccgggcgaatagcgccgttggcatccctt

SEQ ID NO: 21042 - DNA, 1135 bp, Heterodera glycines
taaattaatgcaatttttgcaacaaattttcttcaattatttcaaacaattaatcatttttggactaaatcatcgaatattaatagaaattcagatttgattttcacatcacttttttcggagcgctttttcaaaaaacttttgggaaagaaggggtccggcggtgccgataggcgccgccgggggaaattttaaaaatttgggtgcaatttgttaacagattttcaacaaaaaaaggttggtttttgcgattattaagctcaattggtaggattttcatttaaaaaatgataaaatatgtatcaatttaaaaaaaaactatgaggaatcatattttctttataggaaacccacgagtatacaaaaaaaaaattgaaaataatctaattcctgtagagggattgaaccaggggaaagaagaagggaaagtgaaggagactagccactaggccatttgcacagttggccttgctactttatgaatatatttaattattatttctaatttttttcctttgactccaattttctttcactaatttttcactcacaaatcagaccccattcttaccagtgcttgtttttcccggttcccggttgccctaccgggaccgggacctgagcttttcaaaacccgggaccgggaaccgggaccgggacctcggaggaccgggaattcccggcccggtcccggtcccgtggcactctaattttttcatataaaatagtcggatttttgaatttttcttatgttaattgcccaattatattaaataaaattactttttttattgaatttacatatttatttattttttaattaatttcccactgattctcatcgacggaatgttctaatgaatcatttaatgtgacagcagcaaatagaaatcggaaaagcagaaaatttacatttccatcggtaaaacaaattcatttttaataaacccaaacagaattttttatcaatttgaatgcatttgaaaagtccaaataaataatggaaagctattttatatatttattaatacaattcagtaactacaattaaggaattttttcgttttttgggcattttactaaaaacaattttgtcactaagccccctggccatgaaaataagaagtttatgcaa

SEQ ID NO: 21043 - DNA, 875 bp, Heterodera glycines
catttttttcccgtgaacagggactcgggcccaattttttcggatctcgaatttcgggaaaattttcggtatggaccgcattaaataatatttggccgagctcataaaatattaaaaaacaaaaataaacaaataaatttaatttgctttcatttaaaattatttctagacaaatactaaacatgcttttgtgttcaaaaatttcgcactttcttctgcttttgcttggtgccctgctgttgttgtccttcatttcaatgggcaacggtaattaatttaaaaataatataattctaattttaattatatgaagaaataaaaatacaaatattatttaactttttttttggcatgataatgggtttacttatttcttctttctaccccccccccccccctcttaattagttggaaaattagtacgagtcagggtatactaccagcagtactgagttggcctagtacgagttggggctttcataaaccattcatactccaatttatagttgctaaaaagtgccaaaataattaatttttagtttctaaaaacccccaaaatggttttgctaaaaataccaaatagtttctaaaattcaaattaaggggggtgggtgtaaaatcgaaaattttcttcaaaaaacaaaaatattatgccaacccattaattagatacataattttcaaaatcaaaaattatcgtcaataaaataaattaattatttttggagatgattttttgagaaatttttcatttcttaggggtgtattttttgaaaaaaatttttaagtcgattcttaggggtgtatttttactttttattgcatttttttaacaaattttgggcaaaacgccaaaatagttgaaaatatttttt

SEQ ID NO: 21044 - DNA, 3388 bp, Heterodera glycines
tcgtcatctcagtgcgcttataaacacgataggtatcctgttatctccaactgctccaaattgagaggttcgactcgcggtgcattttcctcacggcgcaaacgtttgatgacctgaataaaaagaaaacaaaattatttacaaaattgtttttgatattaacccaccttttttgtggcatctttgctcggaaaagaggccagcacaggtgtgcatgtgttttgaagcacttgagcacgaatggtcgcaggtgcttcgcacgtctcagcagcacgtcgcttgagtccagttacaagacgctgacattccacatgcgcagcgttcatgtcgcacgaatgaactccgaccaacttctgcacaacgttatttaaatccgtgtgcaagcgtcctggattttaaaagattttcaaaattcaaaataatatattgcatacccttgcattggtctgccgggccatgaaactcacaccgccaaaatttcttaagtccatcgttactgaatttgtgaaacacataaagtgcaccatcatgcaccaatttatcattatttcgttttgttttaattacttgctgctggttcattttgtagttaataaaagcttaactgtcaaaacattaaaagtaattttaaaaaattagcaaattatttgaatgcaattttttcgatactcactcgtacgaaaacggccgtacgaaaacgtctccggtacgaaaacggcggtacgaaaacgtctcaggtacgaaaacggcggtacgaaaatggcggtacgaaaacggcggtacgaaaacgtccaaaaggtacatcagaaaccaggggttttcagtcatttttggccataacttttttgtcccttaacgaaattttttgcaattttgcaggctaatagacgacacttagcgctatcaaatgataccatcaatgtttgatttgattgaacatgaaaacagttatagtccagggaccaaacgtgccccgggtcccaactgatcgagtccgggaaaaagcgcatgaaaatggagggggggagggaaagtgatcaccgatcttgaaaaagtcatctcgtcgatgagggacgaagaagaagctgttgacgaattggaattgtgttgtgctaacaacagagagagagagagagcgagggaaaaatgtgtaagcgctaaaatttaatttgacgaattttttatttaggaaatttgaattgaaattttctataaaactttaaggggagggggggggggggaccagtcattttaggtgagagttgcacccaaaaatacgcggaaatttatgcatggaagagtcccaaaatcagcgtttgtttttccccatcggtcgaatccttatcctgctgctgtacaataaaatccctaatccccgtcagttttttttaatttggagataagtgcctaattttattaaactggttcatcaaatctctccttacagcgattgaaacaacggaatacataaattagtacagtaacaatacacagatggcacatattccgacattgctaacatcacatgatggcattatgggtgaaaattatacatatacaaacaaatcggatggatttgacgggggatcaatttcattgcacaattatccgtgatttaattagtatcctctgcaaaaattctcgtccatttcgtttgccctttttctccatgccgttgttgttattgttgttgttgtaccatggctcatccgaccacgcgtcacgtcattcagtcactgtcgctgcttgaggggcttctggtcgcattcccatgggtcgtattgttggtggcattcgtcgtcgccgccgtcaatccctccagtgccgcgatgttggcattcaatgccgtcgtcaattccgcgcgcgccgcggcattggcatccaatgccgtcgtcaattccgcgtgcgcggccgcgttcgtcactgcaagaccttgaaaaacaggacaaaaatttgttgcttcaaaaaaatgcatatattacgttcaagcgccatcatgacttctctctgctcggcctcggtcataggggcatcctgccgcgtacgcgcagtactccgtccacgctgcttggtcgacttggaccgcttcgttggcgtcgctttgcgcgccacaatccggcgacgtcggcgagacgctttcctggcggacgacgcacggcgcgacactcggcgagacgctttcctggcggacgacgcacgacccgttcccctgtttctcgttgcccttcggctcgcggaacgacgacccgtatttcgtgaacgactgcgactacgaccagcagcagttgaagtcgtacgacgagttcgctgaacggtggggaggaggggaaaatgaatgaatggtggcggaaaaagcggatgaaaatgaatgaaaatggaggggaaagggatcaccgatcttgaagaagtcatctcgtcgatgagggaagaaaaagctgttgacgaattggaattgtgttgtgatagcgcaacagagagagagagggcaaaaaatgtgtaagcgctaaaatttaatttgacgaattttttatttaggaaatttgaattgaaattttctataaaaatttaaggggaggggtggggaccagtcattttaggtgagagttgcacccaaaaatacgcggaaatttatgcatggaaaagacccaaaatcagagttttgctggaaacctgaatacagacagacacacttttaggttagatgtacatacaaaataggtagagaagaaaaaagaaagccggaattatgtaataatttatcttttttggtcaacgcctttgctcttttaaaaactctaagctaaattgtaaaaaaaaaaggacaaaaggtcgaaaatggacagaaaagaagagtaatttcaatgaatttgaactaaaaaaatggaaaagatatacctaaatttgtcctatttatactttttgtaaacgactgacaaatttatgaaattttctgcgtatttaagcggtgctttcccccacccaaatcatgcattcactcccattgtttcccaatcggtcgaatctttttcctgctttacaataaaatacctaatttctgtcagttttttttaatgtggggataagtgcctaattttcttcttaattgattcatcaaatttctcctgacagcgattaaatcaatgaaactagagtagagcgggaccgggaccaaaacacggacaactgagtaccgaggtcccggttttgaccgggactagtcccggttttttcccggttttcccagccaaaaagtcccggtttttcaaccagaaaaggtcccggtcccgggtttgcccaaaattcccggtcccgctctactctaaatgaaacaacaaaatatttcaaaaaaaaggacaaaaagtcgaaattgtacagaagagaaaagtga

SEQ ID NO: 21045 - DNA, 3289 bp, Heterodera glycines
ttaaacaaatttaaaaaataatgggcattttaaaattcccttcctagaatatttattaaactcaaaaatttgtgtagatttgttgcctcgtctgcgtggtgctgggcgtttggctcatttttgaccgttacgcggtggacaatttggccaccgcaattggccacgtggtcaaaggccatgaaaacgacgagggactcagcgaattggtggcactcggaattcttttgtttatttatatttgttcatttcgttaaatacaaatttatttctttgctaattcaaataaaacccatttatattttgcaattgaattttaattttacaatttaaggcatcaaagcccaccgccgtccgtcagattggctatttgcttttgtttggcggcatcgccgtcattgtggtcgcttctttgggctgttgcggcgctgctaaagagtggcgtccgctgctttgctgtgtaagcaaaaacaaaatataatttaaatacaaaatttaataaaataaaataaatatttattacataattaaataaataaattcataaaattttatttttgattttaaaagtttcgttatttgttttactttaaaatattatccaaatgttttaaaatattttttataatgtatatattttaattaaatatattgttttatttgattaatattattattattattattcacttttcttcttcagtatgcaagttgtctgatggttattttggcggtcgaaattgcggcgggaatttacgcagcgatggttggtggcatcttttggttcaacaaattaacaaaaacaaattaattgtcagcactcgcacatgttcgacaaagacttccgccaaattttacgcgcttcattgcgcatgtaaatttattttaatttaattttgtttatttataaattctttttttaaatgcttttccatttttaggtacaatgggacagagaatggcgtggagggcagcgactcaatgctggtcaaaacggcatgggacaagcttatgcaagaggtcgaggagcagggataaagcacattgaaaagtgaatgttttttgaaattcagaagagttgttgcggcgtcgactcgcgggtcggcgaatttcagcagagcgggtggtatcaggtcacacttttggtcccataattcagccgtttgatcgataagcaatgatttttttttgacaaatgccacacacaaaattgaaaaataaatatttttaaaattaattggcttttaatttcgtagcataactagccactagccaagaaaaaaattaaattttttacagcagagtccgtataaaatgacttggcaaaatttgagaattgattgggctaaacctccgtgaatttgaaaaattatgcaaaactcggccaaaattgaggacaaaaggcaatttttgatcacagatgaccaaaggccgtcacgaatttccgcctgcgtgttgtccaccgaaaaagaatggcaaattggcaccaagttgcccaacagtgttcagatttggcgaggtgaaatcagtaaaattattagcaaaatatggaataaatataaaagtaaattcaaaaattatttaataaattttaaattaaaactaaatttttgcttagcttttgtttaattattattatttatgctatttgcttttattttttgccattttgtaaatttatgccaatttgtgaatgcttttgaagggctgttacatcaaaatcagagagtccatccgcgaactgagcatccaattcaaattggtcatgtggacggccattgtcatttcacttattcaggcaaaatgatatgtatttacatgtcaaaatcaccaattattgaactttttgtttaattaattgcttatgtttcgcttgtgaaggtgttcggcataattgtggctttttgtctgtgcaatgccatcggttcggaggaggcggcctattgacaacaacaacaaaaaaatagaaaatgcatctgtgctcattcattttatgctgccctttttcccattcgttcgttctttgccttttgtctaaattttacattttgtgaataaaatttcgatttgttttgatttttttttttgttgtgaattcgggaggaatgcttcgacttttctctccttttttctgccagttttaccaggtttttttttcgaaaaaaagcaacatttggttattgatgtgggccgaaaatgaactcagctacccattggcattacctaaaacccgtccaaacgagggggggggggaaggtcgaaacaaaagaaattaggtccagactttttcaaatgtcgaactttagccctatcatttgtttgttagtggaacagaaaattttacttttacttgcaaaaatataaatatttattaatatttttttttgcgttttaagggttgccatgaccatctgtattatgagcattatgttcgcattgcttttgccatttcttttctgattctggtcggcattgtcgaggtgaaaaagtgaaaattaatttccaattttttttgattttccaccatttttaaactcctcccccatttgccatttgttcagctgttttgcgttctgttcacccacaaattgcacttccgtctgggggacattgaccaccaattgtacatcagctgatgaatgccaattacccataatacgtttttgaccaaaacattgacataaattaagcgaccgaaaaaaatcatttaaaaattatcagtgatgattaataatgacgagggaaagacaaatacataattctcacctttttattttttgaaaattttctatcaaaattggaaaaatcataattaacattcattttgcccaatttgaacccctcaaaaaatttttcaaacttatttttacggcaaatgatcgggccggacattgttaaatcaaaataaaatctttacctttaatttagaaaagaaaaaactaaaaaataatttcaaaatttgactaatcacaacaatattcgaatcaattattttcacattttttaaataaaattgataaaattaaatatactttaaattttaaagttttcatataattccttattggacaacggtatttattgctgaacaccacagaacgttttgttgcggcgttatcgacaggcttattcggggaaaaattcggaaatctgactcaaaattactgctaaatttttgaaagtttaagaaaaaatttaagtctcggtttcgagtaatccttagtttatgaagtctcgaggctcggcggtcaaataattttttttctgccggaaagaatttattaaaattaat

SEQ ID NO: 21046 - DNA, 3281 bp, Heterodera glycines
  misc_feature (2988)..(2988): n is a, c, g, or t
ccacagcaatttgagctcccacagctattttcgatcacctatcacaagcagtaaatcccgtttcttttcttttttacagtccctattttgtcttatttttggattacacacattatggcacgctatcgccaacggggccatcatcgtccgtccgaaaagcagcagcaaaatcacggcaacatttttgacaaagatggcgccaacacttcacatttccatcactcaatgcaacaacaattccacgatgatgaaaatggcttggaattatttgccactacggtaaaaagctcaattttttgtttaaaaatggtatttcagcggtaacggatcactattttattaattttaatgaaattaataaacgtaaagtattgattttttgaaacttgtcaataaatttaaatcaaaatgtgagaataaaaatttatgcttttagtccaagtcaattataaaattcatacaggtcaatacaccaatacattaatcctattcttctttgactcctgctttcttcattagcaggccgatgttcttctccaacatgtccaggcgacccccaatgtgtccgatattcttctctaacgtgccgatgtttttctccactccgtccaccttgtaagccaacattgcgagctcgacccccacacctccgagcgccaccaggccagatgacgccagctccctgcagcatgcgcaaagttgtgttggcgaaatttgcggctttgtcgatgatgagcaagtgttccttggtcatttcagtgaccttttcggcgacgttgagtttaagatgcggtggcaaagtgtcgtgacgagcagcgaagagaagccagaatcatagtcgcgtcttaaaagataaatcgagcaaatttatacaaagaagttaagaattaatgaaaaggcattcgaaaataattggaaagggacttttcccttaaatgagggagaaatggggggaaacgaaattatctacttatatatttcaaatattaaagctttttgattatcatgtgtgtgtattagggttgagcagtactggtacctgtaccggccggtaattacagggtttttttggtaccggtaccggttttttcaaaaatcaaagtaccggtaccggtttgtctagtaccggtaccgccggtaaaaatttgcactggtaagatttgtgagaacttaaatctttaaattgattttttattttaatttattagaatttttgatttcatattaaacggtaaaaaaattgaaatttttaaggagtttttattttaatttaaaattttattctgtaaaataaaaatttggaacttttaggttttagtttttttaattaattttattgtctgtcatttgaaataaaatattctaatttttttttttcattttaaacagcctagaaatcgaaaaagtaaccaaagatttggtcatttttttgtaaaaaacaacgtgaaaactgaataaaaattttgtatttgaaaaattttgtccaaaaatttttacgttggaaaattaccggtttttaccggtaccggtggaaaaatttggtaccggtaccggtttttgcattaccggtcagtaccggtaccggtggaaaaagttggtactggtaccggtttttgcattaccggtcagtagcggtaccggtggaaaaagttggtaccggtaccggtttttgcattaccggtcagtaccgtaccggttttttaaaaattaccgctcaactaaagtgtgtacacatgaatagaataaacaaaaaagaactacaaattttttgtgtctgtcgccaattttctcattggcgacgagaaggcgggtgccaacccgccacggcgtgcgcgagtgctcgcgttcaaccagggcacggacgggcagcgaatcgggaaagaacttgacacagacgaggaggaccgttacggggagtccgttttctcgggaccaagcacgagcacatgggccggaccgtcaaagacgaagaaataccggaagaaaaagagcaaaaaggcgacgagacgttcgggcggattcccgattcatcaattcctaaatcgctgattttgatcacgttcctctccatttaatcgtaccagccattatcatttcacctattttttgtcccattttcacttctttacaaattcatttctcatcggctggctaatctccggcccaagctttgtgcaaaacaattttgcacaaagttctttcttttcaatttctttaacttttcacatctgccaatttacattttatttttatgcgccatttctttgttcacacttttcacatcacaatttcggcccattttttgtcccatttttctcatcgcattatcgggccgtctgtcactccgcccattttgtcgaatgtctatttaagcggccctgcccaaggggtcgctctcttcgcttccttcacccccaaccattctttttattcgttttgctggacttttcgatcaattttttcaccatttacgcatttttaattcgtcgatcgcttctttaataaattttgtgtcggaatcgaagtctcgaattcgttttcgggggacacggtaaggagggaaaaagaccctcctcactccatcacattcgcctacgtcttttccctcaaccctcccggatcccaaattcccctcccatcagccactgggaaaaaattcgggagtgacccgaagtagcgccaaattcgagcagttcagtctcccaccagtaggagcagcggaagagacggggagaactcccgtcgtcgtcaagtccaagcagggcagtgaaggaaggaagagccgagcggtgccaaatcgtccgacgaaaggacagggccgttcgtcagcgtaactcccaccagccggagtgcccgccgcagggaacgggagtcgaaacccttggtcgtcgagtcaaaggggtccgacaagcccttccccaaaccttgtcggtggtgccgttaagcaagcagcgatttgctgcacaattctctcaagcaccagtccanactttgtcacccctcccccctcccattctcgtccccctttggcgctgatcggatcggtcagcagcatcagacccatcaaaacgaacggcaaaaagggcgccattccctttacggcacagcgagcggagtgagcagaaagagaagggacgagagcggtgaagaggagcgggaaccatcccgcctcagcttggcccacccccacccccaagcgcgcggcggaaataaaaagattggcgacagtgtcttcacaaacaaaaaattgtgatgaaaaaatcaatcaaatatatttaaat

SEQ ID NO: 21047 - DNA, 1014 bp, Heterodera glycines
ttctgatttatcagaaatgttctgatttgaagggtccaaatctgataaaataaaaatgttctgatttgtcagaaatgttctgattttggggtagcgaccaaaatttgttctgatttcttaaataaacttacaattttgaaattttatggcttaatgtcactattttacaaaaaaaatataaaatttatggcaaaatccaaataatgccgttttggtaaagggtatagaccagggatggcattccgaggcccaaaaaatttcggaaatcgtaatttcggtggccaaaaatttttttggaagtcgtacaccggaaatttttcaaacaatataaaatgcaaaaagtatttctgtttatgcgctagatcagaattcacatactcaaaattagtaaattttattttttactcagtcagcgcctcaaattacccttaaaattgctttaattttggggtttccctcttttttgtgggaccaaatgatcttggcgattgccaaagccatttaaggtataactcgtcgaacaatcaataaactcagcaatttgcacactaatcattttatctaaatttttacagaaattattgtaaatttaaaatttacagaaaaacacaaacatatatattctgtaggtggtaaaaaaggtattataagtttaggcaaaataaaattcacatcgatttaaaattaatttcatcaaattctttcgctctaaaaactgttggattattcgcgcttcttgaggtattccagagaaaatggcataatgttgaaatggtcacaaagctggcgaatcttcaaaaagcacaaaatttaatagatattaatttactaaatttggggtgtaatagtaaaaaagaaaatttgtttaaattgggttttttagttaatgggaaggggaggaaattacgttgaaatagtcccgctcaaaaattgatggggatatattttataaaatttgaatgctgcaattgaattaggtagtcgagctctcaatcatcctccactccaaccatt

SEQ ID NO: 21048 - DNA, 1404 bp, Heterodera glycines
tttttttcttgaaaaacttctaagttagtaaatttaaaaaaaaaatttttttctcgagggggaaacgatgcgggggggggggggggggaaatgagctgctcccctccggaacaatgcttgctgattccgtgacacattttgttgttgttgttgtcgttgaactgaccacacaaatgccgtaatggagatggacaacggtgaagaggagggcggcggcacggagcacgcacaattcggtgaccaaagatgggacggagacggcggaggaaaggcacagggccaccaccgccacgtacagggacgccaacgcgttgaaaatgggcgcccgcgagttggacatttgggcgatgatcagatggacctgtgacaacaatgatgagaatgggggaaaacaatttgtgaaattttccattttttaaaaaacgtaaaaaatttttcataaaaatttaaagaatgatataacaaatttttgtttttaaactaaattaatttgtttaaattgataatttttgttattgggtgatgaccatgatcgggtggaacgagtgcaagacgttccttctttcttcctcccccaaaaaattttaaaaaaagcgaatttttttaatttttcaaaatttcaaaattcctaaaagcttttctctaataaatttagttttggttttaattttttttcgttgaaaatgtaaaaaaacgataaaagaaattcgttttgaaaatttgaaaattcaaaacaaaatttcaattatttttggttttcttttttaaaatttataaaaaaacattactataatttttccaatcttaaaaggtcgtaaatttcccaaactaaaaagttgtccgattattttttttttttttttggagttttttggtcgtttttttgtttggaaaagacatttaatttgtggcccaaaagtatcatccgacacggagcgcaaacccaccgcaatgttggagaacacaacgccaacagtccaaaagaacgcgtgcgggtcgcgctccaacactttggcgggcgaacggacggcccacacaaacgcggcaccgaacagcacaagcggagagagcagcgggggcaccaacgcctcgtagaaggaatgctttaaaaaaaaacaatgacggagggggggggaatggcacacagaaaaatgaggacccgggtttttggtgccaaaatgttaaaaataaagccccctccccacaaaaaaaaatgggagcataaaaatttttactaaatttttttaatttttagtgcttttttttgttgaaaaacttgggggttttaaagtttttcttcgaaaattatgaaaagaaagataaaacaatttcaggggtaagaaattcttttaaaaattttaataaattttttaagaaaccgaaaccctttaataaatctataaa
